United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 29

SEQ ID NO: 119431 - protein, 416 aa, Glycine max
  Coding DNA Sequence Number=SeqID_2653
  Gene Ontology: Mol. function=inositol or phosphatidylinositol phosphatase activity; Cellular component=cytoplasm; Biological process=carbohydrate metabolic process
  Homolog annotation: Hit_ID=Q5GZA6; Match level="QueryCoverage=54%, HitCoverage=79%, E-value=1e-101, Identity=79%"; Hit description =Extragenic supressor protein SuhB
  Pfam annotation: Domain name=Inositol_P; Domain location=1-230; Score= 206.2; E_value=7.4e-59; Accession=PF00459.15; Description=Inositol monophosphatase family
MDYASEVDADAEKVIVKELKRAYPDYGIFGEEGGVQGERRQMWVIDPLDGTSNYLRGVPHYCVSIALVENGEPTDAVIFDPLRNELFTASRGAGAVLNDRRIRVADRKDLEGTMIHTGFAPRERSRASAQLKAVDALLVHGEDIRRTGSAALDLAYVACGRADAYFEAGVKAWDIAAGLLLVREAGGKVCDFKGATLGRMDNRGPETHQIVAGNLKVAESLQKVLVNTAIHGDGTCEGAVFVSAVIVLVTFFARKEGNQRNAPPAASRRAAHAGALRSSARRGTVRELAALRHPHLFALAGPAVLGSLEGGLEAVAFDLGSALSEPSIAGESGAKGRRCLSEASSAPPPDSPRSAGYRRVATARAPAACFFGYFLCTSKETDTSPQARKRSARHDPASAMHPHKQKRPARGQAFLH

SEQ ID NO: 119432 - protein, 122 aa, Glycine max
  Coding DNA Sequence Number=SeqID_2654
  Subcellular localization annotation: CTP_CleavageSite=32; ConfidenceScore=5.10e-01
MVILRPLSFSSSKSSDKRAEINYGHSAPLSFRSNKLWSFRTPFRHPEAIVSDGAQRQIMVICAFPSSPDRVRWHAETNYGHSVPCVNKEERIRQYQDDVGRSVLIIFKIFAGSTGGEIYRPN

SEQ ID NO: 119433 - protein, 92 aa, Glycine max
  Coding DNA Sequence Number=SeqID_2655
MALGMSEGREKQKVIPDHVIHYIFTSMPIETYVKLADDNLKIWTLHWGSSMVAYCQLGQGRKYFIRLFPINKNDVVKFIRVVVNKLDVAWIS

SEQ ID NO: 119434 - protein, 70 aa, Glycine max
  Coding DNA Sequence Number=SeqID_2656
MFCHGNLYRGSCHPRSSYCGGYCSDYRSGSVVIIVEVRGYCSSYRSWSAVIIVGLRLLYIFDRPLNIKRH

SEQ ID NO: 119435 - protein, 43 aa, Glycine max
  Coding DNA Sequence Number=SeqID_2657
MAAVPQIPSNGPFCICQNLVMETQRAWLNKKAWFFWDFKNLGL

SEQ ID NO: 119436 - protein, 37 aa, Glycine max
  Coding DNA Sequence Number=SeqID_2658
MERVVWVPCSGSLDCSEVGHGGLKTIHTGGGKFGVHH

SEQ ID NO: 119437 - protein, 291 aa, Glycine max
  Coding DNA Sequence Number=SeqID_2659
MASRKRKATTSVSHAGYDKSRLVSQEAWDRYSDNVLARNILPERNVKLYITEFDDFRRELIRRNWHRQQTNLAEGSIDVAIVKEFYANLFVHDDTSPKQVRVRGHLIKFDVDSLNTFFETSMVVEQGESLPSYSRGFVLNVEGLPWKLLRKDLTTLAQTWSVLSYSNLALTSHTSDLNLDRAKLVYGLVMKMNMNLGSLISGTQKSKARRSEAPSTFAPPASTPSTSALPSPPAAPVFPSPSAQSLESLMSMLQSLHQGQLLIMQSLQDVAQQRPVMSLEKFVEKVAWPGV

SEQ ID NO: 119438 - protein, 167 aa, Glycine max
  Coding DNA Sequence Number=SeqID_2660
  Gene Ontology: Mol. function=cytokinin dehydrogenase activity; Cellular component=endoplasmic reticulum; Biological process =electron transport
  Homolog annotation: Hit_ID=Q9FUJ3; Match level="QueryCoverage=92%, HitCoverage=33%, E-value=8e-34, Identity=42%"; Hit description =Cytokinin dehydrogenase 2 precursor
  Pfam annotation: Domain name=Cytokin-bind; Domain location=12-167; Score=11.8; E_value=1.6e-14; Accession=PF09265.1; Description =Cytokinin dehydrogenase 1, FAD and cyto
MIENIVLTRRYVKWLHLLYNNFTAFSGDQEHLISFSERNEIIAADYVEASDQQRITTLVTQYGIVYILELVKYYDNNSQAHINEDLVNLVKGLNFVPTFMLEKDASYEEFLNRVHVAELVLRPKGLSKIPHPWLNIWVPRSRISYFNDGVFKDIILKQNIAVGISLV

SEQ ID NO: 119439 - protein, 98 aa, Glycine max
  Coding DNA Sequence Number=SeqID_2661
  Subcellular localization annotation: CTP_CleavageSite=67; ConfidenceScore=5.45e-01
MASNLAFSIAIAVVWLSSILVFTQAQFQFQPQPIMTPLAVFEPSSVSDISSLIKFSNSLATPFTIARDAVVLNITNLNDFRNGLGILVADCDHDGKSS

SEQ ID NO: 119440 - protein, 204 aa, Glycine max
  Coding DNA Sequence Number=SeqID_2662
MECPFLLQPHPHLSHVRSEYGQGEISQMAQSNSSRLGFPALITTLCIARGVVLDSLTFESLSPAINLAYIRKNCWNSDDPMITFMGTRKARARVPTDASTPPALTPVPAPSSPSTQSTDILVSMLQSLHHGLCLVMQSIHDLAQHRPIMSMEDFIAQVAWPGVHPSPLGEELLGSLAHSNTEYISASPYAPSSPQDKPTPAQES

SEQ ID NO: 119441 - protein, 614 aa, Glycine max
  Coding DNA Sequence Number=SeqID_2663
  Gene Ontology: Mol. function=protein binding; Cellular component =membrane; Biological process=defense response
  Homolog annotation: Hit_ID=Q1SW19; Match level="QueryCoverage=99%, HitCoverage=64%, E-value=1e-129, Identity=42%"; Hit description =Disease resistance protein
  Pfam annotation: Domain name=NB-ARC; Domain location=157-470; Score =284.8; E_value=1.7e-82; Accession=PF00931.13; Description=NB-ARC domain
MEKLQEIAASLAVDYLLPPLMKAVTSVMEVPKDVAEMKDKLDGIQAIIHDVDKMAEAEEGNSHDGLKAKVKQLVETSFRMEDIVDEYTIHEEKQLGDDPGCAALPCKAIDFVKTTASLLQFAYMNEDVKSEFCTINERNGNEDSSPMKSFGGNQNITFDNLRMAPLYLKEAEVVGFDGPRDTLEKWLKEGRKKRTVISVVGMGGLGKTTLAKKVFDKVRTHFTLHAWITVSQSYTIEGLLRDMLLKFVEEEKRVDHSQNDYSTMDKKSLIDQVRNQLRHKRYVVVFDDVWNNCFWQQMEFALIDNENGSRILITTRNQDVVNSCKRSAVIQVHELQPLTLEKSLELFYTKAFGSEFDGHCPSNLKDISTEIVKKCQGLPLAIVVIGGLLFDEKKEILKWQRFYQNLSSELGKNPSLSPVKKILNFSYHDLPYNLKPCFLYFGIYPEDYEVERGRLIPQWIAEGFVKSEATKTLVEVAEKYLNELIKRSLVQVSSFTKVGKIKGCRVHDLLHEIIREKNEDLRFCHSASDRENLPRRGMIRRLTIASGSNNLMGSVVNSNIRSLHVFSDEELSESSVKRMPTKYRLLRVLHFEGDSLYNYVPLTENFQDLSLLTY

SEQ ID NO: 119442 - protein, 76 aa, Glycine max
  Coding DNA Sequence Number=SeqID_2664
  Subcellular localization annotation: CTP_CleavageSite=31; ConfidenceScore=5.11e-01
MAKKASLLALFFNSSSSFRQLQCFKGYLDVSASEGSLSEIGSLSERFPNTLSELHASLSGCHSLSAYASLSETSTA

SEQ ID NO: 119443 - protein, 906 aa, Glycine max
  Coding DNA Sequence Number=SeqID_2665
  Gene Ontology: Mol. function=protein binding; Cellular component =membrane; Biological process=defense response
  Homolog annotation: Hit_ID=Q1SW19; Match level="QueryCoverage=99%, HitCoverage=95%, E-value=0.0, Identity=41%"; Hit description=Disease resistance protein
  Pfam annotation: Domain name=LRR_1; Domain location=617-638; Score =6.6; E_value=16; Accession=PF00560.23; Description=Leucine Rich Repeat
  Pfam annotation: Domain name=LRR_1; Domain location=640-661; Score =8.8; E_value=6.6; Accession=PF00560.23; Description=Leucine Rich Repeat
  Pfam annotation: Domain name=LRR_1; Domain location=782-804; Score =7.8; E_value=9.8; Accession=PF00560.23; Description=Leucine Rich Repeat
  Pfam annotation: Domain name=LRR_1; Domain location=855-877; Score =2.3; E_value=1e+02; Accession=PF00560.23; Description=Leucine Rich Repeat
  Pfam annotation: Domain name=NB-ARC; Domain location=157-476; Score =262.2; E_value=1.1e-75; Accession=PF00931.13; Description=NB-ARC domain
  Pfam module annotation: Pfam domain module=LRR_1::LRR_1::LRR_1::LRR _1::NB-ARC; Domain location=617-638::640-661::782-804::855-877::157 -476
MDKLKEIAASLAVDYLLPPLKKAVNSVMEVPKDVADMKDKLDGIQAIIHDADKMAAAEDSKSRDEIKAKVKQLVETSFRMEDIIDEYTIHEEKQLGDDPGCAALPCKAIDFVKTTASRLQFAYMNEDVKSEFGGIKERNGSEDSSQIQSSGGNQNVPFDNLRMAPLYLKEAEVVGFDGPRDTLEKWLKEGQEKRTVISVVGMGGLGKTTLAKKVFDQVRTHFTLHAWITVSQSYTIEGLLRNMLLKFVEEEKRVVEHSQSVPTMDQINKMDKWSLTDEVRNHLRHKRYVVVFDDVWNTLFWQEMEFALIDDENGSRILMTTRNQDVVNSCKRSAVIQVHELQPLTLEKSLELFYTKAFGSDFNGRCPSNLKDISTEIVKKCQGLPLAIVVIGCLLFDEKREILKWQRFYQNLSCELGKNPSLSPVKRILGFSYHDLPYNLKPCFLYFGIYPEDYKVERGRLILQWIAEGFVKSEATKTLEEVAEKYLNELIQRSLVQVSSFTKGGQIKSCGVHDLVHEIIREKNEDLSFCHSASERENLSRSGMIRRLTIASGSNNLVGSVVNSNIRSLHVFSDEELSESSVKRMPTNYRLLRVLHFEGDSLYNYVPLTENFGDLSLLTYLSFRNSKIVNLPKSIDVLHNLETLDLRESHVLMMPREFYKLKKLRHLLGFRLPIEGSIGDLTSLETLCEVEANHDTEEVMKGLERLTQLRVLGLTLVPPHHKSSLCSLINKMQRLDKLYITTPLALFMRIDLQFDVCAPVLQKVRIVGGLKEFPNWVAKLQNLVTLSLRRTYLTVDPLPLLKELPYLSSLFINRSAYEGKVLQFPNRGFQNLKQILLGSLFILKSIVIEDGALPSLEKFKLVGIPELKEVPSGLYKLPKLEVFHAINMSDEFQENFNLNRGQGPGI

SEQ ID NO: 119444 - protein, 237 aa, Glycine max
  Coding DNA Sequence Number=SeqID_2666
  Gene Ontology: Mol. function=protein binding; Cellular component =membrane; Biological process=defense response
  Homolog annotation: Hit_ID=Q1SW19; Match level="QueryCoverage=98%, HitCoverage=24%, E-value=4e-32, Identity=35%"; Hit description =Disease resistance protein
MEGGIGVLTSLQTLRDMDADHDAEEVMKELERLTQLRVLGLTNVREEFTSSLCSLINKLQHLEKLYINAKYILGVNDLQFDVCAPVLQKVRIVGGLKEFPNWVAKLQNLVTLSLLHTRLTVDPLPLLKDLPNLSSLCLLKFSYIGEILQFPNRGFQNLNQILLNRLIGLKSIVIEDGALPSLEKLKLVDIPRLKKVPSGLSKLPKLEVFHVIDMSDEFKENFHLNRGQRQWRIGHGI

SEQ ID NO: 119445 - protein, 153 aa, Glycine max
  Coding DNA Sequence Number=SeqID_2667
MYSTLSFTPPSVHNGVKVAKLKPDLVAKEADRWKNALLGCVYGLEPRFKKIERFALNRWKDQGMLSVHMIKENLFLFLFDSEDSKLQVLEGGPVSFDRRPLIFKEWGERMEMKIDASFKTPIWINLPLFPWELWGVDSPSAIASKSFGHTSIY

SEQ ID NO: 119446 - protein, 240 aa, Glycine max
  Coding DNA Sequence Number=SeqID_2668
  Gene Ontology: Mol. function=DNA binding; Cellular component=nucleus; Biological process=regulation of transcription, DNA-dependent
  Homolog annotation: Hit_ID=Q70KC5; Match level="QueryCoverage=98%, HitCoverage=70%, E-value=1e-21, Identity=35%"; Hit description=MYB transcription factor
  Subcellular localization annotation: CTP_CleavageSite=67; ConfidenceScore=5.17e-01
WSQIAARLPGRTDNEIKNFWNSTLKKRLKMNNNNSTLSPNNSDSSGPKDVNVMGGIMSMNEHDLMTMCMDSSSSTSSSSCMQSMHATNMVLTNPFPLLPNNRYDMMTGATGFLDNMAAACLTQVGMVDHDHGVVHGTLEPNKTRLGSDFSLPPLESRSIEDNSSTPIDHVKSHNNNNHFKNSCFNNTDHYHHIQSSNNVVVEDLFGFGNHGQGENFRMGEWDLEGLMQDISYFPSLDFQV

SEQ ID NO: 119447 - protein, 437 aa, Glycine max
  Coding DNA Sequence Number=SeqID_2669
MNPNRDGIKGPLIVEPEANHGESVTPSNDAQIAPLQRLSFQMSILLKLAKVSDLLALLQPIRRLQDLHLNLHRFPRKAKHYLRWIIYLSKLLPVCHKPSWLTVDIIFNLRLLGLEQEWKKESCLYLLLQPVPPPDMKECPIIGGYVSSLACGSESRGSPDGRCRDACLSWGNPSLHSIIVFASIAPESADQRSEYQPLTARGGLVERPNAICLLLLFALVHLVYNAERLLIIPPTSDLMKGKTFKQDFLSLAPRRNVWTLPKVKKTKNRVYEQGPGPESFNGGGRNGSNLLVIHRLGTEWGISKSLVSQSGAAEFAKRFRVKNITYDLSPVSIRNLLNSHHLPGTVLLLNTYGIKRFSTLARLHFSFMPLSGKLLQFSNKWKKSSVSFKRRNASTDSLNLKLALRPVPYPVHSAILPIISKADFATSYRLLYERRPA

SEQ ID NO: 119448 - protein, 194 aa, Glycine max
  Coding DNA Sequence Number=SeqID_2670
MDLGNNLNRRLSMNGGLNLLFRKFKRKKRGVHRERHKSSRATITQEWRPKEEENVVIGDKLAVIEKVDKTNEELDSKKSESVKGKAIQQTPTMVKKPLVIITTEREQVRIQGEGSSPPVIGVNDRKLEYRSLEGNPSSKVFASFHSFLYSGRSVIERLCIEEITDALSALGGITAVGALCFSRGIIFCFRKNSE

SEQ ID NO: 119449 - protein, 112 aa, Glycine max
  Coding DNA Sequence Number=SeqID_2671
  Gene Ontology: Mol. function=DNA binding; Cellular component=nucleus; Biological process=regulation of transcription
  Homolog annotation: Hit_ID=Q2LME4; Match level="QueryCoverage=84%, HitCoverage=28%, E-value=9e-41, Identity=78%"; Hit description=MYB20
  Pfam annotation: Domain name=Myb_DNA-binding; Domain location=22-69; Score=41.3; E_value=3.3e-09; Accession=PF00249.21; Description=Myb -like DNA-binding domain
MRKPDMMGKDKINNNIKSKLRKGLWSPEEDEKLLRYMITKGQGCWSDIARNAGLQRCGKSCRLRWINYLRPDLKRGAFSPQEEEVIIHLHSILGNSLKACQGFCLNYHGLAF

SEQ ID NO: 119450 - protein, 94 aa, Glycine max
  Coding DNA Sequence Number=SeqID_2672
  Gene Ontology: Mol. function=nucleic acid binding
  Homolog annotation: Hit_ID=Q1RWN2; Match level="QueryCoverage=91%, HitCoverage=8%, E-value=8e-16, Identity=52%"; Hit description =Peptidase S8 and S53, subtilisin, kexin, sedolisin; Integrase, catalytic region; Zinc finger, CCHC-type
MITSEKFVQPSIPRFDGHYDFWSMIMENFLRSKELWQLVEDGIPMLGATPTEGQKRSVAEAQLKDLKKHVTSNLEIHATEISGINEGVEIATNF

SEQ ID NO: 119451 - protein, 101 aa, Glycine max
  Coding DNA Sequence Number=SeqID_2673
MTNANCPQESMHSVSNGNLRFDTAQTLVSRFLQVSSFFEDEGESPVESYETKVQTWSSQHYRNKPVVVVAAPRLQKYSSFDDHSGEKPLLLPIRSFKISLI

SEQ ID NO: 119452 - protein, 81 aa, Glycine max
  Coding DNA Sequence Number=SeqID_2674
MNKTEDEEDEDVGLSPELERIVAQEDQEMGPHQEETELVDLGTGSGKREVKIGTELRRSDFLIAIKEYVGAREIPSSTAKR

SEQ ID NO: 119453 - protein, 138 aa, Glycine max
  Coding DNA Sequence Number=SeqID_2675
  Gene Ontology: Mol. function=nucleic acid binding
  Homolog annotation: Hit_ID=Q1T6D0; Match level="QueryCoverage=85%, HitCoverage=23%, E-value=2e-27, Identity=47%"; Hit description=Zinc finger, CCHC-type; Lipocalin
MYFGVVGDGSKGPPDGRGGDKQRVLFKDMIMGNKEIAPPRQKVDLIWQKPATIVYKDDNRVKPMVHIVDFVFEVLCAPWEDALVAKLLGKCIGYNVMKDRLTCLWRLIVGFDILDIDNNFYMVKFDMEMDITKVMKEG

SEQ ID NO: 119454 - protein, 401 aa, Glycine max
  Coding DNA Sequence Number=SeqID_2676
  Gene Ontology: Mol. function=chromatin binding; Cellular component =chromatin; Biological process=chromatin assembly or disassembly
  Pfam annotation: Domain name=Chromo; Domain location=299-350; Score =25.2; E_value=0.00023; Accession=PF00385.14; Description='chromo' (CHRromatin Organisation MOdifier
  Pfam annotation: Domain name=rve; Domain location=88-248; Score=16.6; E_value=0.00025; Accession=PF00665.16; Description=Integrase core domain
  Pfam module annotation: Pfam domain module=Chromo::rve; Domain location=299-350::88-248
  Subcellular localization annotation: CTP_CleavageSite=29; ConfidenceScore=5.08e-01
MASPLTSMLCRNNFLWSSQAQLSFDNLKQAMTKAPVLTAPDFSLPFVVETDASDTPLGGHFRVTKTAHRIKANFTWDTLLSDVKAVTAIAHPFWHLGRFITGFRYPSTIIPYMVVVDRFSKGAHFGVVPRQFLAYKVANLFLDTVCKLHGFPQSLVSDREPLLINNFWRELFRISGTSFRMSTAYHPQSDGQTEATIKCYADAKRRHQDFQEEQWVYVKLQPFCQTTVSRTAHHKLTKRYFEPFEILELIGNVAYCLRLLANSHIHPVFHSSLLCPHYGPLVLDTNPLPPHVVHNHPILEPLVKLDSKFDSSTTLPTRMVLIQWQGFPPKEATWEKWSTVSDVLHLEDKVHLSRDVIDSNQGHNPSPLEELEVGVHQEEIPAQEGRPKRNNIRPGYLKDFV

SEQ ID NO: 119455 - protein, 385 aa, Glycine max
  Coding DNA Sequence Number=SeqID_2677
MAAILDDSGSILLPEIMWPRYSSWRWANKHLERLRKSLAFNRGITIDKDIIKEDDREFPQGALHKLNNITQYSQWPWRRDQGHPTIRRSLAWVNDHEQSQRLKHGEMALANTVEARFEEEVDVVGNLTWRGKGSWFEEDGGKLGNDDLDSRYGLGRFRRVGLWAIGNINMNGKEIAHMFKLHGEGGISVIPCVRGQEFIRSDAVPFGPTFMGRYLLLVDFSFQFLRSILLALAAAIGTPIRVDSTMLDVRRGSVCVKIDLDKPVIEKVWLEECCSGGGGTNGDAKGKQVVVASMRQDAGSTSSNIPIGNFNTNNGNINGEDKSITANDELHVPMQAISPNRFVVLQGNEDDQMQPMEIGKSTDQPMVGQQDMVLETSLGDHNATT

SEQ ID NO: 119456 - protein, 264 aa, Glycine max
  Coding DNA Sequence Number=SeqID_2678
  Gene Ontology: Mol. function=ferrochelatase activity; Biological process=heme biosynthetic process
  Homolog annotation: Hit_ID=Q8GRN0; Match level="QueryCoverage=98%, HitCoverage=98%, E-value=3e-16, Identity=33%"; Hit description =Expressed protein
  Pfam annotation: Domain name=DUF581; Domain location=175-233; Score =105.8; E_value=1.3e-28; Accession=PF04570.5; Description=Protein of unknown function (DUF581)
MLGKRPQPRIGKISELLVSGDCTTKLFDALGRSPRSPFDMMNLKMQSPKGLKSYDLGGVGLGIVVALDKKSSSEEQGHDVVPKHAVICTSNSNRSVPIPVKNHQGFQKGVNEIPVGSSEDYTFVTYHVPNNKTITKVYYDGGERGILTHGCYNINNNNNNNVGVGGVRRIPPTQTLNIEEDEPSYPTSDFLSSCHLCRKNLHGKDIYMYRGEKAFCSNECRSRQISMDDERKERCRSEASRSVEMSSSPYTARDQMFSTGIVAL

SEQ ID NO: 119457 - protein, 840 aa, Glycine max
  Coding DNA Sequence Number=SeqID_2679
  Subcellular localization annotation: CTP_CleavageSite=24; ConfidenceScore=5.50e-01
MTTSALEIPRPSFSTPPVPPSAVLASGSPSSSSHPNVSLDKIYSSRDVDSLWETEIAKWRATTQNVWRVEHPKVANAIVALVEVVSSNHRLLFKVGNVLVKLLRTRLDGDELLRRCKGLQREKNDLTDKVESTAIEKDELAKVVADLQAQLKESESRLEEFELRASKEREASKKLEEELLVYKKEVMEKHEKGFHKAVRQDVKDDVLLEEREIVVEEEDAGEEQGIGMTRDNLVFDFDLLKGLVTHLGDASFFFAKLFPLCLSDLTKGVPYIFLRVCTKGAPWVSCIPIEIKFKNMKACEGDAFVLGFGEANLGFVQPLEKRDSPRVYLGFDKPLEKRDSPRVDLGFYEPLEKRDSSRENLGADLGFDEPLEKQDSQRADLGFDEHAKMRPGMPSSWVLLGLTKDLRREKSTTPGLPACYDPEWAFPVGTKLSCSGIFSGFTLDSPYKGFKDDSVGCLRLTVGLGVFDRVYKAILAYEVFSGELLYLDGWNFFISIPYMAKGQGEIMLWMLSGGVHGTFANSWHFLHLLVKSKVSALSVGQLCLTNLSKGVVNPFLNSSPSRMTYLAFSSFPAMTSLVSMVGAWKVSWMMVLRSKGTSGFDRLKIGGVVIVFLKAKKACSQASSHGNGSVSGVACRMAFPSLQASGGTWTKMLYHRALVRVGFISPVNNHEAYKFSTANPKSAIFRIEAHVVLADLSKYLFQIYHVVGHAIRLDDHVVHIDFGIQEYLSSVHEPLECGSYLLQFEGHDPVTKIGVFGDEGGFFLIGRVHPNLVGVVSAHMPFAIGLFYHDNDFCYMFVLVANEVLAELSTLPSCFVDGQGPYWRFFAHAHDLTVATTKCG

SEQ ID NO: 119458 - protein, 152 aa, Glycine max
  Coding DNA Sequence Number=SeqID_2680
  Gene Ontology: Mol. function=RNA-directed DNA polymerase activity; Cellular component=intracellular; Biological process=RNA-dependent DNA replication
MSSSPSLERAFGSSCIQSTRPGCLELGTQMLHRLAYGFWAEGMYPWGSPCSDQCSQCTFAICHWPFDHDDVGEPGGISNFSYEVGFEKLVHYFLDRFVSFFYHVPLLLWLPSEQVPIELHTLPGFGFELQLDEFFDRLWASIKSVVVWIYIE

SEQ ID NO: 119459 - protein, 142 aa, Glycine max
  Coding DNA Sequence Number=SeqID_2681
  Gene Ontology: Mol. function=chromatin binding; Cellular component =chromatin; Biological process=chromatin assembly or disassembly
  Homolog annotation: Hit_ID=Q1SAV4; Match level="QueryCoverage=72%, HitCoverage=34%, E-value=3e-16, Identity=37%"; Hit description =Integrase, catalytic region
  Pfam annotation: Domain name=Chromo; Domain location=52-100; Score =8.6; E_value=0.094; Accession=PF00385.14; Description='chromo' (CHRromatin Organisation MOdifier
MAKLRPHRQLLAIGTSYLELAKCYYEPFQILERIGKVAYSSTAIDVDNKPVITPFAILNTNLNHSTAEPRLMVLMQWTGLHPNDTSWEEWANVKGTYHLGDKVLFDGLRDDRQRTMVQQDTRVGSERLKRKINPPKHLEDYV

SEQ ID NO: 119460 - protein, 361 aa, Glycine max
  Coding DNA Sequence Number=SeqID_2682
  Homolog annotation: Hit_ID=Q1T192; Match level="QueryCoverage=43%, HitCoverage=31%, E-value=3e-17, Identity=33%"; Hit description =Polynucleotidyl transferase, Ribonuclease H fold
MRELGTYSVERKLRVLVDRGCYGDVTALADNYRLVDKSQALRMTLLAASLSDCWSGDVQQSFELGAIVGDNGVREAILPYDVFLGELLYLISCDFSKWSCLDPLGPKGAQIVEIVRKRGHPIWFLFFSDHNFLSVYAGSLECLLDDSLEVFDLFGVAQLRKQVCFGVALPSTVSLVWYLLATCPWTSFEVELEGLLYSDIIRSFEDDSYPAPFHVGHTVNIEAPPVSSDQTLKVLRTMPPSSLLVHASQNLFDGVVRLDYHLMTLEIGPETSGRVLLGVMGYTDGEVDRELVLPFLLTGDVAMVFLKAKKASFGGTWIGILVYHLAYGLPGPQELASVDLESTFFRVEAHVLFAELFEDLF

SEQ ID NO: 119461 - protein, 69 aa, Glycine max
  Coding DNA Sequence Number=SeqID_2683
MALYPGATNLLAKYNGFEYQHFDGHNLDWAKSEDKAYGGRNQPPWWRSREIEGARSSKGPKVRVRRDLD

SEQ ID NO: 119462 - protein, 204 aa, Glycine max
  Coding DNA Sequence Number=SeqID_2684
  Homolog annotation: Hit_ID=Q9LIN9; Match level="QueryCoverage=60%, HitCoverage=17%, E-value=8e-18, Identity=41%"; Hit description =Similarity to the auxin-independent growth promoter
  Pfam annotation: Domain name=SRF-TF; Domain location=1-32; Score =22.5; E_value=0.0011; Accession=PF00319.9; Description=SRF-type transcription factor (DNA-binding and dimerisation domain)
MIKKAKELAILCATQVGLVIFSSTRKLYEYASTNFTKCIIAKCCSCIPFFFRGLCSFFTDDSRVLPHNSRISLAFTLLLLLVGLVSLFTIFNNLVSPHLFGCIFRFTTKSLMHCILLRLSNAPYLCKNDGIVLHCPYVKESPSLWENPFSSTTSWKPCAERQDGVLPGVIPSLFYSEENSGSRLPSAQSYCREKHSHSHQKPMP

SEQ ID NO: 119463 - protein, 135 aa, Glycine max
  Coding DNA Sequence Number=SeqID_2685
  Homolog annotation: Hit_ID=Q1SM20; Match level="QueryCoverage=78%, HitCoverage=27%, E-value=2e-17, Identity=38%"; Hit description =Nucleic acid-binding, OB-fold
MARIPNKIRSIDGSKETLKLAVRITDLWFVGTPNKSEQEEMIFVDSEGDQIHAICKSDHLKSWKADLKENCTYVMHNFKVVKNDGQFRVCEHEYKLFFIGVTVVREADLHELPFKLDLLNLQMSLLAILWLACWL

SEQ ID NO: 119464 - protein, 98 aa, Glycine max
  Coding DNA Sequence Number=SeqID_2686
MPLITIEENATYHFLFERTPQHEINHIVSYYAYFGFVWSDNPLQFSQQFFGYDGNGRPIRSTFHRDTTIEVNEDVGDFSDDGDLTLSEITFYQDVYGE

SEQ ID NO: 119465 - protein, 119 aa, Glycine max
  Coding DNA Sequence Number=SeqID_2687
MVVTTCPDVVVVEIESLKLNHMTQSKTLDSLISLEALLVAFDPCLVPPQHHVQDGDGLSFLCLVAPLLLSRVVVYVYEVVAREVATKTNATNNTIMYLGDILIELALTVLDNIGAENRA

SEQ ID NO: 119466 - protein, 75 aa, Glycine max
  Coding DNA Sequence Number=SeqID_2688
  Homolog annotation: Hit_ID=Q1S1I5; Match level="QueryCoverage=61%, HitCoverage=7%, E-value=4e-12, Identity=79%"; Hit description=SART-1 protein
MAKSDFGMLRSLAAIGLSYDADCGQVDIPIGFATVEKDLPGGLTPMLGDRKVEHFLGIKRKAEPSSSDTPKKPKS

SEQ ID NO: 119467 - protein, 742 aa, Glycine max
  Coding DNA Sequence Number=SeqID_2689
  Gene Ontology: Mol. function=protein binding; Cellular component =membrane; Biological process=defense response
  Homolog annotation: Hit_ID=Q1SW19; Match level="QueryCoverage=99%, HitCoverage=80%, E-value=1e-145, Identity=41%"; Hit description =Disease resistance protein
  Pfam annotation: Domain name=NB-ARC; Domain location=156-452; Score =209.6; E_value=6.9e-60; Accession=PF00931.13; Description=NB-ARC domain
MEKLQEIAASLAVDYLLPPLKKAVNSVMEVPKDVADMKDKLDGIQAIIHDVDKMAAAEEGKSRDEIKAKVKQLVKTSFRMEDIIDEYTIHEEKELGEDPGCAALPCKAIDFVKTTASLLQFAYMNEDVKSEFRRINERNGNEDTSQMKSFGGNQNTFDNLRMAPLYLKEAKVVGFDGPRDTLEKWLKEGRKKRTVISVVGMGELGKTTLAKKVFGKVRTHFTLHAWITVSQSYTIEGQLRDLLLKFVEEEKRVDHSQSDYSTMDKKSLIDQVRNRLRHKRYVVVFDDVWNNCFWQQMEFALIDNENGSTILITTRNQDVVNSCKRSAVIQVHELQPLTLEKSLELFYTKAFGSEFDGHYPSNLKDIYTEIVKKCHGLPLAIVRFYQNLSSELGKNPSLSPVKKILNFSYHDLPYNLKPCFLYFGIYPEDYEVERGRLIPQWIAEGFVKSEATKTLEEVAEKYLNELIQRSLVQVSSFTKGGKIKGCRVHDLLHEIIREKNEDLRFCHSASERENLPRSGMIRRLTIASGSNNLMGSVVNSSIRSLHVFSDEELSESLVKRMPTNYRLLRVLHFEGDSLYKYVPLTENFWDLSLLTYLSLKNSKIENLPKSIGLLHNLETLDLRQFVVRMMPREFYKLKKSRHLLAHDRLFGLFGGLQMEGGIGVLMSLQTLRDMDAEEVMKELERLTQLRVLGLTNVREEFTSSLCSLINKLQHLEKLYINAKYILGVNDLQFDVCAPVLQK

SEQ ID NO: 119468 - protein, 83 aa, Glycine max
  Coding DNA Sequence Number=SeqID_2690
  Gene Ontology: Mol. function=protein serine/threonine kinase activity; Cellular component=chloroplast; Biological process =regulation of photosynthesis, light reaction
  Homolog annotation: Hit_ID=Q9S713; Match level="QueryCoverage=84%, HitCoverage=13%, E-value=4e-11, Identity=52%"; Hit description =Serine/threonine-protein kinase SNT7, chloroplast precursor
MKHIVLTFYLNFILPWDIKPQNISLFEESHIFNIIDLGAATDLRVGINCIPKEFLLDPRSPYVVTHGPEDVTDAAVIAVTMPL

SEQ ID NO: 119469 - protein, 67 aa, Glycine max
  Coding DNA Sequence Number=SeqID_2691
  Gene Ontology: Mol. function=protein serine/threonine kinase activity; Cellular component=chloroplast; Biological process =regulation of photosynthesis, light reaction
  Homolog annotation: Hit_ID=Q9S713; Match level="QueryCoverage=86%, HitCoverage=10%, E-value=3e-19, Identity=77%"; Hit description =Serine/threonine-protein kinase SNT7, chloroplast precursor
MRHILFLFALDGLRSTGIVHRDIKSQNITLFEETRTFKIIDLEATTDLRVGINYIPKEFLLDPRYLR

SEQ ID NO: 119470 - protein, 105 aa, Glycine max
  Coding DNA Sequence Number=SeqID_2692
  Homolog annotation: Hit_ID=Q1SW19; Match level="QueryCoverage=81%, HitCoverage=9%, E-value=2e-15, Identity=51%"; Hit description =Disease resistance protein
FPNRGFQNLKQILLNRLISLKSIVIEDGALPSLEKLKLVDIPRLKKVPSGLSKLPKLEVFHVIDMSDEFKENFHLNRGQHQWRIGHGILVSWTSNSPCGLSQQWH

SEQ ID NO: 119471 - protein, 488 aa, Glycine max
  Coding DNA Sequence Number=SeqID_2693
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=97%, HitCoverage=63%, E-value=0.0, Identity=48%"; Hit description =Multidrug resistance-associated protein 3
  Pfam annotation: Domain name=ABC_tran; Domain location=174-340; Score= 92.0; E_value=1.8e-24; Accession=PF00005.17; Description=ABC transporter
  Pfam annotation: Domain name=MMR_HSR1; Domain location=175-252; Score= -12.4; E_value=0.014; Accession=PF01926.13; Description=GTPase of unknown function
  Pfam annotation: Domain name=Miro; Domain location=176-288; Score= -12.5; E_value=0.09; Accession=PF08477.3; Description=Miro-like protein
  Pfam module annotation: Pfam domain module=ABC_tran::MMR_HSR1::Miro; Domain location=174-340::175-252::176-288
MEFKDKRMKATSEILNSIRILKLQAWEMKFLSKIIQLRKTEETWLKKFLVGTAIVRFLFYNAPTFIAVDTFGACALIGIPLESGKVLSALATFRILQMPIYSFPDTISMIAQTKVSLERIASFLRLDEWKTDVVEKLPQGSSDKAIELVDGNFSWDLSSPYPTLKNVNLTVFHGMRVAVCGNVGSGKSSLLSCIIGEVPKISGTLKICGTKAYVSESPWIQSGKIEDNILFGKEMDREKYDEVLEACSLTKDLEVLPFGDQTTIEEKGINLSGGQKQRVQIARALYQDSDIYLYDDPFSALDAHTGSHLFKVMREGRITQSGKYNDILRSGTDFMELVDDIVKPKGQLVQEEEREKGRVGFNVYWKYITTAYGGALVPIILLSTILTVAFQIASNYWMILATPISATAEPDIGSFKPMVVYVALSIGSSIFTFAKAFLAVIAGYKTTTVIFNKMHLCIFRAPISYFDATPSGRILNRVCHTMLTIFMV

SEQ ID NO: 119472 - protein, 73 aa, Glycine max
  Coding DNA Sequence Number=SeqID_2694
MIVVNVVGIQRHLKQCRCLARRRASILTDVDALFCSSASDGSSKGGGYLSTEDSQGSAETIFLEEGFLDFLNK

SEQ ID NO: 119473 - protein, 429 aa, Glycine max
  Coding DNA Sequence Number=SeqID_2695
  Homolog annotation: Hit_ID=Q5F4K8; Match level="QueryCoverage=19%, HitCoverage=14%, E-value=6e-09, Identity=49%"; Hit description =Aspartate aminotransferase
  Subcellular localization annotation: CTP_CleavageSite=54; ConfidenceScore=5.59e-01
MAVFPGCHTSSSSPFHTATHSHPFPQHPSPSLPHNPSWSAMLPFTVHGCHSPYKASMAAYNHQHYSSSATEDRLEVALAKLTLSQHKLAVSIDTLATTIDNLLHRLPCNSTPHFSSSFLPPPPPPQTPPPPPLLKPTPSPTCTASITIPPPPATTPPPPPPPATTPPPPPVPPVVPIQPRPTTWPDPLPRPVLHLSDHIRPTMPFTKLFSRVPPHGTAMAVYTLPAMAVAFCTTAKLCAIPRNKPWDPGSKGLAGSKKHETHAAGIIVKEDIIVLSRRYVDELSAFDIGKYNNKFSLSLSLPLLLWRFLALEARWFTFSSLVPNTKFVVIRIYTTTKSTYHHIPTDQPLKVHSQLEFYSTFLVKMQSLENLYKTAIEIFKGSIIEKNKCRHHGCMSVPEAWGALLQFGLSLQVISSTRHILWGYTVNKE

SEQ ID NO: 119474 - protein, 303 aa, Glycine max
  Coding DNA Sequence Number=SeqID_2696
  Homolog annotation: Hit_ID=Q6TAS3; Match level="QueryCoverage=19%, HitCoverage=6%, E-value=2e-07, Identity=47%"; Hit description =Aminodeoxychorismate synthase/glutamine amidotransferase
MKHLEMFNMVSTPHATTGSKYLKLKWRKFGHLAGQVGGAKSLFCRLFGHEAENTFWLGSSSTEKRLCLVGRGIFELIYDGVLVETVVDLVTYKDGVTYPPFVCRPPNVVFDPPPPRCRSRAPLTATCNCSSRPALASSVGCTSRDRCQYGFCVSHCMCSLNLSMDFVSLHPTLKIAEETTTAVGYVVERLYTEREHAAAPYFRIKRVEIEDQLYDMTSPLTQTLNQLSMSEILRKPINRKSHGARVTLACHKIPKSLSDKPDMLAAWQPASQSLLTVVEHEPNNDSLTLSHDVVLMNTMTALG

SEQ ID NO: 119475 - protein, 158 aa, Glycine max
  Coding DNA Sequence Number=SeqID_2697
  Gene Ontology: Mol. function=helicase activity
  Homolog annotation: Hit_ID=Q2R0W4; Match level="QueryCoverage=97%, HitCoverage=10%, E-value=5e-19, Identity=30%"; Hit description=AT hook motif-containing protein, putative
MMFTTCKGATSFEDIRTVENVLYPTYREACFTMGFLQDDREFVEAIKEDKDWGVITKPEEVWSQTWNWLAEDIAYHYKKTTLNTELHIDDEQLKNLTLLEIEKLLLANEKSLRDYPTMSYPKGANPASCLENSLILSELNYNNDEARSEFENLFLSMT

SEQ ID NO: 119476 - protein, 58 aa, Glycine max
  Coding DNA Sequence Number=SeqID_2698
MYRDAILPRKGPVTRAMNKSLQEDWTRVAKEGPRVLMNLRVYRVPYKLRIGYPSSIEF

SEQ ID NO: 119477 - protein, 80 aa, Glycine max
  Coding DNA Sequence Number=SeqID_2699
  Gene Ontology: Mol. function=transferase activity
MAKNEKSGIRSKHIDIKYLAIRERVKDKKTVIKNINIELMIADPLTKGMPTFKFKDHRETESLKEPKQGSSFMAMAGGTF

SEQ ID NO: 119478 - protein, 66 aa, Glycine max
  Coding DNA Sequence Number=SeqID_2700
MVVEDDNVDLAVSGNIKGTGVGDITVVSKSLFSTNDVSASDTIVFVEEVKRSVLVVTGRPKIKLTS

SEQ ID NO: 119479 - protein, 90 aa, Glycine max
  Coding DNA Sequence Number=SeqID_2701
MDLDGMTPEIVSLHPKVDNHVYKEFERLQGIFGKDHANGHGVESATDVVENEIGDNQVDGEDWLQHDNSLLSNGNTSARSEHFSTRQPLK

SEQ ID NO: 119480 - protein, 145 aa, Glycine max
  Coding DNA Sequence Number=SeqID_2702
MDENPRSLKRPIHMLTSFFEDWKRTSKLLLNLMRLTVATNVKPCMPKRGNVLKFIKLARDYSHSNITDKALWDTYQEINAMLIQEEGRLKKMKDNLVHLITHDGASTSKSNLVKKEGVRKEKKYYFCKPNGDFKKVCLKRKKWIE

SEQ ID NO: 119481 - protein, 112 aa, Glycine max
  Coding DNA Sequence Number=SeqID_2703
LGGGTGGSYMGISTLKSSSMMVARLAISVLGAETFDKGVKADVDESSFPHSDESMRHHGHPRYGWLVGGVIPLEYVLPPHGVALSPQHVFRVVGGCCLSVMVVGGGLEVSRV

SEQ ID NO: 119482 - protein, 196 aa, Glycine max
  Coding DNA Sequence Number=SeqID_2704
  Subcellular localization annotation: CTP_CleavageSite=15; ConfidenceScore=5.19e-01
MDLSHPQSNLSLGFSSSHASPPPRSNPPVSLQLMEPQTENGNLDVESDDDEDKEVEEFRILGHSICLKRRRDCDSSSSSFATKRVSVEPDLDTHNVVVRAWGCQPLYIGIVDDDHAMPMDMVIGGDERGSFDFVHKSGNDSRIICSKKGNIEDVALVFAQDKDRSLGTSCYLFGSPCNLMHDIHVTTIVHITLFHC

SEQ ID NO: 119483 - protein, 162 aa, Glycine max
  Coding DNA Sequence Number=SeqID_2705
  Gene Ontology: Mol. function=DNA binding; Biological process=DNA integration
DLIEVQRSSLHRSSTSKLPPNPLTPLDLIPLPLDTSFIHKEGESRKDRFPTKRKSKLSPRGDGPFQVLKRINKNAYRSDLPEESGVSTTFNISDLIPFAGGADIEEEKPTNLRSNPFQGGGDDAILPRKGPVTRAMSKRLQEDWARAAEEGPRVFMNLKINF

SEQ ID NO: 119484 - protein, 140 aa, Glycine max
  Coding DNA Sequence Number=SeqID_2706
IAPTRHLVDPETSNRALGFPALFTGLYQSYRVPVPPRQGIAPTRHLVDPETSNRVLGFPALITGLCQFYGVPVTPSKVIRPPTNRAFIKRYCAPRQAQGKTPQQLGDGQQQAKNAPLPPPESLSSTTKRLEYCLRPMADQ

SEQ ID NO: 119485 - protein, 437 aa, Glycine max
  Coding DNA Sequence Number=SeqID_2707
  Gene Ontology: Mol. function=two-component sensor activity; Cellular component=integral to membrane; Biological process=two-component signal transduction system (phosphorelay)
  Homolog annotation: Hit_ID=P0AD14; Match level="QueryCoverage=85%, HitCoverage=66%, E-value=1e-154, Identity=73%"; Hit description =Inner membrane protein yehU precursor
HADHFQPADARHLDIEKHHVRLQPVDLADGFNGVGAFADNRDPRFSFQQVHRQQSVRLTSGGPLHGNIERNAGVGVRSAIHLHAIAFAVAHANAFIHQVHPQPAAVRLRLEQPGVVRHLQQQMLPFAAGADFDAAHAQQMRGAMLDGVLDDRLQRERRQPHRQQRLRQRYRDLQPIGEARFLDLQVGVHVFNLVRQADFVIGTFEVFTKEGRERLHQIAGALAIAADHRHQSIQGIEQEMRIDLRMQQLDLRLRQQLLVALVLSGHDLRRQQAGDAFAQRTVDGAEQLAFRLIQLDGADHPLIFAAQRDHQRRSQLAGRIDRAAVRELITVGVHHLVVVDGAMRMHRGDRRARQVVVVADADKRQQLVAIGDRHRADAQLLIDHPGDLHAVFLIEALPQDALGALGDLQRLGRECAGVFFEHRAPIQQDLHEHRRAD

SEQ ID NO: 119486 - protein, 767 aa, Glycine max
  Coding DNA Sequence Number=SeqID_2708
  Gene Ontology: Mol. function=protein dimerization activity; Cellular component=nucleus; Biological process=regulation of transcription, DNA-dependent
  Homolog annotation: Hit_ID=Q1SGV7; Match level="QueryCoverage=62%, HitCoverage=43%, E-value=0.0, Identity=82%"; Hit description =Transcriptional factor B3; Auxin response factor; Aux/IAA_ARF _dimerisation
  Pfam annotation: Domain name=Auxin_resp; Domain location=252-334; Score=196.7; E_value=5.6e-56; Accession=PF06507.4; Description=Auxin response factor
  Pfam annotation: Domain name=B3; Domain location=125-230; Score =109.5; E_value=1e-29; Accession=PF02362.12; Description=B3 DNA binding domain
  Pfam module annotation: Pfam domain module=Auxin_resp::B3; Domain location=252-334::125-230
MKAPPSGYLPNSGEGERKTINSELWHACAGPLVSLPPVGSLVVYFPQGHSEQVAASMQKEADFIPSYPNLPSKLICMLHNVALHADPETDEVYAQMTLQPVNKYDKEAILASDMGLKQNQQPTEFFCKTLTASDTSTHGGFSVPRRAAEKIFPPLDFSMQPPAQEIVAKDLHDNTWTFRHIYRGQPKRHLLTTGWSVFVSTKRLFAGDSVLFIRDEKQQLLLGIKRANRQQPALSSSVISSDSMHIGILAAAAHAASNNSPFTIFYNPRASPSEFVIPSAKYNKALYNHASLGMRFRMMFETEESGVRRYMGTITGITDVDPVRWKNSQWRNLQVGWDESTAGERPSRVSIWDIEPVVTPFYICPPPFFRPKFPKEPGMPDDESDIENAFKRAMPWLGDDLGMKDASSSVFPGFSLMQWMSMQQNNQFSAAQSGFIPPSMLSSNALHGNLTTDDPSKLLSFQAPVLSSPNLQFNKPNLANQVNQLQQSPTSWPPQQQQQQQKLQSMLQTPLNPLQQQQQQRQQQLPVPQNLSQPQQQQPQMPQQRAQQPQQQQQQSCQQTIMSNGTVASNQIPNQCVQQPVTYSQLQQQQLLSGSIPPQQSFQSPNKNALLMTSLPQDSQFQQQIDQQASLLQRQQQQQTQLQSSPLQLLQQSLSQRASQQPQMTQMCQQNSSEQQPQLQLLQKLQQQQQQQQQQQQQQLLSTSSPLLQSQLLHQQNTHQQNQQLPQLPLSQGHQPQQLGNNAFSMEKLLNGNNYSTSSLMQTQQLS

SEQ ID NO: 119487 - protein, 209 aa, Glycine max
  Coding DNA Sequence Number=SeqID_2709
  Homolog annotation: Hit_ID=Q1SKD7; Match level="QueryCoverage=76%, HitCoverage=45%, E-value=4e-14, Identity=29%"; Hit description =Ankyrin
MAPRKLSAKRSRKDATAEGTSAPPEFDSHRFRSAEHQQHFEAIKGWSFHRERRVQLRDDEYRDFQEEIAHRRWTSLVTPMPKFDPDIVLEFYANACPTEEGWIPFDADALSQFLGYPLVLEEGQECEYSQRRNRADGFDEKAIAQLLCIPGQDFARTAAGRRVRIMHTNMTTLTQTWMTLLLNNILPSDHNSDLPLPKCQLVCRLLGTL

SEQ ID NO: 119488 - protein, 135 aa, Glycine max
  Coding DNA Sequence Number=SeqID_2710
  Gene Ontology: Mol. function=nucleic acid binding; Biological process= DNA integration
  Homolog annotation: Hit_ID=Q1SHC9; Match level="QueryCoverage=85%, HitCoverage=22%, E-value=7e-22, Identity=46%"; Hit description=Zinc knuckle, putative
MEPTKKVADYFTRILSITNLMKGCGEKLDDQMVVEKILRSLSPRFDYIVFVIEESKNLEDLKIEKLQGSLEAHEQRLNDRDTKRSTQDLQAHSSKGKGRGNWNTDKGKGSHKTHSKNSEETQSEIGESSGQHKNG

SEQ ID NO: 119489 - protein, 207 aa, Glycine max
  Coding DNA Sequence Number=SeqID_2711
  Homolog annotation: Hit_ID=Q1T493; Match level="QueryCoverage=95%, HitCoverage=38%, E-value=5e-10, Identity=26%"; Hit description =Nucleic acid-binding, OB-fold, subgroup
CYPACIQCHRKTDIQTGPFTCGCGKDNDQPVLRYRVEVMVSQNNDSSKFLLWDRECAELIGEIADEVNRVKIEDGDVDLNASPQALDRLLGYVLAFKVRIQSKFRNVIVLRYSNELDLINVVLDMLADTEVCSKIDASNVDCNNAMHPECQSLFVTADHDPVAGFPLMPKKCLSSDEVDDELGSSQISPAQLSSNKLTRHSDKSEFS

SEQ ID NO: 119490 - protein, 97 aa, Glycine max
  Coding DNA Sequence Number=SeqID_2712
  Subcellular localization annotation: CTP_CleavageSite=80; ConfidenceScore=5.04e-01
MATPSEKAALPHLLLISYVLHLPACMHTTSKPILPMMLAKPVRHVFRQRQWRNTSSMLHVSRYLANANGGSAVSPACMVECMKKETPCINTFKREPI

SEQ ID NO: 119491 - protein, 180 aa, Glycine max
  Coding DNA Sequence Number=SeqID_2713
MQLTRLIEVSNFKIIIFEPKITRHHSFLASTKEFPCYCHSHRQVSSISVLTEQPCIMNSVFDFLRDVSPVKQTWRFKVRVLWLWEMSPLSESTKAFAIEMVLMDSEVQMNFGRVGDVETNLEVESEGDPSMEKCIGSVNQTRKSQQSLGSSIVPAGYNYCLLPCLFSFLFYYSLFLIGHS

SEQ ID NO: 119492 - protein, 65 aa, Glycine max
  Coding DNA Sequence Number=SeqID_2714
MPVKRHAGVEGQRRVGARDVGWEVWEVWEVWVVAVILGVVGVKVREGEIVILAMLCCVGTLFSVK

SEQ ID NO: 119493 - protein, 81 aa, Glycine max
  Coding DNA Sequence Number=SeqID_2715
MERYLQHLVRQEAANHRGQVQIHECLYQLSLSQQSQGFTPFACPTPDQFRAEVAWPGDWPKAQAGEAPRRGSRRCRGGPHG

SEQ ID NO: 119494 - protein, 337 aa, Glycine max
  Coding DNA Sequence Number=SeqID_2716
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=5e-42, Identity=34%"; Hit description= UPI00006A17C9 related cluster
GLHLLAFRGLHLLIFRGLHDLTFRGLHALAFRGLDVLAFRGLDVLVIGGLHALTFSGLKVLIFRGLQVLAIRGRHALTLKGVHILGIRGLRALSIRGLHILAFRRLLVFRGLHALTFRGLHALPFRGLDVLDCRGIDVLTLRGLEVLAIRVLHALAFKGLHILLFRGLHVLVFRGLHALTFRGLHILAIRGLHALTIRGLLVLAFRGLHVLVFRGLHALTCRGLHALPFRGLDFLACRGIDVLTLRGLEVLAIRVLHALAFRGLHGLVFRGLHVLVFRGLHALTFRGLHVLAIRGLHAITFRGLHVLDFRVLHVLYFRGLHALTFRGLHALAFRGLH

SEQ ID NO: 119495 - protein, 246 aa, Glycine max
  Coding DNA Sequence Number=SeqID_2717
MENSRLNTMTNAICLQESLHSVSNGNLRFDTAQTLVSRFLQVFSFFEDEGESPVESDETKVQTWSSQHYRNEPVVVVAAPRLQKYSTFDDQSGEKPLLLPIRSLKSRLSEEDIDVQSLNMSMSSKRFSSYSNRKAEVKAVDADDVDAEVQSQKRSTSSKRFSSNSNRNTKVEGSRAENKKKESVVLPSPIPWRSRSGRLEHKQEEFDEASNMMFPSSKEESHPVKSQPSCASSRDNSVSFSPSCGI

SEQ ID NO: 119496 - protein, 128 aa, Glycine max
  Coding DNA Sequence Number=SeqID_2718
LVTLFLHHFEIPLDSESYIPIKRSFLIGAAAIASFGYRKERDGSWVKKGTQPADEEGNLPNEDNSTLLRRLMDKFDGLQTFVGDKFDAMELQVDMRFDAMESRITRVEEDVSFIRTCFDPPPPPPSSS

SEQ ID NO: 119497 - protein, 171 aa, Glycine max
  Coding DNA Sequence Number=SeqID_2719
MVGAGLKKDLRVSRVVPGGSLNAFLFLLIGVNFTKTCHGKEEGGTSTLGERSAMIYFTGEVSAQLVELRSCNWVVAITGWMSNCPGGNDSILYLNRRAVKNVEEGFLIWDPGEEDQAGPCEQLDALSPFNPLSEMWQKEKESMDRPHRLHPVGTTRSPQGRLRHPGVADRP

SEQ ID NO: 119498 - protein, 78 aa, Glycine max
  Coding DNA Sequence Number=SeqID_2720
MCVYDLWVAGILQEMAPKKLSTKRSRRDAATEGSSAALEFDSHRFWSANHQQCFEAIKGWSFHRERHVQIREDEYTDF

SEQ ID NO: 119499 - protein, 275 aa, Glycine max
  Coding DNA Sequence Number=SeqID_2721
HAFARRKRACCDSAVCQFSILNLIRRPMNSLPSAVHVSSTIESEAPRIHCLALFANSPFSTFIRRPMNSLPSAVHVSSTIEFGAPRIHCLALPANSLRSAVRQFSILNLIRRPMNSLPSAVHVSSTIESGAPRIHCLALFANSPFSTFIRRPMNSLPSAIHVSATIESGAPRIHCLALFANSPFSTFIRRPRNSLPSAVHVSSVIKRGASEKKEGVETRLIITERAGRTKSVSYLCFPLISDERYLAPFVAQYVKSRDVPKIERKQAYAIRENSV

SEQ ID NO: 119500 - protein, 90 aa, Glycine max
  Coding DNA Sequence Number=SeqID_2722
MAPKKLSAKRSRRDAAAEGTSADPEFDSHRFRSAEHQQRFEAIKGWSFHRERRVQLRDDEYIDFQEEIAHQHWTSLVTPMAQFDPGIVLE

SEQ ID NO: 119501 - protein, 95 aa, Glycine max
  Coding DNA Sequence Number=SeqID_2723
MVPRMSSGPPPLDDKSADDHNCLCVPLNTTVSECQKVSGMTIICLRMSSGPPPLDDKRAQNDHNLSPHVTGPQGQYDRDCGAADKSEALAPTYPQ

SEQ ID NO: 119502 - protein, 59 aa, Glycine max
  Coding DNA Sequence Number=SeqID_2724
AEVTITKLNEERRRNTQEKDLQQQQEELDNLLFKISQISPLGVHSRLLEDAISNKYLLI

SEQ ID NO: 119503 - protein, 115 aa, Glycine max
  Coding DNA Sequence Number=SeqID_2725
  Gene Ontology: Mol. function=DNA binding; Biological process=DNA integration
  Homolog annotation: Hit_ID=Q1SKC8; Match level="QueryCoverage=44%, HitCoverage=12%, E-value=3e-11, Identity=55%"; Hit description =Integrase, catalytic region
MASTRKDWSIKLEDALWAYRTSCKTPIGLSPFQLLKSKWSGPFVIKKVQPYGAIELYDPQSQDPDRTWVVNGQRLKLYHGGEFEKMPYNKKPAWEFHYLVNPLQLLKHTRTSLPL

SEQ ID NO: 119504 - protein, 133 aa, Glycine max
  Coding DNA Sequence Number=SeqID_2726
MVSLCGSDFVKDFLQDSGNLKRVAWGLDVGIGCGRTMVSELHSCIKFRNFKNKGLINRPPIFNGIGYHYWKTRMQIFTEAIDMNIWCRNLPFGERVTRDSRERLPRKENAQSRHQRLFEENVGKTRKGAVYEL

SEQ ID NO: 119505 - protein, 131 aa, Glycine max
  Coding DNA Sequence Number=SeqID_2727
  Gene Ontology: Mol. function=helicase activity; Biological process =protein amino acid phosphorylation
  Homolog annotation: Hit_ID=Q1SN45; Match level="QueryCoverage=98%, HitCoverage=7%, E-value=3e-21, Identity=42%"; Hit description=AAA ATPase
MADDITFNHRKQGIHLTEKETIHLCLTEIENMLQANRRSLRDFPSMPYPIGYAPNQHHNKLIHNEMAYDKEMLAAEFNTAYHLLTDEQKTIVDIIMRVVNTQSAAVYFLYGYGGTGKTFVWTTLSSAICSN

SEQ ID NO: 119506 - protein, 196 aa, Glycine max
  Coding DNA Sequence Number=SeqID_2728
  Gene Ontology: Mol. function=DNA binding
  Homolog annotation: Hit_ID=Q1SDS1; Match level="QueryCoverage=68%, HitCoverage=25%, E-value=6e-14, Identity=35%"; Hit description=IMP dehydrogenase/GMP reductase
  Subcellular localization annotation: CTP_CleavageSite=33; ConfidenceScore=5.13e-01
MGSSQTPSLKKRFYQVKVKSLGITSLKELGQLMVSSNGKLFAKITQLTLFLPIIATRKARYDRRCEKSSTRIVCCTPALYVWLVSHLFRQEVRHACPQEGHRSCTEKGGTNWDQLLANKERASINWFPRWKEGRTGVLISCGGYPNVPLMGTKGCISYNPVLAIRQLGYPMRGAPLEEEIAPVLSRRDASEVRKAW

SEQ ID NO: 119507 - protein, 73 aa, Glycine max
  Coding DNA Sequence Number=SeqID_2729
  Homolog annotation: Hit_ID=Q2PMM5; Match level="QueryCoverage=48%, HitCoverage=1%, E-value=1e-12, Identity=97%"; Hit description =Protein ycf2
  Subcellular localization annotation: CTP_CleavageSite=49; ConfidenceScore=5.06e-01
MHIQGSKIPWICMYMAKTPHKNIHMFRVNAVKIFPNTMMKRMSFKRMIQSSYKVEPCSTRHEIDIPKNKAFFE

SEQ ID NO: 119508 - protein, 110 aa, Glycine max
  Coding DNA Sequence Number=SeqID_2730
  Gene Ontology: Cellular component=nucleus; Biological process =regulation of transcription, DNA-dependent
  Homolog annotation: Hit_ID=Q1EPA1; Match level="QueryCoverage=95%, HitCoverage=7%, E-value=2e-15, Identity=48%"; Hit description=Paired amphipathic helix repeat-containing protein / transcription regulator- related
MEEILKDHGDLILGFNNFLPKGYEILLLDEGEDGFGNASKYLKKIQDRFENKDHVYKSFLNILLKFKNNGVTLHDTYHESYIFNFSKLLHFLRVTMILFVTSLSFCHLYI

SEQ ID NO: 119509 - protein, 46 aa, Glycine max
  Coding DNA Sequence Number=SeqID_2731
MEKGTSLPMEKGFKILLFPIIDSLGNPLRIFSQIRFEVDLNGRNLH

SEQ ID NO: 119510 - protein, 74 aa, Glycine max
  Coding DNA Sequence Number=SeqID_2732
MREEGDSSDDVGASVFVHKDGDIANNQCVHVELIEVFYDYFNLKENLNLPSEVQSDAHFRPVDKLVVVRRLLVE

SEQ ID NO: 119511 - protein, 228 aa, Glycine max
  Coding DNA Sequence Number=SeqID_2733
MDSCYSCVSPTLEWELCLGSCRASAYCWIYEHFPSVHDSVTDDGYAEMSPRAYRWLTMKAYMKGLTASTYRTRIDALKITDMGSHCGHTSTREGGAIVSLQTIPPPPISASLSYEDIDDRWMHYSDHLAAAGHICLVPGKCSRDYMEWFFEISHPFITPTQAADQPRHPPVPQHEAYVEPNITEIPVATGARPSLAADPPRHAMDACEAIIERLGRVLNLRMVTEGTK

SEQ ID NO: 119512 - protein, 71 aa, Glycine max
  Coding DNA Sequence Number=SeqID_2734
  Homolog annotation: Hit_ID=Q7CLA8; Match level="QueryCoverage=77%, HitCoverage=13%, E-value=2e-07, Identity=50%"; Hit description =Sodium/glutamate symporter
  Subcellular localization annotation: CTP_CleavageSite=65; ConfidenceScore=5.78e-01
MVAKKASISGSFSDMSKLISQLTSFFRANSRRATSKPPATGAGMVYFRSRGMVLTHLPPRSKTSVAATNVP

SEQ ID NO: 119513 - protein, 287 aa, Glycine max
  Coding DNA Sequence Number=SeqID_2735
  Homolog annotation: Hit_ID=P37903; Match level="QueryCoverage=42%, HitCoverage=86%, E-value=3e-23, Identity=47%"; Hit description =Universal stress protein F
  Pfam annotation: Domain name=DUF903; Domain location=26-98; Score =56.5; E_value=8.9e-14; Accession=PF06004.3; Description=Bacterial protein of unknown function (DUF903)
  Pfam annotation: Domain name=Usp; Domain location=145-256; Score =46.0; E_value=1.3e-10; Accession=PF00582.16; Description=Universal stress protein family
  Pfam module annotation: Pfam domain module=DUF903::Usp; Domain location=26-98::145-256
DQNTDGKTIVSDGKTSGRYRYRELQMKKTLVLPAIALVAIAALSGCTRTSYAIHTHDGRTLISDGKPKETSAGLLGYTDANGVKQQINKTEVKEPANTKGANGSLSTLNPAYLPAFNDNVEHLTFQRQRSRVIPHVNALARLEDSHVHFLAVIPSRATYAAFGFAATAAIETKDEIIAVATEGLAKAAKEFSVPEDRVTTHVAVGDPKDQILELADALNAEIIVMGSNRPSAITYLLGSNATAVVRHANCPVLVAFEVIGYGLGGDGAFHAFNDQVSRFEPAHVAQH

SEQ ID NO: 119514 - protein, 86 aa, Glycine max
  Coding DNA Sequence Number=SeqID_2736
MAPKTCCLLGKHTKLHKKQMFPFLFICFPQLIGQSELSFVDERLLVVRILKLAKYRLKAQVEKDEGLSGEGQSPRVEKDEGPSGEG

SEQ ID NO: 119515 - protein, 225 aa, Glycine max
  Coding DNA Sequence Number=SeqID_2737
  Gene Ontology: Mol. function=nucleic acid binding
  Homolog annotation: Hit_ID=Q53PR8; Match level="QueryCoverage=50%, HitCoverage=20%, E-value=2e-10, Identity=36%"; Hit description =Transposable element protein, putative
MYLNLSKASEASLVPLNPEIKATCRKNNALRRRREQLEKQINQGDKGISSSTTSSSFPLDLDEPTTSTPFSISADNSMARDKPQRFTLEDYFSSSTPRYFTSIVRPELIQGNLFQGLPNEDPYAHLATYIEICNTVKIVGVPKGAIRLNLFSFFREALDRFCNLLRRTAMHGFNEPIQLNIFTNGLRPHSKKLLDTSIGGKINLKTPDEAMELIENMAASDHPVL

SEQ ID NO: 119516 - protein, 174 aa, Glycine max
  Coding DNA Sequence Number=SeqID_2738
MDRDTLGHSGKRGSKNLGKLARGDNRHLVLSFDTNNSQEWKTHPCNHQFQGEVMEHPRRIQALDATDHHRDTRYISHPFRAYPLMRHQSCYFLLCLLWIRAVGQPIVILAAILQLDANGWATRSTFCQDTTIKVYEDVGDYSNDEDLTPSKITFYLGVCGEEISKGEVVLFDEE

SEQ ID NO: 119517 - protein, 196 aa, Glycine max
  Coding DNA Sequence Number=SeqID_2739
  Gene Ontology: Mol. function=2-dehydropantoate 2-reductase activity; Biological process=pyrimidine base metabolic process
  Homolog annotation: Hit_ID=Q0B1K8; Match level="QueryCoverage=99%, HitCoverage=65%, E-value=5e-70, Identity=66%"; Hit description=2 -dehydropantoate 2-reductase
  Pfam annotation: Domain name=ApbA_C; Domain location=70-192; Score =68.7; E_value=1.9e-17; Accession=PF08546.1; Description=Ketopantoate reductase PanEApbA C termin
NGVEQLDRLATYSLPGQIVPAVVWFPAQAQSDGSVRLRGDARLSLPDTSASFLVAKALQGTRCSVDLAANFSSLAWRKLMQNAVAGLMALTHRRSGMFARADIARLTLAYLQECLSVARAEGAELGDEVPQEILDKFRAAPADMSTSILTDREAGRPLEWDIRNGVIARRGRVHSIPTPVSDILVPLLAAASDGPG

SEQ ID NO: 119518 - protein, 169 aa, Glycine max
  Coding DNA Sequence Number=SeqID_2740
  Pfam annotation: Domain name=Hpt; Domain location=4-88; Score=46.3; E_ value=1e-10; Accession=PF01627.13; Description=Hpt domain
MVAKMLAKVGEESRNDMQQCWRHFDAQDWPALASSLHRLGGSAQIIYAGEIDDLCGQIERACQSAEDQEVIREGLLLLEEKLDTLNQSCRNRIRNESCMMARFLAQIFLPCDAADNRTGGSGAIYCAFRHGAISLPCDAADNCTGGSGAIYCAFRRGAVIEMRDESRRY

SEQ ID NO: 119519 - protein, 115 aa, Glycine max
  Coding DNA Sequence Number=SeqID_2741
MLKIKFLLPLLLIISALIWWLMPHYSDEDKAYYIATFCTLTHDGRDNSAQAMQQIIEGGNSDYALQKIHFQSGLAEHLQTVWQDLSPQQQQQARQDAFVCRQLMSDKLLPGQPVR

SEQ ID NO: 119520 - protein, 297 aa, Glycine max
  Coding DNA Sequence Number=SeqID_2742
  Gene Ontology: Mol. function=serine-type endopeptidase activity; Cellular component=integral to membrane; Biological process =pathogenesis
  Homolog annotation: Hit_ID=Q673F0; Match level="QueryCoverage=96%, HitCoverage=23%, E-value=6e-36, Identity=35%"; Hit description=RpeA
MNIMKKSQLALLISTLCLSGSPYAGIMRHDIDVQEYRDFAENRGKYAIGATDIPLYRKDGSFEGYVLDVPMPDFSMVSDEGFSSFIAPSFVTGAKHVRYVLSLNLGKKAKFSPTYRGINYNNDPTRDFHLPRVNKVVVESAPSPYIGGEELLANRSRYTVFARLGAGYQQIDDPESGKLIPIDGAYVYNTGGTFKPGAITNFYKDYIKWRIFSPDHPSFSLLSIGTRGGDSGSPVFAWDSVEKRWVQFAVHSGGYGGTTYNYSFASELINGKHVQEVLDSVRDADVEDSGGTTLEWR

SEQ ID NO: 119521 - protein, 296 aa, Glycine max
  Coding DNA Sequence Number=SeqID_2743
  Gene Ontology: Mol. function=transferase activity, transferring phosphorus-containing groups; Cellular component=membrane; Biological process=peptidyl-histidine phosphorylation
  Homolog annotation: Hit_ID=Q3KE87; Match level="QueryCoverage=95%, HitCoverage=87%, E-value=3e-73, Identity=50%"; Hit description =Putative diguanylate cyclase (GGDEF domain) with GAF sensor domain
MPAQRLSARLPFLILGGVHTCVAAFQQLLQRLRLLRIKFHDARRKLQRVTPLQILHLFMQIVGEARQRRFRLVLTNAVQQHHKLIAAEPGKDIGMAKTHLHGIGKVHQRAVALAVAMPVIDGLKTVEIEKRQAGGQLFQLTLIQRHLTQRHKAAPVGDLRQLIGRRGLKRYQLGFGHGRQIAQRVQILRVELARMVIDDTQRTDFGAGRRAQRIARVETHRIVCIGNQRIIAEARVGQRVLNHHHLILQDGVAAKRDVTRGGWPIKTVAGFKPLIVILQQTDHRDRNVKQTSGKAG

SEQ ID NO: 119522 - protein, 496 aa, Glycine max
  Coding DNA Sequence Number=SeqID_2744
  Gene Ontology: Mol. function=two-component sensor activity; Cellular component=outer membrane-bounded periplasmic space; Biological process=two-component signal transduction system (phosphorelay)
  Homolog annotation: Hit_ID=Q3KE87; Match level="QueryCoverage=63%, HitCoverage=98%, E-value=9e-82, Identity=50%"; Hit description =Putative diguanylate cyclase (GGDEF domain) with GAF sensor domain
  Pfam annotation: Domain name=ALAD; Domain location=1-159; Score =121.7; E_value=2e-33; Accession=PF00490.11; Description=Delta -aminolevulinic acid dehydratase
  Pfam annotation: Domain name=GAF; Domain location=198-331; Score =92.2; E_value=1.5e-24; Accession=PF01590.16; Description=GAF domain
  Pfam annotation: Domain name=GGDEF; Domain location=334-494; Score =136.7; E_value=6.4e-38; Accession=PF00990.12; Description=GGDEF domain
  Pfam module annotation: Pfam domain module=ALAD::GAF::GGDEF; Domain location=1-159::198-331::334-494
AGADFIAPSAAMDGQVKAIRQALDAAGFTDTAIMSYSTKFASSFYGPFREAAGTALKGDRKTYQMNPMNRREAIRESLIDEAEGADSLMVKPAGAYLDILRDIRERTTLPLAAYQVSGEYAMIKFAAQAGAIDERNVVLESLGAIKRAVLSAPARARHPVCCNTSIINKSYAMKAPALPADESQRLTQLRALNILHTPTEERFDRLTRLARRLFDVPVAMVSLLENDYQWFKSSDGFDRPTTARNISFCGHTILQDEVMVVEDALADTRFSDNPLVTDADNPVRFYAGYPLRTPSGAKVGTLCIIDNHARQFNAEDLHALRDLAAMAEAELVAFQTATSDELTQITNRRGFMTLGQMALNECQLKQLPASLTFLDLDGFKAINDRHGHREGDRALMDFADAMKVSFRHADIFARLGGDEFVVLLNGIRQDEAEATLARFAHYLHKQMQDLERRYTLQFSSGIVEFDPQQPQSLEQLLESSDARMYAAKYQKRQPRR

SEQ ID NO: 119523 - protein, 48 aa, Glycine max
  Coding DNA Sequence Number=SeqID_2745
  Homolog annotation: Hit_ID=UPI00005F9D24; Match level="QueryCoverage =100%, HitCoverage=14%, E-value=2e-11, Identity=66%"; Hit description= COG2199: FOG: GGDEF domain
MKAPALPADESQRLAQLRALNILHTPTEERFDRLTRLARRLFDVPVAM

SEQ ID NO: 119524 - protein, 145 aa, Glycine max
  Coding DNA Sequence Number=SeqID_2746
MKDCVRCRPGVVAGRHECRPYSAPGNRRIPTRRYPQGTHSCAPGHRRIITRSTPAGHALMHIRNQQNPNPQHTRRVRIDAHLEASPQHIHSHALATAETKLPPGGGSGRADYSLMSGCCCTRFFRFASRRAISSSISSIFCSMLS

SEQ ID NO: 119525 - protein, 397 aa, Glycine max
  Coding DNA Sequence Number=SeqID_2747
MARFVLFAKSLCFDVDQQVLFPVQSPAHRVALTPLQTAILRRVIDADGKLVRNQTLHALFQRVPSDTPFAERLTATIAAINQQAQLAHAPGPLVHQVPLIGCVLADQVDVAPLSDEPVAAPAAAVVSPQPAPAPASVKKKRPVLRWVIVALLLVNVALALLARQMFAPVQHDALDFRPLLRIQNSQVFIPSHLKADSWVVQDALRRYRQWQPRLPDGSAPPMVYINPVRTRLFSSTFLRYPMRKAIITTAVVLAFVLPWALALLLRPAEPVPEWCEVPYRIDHEGAPAGAIDATIRTRFKADGSGSSTLTGTVTVRERHYRLHRVSDTTWRRQGDFMLSTTRNVRILADDTVPPALAAQIVFSPAREGNNDYYQMYQLPNGDQMINYAGLPRLYCHS

SEQ ID NO: 119526 - protein, 391 aa, Glycine max
  Coding DNA Sequence Number=SeqID_2748
  Gene Ontology: Mol. function=oxidoreductase activity, acting on the CH-OH group of donors, NAD or NADP as acceptor; Cellular component =nucleus; Biological process=metabolic process
  Homolog annotation: Hit_ID=Q2SP02; Match level="QueryCoverage=76%, HitCoverage=92%, E-value=2e-78, Identity=50%"; Hit description =Phosphoglycerate dehydrogenase and related dehydrogenase
  Pfam annotation: Domain name=2-Hacid_dh; Domain location=39-254; Score=12.6; E_value=0.00021; Accession=PF00389.20; Description=D -isomer specific 2-hydroxyacid dehydr
  Pfam annotation: Domain name=2-Hacid_dh_C; Domain location=147-322; Score=267.0; E_value=3.7e-77; Accession=PF02826.9; Description=D -isomer specific 2-hydroxyacid dehyd
  Pfam annotation: Domain name=NAD_binding_2; Domain location=180-326; Score=-72.3; E_value=0.01; Accession=PF03446.5; Description=NAD binding domain of 6-phosphogluconate dehydrogenase
  Pfam module annotation: Pfam domain module=2-Hacid_dh::2-Hacid_dh _C::NAD_binding_2; Domain location=39-254::147-322::180-326
TGDRNPGAGCHHQSVPQAAARGIGGANRFPLRTIMSLNCIILDDYQNVALSLADWASLQPQVQTTALHRHYANEDELVAHIAHADILVVMRERTPLSARLIGRLPNLKLIVTSGMRNASIDLHACAERLIAVCGTASSSAAPLELSWGLLLGLARHIPAESQALRSNGAWQHTLGMALHGKTLGLLGLGKIGGEMANVARAFGMRVCAWSQNLSEARAAACGAEKMASLPALLGASDVVSIHLVLSERTRHLLDGAALAHMKPGALLINTSRAGIVDQQAMISALQSGQLAGAGLDVFEQEPLPADHPLRQLPNVLATPHLGYVADTNYRTYFSEAPRQPGIINHLVAIGQLDTYVARGAEHEIALAAPGGIGYAMQAIVALAYRDGAGQR

SEQ ID NO: 119527 - protein, 55 aa, Glycine max
  Coding DNA Sequence Number=SeqID_2749
ATNTMLDLRQNDGQMENIQLQGMVAKEKKQRLVTMLECDEHDAQMHTGTVSLDGD

SEQ ID NO: 119528 - protein, 227 aa, Glycine max
  Coding DNA Sequence Number=SeqID_2750
  Gene Ontology: Mol. function=transferase activity
  Homolog annotation: Hit_ID=Q9FFL9; Match level="QueryCoverage=75%, HitCoverage=60%, E-value=4e-23, Identity=38%"; Hit description =Arabidopsis thaliana genomic DNA, chromosome 5, P1 clone:MIK22
  Pfam annotation: Domain name=Ank; Domain location=128-160; Score=6.7; E_value=3.4; Accession=PF00023.20; Description=Ankyrin repeat
  Pfam annotation: Domain name=Ank; Domain location=23-55; Score=6.3; E_ value=3.9; Accession=PF00023.20; Description=Ankyrin repeat
  Pfam annotation: Domain name=Ank; Domain location=59-93; Score=11.0; E_value=0.81; Accession=PF00023.20; Description=Ankyrin repeat
  Pfam annotation: Domain name=Ank; Domain location=94-126; Score=1.6; E_value=19; Accession=PF00023.20; Description=Ankyrin repeat
  Pfam module annotation: Pfam domain module=Ank::Ank::Ank::Ank; Domain location=128-160::23-55::59-93::94-126
SLDPKVIATNKLVAEEDKGRYLTQCVPLHKASLKGDWKEARKLLDQDGSLLKTAITKGGWATLLHIAVGANRVHFVEELLKLMQPEELELQDHKGNTAFCFAAAVGNVQIAEMMERINASLPTIRGGGGLTPLHLAVLQGRKEMAWHLFPKTKEIFEEVDWTILFINCIKSGLYDLALEMLNEKDMLAYARGEENQTGLHVLARTPGCGCQLRCRKHLLHFCKWLYN

SEQ ID NO: 119529 - protein, 369 aa, Glycine max
  Coding DNA Sequence Number=SeqID_2751
  Gene Ontology: Mol. function=DNA binding; Cellular component=beta -galactosidase complex; Biological process=DNA integration
  Homolog annotation: Hit_ID=Q1SS89; Match level="QueryCoverage=99%, HitCoverage=43%, E-value=1e-127, Identity=58%"; Hit description =Integrase, catalytic region
MFVPRNIEEALDDPNWNLAVLEELNALKKTGTWELVDLPRDKKQVGCKWVFTIKCKADGSVERYKARLVAKGFTQTYGVDYQETFAPVAKLNSVRILLSLAANYNWPLHQLDVKNAFLNGELEEEVFMSLPPGFEEELGRNKVCRLKKSLYGLKQSPRAWFERFGTVIKGLGYIQSQADHTLFYKHSTNNKIVILIVYVDDIILTGDDSLELKNLREKLAKVFYIKELGPLKYFLGIEFARSKEGIFMNQRKYILDLLKETGLLGCKAAETPMEPNLKLQPAETENMVDKGRYQRLVGRLIYLSHTCLDIAFAVSMGSPGRGLLYKNHGHLQVEGYTDADWVGSVTDQRSTSGYCTFVGGNLVSWRSKK

SEQ ID NO: 119530 - protein, 240 aa, Glycine max
  Coding DNA Sequence Number=SeqID_2752
  Gene Ontology: Mol. function=signal transducer activity; Cellular component=integral to membrane; Biological process=signal transduction
  Homolog annotation: Hit_ID=Q6DB55; Match level="QueryCoverage=99%, HitCoverage=44%, E-value=3e-62, Identity=47%"; Hit description =Putative signaling membrane protein
  Pfam annotation: Domain name=EAL; Domain location=95-237; Score=1.7; E_value=1.1e-10; Accession=PF00563.11; Description=EAL domain
MDFMRAIGESNRYQMSLRFNGGSPIASGPDDQPELLYLSSANYQAESSRYPISVSVTVPAAELIKAWRQALLIFLPMAAIFSILLMVLTANWLRRRLSWADEIRRAIRNREFTVHYQPVYSTGIQRCTGAEALMRWQRPNGEMIRPDIFISHAEAEGMIVPLTQHLLAMMAEDIQSWQVEPGFHIGFNLAAEHLQHPDFVQDMMRFARNIRDKQMLITLELTERSLIEDGDAVSRKLRYL

SEQ ID NO: 119531 - protein, 107 aa, Glycine max
  Coding DNA Sequence Number=SeqID_2753
  Homolog annotation: Hit_ID=Q9SLZ4; Match level="QueryCoverage=47%, HitCoverage=4%, E-value=1e-09, Identity=66%"; Hit description =Retinoblastoma-related protein
MMRDEVNQSIIISSYCYTYLLFNNIANFFKELPQFVVKAGPTLSNLYGTDWENWLETNDDACSMECKSELLKILKLINEGSSHNQVRDISSSGMSYVVLVIVYGDDT

SEQ ID NO: 119532 - protein, 47 aa, Glycine max
  Coding DNA Sequence Number=SeqID_2754
MRLGVMINKEVEDDKWKHVHLIKEGPGLTHFLCRWCPFVCKRKGFKV

SEQ ID NO: 119533 - protein, 462 aa, Glycine max
  Coding DNA Sequence Number=SeqID_2755
  Gene Ontology: Mol. function=RNA-directed DNA polymerase activity; Cellular component=chromatin; Biological process=chromatin assembly or disassembly
  Subcellular localization annotation: CTP_CleavageSite=59; ConfidenceScore=5.18e-01
MADAENGEGSSHLFGVTTLVNSSGRQRLRLHSSNSNRPYLRRLSLPYRILIIPFTVEIDASGIGMGAVLSQHNHPIPFFSKPFPPKLLSASAYVRELFAITATDVIEFISQCLDCQHVKYETKRTAGLLCPLPVPYRPWKDLSLDFITGLSLFRGNLVIFVVVVALFMDIVGKIHGLPRSLVSDRDPLFLKQCLCAFIHGRPKEWGKFLLWVEWSHNTSWSAATDTTPFEITFGRKPFNFPEYIKGASTLDVVDEMLTNREETFQVIRKKLLRAQERMKMAADTKRREVHYQPGDWVMLKLRPYRQVSAKGAHATRGKLAKRFYVPFQILERIGPMAYHLKLPEEACIHSVFHCSMLKPFKDPHMRTSEHAPLEVLVQWEGLFPDDTSWELWEKLCEDFHLEDKVNLHGPTDDMKQGETEGRSTQAEVQNTQSRVQKQNQEAQIAARTKRTLTSPSYLSDYV

SEQ ID NO: 119534 - protein, 157 aa, Glycine max
  Coding DNA Sequence Number=SeqID_2756
  Homolog annotation: Hit_ID=Q8H042; Match level="QueryCoverage=98%, HitCoverage=75%, E-value=2e-31, Identity=42%"; Hit description =Putative disease resistance response protein
  Pfam annotation: Domain name=Dirigent; Domain location=30-157; Score =5.9; E_value=1.4e-06; Accession=PF03018.5; Description=Dirigent-like protein
MHDILGGSNPTTRPVTGLLSSICSFCHPIGFNTPQGGIPIPNANGAIPTVNVVIGIPLGIGLAGITFAPNNNNNNQSNAQLHLGPDGLGLGMYVASSFDGTRQMMAFTMLFKEGKYGGTEKFKNAKGFAELRLLFPTGQVSIDGAETLLKITVHLSY

SEQ ID NO: 119535 - protein, 263 aa, Glycine max
  Coding DNA Sequence Number=SeqID_2757
  Homolog annotation: Hit_ID=Q8H042; Match level="QueryCoverage=82%, HitCoverage=78%, E-value=2e-67, Identity=60%"; Hit description =Putative disease resistance response protein
  Pfam annotation: Domain name=Dirigent; Domain location=84-263; Score =185.7; E_value=1.1e-52; Accession=PF03018.5; Description=Dirigent -like protein
MASTSETLGNKMAMGMGSLTAASLAMLLAFANLATTIATVDPIAATGKEHVIELYMHDILGGSNPTARPVTGLLGSIYSGQVPFAMPVGFNTQGTPIPNANGANPTVNGVFGTPLGTGLAGTSFAPNSGNNNQNNAQLQLGPDGLGLGFGTITAIDDILTSQPELGSQIVGKAQGVYVASSADGTRQMMAFTALFEGGEYGDSLNFYGLYRIGSTMSQISVMGGTGKFKNARGFAELRALIPPGQIATDGAETLLRITIYLKY

SEQ ID NO: 119536 - protein, 67 aa, Glycine max
  Coding DNA Sequence Number=SeqID_2758
MIPWRSRPHREAFVAHGRQDVLTAAVGKLEHLGCAHVARAGVMIKYYFGSASRGSRTFSSMATEDLE

SEQ ID NO: 119537 - protein, 217 aa, Glycine max
  Coding DNA Sequence Number=SeqID_2759
  Gene Ontology: Mol. function=actin binding; Biological process =cytoskeleton organization and biogenesis
  Pfam annotation: Domain name=Transposase_21; Domain location=60-185; Score=-111.1; E_value=4e-05; Accession=PF02992.5; Description =Transposase family tnp2
MLQCGVSRYKVKDDIEHNNDESTKKGPPAKMGETAMECSAIRLIPPNGRRLIFCIRISTKRQEILGLDFPLMDESLWQFKHLAQFVVYFASNYNLALWLVMKRKYMMLSMMISSPRQPRNDIDVYLSPIIEVLTKVWDEEDVRKKAQTIQKLNTTPQGLVPPPEPEVGPSAACDSTKGSCINPLGQDPDTGISDKRGLSVLRRFRDVDARIPVPTQE

SEQ ID NO: 119538 - protein, 103 aa, Glycine max
  Coding DNA Sequence Number=SeqID_2760
  Gene Ontology: Cellular component=membrane
  Homolog annotation: Hit_ID=Q2R2Z4; Match level="QueryCoverage=49%, HitCoverage=14%, E-value=1e-18, Identity=88%"; Hit description =Uncharacterized protein family UPF0016 containing protein, expressed
  Pfam annotation: Domain name=UPF0016; Domain location=35-89; Score =29.2; E_value=2.9e-06; Accession=PF01169.9; Description =Uncharacterized protein family UPF0016
IKDAWDLPSDVVKGDNSSPELDELAEAEELVKEKEWGDRSMLATIALGAAQSPWGVASGAIAGHLLATTIAILGGAFLANYISEKLVQVNLIEHSMLEFLNIQ

SEQ ID NO: 119539 - protein, 68 aa, Glycine max
  Coding DNA Sequence Number=SeqID_2761
MANAAEMVPFRSTKYAMTMALLRLSSKPQNNHPSMKKTLADDGCGSVGDEAQFENEEVLGRKLWKCGR

SEQ ID NO: 119540 - protein, 354 aa, Glycine max
  Coding DNA Sequence Number=SeqID_2762
  Gene Ontology: Mol. function=nucleic acid binding
MNCIPIPRSSPQFLRIYICLDACKKGFKANCKPFIGLDGCFVKGYYGGHLLAAVGQDANNAFFVIAYAAVNIEDKDNWKWFLTLLHEDIGDYKQYGWNFMSDIQKEVMPGVKHKYCVLHLWKNFSKQWKEKELRGLVWKCTQSTTEADFKWSRESWTKAYFSENCKVDNITNNNYIRTYIMRKMTSAKPKIAARLSPLVPMQQSRLEKEKVESNKWIAKWGGDPDGTRFEVCHHETRINVDLQNQSFTCRQLTEDYNDGMLTIGSYNATYENYIRPTRSQQYWKTTPFDRSTPLHIKKRPSRPKKCRRKDQNEGQVSNSRLKRSYKEVTCTRCGLNGHNSGGCINGGVSPRPKK

SEQ ID NO: 119541 - protein, 106 aa, Glycine max
  Coding DNA Sequence Number=SeqID_2763
  Subcellular localization annotation: CTP_CleavageSite=53; ConfidenceScore=5.11e-01
MKGLGPHAPLVSRGKLPPSLAVVDALPTCSSYFSRTTVLYPLSDIMPELYIVRCRQKSRLSLARGTIRAQASNISGVEPGDYGSNTEKDGQNVFEGNVIEGSSSNV

SEQ ID NO: 119542 - protein, 57 aa, Glycine max
  Coding DNA Sequence Number=SeqID_2764
MQGYCMVIRTFPQPGENEPVDVPRLTLSSAPFVIQTREVRGKAETNIVFCTFCHPDP

SEQ ID NO: 119543 - protein, 142 aa, Glycine max
  Coding DNA Sequence Number=SeqID_2765
MPKYDLEIVMGFYANVWPTKEGVMDKHSKVRGQWIPYDADAINQFLGNPLILEEGQQYEYTARRSQTTGFDEEAIEGTSTCVAVTENKRGYISCGLVQVEGTSTWLFKENKEGYIPCGSLLVKDFTRLKRNLKNRWLLGDWM

SEQ ID NO: 119544 - protein, 86 aa, Glycine max
  Coding DNA Sequence Number=SeqID_2766
MELHMHTYMHHLADQQITNHRGQDPSPYPWHILEQFRAIFAWLGDRPIFQKKAGSADAPGDAQGDGGRTEDNEDMVDLVDYFIGGD

SEQ ID NO: 119545 - protein, 63 aa, Glycine max
  Coding DNA Sequence Number=SeqID_2767
MSFFPGMETIGSVDDLLDFSSDIGEEDDYDDKPRKACPSLNSKCAGPSLFNPLVQVDPNHSFS

SEQ ID NO: 119546 - protein, 59 aa, Glycine max
  Coding DNA Sequence Number=SeqID_2768
MQAPMTVPSPSSVVTKTMRQKDYMQPPISQGLINTNFVAYILSSLEGGSNNKEHTCLYI

SEQ ID NO: 119547 - protein, 118 aa, Glycine max
  Coding DNA Sequence Number=SeqID_2769
MMAHHWTYQMREPPRHPPTVHNPTSVMPHPPMLPVDTIAVPHPPAPTHVDANMPRHAVDNIKLATHVRYEDGHCYTNAYIITKHCLTLARGVMEQGNVYVRSRQRRDTQGRNGGGRGS

SEQ ID NO: 119548 - protein, 59 aa, Glycine max
  Coding DNA Sequence Number=SeqID_2770
MVLRAAKEKTLGKEKKRLTEEAWIENHMRRRRDSWRKRRDEQMKWKKNGWCRNKITKIF

SEQ ID NO: 119549 - protein, 41 aa, Glycine max
  Coding DNA Sequence Number=SeqID_2771
MVKNVKGECPTCYICRITLMIGGGNDQTPDHLIKEASNHVK

SEQ ID NO: 119550 - protein, 82 aa, Glycine max
  Coding DNA Sequence Number=SeqID_2772
MMITRPEAAGNYTGHDGVKGNPLSIETLGVSNDDGACSTLSRSQRRERGDNGAYGTVQVLVKMQTYVQQGIVVMFNKVHLRK

SEQ ID NO: 119551 - protein, 112 aa, Glycine max
  Coding DNA Sequence Number=SeqID_2773
MGGGGSCLCTAGWPRQLLPSFFLSGSVVWTHLGYFLEEGTILHLRVEVRCMHYTEHDCLERWTDDDCCWGVMAGWNDCAIMGALQPLAQAIGNSNSGEVVGAVEYQGLDHFQ

SEQ ID NO: 119552 - protein, 436 aa, Glycine max
  Coding DNA Sequence Number=SeqID_2774
  Gene Ontology: Mol. function=transporter activity; Cellular component= outer membrane; Biological process=nutrient import
  Homolog annotation: Hit_ID=Q6DB45; Match level="QueryCoverage=99%, HitCoverage=51%, E-value=1e-147, Identity=62%"; Hit description =Putative TonB-dependent heme receptor
  Pfam annotation: Domain name=Plug; Domain location=147-253; Score =71.7; E_value=2.4e-18; Accession=PF07715.5; Description=TonB -dependent Receptor Plug Domain
  Pfam annotation: Domain name=STN; Domain location=80-130; Score=35.2; E_value=2.2e-07; Accession=PF07660.4; Description=Secretin and TonB N terminus short do
  Pfam module annotation: Pfam domain module=Plug::STN; Domain location= 147-253::80-130
  Subcellular localization annotation: CTP_CleavageSite=38; ConfidenceScore=5.22e-01
MAIKNKNGAGRTFTSAKRITGKRVAIGIGCALSGMLTSAMAAPGASASPSAVEQPAILSFAIPAGDLAPALQTAAAKAGVIVIFTPEQTRGKSTAGLQGHYRLTDAFNTLLAGSGLRAQQTAQGYRLVDAGPVQPLTIPELSVVGGLSDSVAAGRSVLDKEDIERVQADNIASLLDRLPGVGMAGSPRPGGQSLNIWGMGDMEDVKVVLDGAPKGFEKYRQGSVFIEPELLKKVEVDKGPHNLLNGNGGFGGTITLETKDAGDMLLPGEDFGGLLKYSYHTNDRQGIYSGALYGRTPEGFADGLIYMSKRDGGNLKRPDGTRFAYSANDQASYLLKTNIYLSEAQTLTLSAMRSDSDGWQPFAAKRDDIAAPSQADIDKYGREEAWRRILVYRDQTDTNYSVKWNLAPEAQPLLNLTLSYAYSKTEQHDKRPDSAS

SEQ ID NO: 119553 - protein, 211 aa, Glycine max
  Coding DNA Sequence Number=SeqID_2775
  Gene Ontology: Mol. function=RNA-directed DNA polymerase activity; Cellular component=riboflavin synthase complex; Biological process =RNA-dependent DNA replication
RRSRLFRFFRRFPQINVGGHSAHISFVEHASRESRVALSPKDLSSSVLVHPPILTHLHVYFLVALKRCRSDDESRKELERIIAQEDREMKPYQEETELVDLGTGSERKEVKLGMGMAPPICEELVALLRDYQDVFAWSYQDMPDVSHDIMQHRLPLNSSCSSVKQKLRRMKPEMSLKMKEEVKKQFNADFLAVARYPEWVANIVPVPKKDG

SEQ ID NO: 119554 - protein, 64 aa, Glycine max
  Coding DNA Sequence Number=SeqID_2776
MWVQAFGLFAQATCAPEFWTSKTVQSEITRATYSFLPCYKVMTKDKVDTSKPYTGAMRGTVHEP

SEQ ID NO: 119555 - protein, 194 aa, Glycine max
  Coding DNA Sequence Number=SeqID_2777
  Gene Ontology: Mol. function=chitin binding; Cellular component =extracellular region; Biological process=chitin metabolic process
  Homolog annotation: Hit_ID=UPI000044A8F0; Match level="QueryCoverage =76%, HitCoverage=99%, E-value=2e-23, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLAFRGLHVLALRGLHVLDFRGLHVLTLRGLHVLAFRGLHALAFRGLHVLAFRGLHVLAFRGLHILTFRGLHILSFRGLHVLAFRGLHVLDFRGLPALAFRGLHVLAFRGLYVLALRGLHVLALKGLHVLDFRGLHILALRGLHVLAFRGLHYWFLGHPPDLGGGPNMRAKPEEKAIAQLLCISDAILPLKGIG

SEQ ID NO: 119556 - protein, 237 aa, Glycine max
  Coding DNA Sequence Number=SeqID_2778
  Homolog annotation: Hit_ID=Q9AVH2; Match level="QueryCoverage=73%, HitCoverage=100%, E-value=1e-55, Identity=47%"; Hit description =Putative senescence-associated protein
VDSRGSHQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTMCRPSQTPPPDNVFRPGSTGRSPTLGPKRGAVPRFPIHGIRSSFPADSAKPVPLAVVSLDSRQGQWESR

SEQ ID NO: 119557 - protein, 137 aa, Glycine max
  Coding DNA Sequence Number=SeqID_2779
  Gene Ontology: Mol. function=unspecific monooxygenase activity
  Homolog annotation: Hit_ID=O04892; Match level="QueryCoverage=68%, HitCoverage=17%, E-value=6e-28, Identity=79%"; Hit description =Cytochrome P450 like_TBP
LPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 119558 - protein, 229 aa, Glycine max
  Coding DNA Sequence Number=SeqID_2780
MASGNRLPRLCNRLPGLKMGSGSRDGFWLSITKGCNRLPGLEMETVGGEGSGNRLPGCLCNSCLASGNRLPRLCNRLPEMKSLEIVMAAQVIHDRVEMECLEGAWETLEGNARCRFRGTIRFMATSLVHPEELARTLQRTVEWILPTPTPYRLVEPVQVIEVMSSEEDPEEDQEELPPEPAVDALDFLEGDEDPLLEVDSPEVVMSVSEADSTEESGPGEMATSGGYSS

SEQ ID NO: 119559 - protein, 188 aa, Glycine max
  Coding DNA Sequence Number=SeqID_2781
  Subcellular localization annotation: CTP_CleavageSite=41; ConfidenceScore=5.19e-01
MEESSKKRKGTSSTTATVGHRCHGPSETPTAPIHPSLSSPRSSTLFSSDDQCLRYNSQFSSRIILDPKYLDTNFFNDETFDCYQVFQNSGLVNFMSLKLPYYPELVKVFYNNLKIQDGIISSEVHGISMIIDQSLFFSLTKLPSQGAPFKGTIVDDWKFDYSSHDARRMVCNDQAEMTGRLLARIINL

SEQ ID NO: 119560 - protein, 65 aa, Glycine max
  Coding DNA Sequence Number=SeqID_2782
  Gene Ontology: Mol. function=nucleotidyltransferase activity; Cellular component=chloroplast; Biological process=biosynthetic process
  Homolog annotation: Hit_ID=Q8LLJ4; Match level="QueryCoverage=98%, HitCoverage=37%, E-value=8e-24, Identity=79%"; Hit description=ADP -glucose pyrophosphorylase large subunit
MAAKDFNVQACLFNGYWEDIGTIKSFFDANLALMDQRPKFQLYDQSKPIFTCPRFLPPTKMEKCE

SEQ ID NO: 119561 - protein, 289 aa, Glycine max
  Coding DNA Sequence Number=SeqID_2783
  Gene Ontology: Mol. function=glucose-1-phosphate adenylyltransferase activity; Cellular component=chloroplast; Biological process =glycogen biosynthetic process
  Homolog annotation: Hit_ID=P55230; Match level="QueryCoverage=77%, HitCoverage=43%, E-value=6e-75, Identity=61%"; Hit description =Glucose-1-phosphate adenylyltransferase large subunit 2, chloroplast precursor
  Pfam annotation: Domain name=NTP_transferase; Domain location=97-289; Score=117.2; E_value=4.6e-32; Accession=PF00483.13; Description =Nucleotidyl transferase
  Subcellular localization annotation: CTP_CleavageSite=71; ConfidenceScore=5.72e-01
MMVASELQGFSMSLGSKKPSFYRDMNLSSSFTGSRVNLLHSKNVASGFPQGKFFSVTQRNTTRRFLATSTLADVANDFMALQSPILTGREASPKTVASIILGGGAGTRLFPLTQRRAKPAVPFGGCYRLVDIPMSNCINSGINKIYVLTQFNSQSLNRHIAQTYNLGGCINFGGGFVEVLAATQTPGESGKKWFQGTADAVRQFLWLFEDADHKNIENILILCGDQLYRMDYMEIVQKHINSCADISVSCLPVDGSENVEVVNKMTETWKFQKFGGNRQGKEAVQPFPP

SEQ ID NO: 119562 - protein, 808 aa, Glycine max
  Coding DNA Sequence Number=SeqID_2784
  Gene Ontology: Mol. function=protein tyrosine phosphatase activity
  Homolog annotation: Hit_ID=Q6F2V0; Match level="QueryCoverage=99%, HitCoverage=98%, E-value=0.0, Identity=49%"; Hit description =Expressed protein
MTNVADHLPNSEEAIRRGEYAVIRSLIRVLEGGVEGKRQVDKVIDKCASMQNLREAIATYRNSILRQPDEMKREASLSFFVEYLERYYFLICFAVYIHSERAALRSNTADHCSFADWMRARPELYSIIRRRDPMGALGYSSLKPSLKKIAESTDGRPSEMGVVAALRKGEVLGSQTVLKSDHCPGCQNPSLPERVDGAPNFREVPGFPVYGVANPTIDGIRSVIRRIGSSKGGRPILWHNMREEPVIYINGKPFVLREVERPYKNMLEYTGIGRDRVEKMEARLKEDILREAKQYGGAIMVIHETDDKHIFDAWEDVTSDVIQTPLEVFKSLEAEGFPIKYARMPITDGKAPKSSDFDTLANNIASAAKDTAFVFNCQMGRGRTSTGTVIACLVKLRIDYGRPIKILGGDVTHEESDCGSSSGDETGGYVNTLSSNTLQRKTDDEQNRAFGINDILLLWKITTLFDNGVECREALDAIIDRCSALQNIRQAVLQYRKVFNQQHVEPRVRRVALNRGAEYLERYFRLIAFAAYLGSEAFDGFCGQGESRMTFKVWLHQRPEVQAMKWSIRLRPGRFFTVPEDLREPQESQHGDAVMETIVKARNGSVLGKGSILKMYFFPGQRTSSHIQIHGAPHVYKVDEYPVYCMATPTISGAKEMLDYLGAKPKPSLTAQKAILTDLREEAVVYINYTPFVLRELNKPVNTLKYVGITGPVVEHMEARLKEDILAEIRQSGGRMLLHREEYNPSTNESGVVGYWENIRADDVKTPAEVYSALKDDGYDIVYQRIPLTRERHALASDIDAIQYCQDE

SEQ ID NO: 119563 - protein, 183 aa, Glycine max
  Coding DNA Sequence Number=SeqID_2785
MSRNMNNFTHLLGPWQTDFRSNDGHTFNHRESNEVPVFYRSHSTHVTDDRSSGVLARQRFSDFRNPLGFHSIPNFPAPPPRRQQIHVHNEDMRRLREIFLQPPQRSTFQINTQAPPPVEISKSTALSKLKKVVHDPPPKRYARRVSLYYRNNVAKPWKEKEKEKDEDGKSCAICLEDFEPSEE

SEQ ID NO: 119564 - protein, 119 aa, Glycine max
  Coding DNA Sequence Number=SeqID_2786
MPMISNNQKGSFNMNPLFRSDSFGHYYPEAEHSYTMMEKRQLFLRSYQFCRKKSLKERVKGSLVRVKKVLWLRLRSAKKLRRLFFSRIRIKCGFYYRRRRFSRLLSAHNRKIDSSSCLW

SEQ ID NO: 119565 - protein, 706 aa, Glycine max
  Coding DNA Sequence Number=SeqID_2787
  Gene Ontology: Mol. function=G-protein coupled photoreceptor activity; Cellular component=membrane; Biological process=regulation of transcription, DNA-dependent
  Homolog annotation: Hit_ID=P93673; Match level="QueryCoverage=98%, HitCoverage=65%, E-value=0.0, Identity=64%"; Hit description =Phytochrome type A
  Pfam annotation: Domain name=GAF; Domain location=176-336; Score =40.6; E_value=5.5e-09; Accession=PF01590.16; Description=GAF domain
  Pfam annotation: Domain name=PAS; Domain location=532-649; Score =76.9; E_value=6.5e-20; Accession=PF00989.14; Description=PAS domain
  Pfam annotation: Domain name=PAS_2; Domain location=26-142; Score =178.2; E_value=2e-50; Accession=PF08446.1; Description=PAS fold
  Pfam annotation: Domain name=PAS_4; Domain location=538-654; Score =7.2; E_value=0.039; Accession=PF08448.1; Description=PAS fold
  Pfam annotation: Domain name=Phytochrome; Domain location=347-504; Score=254.3; E_value=2.5e-73; Accession=PF00360.10; Description =Phytochrome region
  Pfam module annotation: Pfam domain module=GAF::PAS::PAS_2::PAS _4::Phytochrome; Domain location=176-336::532-649::26-142::538 -654::347-504
MSPAGTGGGTVSGEHEPKSDRAATTAYLHQMQKGKLIQPFGCLLVLDEKTYKVIAYSENAPEMLTMASHAVPSVDDHPALDIGTYIRTIFTAPSIASIHKVLGFGDLSLHNTILVHCKTFGNPFYAIIHLVTGSTIIDFESVQPPEVPMTASGSLQSYYKLAAKATTRLQSLATVNMETLCNTMVQEVFELTGYDRVMAYKFHDDDHGEVIAEVKRPGLEPYLGLHYPATDIPHATRFSLWRTRAAHSCHLQFMVNMNSSASLVLAVVINDNDEDGNSSDDAAVQQPHKSSTSLWGLVVCHHTTPKFVPQGRFKDLRGLKQIYFLSICHPRVGKELEIEYQIVEKNILRTQTHLFDVLTRDEPLAIVSQSPNMMDLVKCDGATLLYKNKVWRLGVTPSESQIREIALWLSQCHRDSTGFPGAAALGDIACGMTSARITSKDIVFWFWSHTAAEIRCDGGCIQDPSFKAFLEVVKNRSLLWKVYETDAIHSLHLILRDAFKETESMKIATYAPNSRLGCLNIEETQGLEAVTNEMVRLIETATVPVLAVDVNGMVNGWNTKIAELTGLPSDEAMGKHFLTLVEDFSVDRVKKMLHMALQGEEEEERNVQFEINTYDFKIDSGPASLVVNACASRDLQDNIVGVCFVAQGITAQKTMMEKFPRIEGDYKAIVQNPNPSIPPLFSTDEFGWCCEWNSAMAKLTGWKREE

SEQ ID NO: 119566 - protein, 116 aa, Glycine max
  Coding DNA Sequence Number=SeqID_2788
MLKMGWQYLATKRIRCGYEKLPSSSQKMMRDGRSCWVKSLNGRLRGLRLSRSRKLSLGVVVLSSRIVRLYNEVVNQMMNMENIYPAIVLSTQWGLPVLSHSSHVCRSRRVIPLDRN

SEQ ID NO: 119567 - protein, 284 aa, Glycine max
  Coding DNA Sequence Number=SeqID_2789
  Gene Ontology: Mol. function=transporter activity; Cellular component= membrane; Biological process=oligopeptide transport
  Homolog annotation: Hit_ID=Q2HRU3; Match level="QueryCoverage=99%, HitCoverage=48%, E-value=1e-129, Identity=81%"; Hit description=TGF -beta receptor, type I/II extracellular region
  Pfam annotation: Domain name=PTR2; Domain location=91-284; Score= -95.8; E_value=0.022; Accession=PF00854.12; Description=POT family
MADHDAKEEQRPLNQWRRSKGGFMASMFIFVLSALDNMGFVANMVSIVLYFYGVMHFDLASSANTLTNFMGSTYLLSLVGGFISDTYLNRFTTCLLFGSLEVLALAMLTVQAASKHLHPEACGKSSCVKGGIAVMFYTSLCLLALGMGGVRGSMTAFGADQFDEKDPTEAKALASFFNWLLLSSTVGAITGVTGVVWVSTQKAWHWGFFIITIASSVGFVTLALGKQFYRIKTPGDSPTLRIAQVIVVSFKNRKLSLPESHGELYEISDKDATAEKIAHTNQMR

SEQ ID NO: 119568 - protein, 50 aa, Glycine max
  Coding DNA Sequence Number=SeqID_2790
MGHMVQLIWCPQCPLRATLCGVVRTGIAIAIAIAIIPSLKEGPFTVSPYK

SEQ ID NO: 119569 - protein, 158 aa, Glycine max
  Coding DNA Sequence Number=SeqID_2791
  Gene Ontology: Mol. function=G-protein coupled photoreceptor activity; Cellular component=membrane; Biological process=regulation of transcription, DNA-dependent
  Homolog annotation: Hit_ID=P42500; Match level="QueryCoverage=94%, HitCoverage=22%, E-value=4e-29, Identity=75%"; Hit description =Phytochrome A
  Pfam annotation: Domain name=HisKA; Domain location=39-102; Score =32.8; E_value=1.2e-06; Accession=PF00512.15; Description=His Kinase A (phosphoacceptor) domain
MSSFCGAVTGVFCFLQLASPELQQALHIQLLSEQTAMKRLKDLNYLKRQIRNPLYGIMFSRKLLEGTELGAEQKQFLQMSTQCQHQLSKILDDSDLDSIIDGITHDGFGVPETLLNQMFGRDGHESEEGISMLISRKLMKGDVRYIREAGKIIFHLIC

SEQ ID NO: 119570 - protein, 421 aa, Glycine max
  Coding DNA Sequence Number=SeqID_2792
  Gene Ontology: Cellular component=cellulose and pectin-containing cell wall; Biological process=negative regulation of Wnt receptor signaling pathway
  Homolog annotation: Hit_ID=Q153F8; Match level="QueryCoverage=82%, HitCoverage=99%, E-value=0.0, Identity=83%"; Hit description=Pectin acetylesterase
  Pfam annotation: Domain name=PAE; Domain location=41-405; Score =958.2; E_value=3.1e-285; Accession=PF03283.4; Description =Pectinacetylesterase
MERVLWVDIAIGLVVFSNWVDGFVGYEHHFNETELSLLEAHEASLSYAGTERNNLLLVGLTLIQNAAAKGAVCLDGTLPGYHLHRGYGSGANSWLINLEGGGWCNNIRTCVYRKKTRRGSSDFMEKEIPFTGILSNKAEENPDFFNWNRVKLRYCDGASFTGDSEDETAELQFRGQRIWAAAMEDLMSKGMRFASQAILSGCSAGGLATIIHCDEFRGLFPRTTKVKCLSDAGLFLDAIDVSGGHTLRNLYSGVVGLQGAQKNLPQICTNHLDPISCFFPQNLIASVKTPLFILNAAYDSWQIQSSLAPPSADPHGYWHECRLNHAKCTGPQIQFLQGFRNHMLNAIKYFSRSKQNGLFINSCFSHCQTERQDTWFADNSPVIRNKAIALAVGDWYFDRAGVKAIDCPYPCDNTCHHLIFR

SEQ ID NO: 119571 - protein, 295 aa, Glycine max
  Coding DNA Sequence Number=SeqID_2793
  Gene Ontology: Mol. function=transporter activity; Cellular component= membrane; Biological process=oligopeptide transport
  Homolog annotation: Hit_ID=Q2HRU3; Match level="QueryCoverage=95%, HitCoverage=48%, E-value=1e-130, Identity=82%"; Hit description=TGF -beta receptor, type I/II extracellular region
  Pfam annotation: Domain name=PTR2; Domain location=1-198; Score= -97.2; E_value=0.025; Accession=PF00854.12; Description=POT family
MAKFLDKAAIIQESSKPQAWKICTVTQVEEVKILTRMLPIVASTIILNTCMAQLQTFSVQQGNVMDLKLGSLTVPAPSIPVIPLVFISVLVPLYELFFVPFARKITNHPSGITQLQRVGVGLVLSAISMAVAGIVEVKRRDQGRKDPSKPISLFWLSFQYGIFGIADMFTLVGLLEFFYRESPASMKSLSTSLTWLSTSLGYFLSTVFVNVINAVTKRITRSKQGWLHGFDLNQNNLNLFYWFLATLSCLNFFNYLYWASRYQYKREDSGPGFKPLGEMPLKRVERKQDCEVSRE

SEQ ID NO: 119572 - protein, 964 aa, Glycine max
  Coding DNA Sequence Number=SeqID_2794
  Gene Ontology: Mol. function=transcription regulator activity; Cellular component=nucleus; Biological process=regulation of transcription
  Homolog annotation: Hit_ID=Q2HRT7; Match level="QueryCoverage=60%, HitCoverage=98%, E-value=1e-119, Identity=43%"; Hit description =Basic helix-loop-helix dimerisation region bHLH
  Pfam annotation: Domain name=HLH; Domain location=713-762; Score =53.3; E_value=8.1e-13; Accession=PF00010.16; Description=Helix-loop -helix DNA-binding domain
  Pfam annotation: Domain name=PPR; Domain location=143-177; Score =34.6; E_value=3.3e-07; Accession=PF01535.11; Description=PPR repeat
  Pfam annotation: Domain name=PPR; Domain location=178-212; Score=8.0; E_value=0.84; Accession=PF01535.11; Description=PPR repeat
  Pfam annotation: Domain name=PPR; Domain location=214-248; Score=6.1; E_value=1.4; Accession=PF01535.11; Description=PPR repeat
  Pfam annotation: Domain name=PPR; Domain location=280-314; Score =15.9; E_value=0.097; Accession=PF01535.11; Description=PPR repeat
  Pfam annotation: Domain name=PPR; Domain location=42-76; Score=40.9; E_value=4.4e-09; Accession=PF01535.11; Description=PPR repeat
  Pfam module annotation: Pfam domain module=HLH::PPR::PPR::PPR::PPR::PP R; Domain location=713-762::143-177::178-212::214-248::280-314::42-76
IVKRGLVGLVYVKNSLVDVYCKCGLFEDATKLFCGGGDRNVVTWNVMIMGCFHCRNFEQACTYFQAMIREGVEPDGASYTSLFHASASIAALTQGTMIHSHVLKTGHVKDSHISSSLVTMYGKCGSMLDAYQVFRETKEHYVVCWTAMITVFHLHGCANEAIELFEEMLNEGVVPEYITFISILSVCSHTGKIDDGFKYFNSMANVHNIKPGLDHYACMVDLLGRVGRLEEACRFIESMPFEPDSLVWGALLGACGKHANVEMGREAAERLFKLEPDNPRNYMLLLNIYLRHGMLEEADEVRRLMGINGVRKESGCSWIDVNNRTFVFFANDRSLSRTQEIYGMLQKLHGFPLISTLNQSHCGVLYRVAKGKLDDPIEMNNNTTCAVDQSSVPNNDLFELIWEKGQISVQGQSSRARVSPNCKTLPSHTPIGYANNAITTNTRMGKCGNLGAELNEIRRLVPSGEVDLSEEEEDMVMPWFSYGRDDDSLQHGYSTDFFHEPSGVMNELSASNNFSLLDRRNNCSKIFRDTHKHSPFASVRSRVADIAENNANNVPPGSSGFSSLKMEKQGPVMCSNNSSTMMNFSHFAKPAAIVKANLENIGLASRSGSVGIKIKSADESTKVELSRGERPKKPAIHNQDQDVTVSTKGDPSCNDVSKVDQNQTSNIVVGESGNKGHEAVEKGVEPAVDVEEESVGVKKEVHARGFGATRGRSAEVHNLSERRRRDRIDEKMRALQELIPNCNKADKASMLDEAIEYLETLQLQLQIMSMGSGLYVPAMMLPPGMQHMHAPHMGPFSPIGVGMQMRLGMGMLDANVIESSRFIQVPQMQGTQLPITHTPGSSVLHGMARPNAQVFGHHPSQVHPMPMPHAPIFSFPGEPFINPSSTLGLMETVDKASSAFGLKDQIPQLVQNTNNGCNSTNQMSTQCEATIGGFEHSTLVLNSGHATSANDRGASNPSKEDKHL

SEQ ID NO: 119573 - protein, 602 aa, Glycine max
  Coding DNA Sequence Number=SeqID_2795
  Gene Ontology: Mol. function=catalytic activity; Cellular component =intracellular; Biological process=metabolic process
  Homolog annotation: Hit_ID=Q2QNV4; Match level="QueryCoverage=91%, HitCoverage=64%, E-value=1e-113, Identity=34%"; Hit description =Pentatricopeptide, putative, expressed
  Pfam annotation: Domain name=PPR; Domain location=199-233; Score =21.3; E_value=0.0036; Accession=PF01535.11; Description=PPR repeat
  Pfam annotation: Domain name=PPR; Domain location=298-332; Score =44.6; E_value=3.4e-10; Accession=PF01535.11; Description=PPR repeat
  Pfam annotation: Domain name=PPR; Domain location=399-433; Score =36.9; E_value=7.1e-08; Accession=PF01535.11; Description=PPR repeat
  Pfam annotation: Domain name=PPR; Domain location=434-468; Score =10.8; E_value=0.39; Accession=PF01535.11; Description=PPR repeat
  Pfam annotation: Domain name=PPR; Domain location=470-504; Score=6.4; E_value=1.3; Accession=PF01535.11; Description=PPR repeat
  Pfam annotation: Domain name=PPR; Domain location=536-570; Score=9.5; E_value=0.56; Accession=PF01535.11; Description=PPR repeat
  Pfam annotation: Domain name=PPR; Domain location=98-132; Score=34.5; E_value=3.8e-07; Accession=PF01535.11; Description=PPR repeat
  Pfam module annotation: Pfam domain module=PPR::PPR::PPR::PPR::PPR::PP R::PPR; Domain location=199-233::298-332::399-433::434-468::470 -504::536-570::98-132
MIIMKLVLQLQLFTSYQSGVPKFHQFSSVPDLKHLLNNAAKLKSLKHATQIHSQLVTTNNHASLANINTLLLLYAKCGSIHHTLLLFNTYPHPSTNVVTWTTLINQLSRSNKPFQALTFFNRMRTTGIYPNHFTFSAILPACAHAALLSEGQQIHALIHKHCFLNDPFVATALLDMYAKCGSMLLAENVFDEMPHRNLVSWNSMIVGFVKNKLYGRAIGVFREVLSLGPDQVSISSVLSACAGLVELDFGKQVHGSIVKRGLVGLVYVKNSLVDMYCKCGLFEDATKLFCGGGDRDVVTWNVMIMGCFRCRNFEQACTYFQAMIREGVEPDEASYSSLFHASASIAALTQGTMIHSHVLKTGHVKNSRISSSLVTMYGKCGSMLDAYQVFRETKEHNVVCWTAMITVFHQHGCANEAIKLFEEMLNEGVVPEYITFVSVLSACSHTGKIDDGFKYFNSMANVHNIKPGLEHYACMVDLLGRVGRLEEACRFIESMPFEPDSLVWGALLGACGKHANVEMGREVAERLFKLEPDNPGNYMLLSNIYIRHGMLEEADEVRRLMGINGVRKESGCSWIDVKNRTFVFNANDRSHSRTQEIYGMLQ

SEQ ID NO: 119574 - protein, 142 aa, Glycine max
  Coding DNA Sequence Number=SeqID_2796
MSEVPPAKHIPVWLLVLKIWPCYWLVTSCTSKSLPAFFLECFSYARLKKGYIPECNITFRQKGFRNKIGDAGSNSHAIGNAEIIKLEASPRDGDVRSTDHNTLLLSAVFVRLRLAQYPATTIVVGSHWYLIVTARNTEEITK

SEQ ID NO: 119575 - protein, 162 aa, Glycine max
  Coding DNA Sequence Number=SeqID_2797
MWAFLTDRQINWAHLVKYRMHKALRTNAPLSYPQLVTLFLRHFQIPLDDEPFVQVKISFAIGAGAITSFRYHKDIDGQWIRKQDLPPLIPDERTPSPLPHRDASSTLMHEVLSELRGLRGFVGDRLDSMDAHFEGMDTWITQLEDDMGFIRCCFHRLPHSSF

SEQ ID NO: 119576 - protein, 83 aa, Glycine max
  Coding DNA Sequence Number=SeqID_2798
FVKGFYKESGNSQAGCLGTGRRHRNSAWSFALQVLRGKVVEGPQLLAVSRAIVVVGLVEECMVCLGQQHFGRKEQAAVVVAEG

SEQ ID NO: 119577 - protein, 249 aa, Glycine max
  Coding DNA Sequence Number=SeqID_2799
  Homolog annotation: Hit_ID=Q9AVH2; Match level="QueryCoverage=68%, HitCoverage=99%, E-value=2e-39, Identity=57%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 119578 - protein, 91 aa, Glycine max
  Coding DNA Sequence Number=SeqID_2800
  Subcellular localization annotation: CTP_CleavageSite=19; ConfidenceScore=5.34e-01
MTKEVIHGHNSTVPRLHFSSSSSSSSAFSLVFEGCWMPSLLNNAWLFIEDSQGVQGNSPRRAAARLGKFRHNGEGIHSPRRVACLGLMLHL

SEQ ID NO: 119579 - protein, 121 aa, Glycine max
  Coding DNA Sequence Number=SeqID_2801
  Homolog annotation: Hit_ID=Q1SKA8; Match level="QueryCoverage=87%, HitCoverage=37%, E-value=9e-07, Identity=27%"; Hit description=Zinc finger, CCHC-type
  Pfam annotation: Domain name=zf-CCHC; Domain location=50-67; Score =32.0; E_value=2.1e-06; Accession=PF00098.13; Description=Zinc knuckle
NMRWNSNALIKMKKLTKSREKFQKFIKKRRIDRRQNFNNGRKSQEDSQVLRCYKCNQIGHIKANCPSNEDWPEKSDKKRYDERRTKKAYIAWDDNDSSDGSEKEINLLTKDYESDENISQE

SEQ ID NO: 119580 - protein, 60 aa, Glycine max
  Coding DNA Sequence Number=SeqID_2802
  Homolog annotation: Hit_ID=Q2HV28; Match level="QueryCoverage=78%, HitCoverage=28%, E-value=2e-09, Identity=81%"; Hit description=C2
MAISGCLLAMSSIMDEQLRILKVIVVQGKKLVIRDSRAVTLMLLSSWGIRQQRPGSFIVA

SEQ ID NO: 119581 - protein, 81 aa, Glycine max
  Coding DNA Sequence Number=SeqID_2803
MRGYFMVTRTFRQPGSNEPVDARRLTLSSAPSVILTRESIDMRGYPMVTCTIRQPRANETIVARRLTSSSEPFVVLTRGVR

SEQ ID NO: 119582 - protein, 294 aa, Glycine max
  Coding DNA Sequence Number=SeqID_2804
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=9e-30, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPLEGCTSCPSEDYMPSPSEGYTSSPSEGYTSSHSEDYTSPQSEGCMSSPLEGYTFYPSEDYITTRPRRQRTTCLLLQKTTRPRLQRATRPHALKFRGLHTLAVRGLHALTFRGLHVLAFRGLHALTFRGLDALAFRGLHVLAFRGVHVLAFRGLNVLALTRLHALTFGRLHSLAFRGLHVLAFRGLHVFAFRGLYVLTFRGLHEIPFRGLHVLAIRGLHVLAFRGLHTLPFRRLHFLTFRGLPVLTFRGLRILTFRGLHALTFRMLHVLAFRELHGLAVRGLHVLAFRGLH

SEQ ID NO: 119583 - protein, 147 aa, Glycine max
  Coding DNA Sequence Number=SeqID_2805
MLLALRPDKFMDSLCKKPLNSMNKLRERAKGYIQMEEMSRLKNKVRQDESKRDRREGGRKTDSHKSDKRHKLDKLQPLPKEPRFSYGSDVALCGTCKPWIFFINEVLCFLKLDGSGMEKEKDDWRRPFKEKMSLEEAHHHRKPWIRT

SEQ ID NO: 119584 - protein, 96 aa, Glycine max
  Coding DNA Sequence Number=SeqID_2806
MGLGGSPPYQVNAAHLRDVGKTRHRIESSLGYVSFHDMIDKGTLIGSLLFLVVGVIPLECTHALCGRNARCPGGIVHEPPTSRGVLSLRPDRVLTM

SEQ ID NO: 119585 - protein, 83 aa, Glycine max
  Coding DNA Sequence Number=SeqID_2807
  Subcellular localization annotation: CTP_CleavageSite=39; ConfidenceScore=5.37e-01
MQQGQAYIPVVRFHDPNYGIKNGSVKTSNNGSQVRRNAKASKGGSWWSSMVSGGGGGGAWGVGGRFRGREGGRKWLFYAAGRI

SEQ ID NO: 119586 - protein, 186 aa, Glycine max
  Coding DNA Sequence Number=SeqID_2808
  Gene Ontology: Cellular component=phycobilisome; Biological process =photosynthesis
  Homolog annotation: Hit_ID=Q5ZWL6; Match level="QueryCoverage=98%, HitCoverage=54%, E-value=1e-33, Identity=41%"; Hit description=AbiD phage protein-like
  Pfam annotation: Domain name=Abi_2; Domain location=6-186; Score =172.1; E_value=1.4e-48; Accession=PF07751.2; Description=Abi-like protein
MTHYRKPPLSIQEQLDLLQQRGLAIGDAANAKRYLQRVGYYRLMGYLYTQRVPGSDSFRAQATFEEAVSLYEFDRALRDLVMEAVGHIEVATRTVLTCHFAHAYGAFGHLEPRNLAFTGQEYADWLGGVESEVTRSREAFIRHYKDKYASPAFPRVPIWMATEVMSLGSLSRFYKALHSREQKAVA

SEQ ID NO: 119587 - protein, 236 aa, Glycine max
  Coding DNA Sequence Number=SeqID_2809
  Homolog annotation: Hit_ID=Q6AGJ9; Match level="QueryCoverage=94%, HitCoverage=50%, E-value=1e-30, Identity=39%"; Hit description =Exopolysaccharide production protein
  Subcellular localization annotation: CTP_CleavageSite=48; ConfidenceScore=5.06e-01
MEGAAVTLGIFTLATLAIGVPMLARNRPQPFRWRRLPWTAAGYTAFALLSIAWSQWREATVITWILLAAVTVNGLFIAHVLTWHEIVRALSSAFKWVLGLSLAIELWVSLVLHGPLLPNFVTLPDGEIDPQWYWVRDNLFDGGRLQGIVGNANLLAIISLFALITFGVLFAARARWRTTLALWMLLAAYFLLRTSSATALVCAAAVAVVLLVALLMRRARTPGARTRIYVIAIGGT

SEQ ID NO: 119588 - protein, 70 aa, Glycine max
  Coding DNA Sequence Number=SeqID_2810
MGLRIRFDGGGSTNSAWQSIRGAPNKMVEDARKAIGNKLVGLRIRFDDEGCTNSAWKSIRGAPDSVVEDA

SEQ ID NO: 119589 - protein, 78 aa, Glycine max
  Coding DNA Sequence Number=SeqID_2811
MEDARTALGFQFVGLRTQWWRMHLWQSIHGAPNKMVEDARKALGNHFVVLRIRFDDRGCVNSARKSIRGAPDSMVEDA

SEQ ID NO: 119590 - protein, 74 aa, Glycine max
  Coding DNA Sequence Number=SeqID_2812
NKSIGFNDEICAISGENEAKSWSAKKESGRASSLRSRAKREISALSARVLSSNPLTRAKREGGAKYNVANSKPI

SEQ ID NO: 119591 - protein, 49 aa, Glycine max
  Coding DNA Sequence Number=SeqID_2813
MLATDLVTVSVLARWRSTLLVNVVLRECKSQSESVSVRECASSPVLVLN

SEQ ID NO: 119592 - protein, 93 aa, Glycine max
  Coding DNA Sequence Number=SeqID_2814
MVEIRCRDLEKDRFVSRLPSCVTVTTTIEMTMEVVALKPNVEGLMREDDGWLDVLYDGGRERHVWMAMEVTMTIVTVSMSAIMASEMIGNGDA

SEQ ID NO: 119593 - protein, 85 aa, Glycine max
  Coding DNA Sequence Number=SeqID_2815
MAIILPKENLVVWFCSLHNRPDNYLKGIINSALKGLDDTLQLKSKAGARWIVVKYFNDVRPLEAERLKALCIQWAKYYLKVRNQT

SEQ ID NO: 119594 - protein, 214 aa, Glycine max
  Coding DNA Sequence Number=SeqID_2816
  Pfam annotation: Domain name=zf-CCHC; Domain location=10-27; Score =10.2; E_value=0.021; Accession=PF00098.13; Description=Zinc knuckle
MKNKEENNEIICFECRKPGHMKDNEKSSSSGDEQANICLMEDTYDKVETDETSTFEKLREEVACLTNDFGKFLESSKTLTTLLKFHQHPYDKSGLGFEKGTTSSKLQSVVDKCDFYVGAHEHDGERSMFLDLKTHEGGEVTFGGIGKGKISGIGKIGIPFLAFIGNILYVEGVKTRLPFKDLASCALVVEIEPKTLEEALTDDDLIIAMEEELH

SEQ ID NO: 119595 - protein, 95 aa, Glycine max
  Coding DNA Sequence Number=SeqID_2817
  Gene Ontology: Mol. function=transferase activity; Biological process= DNA integration
MTKGQLPTIFMMEGGAISWKIVKRILTSTSAIEAEYVACFEATHQAMWLKNLISSFHIIESIFRPLVIYCDNTVVVDFYRNNKTSSHTKHFDIKY

SEQ ID NO: 119596 - protein, 186 aa, Glycine max
  Coding DNA Sequence Number=SeqID_2818
  Gene Ontology: Mol. function=transcription factor activity; Biological process=regulation of transcription, DNA-dependent
  Homolog annotation: Hit_ID=Q65QR1; Match level="QueryCoverage=79%, HitCoverage=50%, E-value=2e-60, Identity=69%"; Hit description=LysR protein
MMKLDTVQNRIDMGIRIEREPNPNFIVRPITLVHHALMTSPGLIEKLGAPKNFDDLRQRYPFSGLLNPETGKVFEYMLDGVDTFVPRHLEFFTTDSQSEIQAALAGKAVIQSSNLACREYLEDGRLVNVLPELKLETWQLYLYRPYQTLPFSGKSLLRDGLTRRNKVCRSFRGPEYWRHLMCNGEL

SEQ ID NO: 119597 - protein, 72 aa, Glycine max
  Coding DNA Sequence Number=SeqID_2819
  Subcellular localization annotation: CTP_CleavageSite=26; ConfidenceScore=5.15e-01
MDTLEPYTGAMKGTMHKPQANLRQIRSSHPMGSQLHVMTKDKMGTSKPYTGAMRASCMSLNSIVVTPKWSSD

SEQ ID NO: 119598 - protein, 82 aa, Glycine max
  Coding DNA Sequence Number=SeqID_2820
  Subcellular localization annotation: CTP_CleavageSite=18; ConfidenceScore=5.10e-01
MASMDISAMVNSKIFPCNLAMRGSEEFVPFLDTTSRGSKVPPRTFFKKATRTLRWFCLQKGIKTEPIWDAYAKDAIAGMYIV

SEQ ID NO: 119599 - protein, 227 aa, Glycine max
  Coding DNA Sequence Number=SeqID_2821
  Gene Ontology: Mol. function=glyceraldehyde-3-phosphate dehydrogenase (phosphorylating) activity
  Homolog annotation: Hit_ID=UPI000066F90E; Match level="QueryCoverage =98%, HitCoverage=58%, E-value=4e-42, Identity=39%"; Hit description =glyceraldehyde 3-phosphate dehydrogenase
FGGLQKLLFRVGDSPVFLGASQFYAHTDVTADNQLINKVWQRVLGENSTSSALGVVAEYDTTDNFFYPKKGLSLQGEYRFYRALLGGDYHYNQLSLDGKYFIPLAPTLTLALAANYQSLTHHDKHLTPMARPYIELRGISRFRYQGDYVAVAQTQLAWQFAPRWILQGFVGIGSASDEAGSLWQQTEVAWGTGFRYLVARQYGLFTGVDVAFSEHEQAVYFNVGSGL

SEQ ID NO: 119600 - protein, 117 aa, Glycine max
  Coding DNA Sequence Number=SeqID_2822
MATVSLKHKCLSYSLITTNMRSNLCISSHSIKSEMYKQNQKDFLRLVVRLWLQKFIGFSRIQSTGVATGKVFKDRTGVVRTSGVEGSDAYCGEVVSAIGARGFGVASGDFSGVVAAS

SEQ ID NO: 119601 - protein, 459 aa, Glycine max
  Coding DNA Sequence Number=SeqID_2823
  Gene Ontology: Mol. function=recombinase activity; Biological process= DNA recombination
  Homolog annotation: Hit_ID=Q857I8; Match level="QueryCoverage=98%, HitCoverage=88%, E-value=1e-126, Identity=49%"; Hit description=Gp34
  Pfam annotation: Domain name=Recombinase; Domain location=191-296; Score=46.6; E_value=8.4e-11; Accession=PF07508.4; Description =Recombinase
  Pfam annotation: Domain name=Resolvase; Domain location=8-170; Score =40.8; E_value=4.8e-09; Accession=PF00239.11; Description=Resolvase, N terminal domain
  Pfam module annotation: Pfam domain module=Recombinase::Resolvase; Domain location=191-296::8-170
MSSNRPRALVGARVSVLSGPQKVSHEAQIDTATKWAKAHDYPVVGAFEDLGVSASVPPDERPDLGPWIRERSHEWEVIIWSKLDRAFRSMRHCSDFIKWAETNRKVVVFAEDSMTLNYLNPSTGIDSILGELFVQIAAAFAQIELNRFKSRAEDMHRAIRPTTRWAAGLPPLGYQVVDHPSGRGKGLAIDSDAANLVREMADKLVDGWSFVRITEWLNESGKLTSQGRSREARGLEPKGRWTTTNVIEILTGYRTLGIKTHKGQPVLDDDGEPVRLAPPLFTPERWDEVQRAAQLRKGKPRTPSETANPMLEVGFCAVCGSSLAQQFAKSRPRKSDGHVIHYRYYRCSRTPINCKAVFVVADDLDELLSEQFLLERGDRRVTERVFIPGEDNSYELDFIKDRIERLREDRVAGLFPSGEDELVFRNQMKQLLARREELESVPVRQPGYENVELEKTYRE

SEQ ID NO: 119602 - protein, 246 aa, Glycine max
  Coding DNA Sequence Number=SeqID_2824
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=4e-29, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLTFKGLHAFTFSGLHVLGFRGLHVLAFRGLHTFTFRGPHILAFRGLHVLTFRGLHTLIFIGLHVLTFRGLHVLTFRGLHILAFRGLHVLTFRGLHVLAFRGLHILAFRGLHALAFRGLHALAFRGSHALALRGPHALTFRGLHVLDFKGVHVLTFRGLHALVRTARPHLQKAERPRLQRITRPHLERPTHPRLRRTICPHLQRATGPRLQGTQGPLPLMLNRGLHSWLRGQWFPFISSWATI

SEQ ID NO: 119603 - protein, 314 aa, Glycine max
  Coding DNA Sequence Number=SeqID_2825
  Gene Ontology: Mol. function=1-acylglycerol-3-phosphate O -acyltransferase activity; Cellular component=membrane; Biological process=phospholipid biosynthetic process
  Homolog annotation: Hit_ID=P26647; Match level="QueryCoverage=70%, HitCoverage=91%, E-value=6e-92, Identity=72%"; Hit description=1 -acyl-sn-glycerol-3-phosphate acyltransferase
  Pfam annotation: Domain name=Acyltransferase; Domain location=121 -249; Score=160.3; E_value=5e-45; Accession=PF01553.11; Description =Acyltransferase
MSKGKGNKIISIPSADAAAGVDKVQWLLILPPGSSITIYVGKRKLIMRDEDLQKVRAERGRRGSVSRGLQRIDSVEVNAPARPKSDANSEDIWCLFSPRNPRHVATFGHMFGRLSTVFGVKVELRKPADAESYGNAIYIANHQNNYDMITAANIVQPTTVTVGKKSLLWIPFFGQLYWLTGNLLIDRDNRAKAHGTIGELVAQFKKKKISFWMFPEGTRSRGRGLLPFKTGAFHAAVAAGVPIIPVVVSNTHGKIKLNRWNNGLVIVEMLPPVDTTQFETTSVRKLATHCRELMSAKLEELNAEVAEREKNGKI

SEQ ID NO: 119604 - protein, 153 aa, Glycine max
  Coding DNA Sequence Number=SeqID_2826
  Homolog annotation: Hit_ID=Q00M75; Match level="QueryCoverage=20%, HitCoverage=5%, E-value=5e-10, Identity=100%"; Hit description=PPR -repeat containing protein
MIDASWVRGPEPPKKKGTQRTEKEKITSITKMVLLPPEARQQSQQILYSLFQLSLVTHNLSVKDSIGGMTSLQKISSLIMDDEGVVIRELGKLKQGIIYTNLEEFIINFSQLQQLTKSYPCICKEAVSGFEPMTNKSPRHNFTAAPGLALILR

SEQ ID NO: 119605 - protein, 1268 aa, Glycine max
  Coding DNA Sequence Number=SeqID_2827
  Gene Ontology: Mol. function=RNA-directed DNA polymerase activity; Cellular component=chromatin; Biological process=chromatin assembly or disassembly
  Pfam annotation: Domain name=Chromo; Domain location=1193-1238; Score= 34.7; E_value=3.1e-07; Accession=PF00385.14; Description='chromo' (CHRromatin Organisation MOdifier
  Pfam annotation: Domain name=RnaseH; Domain location=669-783; Score= -30.6; E_value=0.04; Accession=PF00075.14; Description=RNase H
  Pfam annotation: Domain name=rve; Domain location=919-1075; Score =94.6; E_value=3e-25; Accession=PF00665.16; Description=Integrase core domain
  Pfam annotation: Domain name=zf-H2C2; Domain location=860-901; Score =27.1; E_value=6.2e-05; Accession=PF09337.1; Description=His(2) -Cys(2) zinc finger
  Pfam module annotation: Pfam domain module=Chromo::RVT_1::Retrotrans _gag::RnaseH::rve::zf-H2C2; Domain location=1193-1238::405-574::107 -197::669-783::919-1075::860-901
MSDSSHTLGSAVTLEAAILKLPQHQMSLSESVHNMTQKFDELLLRLPLSPIQPQPTSAPTLTSPVPATQHRMKLDIPRFDGTDPCEWVFKINQYFQYHATPEHERLTIVAFYMEGRALAWFQWMTSNGQLTSWPPFLHALQTRFAATTYEDPTGSLFKLTQTGTVAQYLSDFEDLANRIVGLPAQFLLSCFISGLMPEIRREVQALQPMTLVQAAGLARLQEDKLLDTRSSFRHRAPPTLTIPVSRPAPTTTLLPSPPSRVPTPRSPTPRPPPTLKRLSPEEMISRRERGLCFNCDEKYHRGHRCASRVFFLVAEEDPAAEVNIEELDPGPEPPATHDPPGNALTVRDALRPPGYHPRGRGPHPRLQYLIDRFLALFQPPSSLPQAAPVNVESMLQKGLIRPSNSPFSSHVLLVRKQDGSWRFCVDYRALNAITVRDRFLIPTIDELLDELGKACWFSKLDLLQGYHQIRMNSDDIAKTAFRTHHGHYEFKVMPFGLYNAPSSFRATMNMIFRPFLHRFVIVFFDDILIYSVTFDDHLVHLEQAFQVLAENQFVLKLTKCSFGQPQVEYLGHMVSSKGVEPVASKVSAIHHWPVPKSTRALRSFLGLAGFYRRFIRGYASIATPLVRVTTVEPFQWTTEAQGAFSMLKKALSEAPVLALPDFQVPFTMETDAFRVGMGAILSQRGHPIAYFSKPFPPKLHHASTYVRELFAVTTAVRKWRQYILGHRFTIITDHRSLKELLTQVIQTPEQHMYLARLMGFDYQIQFRSGASNQAADALSRLPEHTTSLFLTLSVPCLTFMDELRAQLTASSEFQDMVKAIQTSPSVYPDYTIVNDLVLRKGQIWLPSKLALIPTLLTEFHATPTGGHLGTAKTVARIMENFHWTGLRKDVADFVAQCMDCQSVKYETKRVAGLLCPLPIPHRPWEDLSLDFIVGLPPYHGHTVILVVVDRFSKGIHLGMLPTVHTAHFVACLFMDIVGKIHGMPRSLVSDRDPLFVSRFWQELFRLSGTQLRMSSAYHPQSDGQTEVLNRVIEQCLRSFIHRRPSSLGKFLLWVEWSHNKSWNAATGSTPYEVTFGRKPFNFPEYITGSSNVDAVEEMLTNREETFLSIRKKLLKAQAQMKHYADARRRNVEYHPGDWILQRVGQVAYKLQLPEGARIHPIFHCSVLKPFKGSPETMEPVALPSRFDQNQPLIAPLTILDYRQRTDKKWEVLVQWEGLSPDETTWEELDQLRRDYHLEDKVFLQGPWNDMNSGREVQEVTQGLDSNEG

SEQ ID NO: 119606 - protein, 80 aa, Glycine max
  Coding DNA Sequence Number=SeqID_2828
MSRKFTDYASIPSLTSRMLRNFTDCAIIFPFDSRHVTKLHGLTNNGCQVPRSGHAKVASHQPDGPRTKLGYDKVQCGEEG

SEQ ID NO: 119607 - protein, 147 aa, Glycine max
  Coding DNA Sequence Number=SeqID_2829
KHKAKTVESVNADAEAFGDHWKTGDSTVLKIGDSAEVVIKQDMKGRKHKYGFNNNKHEKPENIRVVDDETGDKHQLDEVLRMPSTYHGFSTCLPSSSSSSSCSFGRIGFAVYREADMQASRLRSLSTRPPGADPPVVHVDPATGKAN

SEQ ID NO: 119608 - protein, 281 aa, Glycine max
  Coding DNA Sequence Number=SeqID_2830
  Gene Ontology: Mol. function=RNA-directed DNA polymerase activity; Biological process=RNA-dependent DNA replication
KKRALRCPYRTRAKARVMSEIEEVQEQMKVDMEAMKEQMTTMMEAIMSIRKMMEVNTAIVIAASTATEVDPTHPSGINQVNRPVSDMVGQGGEALGSMGDSYFVQVQNKHSFPPYGLLPNYIPPNVVHAPDENVDNSTPIPIESQQPQSDHAQVSQPMGETHEAPRDHNLADFEPHLGYAVEGQAVLPAMGERERFDHIKERLRAIEGGRDYAFADIAELCLVPDVIIPPKFKVSDFDKYKGTTCPKNHLKMYNRKMGAYLKNEKLLMHFFQESLTRAAIT

SEQ ID NO: 119609 - protein, 103 aa, Glycine max
  Coding DNA Sequence Number=SeqID_2831
  Subcellular localization annotation: CTP_CleavageSite=79; ConfidenceScore=5.30e-01
MRKIPKKRGKRVFSLSFLDPSLPRLASGSPGPPNYSRVKEPTRLGEPITSGVSISSPGDRGLGSSSSMDSFASWKINGSGMEKEEREETPLQGEDESRRSSPP

SEQ ID NO: 119610 - protein, 79 aa, Glycine max
  Coding DNA Sequence Number=SeqID_2832
  Subcellular localization annotation: CTP_CleavageSite=37; ConfidenceScore=5.12e-01
MHETQCGPLRVHRMNRKAWFEGRWLPPSSPRRAQLAQASRVASSRSNRLLEESSGGPKWAWVLFAPPFLLSTPPSAVFW

SEQ ID NO: 119611 - protein, 177 aa, Glycine max
  Coding DNA Sequence Number=SeqID_2833
TSQPSSKLTSPPLSKKEVVALKKTEKKSLSKTRKKAKLDKSLEKKEAFELDEVLLASVLTLSTEEHKRKLEEDASLVYLAGKVTEKATMMDIDAHLEDEVRKVEIERVQSATKHRAKIMFVYDSERQAEMEVAMVPKYRDPEGKDALEEVVHKFFTKASLGDKDDLLHQWIPLLLGR

SEQ ID NO: 119612 - protein, 154 aa, Glycine max
  Coding DNA Sequence Number=SeqID_2834
MFSKKEGMMKILKLVKYRLKAQVEKDEGLSGEGQSPRVEKDEGPSGKGFSLSSLLNQSQTYQGNPCGIYPDLSSFTGSSVYPDLSSFTGSGIYPDLSSFTRSGVYPDLSSLFGSGVIQKSLLPVSSDPPRKVHITLPSFISFFLQALIHGLLWS

SEQ ID NO: 119613 - protein, 113 aa, Glycine max
  Coding DNA Sequence Number=SeqID_2835
MQSLQNVVHQRPIMSIEEFIQQVAWSGVQPSPLGGGEASATQEPQWDQQEDIPKAAEPTPPKAFTLESDPVVVQADPAISPHPDPSAPVSDLPLSQDPSSAPALDLNEHAQDH

SEQ ID NO: 119614 - protein, 109 aa, Glycine max
  Coding DNA Sequence Number=SeqID_2836
TKVDVSLSELNALSECHPLSEASTCLVDRRNLEGNLSRRHVLRASPACSASHFSPSRLSANLALSENSLTRAKHENGAKNDVKEAVNRALNSRQSLKSEIHRGKEQSKE

SEQ ID NO: 119615 - protein, 245 aa, Glycine max
  Coding DNA Sequence Number=SeqID_2837
  Gene Ontology: Mol. function=transporter activity; Cellular component= integral to membrane; Biological process=transport
  Homolog annotation: Hit_ID=Q392E2; Match level="QueryCoverage=88%, HitCoverage=64%, E-value=2e-50, Identity=52%"; Hit description=Major facilitator superfamily (MFS_1) transporter
MRLVPADQVPRALSIVFSVLHPAVDAAGEQSAQRRRAGPAASERDALGHAGGDHDVYRPFCLLYLSAPVPGNQRAAECESAVAGAAGVRRGELLRHLAGRVAGDAQRVADADRHGAGDERDGGAAGELWPRLLAGGERRRAVGAGVWFNADWLVNLAVARGAGRRRIGRRAAGGHYSAGDHRRCGSRWLDVRSAGRGRRIPCQRRADAAGRHHHLYPRAASRLKPFTAIRRAATRFRVCRGAAFA

SEQ ID NO: 119616 - protein, 84 aa, Glycine max
  Coding DNA Sequence Number=SeqID_2838
  Homolog annotation: Hit_ID=Q9HFI5; Match level="QueryCoverage=83%, HitCoverage=3%, E-value=3e-08, Identity=46%"; Hit description =Related to SEN1 protein
MSNKSAPFHQTKGLGPYVFYDIIDGQEIQGKNSGVMSLCNEQEADAAVEVLRFFKKRYPAEFVGGRIGIITPYKRQLSSAFSFS

SEQ ID NO: 119617 - protein, 109 aa, Glycine max
  Coding DNA Sequence Number=SeqID_2839
LIKVILVASTLTCVYPDLSSFTRSGVYLDLSSFIGSGVIQNSKACIKRSAHSQWHPNLSSFTGSGIYPDLSSFTGSGVYLDLSSFTGSGVIQNSKACIKRSAPSQVHIS

SEQ ID NO: 119618 - protein, 62 aa, Glycine max
  Coding DNA Sequence Number=SeqID_2840
MASVASPLSVEWGINSKKQGTERSRSVGILGPALELATPSLVLLPASLVGLKAELSFSLRES

SEQ ID NO: 119619 - protein, 123 aa, Glycine max
  Coding DNA Sequence Number=SeqID_2841
  Gene Ontology: Mol. function=electron carrier activity; Cellular component=cytoskeleton; Biological process=electron transport
  Homolog annotation: Hit_ID=Q9JKS4-3; Match level="QueryCoverage=57%, HitCoverage=11%, E-value=1e-08, Identity=43%"; Hit description =Isoform 3 of Q9JKS4
MGQFEGPLDESICCFLIRVDPWVLVPIAFRGLHVLDFRGLHILAFRGLQGYTPSPLDDYMSSPTKGYTPSPSEDYTFLPSKDCASSPSKGYTPSPLEGDTPSPSEDYTSLPSEDCTSSPSEDC

SEQ ID NO: 119620 - protein, 234 aa, Glycine max
  Coding DNA Sequence Number=SeqID_2842
  Gene Ontology: Mol. function=chitin binding; Cellular component =extracellular region; Biological process=chitin metabolic process
  Homolog annotation: Hit_ID=UPI000044A8F0; Match level="QueryCoverage =61%, HitCoverage=99%, E-value=1e-15, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRGLHVLTFRGLHILAFRGLHVLTFRGLHVLAFRGLHILAFRGLHALAFRGLHALAFRGSHALALRGPHALTFRGLHVLDFKGVHVLTFRGLHALVRTARPHLQKAERPRLQRITRPHLERPTHPRLRRTICPHLQRATGPRLQGTQVPGPPSDIGGPPTVQAQPEDGAGIAPARHPMDTKKFNRVLGFPALITSLCQFYGVSVAPSRVIRPLTNRAFIKKYYAPRQAQGEAPQ

SEQ ID NO: 119621 - protein, 187 aa, Glycine max
  Coding DNA Sequence Number=SeqID_2843
METPDGYLPTHLCYPVTRESGSMRRRLMVICTSSFRDRKHQVAGGYTQVIICTKITSDNPDPCVRRLVAGGYTTMIIRTKTTSTDPDPGIRTNAPGGRQIYPSDYPCQVAGGYTQVIICTKITSDNPDPRQVASGYTTMIIRTKTTSTDPDPGIRTNAPGGRQIYPSKFTQVTIRTKTTFADPDLGV

SEQ ID NO: 119622 - protein, 198 aa, Glycine max
  Coding DNA Sequence Number=SeqID_2844
  Gene Ontology: Mol. function=signal transducer activity; Cellular component=membrane; Biological process=regulation of transcription, DNA-dependent
  Homolog annotation: Hit_ID=Q8UB13; Match level="QueryCoverage=98%, HitCoverage=37%, E-value=2e-99, Identity=94%"; Hit description=GGDEF family protein
  Pfam annotation: Domain name=GGDEF; Domain location=16-175; Score =116.2; E_value=9.1e-32; Accession=PF00990.12; Description=GGDEF domain
VALTDITARKKAEAYLEYLGKHDVLTKLHNRAFYSDELNRLERSALRPVSAIVIDLNGLKDANDKLGHDAGDALLRRMGEVLNGVVTAPNHAARIGGDEFAILLPGADKQVAAAMVETVYELLKINNQFYSSAPLSLSLGVATSEAGETMESLVRRADMNMYEQKNAYYAALRNRSADNNDKTNAGPQPEASSLKRLS

SEQ ID NO: 119623 - protein, 53 aa, Glycine max
  Coding DNA Sequence Number=SeqID_2845
MLYAQIDAVYATINENLKPGPVSERNYGLYYLMALSTNFLIYIFTCLLFTWEL

SEQ ID NO: 119624 - protein, 33 aa, Glycine max
  Coding DNA Sequence Number=SeqID_2846
MTDNIGNSNRRPNAIPSLGTQAFSFNARKYTYG

SEQ ID NO: 119625 - protein, 84 aa, Glycine max
  Coding DNA Sequence Number=SeqID_2847
MDSVPFIIQEQRVEWNNKLGGKRAETDYAPFIIQEQQAEWINAHRRIFCPLSFRNNKLGGKHAETYSAPFIIQEQQAEWINVHR

SEQ ID NO: 119626 - protein, 160 aa, Glycine max
  Coding DNA Sequence Number=SeqID_2848
  Subcellular localization annotation: CTP_CleavageSite=47; ConfidenceScore=5.59e-01
RPMNSLPSSVHVSSTIESGAPRIHCLALFTNSSFSVLLRRPMNSLPSAVHVSSTNESGAPRIHCLALPANSLPSAVRNFSILNFIRRPMNSLPSAVHVSSTSESGAPRIHCLALLANSLFSNFIQRPMKSLPSAVHVSSTIESGHPRIHCLALFMGPPPT

SEQ ID NO: 119627 - protein, 267 aa, Glycine max
  Coding DNA Sequence Number=SeqID_2849
MATKKRLTKRARKDTAGEGSSAAPQEEIEFDGHHFQEEVARRQWTQLTEPMAKYDPKIVIEFYANAWPIEEGVWGQWIPYDEDAINQFLGHPLVLEEGQRCEFNERRSRVSGFDKEAIGHLLCSPGQDFARSVTGRRVRIMRTSMTMYHASKTPSGPEKSNRALGFSALIASLCQFYGVPVTPTRLIRLLINRSFIEKYCMPRVELYMQHLADHPYPWPTPEQFRATVAWPRDKPNFQAEAGHTEALRDEDGVEEDGDMADVTDFFL

SEQ ID NO: 119628 - protein, 80 aa, Glycine max
  Coding DNA Sequence Number=SeqID_2850
MQLSFRGGSVVSAAGESGGAAVSSDDASEMKIRGGDGGTASSSGKKGGFTTGDCGLAGSELTCTGVGSGRATSLGLTNGS

SEQ ID NO: 119629 - protein, 61 aa, Glycine max
  Coding DNA Sequence Number=SeqID_2851
  Gene Ontology: Mol. function=sequence-specific DNA binding; Cellular component=nucleus; Biological process=regulation of transcription
  Homolog annotation: Hit_ID=Q1T4J9; Match level="QueryCoverage=100%, HitCoverage=10%, E-value=4e-09, Identity=56%"; Hit description=DNA -binding WRKY
MEIASERSGDGSSGLKEENSVGDDDGRHKQEIIVEEPLVANTERSILEAGPSTSPNKKEDE

SEQ ID NO: 119630 - protein, 133 aa, Glycine max
  Coding DNA Sequence Number=SeqID_2852
  Gene Ontology: Mol. function=ATPase activity, coupled to transmembrane movement of substances; Cellular component=integral to membrane; Biological process=transport
  Homolog annotation: Hit_ID=Q8GU67; Match level="QueryCoverage=100%, HitCoverage=63%, E-value=1e-28, Identity=43%"; Hit description=MDR -like ABC transporter
MGGLSILSALPNLTAITEATAAVTRLFEMIDRVPTIDSEDKKGKALSYVRGEIEFQDVYFCYPSRPDTPVLQGFNLTVPAGKSVGLVGGSGSGKSTVIQLFERFYDPVEGVILLDGHKTNRLQLKWLRSQIGL

SEQ ID NO: 119631 - protein, 509 aa, Glycine max
  Coding DNA Sequence Number=SeqID_2853
  Gene Ontology: Mol. function=sequence-specific DNA binding; Cellular component=nucleus; Biological process=regulation of transcription
  Homolog annotation: Hit_ID=Q1T4J9; Match level="QueryCoverage=91%, HitCoverage=77%, E-value=8e-86, Identity=56%"; Hit description=DNA -binding WRKY
  Pfam annotation: Domain name=WRKY; Domain location=155-215; Score =136.6; E_value=6.6e-38; Accession=PF03106.6; Description=WRKY DNA -binding domain
MNIGHQRCNFQDILKQQGTKKNVDKGKADSHEEILEESDLVSLCLGRVPTINARSDEKIKVSNKPLKDDEGFNNEELTLGLECKFETSKSGSTTEALPNNIPSPENSCEVPKEEGGESKEALKTMRDSTEDEVAQQNPTKKPRVCVRARCDTPTMNDGCQWRKYGQKISKGNPCPRAYYRCTIAPSCPVRKQVQRCADDKSILITTYEGTHNHSLPPTATAMASTTSAAASMLLSGSSTSNSNSASIPSATPTNLHGLNFYLSEGSKPRQLYLSNPALSSSPSHPTITLDLTTSHPAASSSSSSPFFRFNSNYNNNNQPRYPSSSSSLSFSSNNSSQIANAISWSNGFLNHNNRDILSSVNFGRQQQMENVYQSYMQKNNSNNNNNNTSLVPQADTISAATKVITADPTFQSALAAALSSFIGGGGVGNTRGSQGCNFGESLSLGQKMKWGEVFPVSEKGCASSFVNKTPVANTQTESLMFLPPSSLPFSSTTKSASASPADNSNTTIN

SEQ ID NO: 119632 - protein, 54 aa, Glycine max
  Coding DNA Sequence Number=SeqID_2854
MEEEIESPHPLCVYGFGMRQFKENARAFEGWRVVGVGSKPVAAEEKRLFSFLKV

SEQ ID NO: 119633 - protein, 162 aa, Glycine max
  Coding DNA Sequence Number=SeqID_2855
  Gene Ontology: Mol. function=small conjugating protein ligase activity; Cellular component=nucleus; Biological process=protein modification process
  Homolog annotation: Hit_ID=P25865; Match level="QueryCoverage=99%, HitCoverage=100%, E-value=2e-81, Identity=89%"; Hit description =Ubiquitin-conjugating enzyme E2-17 kDa 1
  Pfam annotation: Domain name=UQ_con; Domain location=8-155; Score =251.8; E_value=1.4e-72; Accession=PF00179.16; Description=Ubiquitin -conjugating enzyme
MSTPARKRLMRDFKRLQQDPPAGISGAPQDNNIMLWNAVIFGPDDTPWDGGTFKLILQFTEDYPNKPPTVRFVSRMFHPNTTNAIFLLWEVYADGSICLDILQNQWSPIYDVAAILTSIQSLLCDPNPNSPANSEAARMFSENKREYNRRVREIVEQSWTAD

SEQ ID NO: 119634 - protein, 97 aa, Glycine max
  Coding DNA Sequence Number=SeqID_2856
  Gene Ontology: Mol. function=hydrolase activity
  Homolog annotation: Hit_ID=Q8L9J9; Match level="QueryCoverage=74%, HitCoverage=30%, E-value=2e-18, Identity=59%"; Hit description =Probable carbohydrate esterase At4g34215
MAVSCNRGGLGAVSKDIFVLAGQSNMAGPGGVFGGKWEGNAPAECRPSPWVLRRSAGLEWEEAREPLHEDNDVAKTCGVGPGMAFANEVVKARGGCV

SEQ ID NO: 119635 - protein, 64 aa, Glycine max
  Coding DNA Sequence Number=SeqID_2857
MAMLTAFQWPKNINTLHNNISFELDCKVVTDSFSKVTSIQSEFDAIILQAKLLHLLLCSKNTIS

SEQ ID NO: 119636 - protein, 417 aa, Glycine max
  Coding DNA Sequence Number=SeqID_2858
  Homolog annotation: Hit_ID=Q651Y0; Match level="QueryCoverage=95%, HitCoverage=91%, E-value=1e-42, Identity=30%"; Hit description =Transducin / WD-40 repeat protein family-like protein
  Pfam annotation: Domain name=WD40; Domain location=113-151; Score =27.2; E_value=5.8e-05; Accession=PF00400.22; Description=WD domain, G-beta repeat
  Pfam annotation: Domain name=WD40; Domain location=168-204; Score =23.2; E_value=0.00095; Accession=PF00400.22; Description=WD domain, G-beta repeat
  Pfam annotation: Domain name=WD40; Domain location=259-297; Score =21.0; E_value=0.0043; Accession=PF00400.22; Description=WD domain, G- beta repeat
  Pfam module annotation: Pfam domain module=WD40::WD40::WD40; Domain location=113-151::168-204::259-297
  Subcellular localization annotation: CTP_CleavageSite=51; ConfidenceScore=5.44e-01
MSSSSYELILTNSPDGPITVYETTTGTVVARFSGSRSPCRGLTVVGRRLFAASHVSSETGAGSINIYNWFNSTAFHNFPVPEPVAPLIATHDGTFLFGGGISGSLFSISTHSGDVIRSIAAHSRSVSSLHLSDDGSLVISGSDDGTIVVVPTFKIVIIRASLDEDMEDLILHKWKAHSDSVTAFKSVMGTLLSCSLDCTCKFWNLGDNGVLLRIVAFPCAIFGIALDSKGLGFYVAGADGLVYKGAMKAGSRKLLSRVCELSTWSKSHGRSIVSLALVNEGRNLVSAAEDGSVWMWDVDKGEVVMDMGNEVVMVNISDMVVARGNGEFGVRKGNNVAIEEGNGSFTSYGLCDEEMIKTLEQITKLGEVRGEVEQHKKKVIGMLESTIEMYERFLKLILKEATKAIEEGGVEDDKDEE

SEQ ID NO: 119637 - protein, 84 aa, Glycine max
  Coding DNA Sequence Number=SeqID_2859
  Homolog annotation: Hit_ID=Q1T4I1; Match level="QueryCoverage=76%, HitCoverage=11%, E-value=2e-23, Identity=86%"; Hit description=IQ calmodulin-binding region
  Pfam annotation: Domain name=IQ; Domain location=15-35; Score=21.5; E_ value=0.0031; Accession=PF00612.17; Description=IQ calmodulin-binding motif
  Pfam annotation: Domain name=IQ; Domain location=41-61; Score=3.2; E _value=18; Accession=PF00612.17; Description=IQ calmodulin-binding motif
  Pfam module annotation: Pfam domain module=IQ::IQ; Domain location=15- 35::41-61
MGVSFMKARRAFRALKGIIRLQALIRGHLVRRQAVATLCSMYGIVKFQALVRGGIVRHSNVGSEIQEKCNILNPLKKLVHYTGC

SEQ ID NO: 119638 - protein, 422 aa, Glycine max
  Coding DNA Sequence Number=SeqID_2860
  Homolog annotation: Hit_ID=Q1T4I1; Match level="QueryCoverage=87%, HitCoverage=63%, E-value=1e-151, Identity=74%"; Hit description=IQ calmodulin-binding region
MVLQLQYVPGDPNSVLSWLERWSASHFWKPVPQPKKIRDTKSHRKHGNISVGDTHMSKSKRTNRKLPTASFDSVPVQAHPEFEKPKRNMRKIPSQSSDPPVQENPQSELEKIKRNLRKVHNPVVENAVPSEVESETPKDHLEKATVTSCLAVSEQEVISSNEKIKKEATLIVSSVPDIETTPRLSVSKEVLDSPSSYQVTVESKPLTEITTKDKNIHVSDEVKNEPIDLPEPICKDENSHLTNGDLSHKEDQIGSENQKPNGKASIVAKQERAENGIQNSPALPSYMAATESAKAKLKAQGSPRFGQDGSEKNNHTRRHSLPSSTNCKISSHSPRTLRQVQSGGKGGHRSDRTVSSSRDGNGKVIQAEWRRTYLGRQIDLRGFLLETNPQPGSDLKHFAMSVLLRGMAKDIFRQEEQRNRGV

SEQ ID NO: 119639 - protein, 164 aa, Glycine max
  Coding DNA Sequence Number=SeqID_2861
  Gene Ontology: Mol. function=nucleoside-triphosphatase activity; Cellular component=integral to membrane; Biological process=transport
  Homolog annotation: Hit_ID=Q1SCG9; Match level="QueryCoverage=96%, HitCoverage=17%, E-value=1e-47, Identity=62%"; Hit description =Probable ABC-type transport protein T23J7.110-Arabidopsis thaliana
  Subcellular localization annotation: CTP_CleavageSite=69; ConfidenceScore=5.20e-01
MVASIFSNVKTATVTAYIGVFGTGLLAVFLFQFFVQNTSFPRGWIIVMEFYPGFALYRGLYELAQFSFQGSSSGSGGMKWQNLSESTNGMKEVLIIMFVEWIVMLFAAFYVDQVLLSGSRKSPLFYLKGFQKRPPFQKLDAQMQGSKVFSQTEKPDVIQEVSIT

SEQ ID NO: 119640 - protein, 342 aa, Glycine max
  Coding DNA Sequence Number=SeqID_2862
  Gene Ontology: Mol. function=nucleoside-triphosphatase activity; Cellular component=integral to membrane; Biological process=transport
  Homolog annotation: Hit_ID=Q1SCH7; Match level="QueryCoverage=93%, HitCoverage=32%, E-value=2e-73, Identity=48%"; Hit description=ABC transporter, putative
  Subcellular localization annotation: CTP_CleavageSite=14; ConfidenceScore=5.27e-01
MANPVPASFWTQANALLRKNLTFHKRNVKTNAQLVLFPLILFLLLFALQRLIDTQFGGSIFKCGCVCANNTTTTTQEQHSRCPDSEKVCGIHYSDSIQAAFCAIPNPIEWPPLLQLPAPPNRAARTPSLPLPDFPDASCRRTDSCPLTLLFTALNHSFAETVSANMFGSALNVSDFGSDFLASLAMNVLGSESTPGSNNFIEPAFSSGLPIYYLQTKCTDTEKSGLSFPSLPAADNEIKCDQALNLWRNSSSEINSELYKGYQRGNSDGQVNEIVSAFDFLNSNGNGYNVCIWYNSTYERHTGFGPSSVLLRIPRSINLVYTSKTCFNCCILFAVILTMDTT

SEQ ID NO: 119641 - protein, 99 aa, Glycine max
  Coding DNA Sequence Number=SeqID_2863
  Gene Ontology: Mol. function=isomerase activity; Cellular component =periplasmic space; Biological process=carbohydrate metabolic process
  Homolog annotation: Hit_ID=Q1SCH9; Match level="QueryCoverage=96%, HitCoverage=27%, E-value=4e-38, Identity=75%"; Hit description=Non -cell-autonomous protein pathway1
MSKAHKHHKKIGFYELKRGDLRLNLTNYGATIISVITPDKHGKLADIVLGYDSIDSYKNDTVYFGALIGRVANRIRGAKFTLDGKTYKLPANDHGNTLH

SEQ ID NO: 119642 - protein, 123 aa, Glycine max
  Coding DNA Sequence Number=SeqID_2864
MFEIREKLFTLVLQLGIRAGCRRPPFAAAPSPAAVISGVQIASKSATQPCNLRRHSPPHAPPCTASSSATSGACSARAAVPASEATSSGPSSFVVASWVYFRLHLPLPASRLVNSCVFSSLMC

SEQ ID NO: 119643 - protein, 181 aa, Glycine max
  Coding DNA Sequence Number=SeqID_2865
  Gene Ontology: Mol. function=isomerase activity; Cellular component =periplasmic space; Biological process=carbohydrate metabolic process
  Homolog annotation: Hit_ID=Q8LFH1; Match level="QueryCoverage=98%, HitCoverage=50%, E-value=2e-62, Identity=62%"; Hit description =Aldose 1-epimerase-like protein
  Pfam annotation: Domain name=Aldose_epim; Domain location=1-177; Score=7.6; E_value=1.4e-08; Accession=PF01263.10; Description=Aldose 1-epimerase
MIAKPVDKATPVNLAQHTYWNLRGHNSGDILSHTVQIFGSHITPVDRLLIPTGEIISVKGTPYDFLEPKKVGSQIQEGLYDMNYVLDKSFKKHLSKVVVVTDPVSGRKLELWSNQLGLQFYTSGQLNATKGKDGAVYRKHAGIALETQGFPDSVNYPYFPSQIVRPGEIYKHTMLYRFTTS

SEQ ID NO: 119644 - protein, 408 aa, Glycine max
  Coding DNA Sequence Number=SeqID_2866
  Gene Ontology: Mol. function=protein binding; Cellular component =nucleus
  Homolog annotation: Hit_ID=Q6L3I4; Match level="QueryCoverage=83%, HitCoverage=67%, E-value=1e-111, Identity=57%"; Hit description =Kelch repeat-containing F-box family protein, putative
  Pfam annotation: Domain name=Kelch_1; Domain location=195-240; Score =44.2; E_value=4.6e-10; Accession=PF01344.15; Description=Kelch motif
  Pfam annotation: Domain name=Kelch_1; Domain location=242-288; Score =45.4; E_value=2e-10; Accession=PF01344.15; Description=Kelch motif
  Pfam annotation: Domain name=Kelch_2; Domain location=104-143; Score =7.9; E_value=3.5; Accession=PF07646.5; Description=Kelch motif
  Pfam annotation: Domain name=Kelch_2; Domain location=195-240; Score =20.5; E_value=0.006; Accession=PF07646.5; Description=Kelch motif
  Pfam annotation: Domain name=Kelch_2; Domain location=242-288; Score =13.6; E_value=0.61; Accession=PF07646.5; Description=Kelch motif
  Pfam annotation: Domain name=Kelch_2; Domain location=298-338; Score =4.9; E_value=8.7; Accession=PF07646.5; Description=Kelch motif
  Pfam module annotation: Pfam domain module=Kelch_1::Kelch_1::Kelch _2::Kelch_2::Kelch_2::Kelch_2; Domain location=195-240::242-288::104 -143::195-240::242-288::298-338
MGTLERFSTEEDERPRKFSKLSDDPEEEDAMQIDMGSLLASQDQGNDHPKHAPKKTGKVVRDPKWLVNEDVSTGVLLHLSRYEYGSIASLNRNFLSLIRSGELYRVRRKLGVVEHWVYFSCNILEWEVFDPINGHWMHLPRMPCNPYDCFVFSDKESLAVGTELLVFGRAIEACIVYEYSLLTNKWSHGIQMSVPRCLFASASHGEKAIVAGGSAEGKILSVAELYNSDTKTWEVLPNMNKARKMCSGVFMDGKFYAIGGMGEDGNRLTCGEEYDLDTKEWRVIPNMVPPRIQGPDGPEAPPLVAVVNNVLYAADYAQMVMRKYVKERNNWVYVGGLPEGASSVNGWGYAFRACGDRIVVIGGERTMGGESMVEINSWIPAQGAPQWNLLARRCIGGNFVYNCAVMGC

SEQ ID NO: 119645 - protein, 113 aa, Glycine max
  Coding DNA Sequence Number=SeqID_2867
  Gene Ontology: Mol. function=transition metal ion binding; Cellular component=chloroplast thylakoid membrane
  Homolog annotation: Hit_ID=Q9M2Z4; Match level="QueryCoverage=89%, HitCoverage=41%, E-value=8e-24, Identity=58%"; Hit description =Putative steroid-binding protein 2
MGLYTSVMEEISFYTGLSPAAFFTILAMMVVVYRTVSGMFVSPEDYNKPPVVSARANSRLDESEPPREPVQLGEITDRELRAYDGSDPSKPLLMAIKGQIYDVSNGSWSRLIA

SEQ ID NO: 119646 - protein, 109 aa, Glycine max
  Coding DNA Sequence Number=SeqID_2868
MDELKILNIPSEMFKLFNHSIFPHQGHLIRVFQRKFKTPYYSTQHIRDTKSDRRKRERRRHFKEKMSLEEAHHHRRPWIRAWRKKEMNGGRGREEHEILCSKRALKSEV

SEQ ID NO: 119647 - protein, 54 aa, Glycine max
  Coding DNA Sequence Number=SeqID_2869
MEDVPVSPTSPFHRRSTIESHIEILFVSRCWVIDYPKIQILSSSKTGLGIRLPS

SEQ ID NO: 119648 - protein, 70 aa, Glycine max
  Coding DNA Sequence Number=SeqID_2870
MDYAPLMVSFSSSINFSIRSDDPSDKEGCCERAVSAYSGMILAVLRISMSPWRELVTVITAEHGGGRARS

SEQ ID NO: 119649 - protein, 208 aa, Glycine max
  Coding DNA Sequence Number=SeqID_2871
CATAACRGGTIAEVHLRSPVEDRTPDAELRDKEYAEFQEEIARRQWAQLVSPMAKFDLEIVMEFYANVWPTEEGVKDKCPWASIASLARGGVRPLASMRRLSAICCVFRGKTLPKADYASETPSGPGEVQQGPRISYSDHKPFLVLWSGQATQQPDEDQQQPAANAPPPHLEEAINHSGQVQLNKTCYHYNMHQQSQDPNPFPWTTPE

SEQ ID NO: 119650 - protein, 163 aa, Glycine max
  Coding DNA Sequence Number=SeqID_2872
  Gene Ontology: Mol. function=microtubule binding; Cellular component =phragmoplast; Biological process=negative regulation of microtubule polymerization
  Homolog annotation: Hit_ID=Q1SCI5; Match level="QueryCoverage=80%, HitCoverage=45%, E-value=7e-65, Identity=88%"; Hit description =Microtubule-associated protein EB1-like protein
  Pfam annotation: Domain name=CH; Domain location=14-115; Score=52.0; E_value=1.9e-12; Accession=PF00307.21; Description=Calponin homology (CH) domain
MASSIGMMDSAYFVGRNQILTWINNRLHLNLSRIEEAASGAVQCQMMDMTFPGVVPMHKVNFDAKTEYDMIQNYKILQDVFNKLKIDKHVEVSRLVKGRPLDNLEFLQWLKRYCDSVNGGIMNENYNPVERRATLSVRTEPLVSYLVWFNSDSKFSISSDGFA

SEQ ID NO: 119651 - protein, 110 aa, Glycine max
  Coding DNA Sequence Number=SeqID_2873
MTLVKIAFAAIVLAVIACNGFGFTSISRMSGPNECHRSNECTLILPYCNGEAICRNGFCMCDQTKETKEECSTPDCKNMVKCATLMCFPPCDTPYLNMETGECKCLCPND

SEQ ID NO: 119652 - protein, 154 aa, Glycine max
  Coding DNA Sequence Number=SeqID_2874
  Gene Ontology: Mol. function=transcription regulator activity; Cellular component=nucleus; Biological process=regulation of transcription
  Homolog annotation: Hit_ID=Q1W7D6; Match level="QueryCoverage=67%, HitCoverage=77%, E-value=2e-07, Identity=38%"; Hit description=DNA -binding protein
MEKNELKEENCSLETQIEKLQGQIQARLAQCKPDLNVPPHLELEPLEQTNFPGQNLQLHTIEPNLQQGSAILVVPCNPDLPPSFPAPNVTGVMPKSTSVVSKPHASIGLTCQLAFPIAKPLWSFHALKPLVTCRNVFAVLFHGTISDVYLALSF

SEQ ID NO: 119653 - protein, 84 aa, Glycine max
  Coding DNA Sequence Number=SeqID_2875
  Gene Ontology: Mol. function=transcription regulator activity; Cellular component=nucleus; Biological process=regulation of transcription
  Homolog annotation: Hit_ID=Q2R1K8; Match level="QueryCoverage=79%, HitCoverage=27%, E-value=7e-09, Identity=61%"; Hit description=Helix- loop-helix DNA-binding domain containing protein, expressed
MGSESAAPMVETSKNRSSSDKMNQGKVPRKIHKAEREKMKREHLNDLFLDLASALGNRLCHHHVAKRLAQSDRVPQERECHSVV

SEQ ID NO: 119654 - protein, 413 aa, Glycine max
  Coding DNA Sequence Number=SeqID_2876
  Gene Ontology: Mol. function=catalytic activity; Biological process =regulation of transcription
  Homolog annotation: Hit_ID=Q1SCJ0; Match level="QueryCoverage=98%, HitCoverage=100%, E-value=1e-117, Identity=59%"; Hit description=TCP- domain protein
  Pfam annotation: Domain name=TCP; Domain location=69-324; Score =157.8; E_value=2.9e-44; Accession=PF03634.4; Description=TCP family transcription factor
MEGGDDLQHHHRQNNFPFQLLEKKEDQETASCSTSSPYPSLAISAEPSMSNSTRSNQLSAAEASAEAANSKKPPPKRTSTKDRHTKVDGRGRRIRMPALCAARVFQLTRELGHKSDGETIEWLLQQAEPAVIAATGTGTIPANFTSLNISLRSSGSSMSVPSQLRSSYFNPNFSLQQQQRRTFFPGIALSSEHNTTTNNTSTLVNFQQSNNLTTTMLQQQAKPELRDGLPSSLDISDTRTNTEDPSRKRRPTTEQQDLSPTTQQQHHQMGSYLLQSSAGAIPASHAANIWMVANSNSNQVMSGDPMWTFPPVNNSALYRGTMSSGLHFMNFPTPMALLPSQQLGSAGNIGAVHGGSSNNNNHNNNMNEAHLSMLAGLSPYRPVIGVSESQPSGSQSHRGGADDRHDNSSSHHS

SEQ ID NO: 119655 - protein, 225 aa, Glycine max
  Coding DNA Sequence Number=SeqID_2877
  Gene Ontology: Mol. function=transporter activity; Cellular component= membrane; Biological process=oligopeptide transport
  Homolog annotation: Hit_ID=Q2QLL1; Match level="QueryCoverage=73%, HitCoverage=28%, E-value=1e-30, Identity=42%"; Hit description=POT family protein, expressed
MENVMNTDSHGALELEHERTPAPPSSSSAAVCASKKSRRGSLTITLTAGLGLLSIGAGGFRPCNIAFGADQFDTNTEKGRGQLESLFYWWYFTFPIVLVVALTVVVYIQTNISWTLGFAIPTACVAFSITIFLFGRHTYICKEPQGSIFTDMAKVIVAAFQKHNIQASGRAIYNPAPASTLENDRIVQTDGFKLLDKAAIISDPNELNDQGMARNVWRLCSLQQV

SEQ ID NO: 119656 - protein, 73 aa, Glycine max
  Coding DNA Sequence Number=SeqID_2878
MRGKRACIGGHDLNLNRLDLYYYFIAALGVLNFIYFNFFATRYIISDEEDEITEVQPENSIAVGESSEPNDEK

SEQ ID NO: 119657 - protein, 59 aa, Glycine max
  Coding DNA Sequence Number=SeqID_2879
MYVLCPVHEGFADLRWKQRSGPAYPPQNQHIFCNNVAWKLASYNSIKLKGQCMFGPTRA

SEQ ID NO: 119658 - protein, 46 aa, Glycine max
  Coding DNA Sequence Number=SeqID_2880
MTTDQPPLPMAHICPGIGPNIKRLNSLTTPQWSRHLSQPTLRRGCG

SEQ ID NO: 119659 - protein, 132 aa, Glycine max
  Coding DNA Sequence Number=SeqID_2881
  Gene Ontology: Mol. function=molecular_function; Cellular component =cellular_component; Biological process=biological_process
  Homolog annotation: Hit_ID=Q9ZVJ2; Match level="QueryCoverage=85%, HitCoverage=53%, E-value=3e-50, Identity=79%"; Hit description =Uncharacterized protein At2g38710
  Pfam annotation: Domain name=AMMECR1; Domain location=4-131; Score= -28.8; E_value=1.8e-07; Accession=PF01871.8; Description=AMMECR1
MVSANKEMVVYCFDTLLAHYNSTEAPSPAFDQAQHPLFVTWKKVVNGGDPRLRGCIGTLEARSLINGLKDYALTSALRDRRFPPIQANELPLLECTVSLLTDYEAANHYLDWEVCADLLVLVSGILLAELKC

SEQ ID NO: 119660 - protein, 218 aa, Glycine max
  Coding DNA Sequence Number=SeqID_2882
  Homolog annotation: Hit_ID=Q8H6Q8; Match level="QueryCoverage=47%, HitCoverage=3%, E-value=2e-10, Identity=33%"; Hit description=CTV.20
  Subcellular localization annotation: CTP_CleavageSite=79; ConfidenceScore=5.86e-01
MLPTATSSFGRGGRSSKGTVLAPPEPNTKKASSTSSGSSTQAGSSTQKSKLEGSLTQLTIKPESSTQESPKPITTKQTMADYACQKDLAEMASESDDDSKTELRKQIQIVKQTKTMEPEYWEKNPFKATAKAFPEGFHYKPTTLNKTRKFYEFILVDTNSVSIKHFKDPKDPNLNTHSTIQILKVMQPRHYRSNLNQPKKFSASFDPAGDTYWDYIDA

SEQ ID NO: 119661 - protein, 90 aa, Glycine max
  Coding DNA Sequence Number=SeqID_2883
  Subcellular localization annotation: CTP_CleavageSite=48; ConfidenceScore=5.07e-01
MARFSSTGYASHLLGLPSWHCGKHNHKLNAISPRNNKSTSISEVPLCTKSLKGEPSLRIIWTEHHNNTDPINTSWWKPSIDHHLVTSHNF

SEQ ID NO: 119662 - protein, 240 aa, Glycine max
  Coding DNA Sequence Number=SeqID_2884
  Gene Ontology: Mol. function=transition metal ion binding; Biological process=cytoskeleton organization and biogenesis
MGIFKRHHACPICEKETSCIQLKHGKKTVDTRYRRFLKPYHPYRQLKKAFNGSQEIESVPKPLVGHQIVDQANYIITIFGKTQKKDASEKNIRKKRCMTLYRNNACREKCVEGYTKNQYLPDASIVERYIAEEAIEFCSEYIETATPVGLPQSFHDCTWEGRGTRGLNVVTMDHRDVSQVHLYVLTNTPKVIPYIDAHKQNVTVTHPKMNMMRVLYKNTIEHSSTSLEKQSSLMTMLPKH

SEQ ID NO: 119663 - protein, 142 aa, Glycine max
  Coding DNA Sequence Number=SeqID_2885
MRDDEKRKVQDDQKGKNILTYGLSSAEFFRTARYKSAKEIWNMLEVNHKGTTDNLGAKDYNYQGIQESCYNDNGSSLRKSNDRKFSKSSKKVDNSNNNRYTCFECGRGKQGHIKSEHPIYLEKHGGEKKAKKDRKQKKAYNT

SEQ ID NO: 119664 - protein, 84 aa, Glycine max
  Coding DNA Sequence Number=SeqID_2886
MKMDEANLISSPMVGSCKLTKSRYDSFPDLTLYREKVMAKQLQVIHVPAIDQRVDILTKVFTPLNFTTYKSKLIVVKRHFANPS

SEQ ID NO: 119665 - protein, 163 aa, Glycine max
  Coding DNA Sequence Number=SeqID_2887
  Gene Ontology: Mol. function=nucleic acid binding; Biological process= DNA integration
  Homolog annotation: Hit_ID=Q1SRN1; Match level="QueryCoverage=46%, HitCoverage=5%, E-value=4e-26, Identity=68%"; Hit description =Integrase, catalytic region
  Subcellular localization annotation: CTP_CleavageSite=7; ConfidenceScore=5.07e-01
MGVKPPKVFNNGPQMKLGCNSLFTHPHFAKYTPVFVFLAGFTPKHPGALRIPWRWVLKILKWSNEIRMPTKNGPSMKLGYDMYKDKVKENPNGTISKYKAILVAKGFRQQLGYDYNENLSPLIKPVTVRILLSLAITHKWGLQQLDVNNAFLNDILEEDIYMS

SEQ ID NO: 119666 - protein, 106 aa, Glycine max
  Coding DNA Sequence Number=SeqID_2888
MLVVWSIQSYDKELFEDRGRFIGTKDNAYVAGGDASEGLMTLQMLPVTLMGLIRKRETAWENQGNTVSNLVVCVIVLHFGFSFPLSLCLISNLASDLKQEGDGNAF

SEQ ID NO: 119667 - protein, 114 aa, Glycine max
  Coding DNA Sequence Number=SeqID_2889
  Gene Ontology: Mol. function=nucleoside-triphosphatase activity
  Homolog annotation: Hit_ID=Q1SFG1; Match level="QueryCoverage=84%, HitCoverage=12%, E-value=5e-26, Identity=63%"; Hit description=AAA ATPase
MEKSLLIVEEANLSSRSFSGRVSDDKANRSGRKGMVLPFQPLFLTFDEIKYSLDMAQEMKKQGVFEERRELLKGVSGVFRPRVLTALMGAIQGVPKIKKVIILQPGCWKLHQQA

SEQ ID NO: 119668 - protein, 220 aa, Glycine max
  Coding DNA Sequence Number=SeqID_2890
  Gene Ontology: Mol. function=protein binding; Cellular component =nucleus; Biological process=nucleosome assembly
  Homolog annotation: Hit_ID=Q94F78; Match level="QueryCoverage=79%, HitCoverage=68%, E-value=5e-57, Identity=62%"; Hit description =Nucleosome/chromatin assembly factor A
  Pfam annotation: Domain name=NAP; Domain location=27-198; Score=44.8; E_value=4.3e-14; Accession=PF00956.9; Description=Nucleosome assembly protein (NAP)
MVGDNTKKLKVAENLEDSIDGELVLSIEKLQEVQDELDKINEEASDKVLEVEQKYNEIRKPVYNKRNDVVKSIPDFWFTAFMSHPALYELLNVEDQKIFMYLGSLDVEDNKDVKSGYSITFNFNPNPYFENIKLTKTFTFLEEGTTKITATPIKWKEGKGLPNGLDHDKNGNKRVVLISVDESHGHAALGFLLFDIVDVPLSCLLPSCLLCGMWFMRDGH

SEQ ID NO: 119669 - protein, 773 aa, Glycine max
  Coding DNA Sequence Number=SeqID_2891
  Gene Ontology: Mol. function=helicase activity; Cellular component =mitochondrion; Biological process=embryonic development ending in seed dormancy
  Homolog annotation: Hit_ID=Q69L95; Match level="QueryCoverage=93%, HitCoverage=97%, E-value=0.0, Identity=53%"; Hit description =Putative fertility restorer homologue
  Pfam annotation: Domain name=PPR; Domain location=112-146; Score =20.0; E_value=0.0084; Accession=PF01535.11; Description=PPR repeat
  Pfam annotation: Domain name=PPR; Domain location=147-181; Score =22.5; E_value=0.0015; Accession=PF01535.11; Description=PPR repeat
  Pfam annotation: Domain name=PPR; Domain location=182-216; Score =34.2; E_value=4.6e-07; Accession=PF01535.11; Description=PPR repeat
  Pfam annotation: Domain name=PPR; Domain location=217-251; Score =29.3; E_value=1.3e-05; Accession=PF01535.11; Description=PPR repeat
  Pfam annotation: Domain name=PPR; Domain location=252-286; Score =27.5; E_value=4.7e-05; Accession=PF01535.11; Description=PPR repeat
  Pfam annotation: Domain name=PPR; Domain location=287-321; Score =48.9; E_value=1.7e-11; Accession=PF01535.11; Description=PPR repeat
  Pfam annotation: Domain name=PPR; Domain location=322-356; Score =43.2; E_value=9.1e-10; Accession=PF01535.11; Description=PPR repeat
  Pfam annotation: Domain name=PPR; Domain location=357-391; Score =39.2; E_value=1.4e-08; Accession=PF01535.11; Description=PPR repeat
  Pfam annotation: Domain name=PPR; Domain location=392-426; Score =38.4; E_value=2.5e-08; Accession=PF01535.11; Description=PPR repeat
  Pfam annotation: Domain name=PPR; Domain location=41-75; Score=16.6; E_value=0.081; Accession=PF01535.11; Description=PPR repeat
  Pfam annotation: Domain name=PPR; Domain location=427-461; Score =35.2; E_value=2.3e-07; Accession=PF01535.11; Description=PPR repeat
  Pfam annotation: Domain name=PPR; Domain location=462-496; Score =44.0; E_value=4.9e-10; Accession=PF01535.11; Description=PPR repeat
  Pfam annotation: Domain name=PPR; Domain location=497-531; Score =55.3; E_value=2.1e-13; Accession=PF01535.11; Description=PPR repeat
  Pfam annotation: Domain name=PPR; Domain location=532-566; Score =52.2; E_value=1.8e-12; Accession=PF01535.11; Description=PPR repeat
  Pfam annotation: Domain name=PPR; Domain location=567-601; Score =23.3; E_value=0.00084; Accession=PF01535.11; Description=PPR repeat
  Pfam annotation: Domain name=PPR; Domain location=603-637; Score =35.6; E_value=1.8e-07; Accession=PF01535.11; Description=PPR repeat
  Pfam annotation: Domain name=PPR; Domain location=638-672; Score =20.2; E_value=0.0075; Accession=PF01535.11; Description=PPR repeat
  Pfam annotation: Domain name=PPR; Domain location=673-707; Score =24.4; E_value=0.00041; Accession=PF01535.11; Description=PPR repeat
  Pfam annotation: Domain name=PPR; Domain location=77-111; Score=15.0; E_value=0.12; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR; Domain location=112-146::147-181::182-216::217-251::252-286::287 -321::322-356::...
  Pfam module annotation: Domain location=357-391::392-426::41-75::427 -461::462-496::497-531::532-566::567-601::603-637::638-672::673 -707::77-111
MSRTLLPKHVAAVVKIQTDPLKALEMFNSAKSEDGFKHTASTYKCIVQKLGHHGEFEEMEKLLSEMRENVNNALLEGAYIEAMKNYGRKGKVQEAVDTFERMDFYNCDPSVHSHNAIMNILVEFGYHNQAHKVYMRMRDRGVQSDVYTYTIRIKSFCKTARPYAALRLLRNMPELGCDSNAVAYCTVVAGLYDSGEHDHARELFDEMLARCLCPDVVAFNKLVHVLCKKGLVFESERLLGKVLKRGVCPNLFTFNIFVQGLCREGALDRAVRLLASVSREGLSLDVVTYNILICGLCRNSRVVEAEEYLRKMVNGGFEPDDLTYNSIIDGYCKKGMVQDANRVLKDAVFKGFKPDEFTYCSLINGFCKDGDPDRAMAVFKDGLGKGLRPSIVLYNTLIKGLSQQGLILPALQLMNEMAENGCLPNIWTYNLVINGLCKMGCVSDASHLVDDAIAKGCPPDIFTYNTLIDGYCKQLKLDSATEMVNRMWSQGMTPDVITYNTLLNGLCKAGKSEEVMEIFKAMEEKGCTPNIITYNIIVDSLCKAKKVNEAVDLLGEMKSKGLKPDVVSFGTLFTGFCKIGDIDGAYQLFRRMEKQYDVCHTTATYNIIVSAFSEQLNMNMAMKLFSVMKNSGCDPDNYTYRVVIDGFCKMGNITQGYKFLLENMEKRFIPSLTTFGRVLNCLCVKDKVHEAVGIIHLMLQKGIVPETVNTIFEADKKVVAAPKILVEDLLKKGHIAYYTYELLYDGIRDKKILKKRLPTVNSLHRGASSSAVD

SEQ ID NO: 119670 - protein, 454 aa, Glycine max
  Coding DNA Sequence Number=SeqID_2892
  Gene Ontology: Mol. function=transcription regulator activity; Cellular component=nucleus; Biological process=regulation of transcription
  Homolog annotation: Hit_ID=UPI0000546467; Match level="QueryCoverage =51%, HitCoverage=19%, E-value=4e-22, Identity=30%"; Hit description =PREDICTED: similar to Activating signal cointegrator 1 (ASC-1) (Thyroid receptor ...
  Homolog annotation: Hit description=interacting protein 4) (Trip-4)
  Pfam annotation: Domain name=zf-C2HC5; Domain location=198-250; Score= 110.2; E_value=5.9e-30; Accession=PF06221.3; Description=Putative zinc finger motif, C2HC5-type
MESAGEWLEKALVELCSKIETGLGLGLDQDIIKGLVSYCDLAEPRDAKEYLDFILQVIKVSDLSTSCKSWTLGFNNIIGQDAGKTVIEEYLRRRGYSESSIGSNVPTTKLHAYVKPPSVETSASGTKKSFKTPKVAGRGNHAEPNKNASSSNQENQTPTVVSESKTSQKGNQLNSKKKKAGKVVSLAEAAKGSIVFQQGRPCSCQARRHGLVSNCLSCGKIVCEQEGEGPCHFCGALVLREGSSYAGLEESLPPLSESEAVAEAYAKRLVEYDRNSAARTTVIDDQSDYYEIDGNSWLSKEEKELLKKKQEEMEEAEKAKRNRVVVTFDLVGRKVLVNKDEASELQFENRILRPPDAREVNRIKPNPTLTFQPVFVDLGFGRKSTKDKQSHKGISKGLCLEITGRVQHDRNDQKYVMMENQLATASNENVWQVSSGNGMHIMEDDGQCLLNYDK

SEQ ID NO: 119671 - protein, 119 aa, Glycine max
  Coding DNA Sequence Number=SeqID_2893
MDAMELCSLNRCNEIFHHLLIEHVSTTTRIRLYNHRPLHFAAATTTTATSSGPTTSAREASDDGPMALSSVMMSTLLIQSNLGLEAGALEQGARDHYGDHHHHEESKDIWEALSSSSIN

SEQ ID NO: 119672 - protein, 419 aa, Glycine max
  Coding DNA Sequence Number=SeqID_2894
  Gene Ontology: Mol. function=hydrolase activity; Cellular component =chloroplast thylakoid membrane; Biological process=aromatic compound metabolic process
  Homolog annotation: Hit_ID=UPI000038DD6B; Match level="QueryCoverage =75%, HitCoverage=91%, E-value=5e-37, Identity=32%"; Hit description =COG0596: Predicted hydrolases or acyltransferases (alpha/beta hydrolase superfamily)
  Pfam annotation: Domain name=Abhydrolase_1; Domain location=149-409; Score=-14.4; E_value=0.1; Accession=PF00561.10; Description =alphabeta hydrolase fold
  Subcellular localization annotation: CTP_CleavageSite=67; ConfidenceScore=5.35e-01
MTVILPTPTKNLINFALSPQPFEALHPLMALSTTFMPPSSPKLNLYSKIRRPFYPHSVRFLNPLKIRASTTLDYSNVSTNDKSPPLKTSNWQWKFKDNLINIYYEEHVKESPEPSQNILMMPTISDVSTVEEWRLVAGDIAQRNGNTNWRATIVDWPGLGYSDRPKMDYNADVLEKFLVDFINSPNGPMKQPGHAASIVARAAKKGLVKPKAIAAVAPTWAGPLPIVFGRDSSMETSHVCDDHLTLFHSINNWHFFSLSRKPDRYGLLRGTLKAPAVGWMMYNMLVSNENAIQSQYKSHVYANPDNVTPGIVESRYALTKRKGARYLPAAFLTGQLDPVTSREEFLELFTALEGKTPVLVVSTKGSPKRSKAEMEALKGAKGVTKFVEVPGALLPQEEYPALVAEELYQFLQEYFGTVA

SEQ ID NO: 119673 - protein, 494 aa, Glycine max
  Coding DNA Sequence Number=SeqID_2895
  Gene Ontology: Mol. function=metal ion binding; Cellular component =intracellular; Biological process=thiamin biosynthetic process
  Homolog annotation: Hit_ID=Q6ZLQ1; Match level="QueryCoverage=99%, HitCoverage=79%, E-value=1e-121, Identity=39%"; Hit description =Putative pentatricopeptide (PPR) repeat-containing protein
  Pfam annotation: Domain name=PPR; Domain location=188-222; Score =49.4; E_value=1.2e-11; Accession=PF01535.11; Description=PPR repeat
  Pfam annotation: Domain name=PPR; Domain location=223-257; Score =13.4; E_value=0.19; Accession=PF01535.11; Description=PPR repeat
  Pfam annotation: Domain name=PPR; Domain location=24-58; Score=18.6; E_value=0.023; Accession=PF01535.11; Description=PPR repeat
  Pfam annotation: Domain name=PPR; Domain location=259-293; Score =11.0; E_value=0.37; Accession=PF01535.11; Description=PPR repeat
  Pfam annotation: Domain name=PPR; Domain location=86-120; Score=38.3; E_value=2.6e-08; Accession=PF01535.11; Description=PPR repeat
  Pfam module annotation: Pfam domain module=PPR::PPR::PPR::PPR::PPR; Domain location=188-222::223-257::24-58::259-293::86-120
MYAECGDSGSARRVFDEMSEPNVVTWNAVLTAAFRCGDVEGAQDVFGCMPVRNLTSWNGMLAGYAKAGELGLARRVFYEMPLRDEVSWSTMIVGFAHNGCFDEAFGFFRELLREEIRTNEVSLTGVLSACAQAGAFEFGKILHGFVEKAGFLYVGSVNNALIDTYSKCGNVAMARLVFQNMPVARSIVSWTSIIAGLAMHGCGEEAIQLFHEMEESGVRPDGITFISLLYACSHSGLVEEGCGLFSKMKNLYGIEPAIEHYGCMVDLYGRAARLQKAYEFICEMPVSPNAIIWRTLLGACSIHGNIEMAELVKARLAEMDPDNSGDHVLLSNVYAVAGKWKDVSSIRRTMTEHSMKKTPGWSMIEIDKVIYGFVAGEKPNEVTEEAHEKLREIMLRLRTEAGYAPQLRSVLHDIEEEEKEDSVSKHSEKLAAAFGIAKLPKGRILRIVKNLRVCGDCHTVMKLISKVYQVEIIVRDRSRFHSFKDGFCSCRDYW

SEQ ID NO: 119674 - protein, 60 aa, Glycine max
  Coding DNA Sequence Number=SeqID_2896
MVEGEECGGGCSSASTTMKNSRCTFRIQSTFQFGRCKNTELPTRYEITKKGRKEDEAARS

SEQ ID NO: 119675 - protein, 540 aa, Glycine max
  Coding DNA Sequence Number=SeqID_2897
  Gene Ontology: Mol. function=protein serine/threonine kinase activity; Cellular component=integral to membrane; Biological process=protein amino acid phosphorylation
  Homolog annotation: Hit_ID=Q9FM23; Match level="QueryCoverage=60%, HitCoverage=57%, E-value=1e-150, Identity=78%"; Hit description =Receptor-like protein kinase
  Pfam annotation: Domain name=HPP; Domain location=399-532; Score =112.0; E_value=1.8e-30; Accession=PF04982.4; Description=HPP family
  Pfam annotation: Domain name=Pkinase; Domain location=66-336; Score =152.2; E_value=1.4e-42; Accession=PF00069.15; Description=Protein kinase domain
  Pfam annotation: Domain name=Pkinase_Tyr; Domain location=66-336; Score=105.6; E_value=1.5e-28; Accession=PF07714.7; Description =Protein tyrosine kinase
  Pfam module annotation: Pfam domain module=HPP::Pkinase::Pkinase_Tyr; Domain location=399-532::66-336::66-336
MAILGLALVIILSFLWTRLLSKKERAAKRYTEVKKQADPKASTKLITFHGDLPYTSSEIIEKLESLDEEDIVGSGGFGTVYRMVMNDCGTFAVKQIDRSCEGSDQVFERELEILGSINHINLVNLRGYCRLPSSRLLIYDYLAIGSLDDLLHENTRQRQLLNWSDRLKIALGSAQGLAYLHHECSPKVVHCNIKSSNILLDENMEPHISDFGLAKLLVDEEAHVTTVVAGTFGYLAPEYLQSGRATEKSDVYSFGVLLLELVTGKRPTDPSFVKRGLNVVGWMNTLLRENRLEDVVDKRCTDADAGTLEVILELAARCTDGNADDRPSMNQVLQLLEQEGLVLDSNHKGRRRGHGIVASSNVASPSIWDDWKPVKAPSTPSLSDILWPSAGAFAAMAILGKMDQLLAPKGLSIAFAPFGAVSTILFATPTAPTARKYNVFMAQIGCAAIGVLALTIFGPGWLARSASIAASVAYMIITNSVHPPAASMPLLFIDGPKFHHLNFWYALFPGAAACTLLTMVAEYLSLVILGKPVIVPNGNA

SEQ ID NO: 119676 - protein, 333 aa, Glycine max
  Coding DNA Sequence Number=SeqID_2898
  Gene Ontology: Mol. function=DNA binding; Cellular component=nucleus; Biological process=regulation of transcription, DNA-dependent
  Homolog annotation: Hit_ID=Q9ZTC1; Match level="QueryCoverage=94%, HitCoverage=98%, E-value=6e-78, Identity=50%"; Hit description =Putative transcription factor
  Pfam annotation: Domain name=Myb_DNA-binding; Domain location=14-61; Score=42.5; E_value=1.5e-09; Accession=PF00249.21; Description=Myb -like DNA-binding domain
  Pfam annotation: Domain name=Myb_DNA-binding; Domain location=67-112; Score=45.3; E_value=2.1e-10; Accession=PF00249.21; Description=Myb -like DNA-binding domain
  Pfam module annotation: Pfam domain module=Myb_DNA-binding::Myb_DNA -binding; Domain location=14-61::67-112
MGRPPCCDKIGIKKGPWTPEEDISLVSYIQEHGPGNWRAVPTNTGLMRCSKSCRLRWTNYLRPGIKRGNFTEHEEKMIIHLQALLGNRWAAIASYLPQRTDNDIKNYWNTHLKKKLKQSDQSGSDEGVDHEGHSSSSSSNSHPKGQWERRLQTDIQMAKKALCDALSLHKPATATTTTLVVPDDATKPSSSSHHQPYNHASSSYASSYENISRLMENWMKPPNSTNNSPGYYSSFSNMVNNNTSTTGSSSSEGAHSTTTTTTQDQGFDCFLTLNSSKQYYGSPSQTQVPLTLLENWLFDDGAAQCHEDLMNMSLEESTAEFGTACTGSALYYQ

SEQ ID NO: 119677 - protein, 550 aa, Glycine max
  Coding DNA Sequence Number=SeqID_2899
  Gene Ontology: Mol. function=NAD+ ADP-ribosyltransferase activity; Cellular component=nucleus; Biological process=protein amino acid ADP-ribosylation
  Homolog annotation: Hit_ID=Q9ZP54; Match level="QueryCoverage=24%, HitCoverage=13%, E-value=1e-60, Identity=85%"; Hit description=Poly [ADP-ribose] polymerase 1 (EC 2.4.2.30) (PARP-1) (ADPRT 1) (NAD(+) ADP-ribosyltransferase 1)
  Pfam annotation: Domain name=PARP; Domain location=1-135; Score =142.7; E_value=1e-39; Accession=PF00644.10; Description=Poly(ADP -ribose) polymerase catalytic domain
LTNFVGILSQGLRIAPPEAPATGYMFGKGVYFADLVSKSAQYCFTDKKNPVGLMLLSEVALGNVYELKKAKKQYMDKPPEGKHSTKGLGKKMPQESEYVKWRGNVTVPCGKPVPSNVKSSELMYNEYIVYNTAQNSTSSSSDTVFAETGKWRVQEETCQLTEENKQKLESQPAIQNEETTFIKHPYSDGETAEINPTNDTEEQEDFPVSLAKEKLGIEDDGKFNQEEAKAIVEATKEEVQPNLPTPAIVQCDPDQIIQQQTLHNDESEAIDNAKSFIPKNKLERMSIVVEDTNQPEAMANVSTVKEEQADPHAKLCYDVDEQKTVDSHSVDNLESKGASVSEDKALQILPRTTSVCIEEVVKNIQEIHTEAELAVTDTKERQISENESEAKKEVSEYMLKRAFDLHRVACQTSAENEPKAEFLSEEQSYETIVTKHPNFERQTKEMNPTNETKEHEKVPASQTGEKLEIIDDRNFIQEGENEMEKQLKGSVLEDEVQTTLPTSTIVKGETIEGIVQEQTLEEEESVAIDNNSGRPENELEQMANVVEVSQ

SEQ ID NO: 119678 - protein, 90 aa, Glycine max
  Coding DNA Sequence Number=SeqID_2900
MACFRKLAPMDAEKREELEPEKRHANRGRILAFQSSKQSFNLWPSFLPQIAKGGHFRGREVRGYEWDFENSGLGGLLSPLIFVGMGFGEI

SEQ ID NO: 119679 - protein, 863 aa, Glycine max
  Coding DNA Sequence Number=SeqID_2901
  Homolog annotation: Hit_ID=Q1RVR2; Match level="QueryCoverage=49%, HitCoverage=54%, E-value=1e-144, Identity=61%"; Hit description =Ubiquitin-conjugating enzyme, E2
  Pfam annotation: Domain name=UQ_con; Domain location=482-637; Score =74.4; E_value=3.7e-19; Accession=PF00179.16; Description=Ubiquitin -conjugating enzyme
MAILNPEVINVESDDNSTELILFGQRVRKGKEIQTTHQNMEVCEDVMGKSLWTDKHSSSSDSSNHKDDVEYYDFFSKDHTMTTSQPSLSLEPSGVQYSQTPQSKKKSNDSQQRKQKLKLPLEIGSSTSFESKKKPNICYSSNHEFANNLKAKKSVTAGGASHSGLLPTGGASDWGLLPAGGAPQAVGGTLHLGLLPAGGMLPAAGAPQAAGGTLHWGLLPAGGMPPAGGTPDWGMLPAAGAPQAAGGTLHWGLLPAGGMPPAGATPDWGLLSTGGTPQVVGGTPHWGLPPAGGISPASGTPDWGLLSAGGTPQAVGGTTYWGLPPAGGAPEWGLPSTVPMMTLYSPYHSNFVGPSYHHPGAESINQMWSTNAHHLQAIPNYNYPHPYSYTYDYNYTAPVVHHYHVPPAQLFHNSLVQNSVGDENNGATTNSTVATISDEAREEILVKFRNFKQFDVVEDVSDHHFVNADSSMQQHSKNWAKRIQGEWKSLEKDLPDSIFVRVYESRIDLLRAVIIAAEGTPYHDGLFFFDVYFPSGYPHVPPGHFSMQNVHYHSGGLRLNPNLYNCGKVCLSLLNTWTGHQNEQWISGVSTILQVLVSIQGLILVAKPFFNEPGYAHLNGSQYGEISSLRYNEDSFILSLRTMMYIMKRPPKNFEDFVVGHFCRRAHDILETCKAYIDGAQVGCVVKGGAQDVDQGDNSSSIQFRTSLAAVVHMLIKEFTQIGAKDCDQVFPSTAAGNPSGEMLTAAGNPSLVMLTEAGNPLGEMLTAAGNLSGVMPAAGGNPSIVMLGNPSVEMPTAAGNLSGIMSAAVENPSVEMPGNLSGVMPTTVGNPSVEMLGNQSGVMMTAAGNPFTVEMPDSAAIP

SEQ ID NO: 119680 - protein, 160 aa, Glycine max
  Coding DNA Sequence Number=SeqID_2902
  Gene Ontology: Mol. function=acyltransferase activity; Cellular component=integral to membrane
  Homolog annotation: Hit_ID=Q1SWP9; Match level="QueryCoverage=91%, HitCoverage=29%, E-value=2e-60, Identity=75%"; Hit description =Chalcone and stilbene synthases, N-terminal
MVQLSHALQRGSYLVHAPKRLVIWPLVSPNHMHQLVFGSCSVGTFVGEKNHGPTNAEKAIGYEHGLVVPEVPILGYVLGTDDDGVGARVNLKHVFCKVNRDDIGAAAHATKVEAFGVTAELILVDDQGGEGMGGVEEAVVDDKDADVFGVDKGEARRREM

SEQ ID NO: 119681 - protein, 69 aa, Glycine max
  Coding DNA Sequence Number=SeqID_2903
GTLWLHAEVLSSFAAIDDDDVVEGKVLPYPTVDAKCSYQIWQDLLTVVLLHESLHELWWRHTKTLRRSS

SEQ ID NO: 119682 - protein, 68 aa, Glycine max
  Coding DNA Sequence Number=SeqID_2904
MMSSMLEMQRLSLCQGNALINVTSRHEGVTPPLGQATNLFSMSDIGTPENGGLVTMVKITCLVPSDHS

SEQ ID NO: 119683 - protein, 155 aa, Glycine max
  Coding DNA Sequence Number=SeqID_2905
  Subcellular localization annotation: CTP_CleavageSite=66; ConfidenceScore=5.04e-01
MVMPPQPLMGNDLTIQTNASSQLLEASRRPRDFLLHSHFLFSFPLLIFFNCLLPISSHPFSFLGVLSALAAKCFCLSNNQGSCISVGGIIAITSKGPHHLVGVHPDLVGDEGFDDCLLDPETKSKGAKWSFFKISDTYSPRLATNLLVLIKFLQP

SEQ ID NO: 119684 - protein, 87 aa, Glycine max
  Coding DNA Sequence Number=SeqID_2906
MSRLETRGATLFQLSRWSISDRLSLRYIRNRNLVEGISKANMDFDGLLGSSLRDNHSLGPQPTPEGGFIQSGAKRLLVEGVKLTCRF

SEQ ID NO: 119685 - protein, 203 aa, Glycine max
  Coding DNA Sequence Number=SeqID_2907
MVVLYKLPWNPNCKLLVDLPFLKTPNVDLDSKAKDEKAKAEKSQVDKARAEKAQVEKIAIVRGKRKENHLDDWVPSPYTRVIIRDSSTLQALIQNSMLGPTEIDMLRTTKSRKEALKASAADSTKTLQEEVEHLNKEFALFKIDAVAAEEKVKTNLGDAKAEILKLMKLGFRRPVDRSNKDVNGQGELVNKADISANVMLESA

SEQ ID NO: 119686 - protein, 49 aa, Glycine max
  Coding DNA Sequence Number=SeqID_2908
  Gene Ontology: Mol. function=serine-type endopeptidase inhibitor activity; Cellular component=extracellular region
  Homolog annotation: Hit_ID=P01063; Match level="QueryCoverage=72%, HitCoverage=43%, E-value=7e-17, Identity=100%"; Hit description =Bowman-Birk type proteinase inhibitor C-II precursor
MGLKNNMVVLKLVIAVRAHARCQASVVALTPPTSATNLASPVMKMMTRN

SEQ ID NO: 119687 - protein, 51 aa, Glycine max
  Coding DNA Sequence Number=SeqID_2909
MQDMEIEVASTIARCCLAICMKNRFCGERVNPYVRGWDDWLSSDTEGSGML

SEQ ID NO: 119688 - protein, 141 aa, Glycine max
  Coding DNA Sequence Number=SeqID_2910
MNDEERLKIFAKSPTKTKIGEELATQLAQASQVASSRSNHLVEEHPGRPNMLRNLTNCVTMLPFDLRHVTELHVMCNKGCQVPRSGQKKVACHQTMRNAKRKKEIPEGECVVAEKEKCESEKEEVNVAMEAEIYPTGTTAI

SEQ ID NO: 119689 - protein, 124 aa, Glycine max
  Coding DNA Sequence Number=SeqID_2911
MSKCELLHHKTLIIRSYEPISCIFMSSLLNFVGIRVGVVVDDIGFRARLTGASSKGGKCAESPPTFIYGKRQKNRRKSVMKNIPDSGVVFTFEEGISTSHVDKSGALAPTYLPSKRKPDLRSSF

SEQ ID NO: 119690 - protein, 43 aa, Glycine max
  Coding DNA Sequence Number=SeqID_2912
MWINKLALCMPLIAVTHCDQRFTERGKVRTVLKFVCDDSGEAD

SEQ ID NO: 119691 - protein, 976 aa, Glycine max
  Coding DNA Sequence Number=SeqID_2913
  Gene Ontology: Mol. function=zinc ion binding
  Homolog annotation: Hit_ID=Q8LJR1; Match level="QueryCoverage=40%, HitCoverage=97%, E-value=4e-74, Identity=46%"; Hit description =Putative zinc finger protein
  Pfam annotation: Domain name=Hemerythrin; Domain location=402-462; Score=12.4; E_value=0.86; Accession=PF01814.13; Description =Hemerythrin
  Pfam annotation: Domain name=Hemerythrin; Domain location=472-551; Score=24.0; E_value=0.00054; Accession=PF01814.13; Description =Hemerythrin
  Pfam annotation: Domain name=Hemerythrin; Domain location=88-150; Score=0.2; E_value=26; Accession=PF01814.13; Description=Hemerythrin
  Pfam annotation: Domain name=zf-C3HC4; Domain location=870-911; Score= 15.2; E_value=0.0043; Accession=PF00097.15; Description=Zinc finger, C3HC4 type (RING finger)
  Pfam annotation: Domain name=zf-CHY; Domain location=819-876; Score =24.4; E_value=3.3e-06; Accession=PF05495.3; Description=CHY zinc finger
  Pfam annotation: Domain name=zf-MIZ; Domain location=866-914; Score= -5.7; E_value=0.0069; Accession=PF02891.10; Description=MIZ zinc finger
  Pfam module annotation: Pfam domain module=Hemerythrin::Hemerythrin::H emerythrin::zf-C3HC4::zf-CHY::zf-MIZ; Domain location=402-462::472 -551::88-150::870-911::819-876::866-914
MGGKIRQQAILINLCTAADIIVKVLVSWLRSSKQTCTETCFQSGEFQGVDGFLHIERSLELSYCNRNSEEISSPMKVNGKEIEDGANQVNVLHLWHNAIKKDLKDILEELHLLRKSSCFQNLDSILIQLKFFADVLIFYSDAQKKFFHPVLNKHAYGWLSKSIEQFLGESNIEDIQQLLFYNSESGILLSKFIEKLCQTLESFVSGVNKQFAFQENEVFPIFRKNCRNGMQERLLSLSLYMMPLGLLRCVITWFSVRLSEKESSSILYCIKKGNNSVCKAFSSLLHEWFRIGYSGKTSIEKFRQELQHMFKRRCSLLPEQIKEAHEFSFLNSEKQPHKVSGQNCLSYSSSSGSNNVNKYETPYSTGINLHIFFPSTVAKLHQHPTLHAEERSSISFLDDPKPIDLIFFFHKAIKKDLEYLVLGSTQLEKNDKLLMDFHKRFHLIYFLHQIHSDAEDEIVFPAMEARGKLKNISHAYTFDHKHEVDHFNKISHILDKMSGLHLSVSTIDPNVKEKGILRYHHLCRKLQEMCKSMHKSLSDHINREEIEIWPIIRKFFSNHEQGRIIGCMLGRIRAEILQDMIPWLMASLTQEEQHVLMFLWSMATKNTMFDEWLGEWWDGYSLTKVTEGSNVAPLQPVEPLEIISKYLSEEILDELQEESSANKSINFLQKDHNGDNVVLSNYNFDDKVKVHNAEQNNNQCSKLTNQFHDHNKHACNEVPNIINPVNNEGKYSQLCDKSGRYDRLLKLSQDDLETVIRRVSRDSCLDPQKKSYIIQNLLMSRWIIRQQISSTEANIKNDELEFPGKHPSYRDPLKLIYGCKHYKRNCKLFAPCCNQLHTCIHCHNEESDHSVDRICKLFDDEREKHLEDNCPICHEYIFTSCSPVKALPCGHVMHSTCFQEYTCFNYTCPICSKSLGDMQVYFRMLDALLAEERISDEISSQTQVLLCNDCEKKGETPFHWLYHKCPSCGSYNTRVL

SEQ ID NO: 119692 - protein, 582 aa, Glycine max
  Coding DNA Sequence Number=SeqID_2914
  Gene Ontology: Mol. function=transporter activity; Cellular component= membrane; Biological process=oligopeptide transport
  Homolog annotation: Hit_ID=Q9CAR8; Match level="QueryCoverage=98%, HitCoverage=96%, E-value=0.0, Identity=60%"; Hit description=Nitrate transporter (NTL1); 53025-56402
  Pfam annotation: Domain name=MFS_1; Domain location=34-522; Score =11.6; E_value=9.4e-05; Accession=PF07690.6; Description=Major Facilitator Superfamily
  Pfam annotation: Domain name=PTR2; Domain location=96-510; Score =388.7; E_value=8.7e-114; Accession=PF00854.12; Description=POT family
  Pfam module annotation: Pfam domain module=MFS_1::PTR2; Domain location=34-522::96-510
MEEAQVQVWEGYVDWRNKPAIKGHHGGMLAASFVLAAEVLENLAFLANASNLVLYLSKFMHFSPSTSANIVTDFMGTAFLLAILGGFLADAFITTYSIYLISAVIEFMGLLMLTIQAHKPSLKPPNCVIGNTDSPCDKIHGGDAVMLFAGLYLVALGVGGIKGSLPPHGAEQFDENTPEGRKQRSSFFNYFVFSLSCGALIAVTFVVWIEDNKGWKWGLVVSTASILLSIPVFLLGSHKYRTKIPAGSPITSMFKVLVAAICNNCKAKNSSNAVISMTTGPSHATERKDGEEQSKTRKEVVPGQTLTDNLKFLNKAVMEPAVHPMLECTVKEVEEVKIVARILPIFMSTIMLNCCLAQLSTFSVQQSATMNTMLGSFKVPPASLPVFPVLFIMILAPLYNHIIVPFARKATKTEMGITHLQRIGTGLFLSIVAMAVAALVETKRKKTATKFGLLDSPKVPLPITFLWVALQYIFLGSADLFTLAGMMEFFFTEAPWSMRSLATALSWASLAMGYFLSTVLVSTINKVTGAFGSHTPWLLGANLNHYHLERFYWLMCALSGLNFVHFLFWANSYKYRCSTKPG

SEQ ID NO: 119693 - protein, 613 aa, Glycine max
  Coding DNA Sequence Number=SeqID_2915
  Gene Ontology: Cellular component=nucleus
  Homolog annotation: Hit_ID=Q1T4K6; Match level="QueryCoverage=59%, HitCoverage=87%, E-value=3e-88, Identity=46%"; Hit description =Unnamed protein product; contains similarity to nuclear protein ZAP gene_id:MQB2.8-related
TENASINGGFNGGLASVMDRQWRPAPPPNVCPSCFHPHFPFCPPPPPYYHPHPPFPYANFKRPRIDDNPINFSDDERRLKLIRDHGFHTYAPHPNHKDFPPHNAQFRSSPHPFHAYPDPSQHRVPDAYHHAHAPHVAMHEGNHQHNFNGRVVHYPYPYPAAGNNSNDNNNNNNMEPSRFFRGQPQPPLPSSPPPPLPMEPSMNQLKPPSLFPVAESQPMSQPYYHPSAFPSEEASKQQYLGDSQSFSLNQLAAERPKVIDASHLFRHPHRASRPDHFVIIFRGLPGSGKSYLAKMLRDLEVENGGDAPRIHSMDDYFMTEVGKVEDGEASKSSSSGRNKKPVTKKVMEYCYEPEMEEGCAARNVHGFTQEDIEKMSKQWEEASSLYLQLDVKVDMDMEDDLGDALPPFQGKEDEKVVDPPVGEDASRAGKNWHAEEEHPTEVRELGKSKWSEDFGEDDIDQTEGMKGNINALSGLIHQYGKERKSVHWGDKNEGKWVVQGLNPWHQVLYGKDGSESYQLIGKHGYKYNKRGGKTGFSIGAARKVNALSLVIGPGAGYNLKSNPLPEEDSPTRNSVESKKHSIFQEQIRAERESFKAVFDRRRHRIGGLDVEED

SEQ ID NO: 119694 - protein, 249 aa, Glycine max
  Coding DNA Sequence Number=SeqID_2916
  Homolog annotation: Hit_ID=Q1T4K9; Match level="QueryCoverage=99%, HitCoverage=98%, E-value=6e-62, Identity=53%"; Hit description=Heat shock protein Hsp20
  Pfam annotation: Domain name=HSP20; Domain location=29-122; Score =12.8; E_value=2.9e-05; Accession=PF00011.11; Description=Hsp20alpha crystallin family
MASARGTTRVGERTRARTPVVEEMVPNSGWTLDSAGHYLIVDLPDFRKEEVKLQVDSYGRIVVSGERHLNEWKRVHFRLTFPAPLNSDMDKIAGKFDGGILYVYVPKQVTHQNKESATAKVGNRKVERSEEKDRHQHGNGEVERAEEKDCHQHENGEVERAEENDSHAPKADEGRRGPSQHDDHIELAVKRNENEHIGEFPEQVIRNWHQESALRSALGVLRENKGIVITAVIAFSLGLLVSRKFNGSS

SEQ ID NO: 119695 - protein, 213 aa, Glycine max
  Coding DNA Sequence Number=SeqID_2917
  Gene Ontology: Mol. function=voltage-gated ion-selective channel activity; Cellular component=mitochondrial outer membrane; Biological process=anion transport
  Homolog annotation: Hit_ID=Q4PKP6; Match level="QueryCoverage=95%, HitCoverage=71%, E-value=2e-41, Identity=45%"; Hit description =Mitochrondrial voltage-dependent anion-selective channel
  Pfam annotation: Domain name=Porin_3; Domain location=1-206; Score= -2.9; E_value=7.3e-08; Accession=PF01459.12; Description=Eukaryotic porin
MSDFSAFAATSITVDELVPGFKSLFKCTIPDSGKLELQHLSNYTGITGCIGLEGNLEKGYDPVLNLSGLVGTNILSLGGNVALDLPTRTISKLNAGLGLNTNFLVASLTMHDSFDIVKASCYHEVNLLTKTAIAAELKHSLSMGETSGTIGAQHAFFPQTLLKARFDTFGRAGALIQQGFWERCFVTMAGEVEFKNSDNNLHPKVGVSVALKP

SEQ ID NO: 119696 - protein, 391 aa, Glycine max
  Coding DNA Sequence Number=SeqID_2918
  Gene Ontology: Mol. function=transferase activity
  Homolog annotation: Hit_ID=Q9SS68; Match level="QueryCoverage=96%, HitCoverage=35%, E-value=1e-37, Identity=29%"; Hit description =Putative phosphoribosylanthranilate transferase
  Pfam annotation: Domain name=C2; Domain location=15-104; Score=104.7; E_value=2.8e-28; Accession=PF00168.20; Description=C2 domain
  Pfam annotation: Domain name=C2; Domain location=301-383; Score=23.8; E_value=0.00063; Accession=PF00168.20; Description=C2 domain
  Pfam module annotation: Pfam domain module=C2::C2; Domain location=15- 104::301-383
MTTPFQQPPQTVRRLVVEVVDARNLLPKDGQGSSSPYVVADFDGQRKRTSTRFKELNPVWNEPLEFIVSDPENMEFEELEVEVYNDKKFGNGSGRKNHFLGRVKLYGTQFSRRGEEALVYYTLEKRSVFSWIRGEIGLRIYYYDEMLMEEDKPPPPPPPPQQQQQEQGERTEQNKPPPGVVVVEERRVFETPGGPMMEQCVPLPTGPPHSPPRVVVVAESPPPVVHVSQDPPLPEMCEPPPASEMQFQPEVRKTQANRGERVKILKRPNGDYLPKDISGKKTGNESERVHPFDLVEPMQYLFVKIWKARGLAPPSEGPIVRVRMSSQSRRSKPASYRPNEPTDSPEWNQTFALGYNTTDANNAATLEISVWDSPTENFLGRLCFDLSDGEN

SEQ ID NO: 119697 - protein, 305 aa, Glycine max
  Coding DNA Sequence Number=SeqID_2919
MTLLEVIKDASVNSKPLDSPIDYPIVLNPDGILPNLKPEVEDESSSSLIKPLIGWQLSQTDAEIIDISKKFFIQLKAKLKNNNDLNKGEFIGSLNSYLENIRDKLGVVIEFDPSCSGYNRALIDKLGVFMGKDVAGLVLDGSVSLEIWEVVKALIVNGITEHSCYSNLITKLVEKKRSDLLCLCITHGFDLGSSEILTILRYFLSPSKDAYNSMVTVKKDWECQVLLAIEKANDSNLKKYLLTAKEASILLIIAYDGFSASEIRLHYLFASSNINDVVLSPSFSKLNGKESINLIRYLAKWLQEI

SEQ ID NO: 119698 - protein, 198 aa, Glycine max
  Coding DNA Sequence Number=SeqID_2920
  Gene Ontology: Mol. function=oxidoreductase activity; Cellular component=mitochondrion; Biological process=metabolic process
  Homolog annotation: Hit_ID=Q1T4K0; Match level="QueryCoverage=79%, HitCoverage=35%, E-value=6e-61, Identity=60%"; Hit description =Aldehyde dehydrogenase; Carbamoyl-phosphate synthase L chain, ATP- binding
  Subcellular localization annotation: CTP_CleavageSite=39; ConfidenceScore=5.18e-01
MFKSLVSRATKDSISRNHNAIASFAFSRCAHSLSFATVEAEEVSGSRPAEVLHLVQGKWVGSSNWNTIADPLNGDSFIKVAEVDETGIQPFIKSLSSCPKHGVHNPFKAPERYLMYGDISTKAAHMLSLPKVRFLARSFGVPGNHLRQQSHGFRWPYGPAKNESMSFSCQWCLFIVPKLSITLWSSTLVYGSNWLSVL

SEQ ID NO: 119699 - protein, 328 aa, Glycine max
  Coding DNA Sequence Number=SeqID_2921
  Gene Ontology: Mol. function=oxidoreductase activity; Cellular component=mitochondrion; Biological process=metabolic process
  Homolog annotation: Hit_ID=Q1T4K0; Match level="QueryCoverage=99%, HitCoverage=61%, E-value=1e-165, Identity=84%"; Hit description =Aldehyde dehydrogenase; Carbamoyl-phosphate synthase L chain, ATP- binding
MGALYMGNKPVLKVDSKVSIVMEQMLRLLHTCGLPLEDVDFINSDGKTMNKLLLEGNPRMTLFTGSSRVAEKLAVDLKGRVKLEDAGFDWKILGPDVHQEDYVAWVCDQDAYACSGQKCSAQSLLFMHENWSKTSLLSKLKDLAERRKLADLTIGPVLTVTTDSMLEHVNKLLEIPGSKLLFGGSPLENHSIPPIYGAIKPTAVYVPLEEIMKDKNFELVTKEIFGPFQVITDYQNSQLAVVLDALERMHNHLTAAEVIGKSVNGTTYAGLRARTTGAPQNHWFGPAGDARGAGIGTPEAIKLVWSCHREIIYDFGPVPKNWEVPPST

SEQ ID NO: 119700 - protein, 404 aa, Glycine max
  Coding DNA Sequence Number=SeqID_2922
  Gene Ontology: Mol. function=pseudouridine synthase activity; Biological process=RNA processing
  Homolog annotation: Hit_ID=Q69K07; Match level="QueryCoverage=75%, HitCoverage=73%, E-value=3e-40, Identity=42%"; Hit description =Ribosomal large subunit pseudouridine synthase C-like
  Pfam annotation: Domain name=PseudoU_synth_2; Domain location=128 -293; Score=10.7; E_value=3.9e-07; Accession=PF00849.12; Description =RNA pseudouridylate synthase
MGVGGTIHDVESVEEWAASVLGGGDKAVGGQMAYSASRQCEFECECGAESTLVHSDHRTQMGCSVLPPPSQSSGAQAFPSKTAKDTLNTGDRILLPQSVKVKQTPTHSHLTPQQINFIRTLVIYKDPAILVLNKPPGMPVQGGINIKRSLDAVAAASLNYGYSQPPRLTETVLAFWSWEGHTPVQQSCIPSSARKLPGRQMILAKRREYYKEGTGHWSLDVLDVQRGWSLLHWVVVDNGRSDRITIVDNSTLMSSQHAITEYRVIASSSQGYTWLELTPLTGRKHQLRVHCAEVLGTPIVGDYKYGWQAHRKWGHFDLPNVEDSREELLNEEKLPFGLNLNKGSISENHPRLHLHCKQMVLPNISQALQNVQSASSCDLSLVEELELVADLPPYMQRSWDVTNY

SEQ ID NO: 119701 - protein, 485 aa, Glycine max
  Coding DNA Sequence Number=SeqID_2923
  Gene Ontology: Mol. function=receptor activity; Cellular component =cellulose and pectin-containing cell wall; Biological process =protein amino acid phosphorylation
  Homolog annotation: Hit_ID=Q9LT85; Match level="QueryCoverage=62%, HitCoverage=65%, E-value=7e-77, Identity=53%"; Hit description =Similarity to receptor protein kinase
  Pfam annotation: Domain name=LRRNT_2; Domain location=74-113; Score =21.5; E_value=0.003; Accession=PF08263.3; Description=Leucine rich repeat N-terminal domain
  Pfam annotation: Domain name=LRR_1; Domain location=151-173; Score =5.0; E_value=33; Accession=PF00560.23; Description=Leucine Rich Repeat
  Pfam annotation: Domain name=LRR_1; Domain location=175-195; Score =7.6; E_value=11; Accession=PF00560.23; Description=Leucine Rich Repeat
  Pfam annotation: Domain name=LRR_1; Domain location=203-225; Score =14.0; E_value=0.55; Accession=PF00560.23; Description=Leucine Rich Repeat
  Pfam annotation: Domain name=LRR_1; Domain location=226-248; Score =9.1; E_value=5.7; Accession=PF00560.23; Description=Leucine Rich Repeat
  Pfam annotation: Domain name=LRR_1; Domain location=249-271; Score =5.5; E_value=27; Accession=PF00560.23; Description=Leucine Rich Repeat
  Pfam annotation: Domain name=LRR_1; Domain location=274-296; Score =1.5; E_value=1.5e+02; Accession=PF00560.23; Description=Leucine Rich Repeat
  Pfam annotation: Domain name=LRR_1; Domain location=298-320; Score =11.1; E_value=2.4; Accession=PF00560.23; Description=Leucine Rich Repeat
  Pfam annotation: Domain name=LRR_1; Domain location=322-343; Score =8.2; E_value=8.5; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=74-113::151 -173::175-195::203-225::226-248::249-271::274-296::298-320::322-343
MGITYMCALILLSLLLHSFMFIAADQRVAGLETIIASGHVHGGNFYGSPPPPPPECHPPPPMCPPPPPPPPVRLERARKALIKFTRLVDDPNGYTSNWKEGRDTCEFRGVRCAKYPDGQQAVAGLDLNGAGLSGKKCTALMLTGILDSIPELTFFHVNSNNFSGAIPTDITKYKFFFELDLSNNKLEGEFPKEVLQPKPKDQQLVFLDLRFNSLCGPIPPQLFDLDLDVIFINNNKFSGHLPDNFGSTPARYLTFANNQLTGPIPASIGKASKTLTEVLFLGNHFQGCLPYQIGYLDKATVFDVSKNSLTGPIPHSFACLQSIQYLNLDRNQFYGEVPEMLCLLPGLRNNGNLSLSDNYFTQAARTMHRILLQDQALPKSKVSPLRPLNKQEYESDSVQPFKPYIHILQHCTDYGNVGRVDLSTRQGDLVKELFVKWKAPFDGWVVINTTDGSVKNQEGGALHGLKMAYEKGFQAVELQMDSEAV

SEQ ID NO: 119702 - protein, 930 aa, Glycine max
  Coding DNA Sequence Number=SeqID_2924
  Gene Ontology: Cellular component=microtubule organizing center; Biological process=microtubule cytoskeleton organization and biogenesis
  Homolog annotation: Hit_ID=Q94GC4; Match level="QueryCoverage=40%, HitCoverage=97%, E-value=6e-75, Identity=42%"; Hit description =Tubulin family protein, related
  Pfam annotation: Domain name=Spc97_Spc98; Domain location=59-930; Score=-179.7; E_value=0.0021; Accession=PF04130.4; Description=Spc97 Spc98 family
MADTKFASLLLENLKLQDPWLPPDTWESIPSESGLLLSSPIPNSNQPLCHLSTLSESSLVRLAVNAMQGAKSSLVIIQNLSAIFSSDPSVRSFLWNRASTTRSLGNILISIGCTGSLLFLLRAFVDYFTDTFPLIHHDSPPFTLVNQAFAVSVGKVLEGYICGLDTIHTSVLLRRSSKDVDFTVPGCLKNVVHSEITLLEFYLHTKELRTQIEALASVCNLQKWVHCFPDTAFQDLITEATSEFRNFFRGGNLLTFLFAQLQVADPAHCTLLKFLFLQSCEPYCGFIRSWIFKAEVHDPYKEFIIENMDCLPHKSHVKAGHSVDFPLASVKVRDGVPIPGFLKDFLVPLVRAGLQLQVLLKLLETCIHVASGEHSCHDFLPCWSGFSSSLSYSSPLTFSKDVIEAMVLARENYYKRMNEKIESLLSSLEVRYQQVAMRALVPSFDNGGDILRGIGDLGSDVSSTIDEFSLLEDVCDLSESSSLYSSEEQLDCDQLSGWSCPVVGQQNHLSALSFLKSSTLNNSIQNSCHHESSGSDSHGICDKMDATDVLMKTSHEVVISSHMSNPLNPENSSCLCKFSIQDRESLIDSCSGMGHFLKKSFDNDGTVEPKVTEKHLGPLKYSMLCHDINTISNTLSGEATKEDQPDNNTLTSHLYGFQPQKYGHQCNHPSINPLSVNPMLTRNSILHLMGRNGGKYKADHEQTLPYFNFSTVEDPCKVYMDKVPTNSRCRSASSFTLDSNVSNRNDKNNEHGEIDCGRENGLVDVPKVCFDASPDLMDHKHLTVVSGGSSWERLLGSFGKTVNVDDTQKQRKHTVLVLPVLRDVRYNYVSKLAINVLEEAFKLQEHLLALRRYHFMELADWADLFILSLWHHKWSVTEANERLSEIQGLLELSIQKSSCEQDTHKDRLFVYMKGHGKLPLSASAIGTSIQ

SEQ ID NO: 119703 - protein, 171 aa, Glycine max
  Coding DNA Sequence Number=SeqID_2925
  Gene Ontology: Mol. function=nucleoside-triphosphatase activity; Cellular component=membrane; Biological process=defense response
  Homolog annotation: Hit_ID=Q9SKL6; Match level="QueryCoverage=94%, HitCoverage=83%, E-value=5e-38, Identity=44%"; Hit description =Expressed protein
  Pfam annotation: Domain name=BSP; Domain location=14-166; Score =118.5; E_value=2e-32; Accession=PF04450.3; Description=Plant Basic Secretory Protein
MAEYLKPLLCLVLTLAVEYVLSNNAGSSTGGKMFEKQVGADYAKQTLDSAADFTLKLFHQSTVADRKNVQQVNLIVENMDGLHLYGLLMAYWINLPWDGNGQALSGLIEGIADYVRLKAGYAADYWGQPGHGGDWNQGYDVTARFLDYCNGIKNGFVADLNSMMKSQFSLK

SEQ ID NO: 119704 - protein, 292 aa, Glycine max
  Coding DNA Sequence Number=SeqID_2926
  Homolog annotation: Hit_ID=Q1ENY2; Match level="QueryCoverage=44%, HitCoverage=74%, E-value=9e-45, Identity=61%"; Hit description=C2 domain-containing protein / protein kinase-related
  Pfam annotation: Domain name=C2; Domain location=12-93; Score=77.8; E_ value=3.4e-20; Accession=PF00168.20; Description=C2 domain
MSSITGIQGQPLEVTVVSCSKLKDTEWISRQDPYVCVEYGSTKFRTRTCTDGGKNPVFQEKFIFPLIEGLRELNVLVWNSNTLTLDDFIGSGKIQLHKVLSQGFDDSAWPLQTKTGRYAGEVKVILHYAIANHQRHKSVSSHAPSAPPYVATTTPPVPSSYSTSYPPPPSATSYPPPPSYHTTGSYSYPPPPPPVASTVSYPLPPTAYPPYSSHPPSSYPPQPSSYPPPPSYPPPASAYPPPPYPPPAGYPPGLLDGFVEHNFDATLHLTPFFVFIYSSTHSQPFNACSNTL

SEQ ID NO: 119705 - protein, 108 aa, Glycine max
  Coding DNA Sequence Number=SeqID_2927
MVYLVPVIESGTRMLKKVWSIFGESLEPLEELFSATCQARGERKLNEKGQLEQDDMALGKKTAQGRSRSENKLKQQLEGGLFKGMPSTAQWTKENGADPGREVDVTAS

SEQ ID NO: 119706 - protein, 46 aa, Glycine max
  Coding DNA Sequence Number=SeqID_2928
MEITQVMLDVPANLHGAHNNTPTQGGIEYARMYGCVQRRMYFLAYF

SEQ ID NO: 119707 - protein, 821 aa, Glycine max
  Coding DNA Sequence Number=SeqID_2929
  Gene Ontology: Mol. function=hydrolase activity, hydrolyzing O -glycosyl compounds; Biological process=tRNA aminoacylation for protein translation
  Homolog annotation: Hit_ID=Q339Q0; Match level="QueryCoverage=98%, HitCoverage=96%, E-value=0.0, Identity=55%"; Hit description=Large secreted protein, putative, expressed
MAEGRGSRNLKIRFREGGKHWTDAVPIGNGRLGAMVCGHVHSETIHLNEDTLWTGTPADYTNSKAPPALSHVRNLVHRQHYPQATAASSALTGNPSEAYLLLGDIQLDFDYSHLTPGLQQPYERELDLDTATVKVRYSVGDVQFTREHFASYPDQLIVTQISSSKPAKLSFTVSLLSKIINQTYVNAPNQIIMKGSCPGKRIQHNPHGIQFSAILDLKIGGTDGVIHILDNNKLKVEASDWAVLLLVASSSFSGPFTAPSDSKKDPTSQCFTTLSSISNVSYSHLYARHLNDYQGLFHRVSLQLMRSTRPNISEDRSLELKRLTSSVAHLSLVDSTVTQASTSDRVKSFQTDEDPSLVELLFQYGRYLLISSSRPGTQVANLQGIWNKDLEPVWDGAPHLNINLEMNYWPALPCNLSECQEPLFDYISLLSVNGSKTAHVNYQANGWVAHSKSDIWARTSAGQGDVVWALWPMGGAWLCTHLWEHYAYTMDEDFLKYKAYPLMEGCVSFLLSWLIEDSEGYLETNPSTSPEHYFIAPNGEPACVSQSSTMDVAIINEVFSTFLSAAEVIGRTKDNIVGEVRKAQPRLRPINIAQDGSIMEWVKDFKDPEVHHRHLSHLFGLFPGHTITFKETPALIEAAEKSLYKRGEEGPGWSTTWKTACWARLQNSSNAYKMIKHLINLVDPDHERPFQGGLYSNLFAAHPPFQIDANFGFAAAVAEMLVQSTLSDLFLLPALPWEKWPNGSLKGLKARGGTTVNIYWREGDLQEVGIWSEDQTRTTLRKRIHYRGTMVTADLVSGLFYKFNGQLKCLNTCSLSEMPCS

SEQ ID NO: 119708 - protein, 62 aa, Glycine max
  Coding DNA Sequence Number=SeqID_2930
MAMTVATHAAECGCRREDGKDEVELKEKQKRQTWTLIKTIEIRRMKRLKAKVKETLKIEKLN

SEQ ID NO: 119709 - protein, 224 aa, Glycine max
  Coding DNA Sequence Number=SeqID_2931
  Gene Ontology: Mol. function=Rho GDP-dissociation inhibitor activity; Cellular component=cytoplasm; Biological process=actin cytoskeleton organization and biogenesis
  Homolog annotation: Hit_ID=Q1SF97; Match level="QueryCoverage=78%, HitCoverage=86%, E-value=9e-57, Identity=70%"; Hit description=RHO protein GDP dissociation inhibitor
  Pfam annotation: Domain name=Rho_GDI; Domain location=35-218; Score= -29.6; E_value=1.1e-06; Accession=PF02115.7; Description=RHO protein GDP dissociation inhibitor
MSAAVSATKDVPFNAHLEEDIKNKEINKVVNVGEADQIPYNDDAEGTDSEAEEDPKLELDLGPQCSLKEQLEKDKEDESLRKWKEQLLGGIDVSAVGENKEPEVKIVSLTIICPGRPDLILPIPFTSDAKKSIFTLKEGSQYQLKFSFTVSNNIVSGLKYTNVVWKTGLRGEPIQQEPRDGGGNGPHVDKGTEINKYPQLLLVLSQANSQKVHQFFDGPEAFVI

SEQ ID NO: 119710 - protein, 160 aa, Glycine max
  Coding DNA Sequence Number=SeqID_2932
  Gene Ontology: Mol. function=zinc ion binding
  Homolog annotation: Hit_ID=Q67Y26; Match level="QueryCoverage=71%, HitCoverage=76%, E-value=5e-43, Identity=67%"; Hit description=MRNA, , clone: RAFL25-17-M10
  Pfam annotation: Domain name=zf-UBP; Domain location=70-142; Score =57.4; E_value=4.6e-14; Accession=PF02148.9; Description=Zn-finger in ubiquitin-hydrolases and other protein
MWKESPQSSPEAKRLGFGVNLSEERERLKKEGEEEYGSESGWVDARSWCDHLASSLSEDLGQIPGPDTPCQTCQHPTENWLCLSCKQVLCSRFVNKHMLHHSRDTNLTHCVALSFSDLSVWCFSCDAYLDPQLIPQLRPLHQLAYILKFGQPPPIPSPSL

SEQ ID NO: 119711 - protein, 192 aa, Glycine max
  Coding DNA Sequence Number=SeqID_2933
  Gene Ontology: Mol. function=protein binding; Cellular component =integral to membrane; Biological process=protein amino acid phosphorylation
  Homolog annotation: Hit_ID=Q0R4K1; Match level="QueryCoverage=65%, HitCoverage=65%, E-value=1e-37, Identity=53%"; Hit description =Leucine rich repeat protein 1
  Pfam annotation: Domain name=LRRNT_2; Domain location=22-62; Score =56.6; E_value=8.5e-14; Accession=PF08263.3; Description=Leucine rich repeat N-terminal domain
  Pfam annotation: Domain name=LRR_1; Domain location=114-136; Score =14.5; E_value=0.4; Accession=PF00560.23; Description=Leucine Rich Repeat
  Pfam annotation: Domain name=LRR_1; Domain location=137-156; Score =9.8; E_value=4.2; Accession=PF00560.23; Description=Leucine Rich Repeat
  Pfam annotation: Domain name=LRR_1; Domain location=66-88; Score =15.0; E_value=0.27; Accession=PF00560.23; Description=Leucine Rich Repeat
  Pfam annotation: Domain name=LRR_1; Domain location=90-112; Score =17.4; E_value=0.051; Accession=PF00560.23; Description=Leucine Rich Repeat
  Pfam module annotation: Pfam domain module=LRRNT_2::LRR_1::LRR_1::LRR_ 1::LRR_1; Domain location=22-62::114-136::137-156::66-88::90-112
MSSFVFLSLLFLLLQRPLPSLSNSEGDALYAFKTRLSDPNNVLDSWDPSLVTPCTWFHVTCDSNNYVTRLELYGNNITGNIPQELGNLINLISMDLSYNRFQGNIPKSFGNLKSLKFLWLNNNQLTGSIPIVVSTLNLQVFNVSNNRLSEPPVDKLRIPLPRGSSLCEGMGEGCCTQSYPCICKEAVSENHS

SEQ ID NO: 119712 - protein, 518 aa, Glycine max
  Coding DNA Sequence Number=SeqID_2934
  Gene Ontology: Mol. function=amino acid transporter activity; Cellular component=membrane; Biological process=amino acid transport
  Homolog annotation: Hit_ID=Q9LH39; Match level="QueryCoverage=88%, HitCoverage=96%, E-value=1e-172, Identity=66%"; Hit description =Arabidopsis thaliana genomic DNA, chromosome 3, BAC clone: T31J18
  Pfam annotation: Domain name=AA_permease; Domain location=27-440; Score=-113.7; E_value=0.01; Accession=PF00324.11; Description=Amino acid permease
MGEEASKSNPKLTLFPLIALIFYEVSGGPFGVEDSVRGGGGPLLSLLGFLVFPLIWSIPEALVTAELATSFPQNGGYVVWICSAFGPFWGFQEGFWKWFSGVMDNALYPVLFLDYMKQSFPIFDRLAARIPALLGITLSLTYLNYRGLHIVGFSAVFLALFSLSPFLIMALLSIPQIRPSRWLLVDFAKVDWPGYFNTMFWNLNYWDKASTLAGEVEDPSKTFPRALVGGLVLVVSSYLIPLLAGTGSFSSSPTEWVDGYFAQVGMFIGGSWLKLWIQLAAAMSNLGLFEAEMSSDSFQLEGMSKMGMLPALFATRSVYGTPTFSILFSATGVIFLSWMSFQEIIEFLNFLYAVGMLLEFAAFITLRLKKPNLYRPYRVPLSTFWATMLCLPPALLLILVMCLASLTTFFVSGAVILVGFILYPFLVQAKNKNWILFEEATGWQQCHSELTDQENSGVELLVSSPLASVEEQLSLMQNIVQYPVRLVKNGDPYATSLTTCLEQKLEKEGFNSQQQEIV

SEQ ID NO: 119713 - protein, 45 aa, Glycine max
  Coding DNA Sequence Number=SeqID_2935
MRQRLADFTLGSPKLSILLTVKLVKLHGTHVKEKFLPTLITYKLL

SEQ ID NO: 119714 - protein, 149 aa, Glycine max
  Coding DNA Sequence Number=SeqID_2936
  Gene Ontology: Mol. function=structural constituent of ribosome; Cellular component=ribonucleoprotein complex; Biological process =translation
  Homolog annotation: Hit_ID=Q5QJE1; Match level="QueryCoverage=48%, HitCoverage=77%, E-value=1e-20, Identity=66%"; Hit description =Ribosomal protein S19
  Pfam annotation: Domain name=Ribosomal_S19; Domain location=30-104; Score=102.2; E_value=1.5e-27; Accession=PF00203.11; Description =Ribosomal protein S19
  Subcellular localization annotation: CTP_CleavageSite=27; ConfidenceScore=5.03e-01
GSNLEALGIVGDTANTVAKKPPPPPPLVSRKPAFIDAFLYKMKKNPNLLLNKTIWSRRSTILPEFVDSTVKIYNGKTTIRCRITEGKVGHKFGEFALTRKRKTREQANSKNVKQLKKKKASPGAAVKLCLGDLLVMGSNPETASLHMQG

SEQ ID NO: 119715 - protein, 822 aa, Glycine max
  Coding DNA Sequence Number=SeqID_2937
  Gene Ontology: Mol. function=amidase activity; Cellular component =cytosol; Biological process=translation
  Homolog annotation: Hit_ID=Q1SF95; Match level="QueryCoverage=88%, HitCoverage=95%, E-value=1e-178, Identity=67%"; Hit description =Amidase
  Pfam annotation: Domain name=Amidase; Domain location=351-779; Score =192.0; E_value=1.4e-54; Accession=PF01425.11; Description=Amidase
  Pfam annotation: Domain name=LSM; Domain location=779-821; Score =38.4; E_value=2.5e-08; Accession=PF01423.12; Description=LSM domain
  Pfam module annotation: Pfam domain module=Amidase::LSM; Domain location=351-779::779-821
MEGNLLREVSLKWIFLVSDSGPGNPKSIHIDDPGGSSSGSAISVAANLVAGSLGSETDGSILCPSGSNSVVGIKPTVGLTSIAGVVPITPLQDTVGTVLDAALVLETIAGIDINDKATIKASKYVPRDGYAQFLKIDGLRGKRLGVVRAFYGFGNDTFKHDTFKLHLKTLRQKGAVLVDNLEINNIQEILMIKEKLKEYGQDLMLVAQKTNGVRELKEAVLNMARLSHIGFEKLMITNNLDAMVVPFSFFASILARGGYPGVTVPAGYEKGAPFGIIFGGLKGSEPKLIQIAYSFEQATLIRKPPPLRKLEAEVVFSWLPTRYEAKGLSIEEATVYDLQLAFRTKQLTSREVVDFYLKQIETQNPVLKGVLELNPDALSQADKADHERKTKAPGSLSPLHGIPILIKDNIATKDKMNTTAGSFALLGSVVPRDAGVVSRLREAGAIILGKASMSEWAFYRSNAAPSGWSARGGQGKNPYTMDGPSGSSSGSAISVAANLVAVSLGTETDGSILSPSNVNSVVGIKPTVGLTSRAGVVPITPRQDTVGTVSDAALVLETIAGIDINDQATIEASKYVPEGGYAQFLKKEGLRGKRLGVVRFFYGFSGDTVMHKTLELHFKTLRQKGAVLVDNLEIENIEEIIDGQSEEIAMAYDFKLSLNAYLRDLVNSPVRSLADVIAFNKEHPELEKLEEYGQDLLLLAEETNGVEELNHAVLNMSRLSHNGFEKLMITNELDAVVVPSSTFSSILAIGGYPGVIVPAGYEKGVPFGICFGGRKETVLDLAKFVDKGVQVKLTGGRQVTGTLKGYDQLLNLVLDEAVEFLR

SEQ ID NO: 119716 - protein, 86 aa, Glycine max
  Coding DNA Sequence Number=SeqID_2938
  Gene Ontology: Mol. function=structural constituent of ribosome; Cellular component=ribonucleoprotein complex; Biological process =translation
  Homolog annotation: Hit_ID=Q10E81; Match level="QueryCoverage=62%, HitCoverage=6%, E-value=2e-27, Identity=96%"; Hit description =Ribosomal protein S14p/S29e containing protein, expressed
  Pfam annotation: Domain name=Ribosomal_S14; Domain location=3-56; Score=101.7; E_value=2.1e-27; Accession=PF00253.11; Description =Ribosomal protein S14pS29e
  Subcellular localization annotation: CTP_CleavageSite=44; ConfidenceScore=5.05e-01
MGHSNVWNSHPKNYGPGSRTCRVCGNPHGLIRKYGLMCCRQCFRSNAKEIGFIKLSSSFSLSHLAFCNSFLVFAQVVKVRSEWFLT

SEQ ID NO: 119717 - protein, 318 aa, Glycine max
  Coding DNA Sequence Number=SeqID_2939
  Gene Ontology: Mol. function=iron-sulfur cluster binding; Cellular component=integral to membrane; Biological process=regulation of transcription, DNA-dependent
  Homolog annotation: Hit_ID=Q10QB5; Match level="QueryCoverage=79%, HitCoverage=66%, E-value=3e-65, Identity=58%"; Hit description =Radical SAM enzyme, Cfr family protein, expressed
MATSPSPAPASIAPETYARSLKPHEERKANPRLGSFPATCQTKCNQCKPCVPVEVTIKTVAEEENEYYPIAWKSWMQNGLQFLCHWIHGIQKQPIIRRNCGTARSSQIRNVVFMGMGEPLNNYSAVVGIIHAINKLHNDLSGLNLAVSLHAPAQDIRCQIMPAARAFPLGKLMDSLQDYQSKSLQKIFIEYIMLDGVNDEEHHAHQLGKLSRDISSVQCLSQEKVLKTRSSFSAQLHNAVVNLMPFNSIGTLSQFKPTSEQNVSNFHKILWGTYHIRTTVRKQMGQDISGACGQLVVNIPDKSLGNAVPLTDIEDLVI

SEQ ID NO: 119718 - protein, 73 aa, Glycine max
  Coding DNA Sequence Number=SeqID_2940
  Gene Ontology: Mol. function=6-phosphofructokinase activity; Cellular component=6-phosphofructokinase complex; Biological process=glycolysis
  Homolog annotation: Hit_ID=Q1SEA0; Match level="QueryCoverage=63%, HitCoverage=9%, E-value=5e-13, Identity=76%"; Hit description =Phosphofructokinase
MLLLHFSFFLPCSSLLGNRYIPFYRITQGQNKVLITDRMWARLLSSTNLPSFTIAKTVSEEKREEEANGNVPE

SEQ ID NO: 119719 - protein, 238 aa, Glycine max
  Coding DNA Sequence Number=SeqID_2941
  Gene Ontology: Mol. function=pepsin A activity; Biological process =proteolysis
  Homolog annotation: Hit_ID=Q9SJG1; Match level="QueryCoverage=75%, HitCoverage=31%, E-value=1e-40, Identity=47%"; Hit description =Putative chloroplast nucleoid DNA binding protein
GAQNDHNNDPTLTNKEFYRKAKSSKSTGLNKEEDEDGVISAKLHLRHRAMNHGNEPKTNVLDSAIRDLVRIQTLHRKVIEKMNTNSMSRKQEVKESITIQQQNNIANAFVASLESSKDEFSGNIIATLEFGASLGRGEYFIDMFVGTPPKHVWLILDTGSDLSWIQRDPCYDCFEQNGPYYSPKDSITYSNISCYDRCCQLVSSPELLQPCKVEIQTCPSFYDQADGSKTTGDFALET

SEQ ID NO: 119720 - protein, 78 aa, Glycine max
  Coding DNA Sequence Number=SeqID_2942
MMSTRSKEVGGVALPQGPALVLPPIPKDPLNDLMEWFLVQKTKVIAPQFDACASWWTQGPDAIMQLVSLDLCGHLHVA

SEQ ID NO: 119721 - protein, 80 aa, Glycine max
  Coding DNA Sequence Number=SeqID_2943
MRTPDQNLFDGMLMKGRSIFVEAIALLKGRWKILQDLNIGIQFSPLCSKQAKHMYSWHQVLIAEKKDRFINTNKEVHESA

SEQ ID NO: 119722 - protein, 241 aa, Glycine max
  Coding DNA Sequence Number=SeqID_2944
  Homolog annotation: Hit_ID=Q9LJR0; Match level="QueryCoverage=42%, HitCoverage=72%, E-value=2e-19, Identity=46%"; Hit description =Arabidopsis thaliana genomic DNA, chromosome 3, TAC clone: K7L4
MPRPLMCKIPKLPLKEESPHCNGNVKHHTPLGKETLKVYVLNKSNHQEKASYCEQQQAREGIRGVNQKQIMGCCPLKLACGLGSVAKHKDLFGVEYHQSSTMYKNEERKKQTPMTNSNASLIHMFQQIRNCNLPLAYLSNKAQSLRLKHENSQNDLNKRYIRLACGLGSVAKHKDLFGVEYHQSSTSKSYCGMKNTHKGIYRRNHLSEFTSKAFNCFLTFNSMEPLPSKPTMVVEIPITSF

SEQ ID NO: 119723 - protein, 100 aa, Glycine max
  Coding DNA Sequence Number=SeqID_2945
  Gene Ontology: Mol. function=copper chaperone activity; Cellular component=mitochondrial intermembrane space; Biological process =copper ion transport
  Homolog annotation: Hit_ID=Q6K670; Match level="QueryCoverage=57%, HitCoverage=73%, E-value=1e-24, Identity=87%"; Hit description =Putative copper chaperone COX17-1
  Pfam annotation: Domain name=COX17; Domain location=37-100; Score =122.0; E_value=1.7e-33; Accession=PF05051.3; Description=Cytochrome C oxidase copper chaperone (COX17)
MCIGGEAKLGPVAVAWRYKTMSGAQLQSASPALTIQGSQKNVGSVAVATAAESKPKKKICCACPDTKRLRDECIVEHGESACTKWIEAHRLCLRAEGFNV

SEQ ID NO: 119724 - protein, 91 aa, Glycine max
  Coding DNA Sequence Number=SeqID_2946
  Gene Ontology: Mol. function=calmodulin binding
  Homolog annotation: Hit_ID=Q9FL13; Match level="QueryCoverage=68%, HitCoverage=33%, E-value=2e-12, Identity=53%"; Hit description =Arabidopsis thaliana genomic DNA, chromosome 5, P1 clone:MSN9
MVSDSSFHGASSIIMLYPEPYIRLQGVILFRWRSEREGVGARKRRLLGSLGKVAREEKVRGRGSCFDSKAFRRDSSFEGSRNGAENRVMCG

SEQ ID NO: 119725 - protein, 465 aa, Glycine max
  Coding DNA Sequence Number=SeqID_2947
  Gene Ontology: Mol. function=DNA binding; Cellular component =chromatin; Biological process=DNA integration
  Homolog annotation: Hit_ID=Q1SAI8; Match level="QueryCoverage=92%, HitCoverage=31%, E-value=1e-112, Identity=51%"; Hit description =Integrase, catalytic region
  Subcellular localization annotation: CTP_CleavageSite=22; ConfidenceScore=5.46e-01
LCVPCPLSSSISLSSLCSLLSMATNKSSFHPALAVSNMRNHVSIVLEMENVQYSTWAELFKIHARSTKVLDHIIPPANGTGTVPSTEEQRELWSTLDAMVLSWIYATISSDLLHTIIEPDSTAMEAWDKLCDIFQDNQHSRAVALEQEFSATSMENFPNVSSYCQRLKSLADQLKNVGAPVSDSRLVLQLVGGLTQPYRGVGTLIRQSNPLPPFYKARSMLTLEEAGMAKEAATESAMIASSINDGSPQPTKSGHSKGKNGAQHSGGGRRNNGGGMKNAGSGGGWNSTDSKGGGRGQSSGGHGLLGPKPPQQAYVHQVASPNPHGQFGLYAPTDIEAAMHTMSLNQPDPSWYMDIGATSHMTSSTEKIIQYPSWYMDIGATSHMTSFTDNLLSYFNLSNHPNPNIIVGNGHTILILGYGHMNLSSPCQSLSLNNVLHAPKLIKNLISVRKFSKEGIGSPLHMVGY

SEQ ID NO: 119726 - protein, 698 aa, Glycine max
  Coding DNA Sequence Number=SeqID_2948
  Homolog annotation: Hit_ID=Q1SAV4; Match level="QueryCoverage=12%, HitCoverage=26%, E-value=6e-21, Identity=54%"; Hit description =Integrase, catalytic region
MPTHHDTTLSLLPFPANIVSLNHHRTTSIINYLRNNLDADGDSDHDTVDLWLHLLGNPEDWRRPRSHQDRGPAQRGLDQGWLRIVLSPGVAVWLRYWWCRVVAQQQRDVGVSRITINTPCVENDLVLKVMKNAQLVPWFPRGLFKRDEQWGWLSMECLGRVAGETGVGPCASLSENDRKIAWPAWCMSGLSTSADTVEGERTPNLPPRKKHHGGVYRQQRHWVIDPGDIGPAAEVLFECAIEHLRLPVGLRMTPSCTGSHGACTPCPEIIRPLCMRYDGWVERQSGPPSKTDQPQLISRYTPEIKEWGGVEEATHSSSSHTSFAGKVLVTPDDRECPVGDPHSTYPVTEHDTNSVGRGSEAWSREGTVAGLDHASSKHGGNLFLDFLLLKMGITIWANIDRRGWRQLEGVWAQVWVWGGACGGGGRAGGGEGKGCICTKGDVTTQMREATVYQYNHLMAAQIPEEAKRLRGWSAVHRIQTDLRSNCMFRHGRSWIVDGIEVRWGLEFIISDEEMADVGRGDGPTAYLLGGVRAPWREEGTKAVVLVPHGKVLESSLKQNSSTSMKGVGLGCGLPNARIPANPIPELAASLAMKGKSRCDTSIDTRITRVPPCKMRQLAGPPISCGGGEGKRKYVMVSEEVAESEIVLGEGFDGLLQLVGGDLACVMLRHGGERRGRNSCVRKKTRVLGVNGARNGEGG

SEQ ID NO: 119727 - protein, 1048 aa, Glycine max
  Coding DNA Sequence Number=SeqID_2949
  Gene Ontology: Mol. function=nucleic acid binding; Cellular component= beta-galactosidase complex; Biological process=DNA integration
  Homolog annotation: Hit_ID=Q1T010; Match level="QueryCoverage=99%, HitCoverage=99%, E-value=0.0, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=275-292; Score =17.7; E_value=0.0012; Accession=PF00098.13; Description=Zinc knuckle
  Pfam module annotation: Pfam domain module=RVT_2::zf-CCHC; Domain location=549-806::275-292
MAMLKNNDQISAKLPIFDGTNYERWTTEMKVVFRYQGVLDIISTGVTPLEMNPMKAHKVTHREQMKKDDKATFLIHQCVDSNILEKIIDYETTKEAWDVLATTYASDKQTKKVRLMALQHQLGLLQMESNEMVAQFVNRLVILANQMKSCGEVVTDSMKVEKVLTGLTPNFDHIVSAIEQSKDLEMLKLEQLLGSLEAHELKMKNREGIKKEEKDFEKALLVKNQKKGGGDSWKNKKGKGKWKYSKQENSGSKSENQKKEGENNGKGKKKSKEHIHYYNCQKYGHYADECNNPKVPRKRGEEAQLAHDSDDEEVVLLMVIVDMKRSIKFGDGSSVMAKGIGKVDIRRDGSKVTISDVLYVPNMESNLLSLGQLLEKGFSMHMEGEHMEVADSNGKCVLEVAVSMNRTFKVGVSTIEQKHLPHDFWAEAVSTTTHILNRCPTKRLDSLTPEEAWSGLKPSVKHFKDEVQIDNEQYVNDEQNVNNGPDVIGVVPLRRSLRQISPPVRFQDYDVFPDTAINVNGELMNLVLLVEAEPISLEETLASPHWRKAMEEELRSIQKNNTWEMVNLPSNKKAIEVKWIFKTKVNPSGEIAKYKARLFVKGFLQKPGLDFNEVYAPVARIETVKLIVAIASMRKWTVSQLDVKSAFLNGPLEEELYTRQPPGYEKIGMEDRVMKLIKALYRLKQAPRAWNKRIDGFLQKQKFLKCTTKHGVYLKDCGVTGVVMLCLYVNDLLVTGDSKQEIDRFKKEMMDEFEMTDIGRIAYFLGIEFVTTKSVIFLHQKKYAIDILKRFNMLDCNSATTPCEPGIKLSTGEDTNLVDSTLYRQLIGSLRYLCNSRLDITYGVGLVSRFMKKPCKDHLLAAKRILRYMKGTLECGILFLAAKENSEIEIVGYTDADWSGDVGDRKSTSGYMFMLGNAPISWCSKKQDVVALSSCEVEYISAAFGASQTLWLGMLLEELNIKCSNVMKLMIDNKSAIDLAKHPIAHGCNKHIEVKYHFLCDQVNKNKLALEYSKTEEQCADMLTKALKPKRLEEMKNKIGMHKLTNLN

SEQ ID NO: 119728 - protein, 153 aa, Glycine max
  Coding DNA Sequence Number=SeqID_2950
  Gene Ontology: Mol. function=protein serine/threonine kinase activity; Biological process=protein amino acid phosphorylation
  Homolog annotation: Hit_ID=O22042; Match level="QueryCoverage=65%, HitCoverage=15%, E-value=2e-16, Identity=49%"; Hit description =Mitogen-activated protein kinase kinase kinase 3
MQDIFRSVRRSLVFCSSPENEEASSLEVIGSLVDKISYCIRSSRVFSKPSLPSPPPPSFPKNATPPIQWQKGELIGCGAFGQVYVGMNLDFGELLAVKQLVAYFDRKIVPVPKAEGTEYVASKKKPPFGPRFIGAAFVQPNKPGFKINGHSIR

SEQ ID NO: 119729 - protein, 258 aa, Glycine max
  Coding DNA Sequence Number=SeqID_2951
  Homolog annotation: Hit_ID=Q852S5; Match level="QueryCoverage=30%, HitCoverage=35%, E-value=2e-31, Identity=84%"; Hit description =Nucleoside diphosphate kinase 2, chloroplast precursor
  Pfam annotation: Domain name=NDK; Domain location=3-109; Score=90.1; E_value=6.7e-24; Accession=PF00334.9; Description=Nucleoside diphosphate kinase
MGEEPNHIFFRANMQKDWLEQSQHVVRQEHYKDLKQKLFFPKLIDYITSGPVVCMGVGIVASARKLIGATYPLQAEPGTIRGDLAVQTRRNVVHGSDNPENGKREIDQTASSRANHQLPILDVVHEVAVYIHRFHNLNLFEQGWYRIKITLRWEDGDDSHPGVLAGVAQYEGAAPKVGADNLCGVLMIDDKDNSFSTSSFRIRYARQDVILAIMISFYVSYGRYKATNIFANDYFYPQGKSSVVILKFELFHTPTPKI

SEQ ID NO: 119730 - protein, 135 aa, Glycine max
  Coding DNA Sequence Number=SeqID_2952
  Pfam annotation: Domain name=XYPPX; Domain location=18-22; Score=2.4; E_value=64; Accession=PF02162.7; Description=XYPPX repeat
  Pfam annotation: Domain name=XYPPX; Domain location=28-32; Score=1.6; E_value=1e+02; Accession=PF02162.7; Description=XYPPX repeat
  Pfam annotation: Domain name=XYPPX; Domain location=33-37; Score=2.2; E_value=72; Accession=PF02162.7; Description=XYPPX repeat
  Pfam annotation: Domain name=XYPPX; Domain location=38-42; Score=2.2; E_value=72; Accession=PF02162.7; Description=XYPPX repeat
  Pfam annotation: Domain name=XYPPX; Domain location=43-47; Score=1.6; E_value=1e+02; Accession=PF02162.7; Description=XYPPX repeat
  Pfam annotation: Domain name=XYPPX; Domain location=48-52; Score=4.0; E_value=22; Accession=PF02162.7; Description=XYPPX repeat
  Pfam annotation: Domain name=XYPPX; Domain location=54-58; Score=1.6; E_value=1e+02; Accession=PF02162.7; Description=XYPPX repeat
  Pfam annotation: Domain name=XYPPX; Domain location=64-68; Score=1.6; E_value=1e+02; Accession=PF02162.7; Description=XYPPX repeat
  Pfam module annotation: Pfam domain module=XYPPX::XYPPX::XYPPX::XYPPX: :XYPPX::XYPPX::XYPPX::XYPPX; Domain location=18-22::28-32::33-37::38 -42::43-47::48-52::54-58::64-68
MSYYNQQQPPVGVPPPQGYPPEGYGKEGYPPPGYPPAGYPPAGYPPPGYPPQQGYPPPPYPAQGYPPPYAPQYAQPPPRQQNSTGPGCLEGWCVPLSLSNSLFQIRSDSLHSLLVLGDFVTRAPTRFIILSPCPL

SEQ ID NO: 119731 - protein, 175 aa, Glycine max
  Coding DNA Sequence Number=SeqID_2953
  Gene Ontology: Mol. function=metal ion transporter activity; Cellular component=membrane; Biological process=metal ion transport
  Homolog annotation: Hit_ID=Q8S1N1; Match level="QueryCoverage=56%, HitCoverage=25%, E-value=2e-21, Identity=51%"; Hit description =Putative magnesium transporter
  Pfam annotation: Domain name=CorA; Domain location=2-174; Score= -52.6; E_value=0.0011; Accession=PF01544.9; Description=CorA-like Mg2+ transporter protein
MVEIKAANHCPLIPLSTKPLSIVTTLKTYPEPHQPQLHLVAKPFPAAPAKIQPLDPKHTPLCLEPCQTSPKSSHYNPFSQLREYVDDTEDYINIMLDDKQNHLLQMGVMLTTATLVVSAFVVVAGIFGMNIHIELFDDQKAGMTQFLWTVGGSTAGTIFLYVVAIAWCKHKRLLE

SEQ ID NO: 119732 - protein, 386 aa, Glycine max
  Coding DNA Sequence Number=SeqID_2954
  Gene Ontology: Mol. function=kappa DNA polymerase activity; Cellular component=nucleus; Biological process=DNA repair
  Homolog annotation: Hit_ID=Q6JDV7; Match level="QueryCoverage=90%, HitCoverage=54%, E-value=1e-144, Identity=73%"; Hit description=DNA -directed polymerase kappa
  Pfam annotation: Domain name=IMS; Domain location=79-385; Score =184.3; E_value=2.9e-52; Accession=PF00817.11; Description =impBmucBsamB family
MEGVDKEKVQRVVYEMSKGSKYFQNEERKEAFIKQKIDNMRIQCASLSQADLAHYQKVADSRIVELESSRDLSRIWLHVDMDAFYAAVETLSNPTLKGKPMAVGSMSMISTANYEARKFGFRAAMPGFIARKLCPELIFVPTDFNKYNYYSDLTRKVFRRYDPNFIAGSLDEAYLDITEVCRERNVKSEEIVQELRAGVNEETGLTCSAGVAPNRLLAKVLGFSDINKPNGEYVLPNDRMAVMTFVSSLPIRKIGGIGKVTENILKRVFGINTCEQMLGKSSYLCALFSQSTADFFCSVGLGLGQTANHQHMNHAKLMFAEELAEMLSADMQKEGLCGRTLTLKLKTASFEVLLVIDDLTLFSLNIFLILVENSLVGLSPLNIKLD

SEQ ID NO: 119733 - protein, 162 aa, Glycine max
  Coding DNA Sequence Number=SeqID_2955
MNALASQCSSGCESGWTLYLEHSFQLNHNASSHTTSQLFKDKQAKKEEAEEEDLSMVSDASSGPPHLHLPDAQDNGSFYSASKAANLGKRSKKRQKVKENQHLPSFLDDTASSPVFDFSMTNVTVTNQQTSTESMLDYSQGFSTTYYEWKILKIGEDGVQGI

SEQ ID NO: 119734 - protein, 64 aa, Glycine max
  Coding DNA Sequence Number=SeqID_2956
MEAIYNGELYTFHIENGELAMCGCRREEPTAFRVWAMKGMERKGRVKQTGESNASFTHHSATRI

SEQ ID NO: 119735 - protein, 434 aa, Glycine max
  Coding DNA Sequence Number=SeqID_2957
  Homolog annotation: Hit_ID=Q75KQ9; Match level="QueryCoverage=92%, HitCoverage=62%, E-value=7e-85, Identity=43%"; Hit description =Expressed protein
MAESTDDESLLARIQQLEQERDELRKDIEQLCMQQAGPGYLAVATRMHFQRTAGLEQEIESLKKKLAACTRENLNLQEELSEAYRIKGQLADLHSAEVSKNMEAEKQVKFFQGCVAAAFSERDQAIIEAEKAKEKEETMLQQINGIHKRVEELTSDCLKLKEFNDALQIDQAVHMKQNENCMKVINKFFQIRQHSLKEFEDMSWNEKCACLLGDSEEVWSFNDASTSKYIGLEIENHLKKRVNALENKQISMDKVIENSIADLKHYHSKCRDEIMNLLGDGESSIKSIINAIDEKVWSFDLSTVPNLTPQRDAEPEESECADLHISPQAKPVSESKRNSPSALSADAGVKGDPSDVLAMALQEKVAALLLLSQQEERHLLERNVNSALQGKTEELQRNLLQVTNEKVKALMELAQLKQEHQLLLEYDYFYDDGY

SEQ ID NO: 119736 - protein, 117 aa, Glycine max
  Coding DNA Sequence Number=SeqID_2958
  Gene Ontology: Mol. function=structural constituent of ribosome; Cellular component=ribonucleoprotein complex; Biological process =translation
  Homolog annotation: Hit_ID=P49200; Match level="QueryCoverage=64%, HitCoverage=61%, E-value=1e-34, Identity=94%"; Hit description=40S ribosomal protein S20-1
  Pfam annotation: Domain name=Ribosomal_S10; Domain location=19-112; Score=114.7; E_value=2.7e-31; Accession=PF00338.12; Description =Ribosomal protein S10pS20e
MKNRRRMQLGNLVESIKSKVRSLKPKKGKKPYMKMDKSASVKDKRLRVKGPVRMPTKVLNITTRKSPCGEGTNTWDRFELRVHKRVIDLHSSPDVVKQITSITIEPGVEVEVTIADA

SEQ ID NO: 119737 - protein, 148 aa, Glycine max
  Coding DNA Sequence Number=SeqID_2959
MFQTLTLPKLRRSEKLVRDYVRKLLVNSNILKFRPAKKDKEKLQGICGRYRRKQLQFDYVEKDIGFHENEGKAVSESEDFQNIIHEHFNLLEKQYRQVKKMSRLLYAESCVCVVSEEWKSFQIVNWEIYMEIGDSITDNIVSEIIDLF

SEQ ID NO: 119738 - protein, 164 aa, Glycine max
  Coding DNA Sequence Number=SeqID_2960
  Gene Ontology: Mol. function=transferase activity, transferring hexosyl groups; Biological process=metabolic process
  Homolog annotation: Hit_ID=Q1SB10; Match level="QueryCoverage=88%, HitCoverage=42%, E-value=1e-19, Identity=72%"; Hit description=UDP -glucuronosyl/UDP-glucosyltransferase
MEVSITSSPSQMKDPEDTSLGGDLLPVSNGYVEWLDSKEDKSVVYISFGSYFVLSKRQTEEIASALLDSGFPFLWVIRVKEEEEGEEVCLRGVGREGEVGEVLFSGGELGFGGAHGGVSSVEKEIKKCSEEVMGSGELRMNVKKWKGLAREAAKEGGPSDFLMP

SEQ ID NO: 119739 - protein, 531 aa, Glycine max
  Coding DNA Sequence Number=SeqID_2961
  Gene Ontology: Mol. function=metalloendopeptidase activity; Cellular component=chloroplast thylakoid membrane; Biological process =response to high light intensity
  Homolog annotation: Hit_ID=Q2JRE9; Match level="QueryCoverage=70%, HitCoverage=71%, E-value=8e-36, Identity=31%"; Hit description =Peptidase, M50 family
  Pfam annotation: Domain name=Peptidase_M50; Domain location=275-470; Score=-32.3; E_value=0.013; Accession=PF02163.12; Description =Peptidase family M50
  Subcellular localization annotation: CTP_CleavageSite=35; ConfidenceScore=5.74e-01
MATLSALSFTNTIRTFPLHTHRLSFSFSSKLTCSRSSLKDDQQTDSCSSNTTTVSVAPENDSETQQQEMDWKSDEEFKKFMGNPSIEAAIKLEKKRADRKLKQLDRETTNTNPLFALFNNLVRDNLLNEKERLQKAEQTFQALDLNQLKSCFGFDTFFATDVRRFGDGGIFIGNLRKPIDDVIPKLEKKLSEAAGREVVVWFMEEKANDITKQACVVQPKAEMDLQFESTKLSTPLGYFSAIALAVTTFGTVALMSGFFLKPNATFDDYLADAVPLFGGFLFILGVSEITTRVTAAHYGVKLSPSFLVPSNWTGCLGVMNNYESLLPNKKALFDIPVARTASAYLTSLLLAVAAFVADGSFNGGDNALYVRPQFFYNNPLLSFIQYVIGPYTDDLGNVLPYAVEGVGVPVDPLAFAGLLGMVVTSLNMLPCGRLEGGRIAQAMFGRSTAMLLSFATSLLLGVGGLSGSVLCLAWGLFATFFRGGEEIPAKDEISPIGESRYAWGIVLGLICFLTLFPNGGGTFSSAPFFRG

SEQ ID NO: 119740 - protein, 61 aa, Glycine max
  Coding DNA Sequence Number=SeqID_2962
MEREIKIKIERIHCMVALMQYCHTGEEYRASKNNNSGCHKNHDILRCGKFRAGCVGIGGGA

SEQ ID NO: 119741 - protein, 247 aa, Glycine max
  Coding DNA Sequence Number=SeqID_2963
MLQEDDSLWNRILVSKYGGWRALDVERVNQQESLWWRDLKKSCGVSAVGEWFNKGMKLKIGCGRRDWEVELVSAFLAELNNYSIRPSEKDRWMWVAGSDNRYTVSGAYAWLYEAVVGSSEEEIFKRVWKVKVSNKYFRDGVFFYVGGMHAAIRNGESSTDGPRGSGLARTSGDFKPAGLASQTCELVPAHVSPDAVAIKPCTGAAVASGGAQARAKTAKSIGSVYSECVTSFSLNSWFFLLWFSCAF

SEQ ID NO: 119742 - protein, 189 aa, Glycine max
  Coding DNA Sequence Number=SeqID_2964
  Homolog annotation: Hit_ID=Q1S7C5; Match level="QueryCoverage=33%, HitCoverage=5%, E-value=2e-07, Identity=42%"; Hit description =Integrase, catalytic region
  Subcellular localization annotation: CTP_CleavageSite=13; ConfidenceScore=5.05e-01
MANPPSTNSAFPSSSAFPNSITEKVNYSNFLLWRQQIKPVIDLYKLQRFVPNPSIQPQFLFDNDHKEGIENPACETWEQQDQVKALLLAHESRLQKYRKISDSPSVNLTQLSTTVPNSSSAQSSDAPNKGSQLSDLENFHSGSGGEFGRGVMVLATLVDSASSVYLENIDDQVMCRTDSVMQLEAYFGK

SEQ ID NO: 119743 - protein, 1306 aa, Glycine max
  Coding DNA Sequence Number=SeqID_2965
  Gene Ontology: Mol. function=phosphotransferase activity, alcohol group as acceptor; Cellular component=cytosol; Biological process =signal transduction
  Homolog annotation: Hit_ID=Q1T2M9; Match level="QueryCoverage=70%, HitCoverage=40%, E-value=0.0, Identity=82%"; Hit description=PIK -related kinase, FAT; PIK-related kinase, FATC; Peptidase M, neutral zinc ...
  Homolog annotation: Hit description=metallopeptidases, zinc-binding site; FKBP12-rapamycin- associated protein, FKBP12-rapamycin-binding
  Pfam annotation: Domain name=FAT; Domain location=846-1078; Score= -54.0; E_value=0.0077; Accession=PF02259.13; Description=FAT domain
  Pfam annotation: Domain name=HEAT; Domain location=102-139; Score =16.0; E_value=0.14; Accession=PF02985.12; Description=HEAT repeat
  Pfam annotation: Domain name=HEAT; Domain location=147-183; Score =5.7; E_value=8.6; Accession=PF02985.12; Description=HEAT repeat
  Pfam annotation: Domain name=HEAT; Domain location=390-427; Score =21.3; E_value=0.0034; Accession=PF02985.12; Description=HEAT repeat
  Pfam module annotation: Pfam domain module=FAT::HEAT::HEAT::HEAT::RVT_ 1; Domain location=846-1078::102-139::147-183::390-427::1112-1296
CISVAGRLSEKNPAYVLPALRRHLIQLLTYLEQSADSKCKEESAKLIGCLIRNCERLILPYTAPIHKALVARLVDVNANTGTISGVLVTVGDLARVGGFAMRQYIPELMPLIVEALLDGAAVSKREVAVATLGQVVQSTGYVITPYNEYPQLLGLLLKLLNGELVWSTRREVLKVLGIMGALDPHLHKRNQKTLPGPHGDVTRSASDSSQQIQSMDEFPMDLWPSFASSDDYYSTVAINSLMRILRDPSLASYHLKVVGSLMFIFKVLPDLFHTVRTCEDSLKDFITWKLGTLVSIVRQHIRKYLQDLLSLISEFWSAFTLPAPARPGLGYPVLHLVEQLCLALNDEFRTYLPVILPGCIQVLSDAERCNDYTYVLDILHTLEVFGGTLDEHMHLLLPALIRFFKVDASVDIRRAAIKTLTSLIPRVQVTGHISSLVHHLKLVLDGGGLCLNELPKLPSSLFSNTEKMMYYEEITVLPMTEYARRKNDELRKDAVDALCCLAHALGEDFTIFIPSIHKLLQKYRLRHKEFEEIEGRLQRREPLILGITASQRLNRRLPVEVISDPLDDVEIDPYEDGSDAHKLRGHQVNDGRLRTAGEASQRSTKEDWAEWMRHFSIQLLKESPSPALRTCARLAQLQPFVGRELFAAGFVSCWAQLNETSQKQLVRNLEMAFSSPNIPPEILATLLNLAEFMEHDEKPLPIDIRLLGALAEKCRAFAKALHYKEMEFEGARSKKMDANPVAVVEALIHINNQLHQHEAAVGILTYAQQHLDFQLKESWYEKLQRWDDALKAYTAKASQATSPHLVLDATLGKMRCLAALAQWDELNILCKEFWTPAEPAARLEMAPMAANAAWNMGEWDQMAEYVSRLDDGDETKLRGLGNTAASSDGSSSGTFFRAVLLVRRGKYDEAREYVERARKCLATELAALGGLRREYLVAGGGCARGVYREKKKWTLDCWFQDNKFLDVVRAAWEGEDERALRRKLQDELWKVATSTESLLRQKGRIKWIRKGDWNSRFYHIMLMAGGLENLCGLRKKSNCFSKTDFKKAWGEAVRECGSSKSPSPKKFRTPLPGGSSLCEGMGEGYCTQPYPYIYKEAVSRFEPMTNKSPRHNFTAAPGLALSPNGFNFKFIKECWGIMKADILKFLGEFHSRDCSKNLVKKVKNVLHEEEVFKVDYEKVYDSVHWGFLFYMMRHMGFCQKWISWIEGCLKSSSISVLGLAELMREAKKKGVYAGFLVGKDKVEVDLLHYADDTMFFGDATVSNVLTIKAILRGFELFSGLKINFDKSMFGAFGVSELWVQNSATMM

SEQ ID NO: 119744 - protein, 176 aa, Glycine max
  Coding DNA Sequence Number=SeqID_2966
MAPEDLEQLTQKTRDQLEESSTEKELVLPPEPEVGPSVAHINIKENCVDPLGNDLDTDEPEKCGLYVKKNPPCLVAIGRLYEGSTTILNIPLANDQVKVGVEKVRDADAHIPVMWDAIVFGVHNDNFPLYIKCEDLSEIAHSGQCLNISIIQLWILHMNETSMRAGNANVYGFLEP

SEQ ID NO: 119745 - protein, 210 aa, Glycine max
  Coding DNA Sequence Number=SeqID_2967
MNEDDEEEPSVFENIDCSYAFTTYPVFATHEDVLQWVRTIAHDIGFVAVIMRSDTSTGKRGRTSFALIGCERSEKYRAYNKALVRTMKNLICGTHNVGVPCATSSQNMGVPYVTYPQKADKSLMSPVSNEHVIKELNPVAVTLPSISSVDLPNFPPSSHEKPTSTRYTPHEPCLQHDPHGQYPQQQLQFPIVYMSMLSAFKVEGLLPHHQ

SEQ ID NO: 119746 - protein, 133 aa, Glycine max
  Coding DNA Sequence Number=SeqID_2968
MDSRDGVSRRGGGGASVAGFCWPSSCYCCAWTYCGACLGMQYFSMKALLMGGQMSLVGGEVRIMVARENVAEEQHHPNLRQGGHASAHDPHSSPDHASGKVLPWNTHPLDDGLLIKPRGLAPPLTKLTALALL

SEQ ID NO: 119747 - protein, 88 aa, Glycine max
  Coding DNA Sequence Number=SeqID_2969
MQHVTGQQAANHRGQVQLNETFYRYTMHQQSQDTSPFPWPTPEQFRATIAWPGDKPDFETGARLTGAPGIEDGAQKDDDMADVLDFFT

SEQ ID NO: 119748 - protein, 86 aa, Glycine max
  Coding DNA Sequence Number=SeqID_2970
  Homolog annotation: Hit_ID=Q1SU13; Match level="QueryCoverage=36%, HitCoverage=7%, E-value=9e-07, Identity=75%"; Hit description=IMP dehydrogenase/GMP reductase
  Subcellular localization annotation: CTP_CleavageSite=71; ConfidenceScore=5.41e-01
MKKNIMSSLLSWPRQEQRKPQHPPCKSRAAPQPPLRACYTSPLRSPSPTSQTPYYKRNSVPTRNPNWNRTRNRTRGPSSRGECSPE

SEQ ID NO: 119749 - protein, 365 aa, Glycine max
  Coding DNA Sequence Number=SeqID_2971
EQQIQRHQGQACSADYSIAWCLLLVDLSEKDIHPGMDEVNQNERHEEDENILEDEDKHEHNEHEEGNEHESEEKGYKRGVRGGGDEQEEVENKNNEVEDERSGGDDEIDENDQEQSAVDTDRDEEFMDEEKEKEEEITRDTGTTSTESETLLENSDVNSAMNMTKSENRSTYTKEKAELPGGTSSNAASGTSANTSSESNQAQNGTVDTLVTEDVKNLHNITTTYLDSHSEAGSNLTAVISGGNLAGTSANTSSESNQAQHGTMNATVTEDAKNVQTEGLEQSGNRVSEENLPGSNSTVPVETEKEDAAAGKSSNLEGGELENTAKFVASNETENNSDTEMSETNKNRNISYVKENTDVTKNEFK

SEQ ID NO: 119750 - protein, 115 aa, Glycine max
  Coding DNA Sequence Number=SeqID_2972
  Gene Ontology: Mol. function=DNA binding; Cellular component=oxygen evolving complex; Biological process=DNA integration
  Homolog annotation: Hit_ID=Q1S1X7; Match level="QueryCoverage=99%, HitCoverage=8%, E-value=4e-36, Identity=62%"; Hit description =Integrase, catalytic region; Zinc finger, CCHC-type; Peptidase aspartic, catalytic
MVAMNEEMDSFQKNQTWDLVELLEGKRVVGCKWVFKKKFGLSSAEVIKYKACLVVKGYSQKEGMDYNELFSPIIRHTSIRVLVALVATMDMELEQLDVKTTFLHGKLKEEILMKQ

SEQ ID NO: 119751 - protein, 292 aa, Glycine max
  Coding DNA Sequence Number=SeqID_2973
  Gene Ontology: Mol. function=nucleic acid binding; Biological process= DNA integration
  Pfam annotation: Domain name=zf-CCHC; Domain location=152-169; Score =15.1; E_value=0.0032; Accession=PF00098.13; Description=Zinc knuckle
MPLGGRIASSNINHFVFVPSESSRFNLEDGQHNQYREIQRKNNFNLWCIKMHALLKEEGNCEPLYGHKLEKSMQQVATEMMYIWPSYEGSVGNDCITLEEVKSSLYSRELQHKAFGNGDEVFASELSVTSSAKGQKKKKDQEFKKGKFDPKGIYKYCKKPDHWKKNCPKKIKKDYVAVVVQSYSYHMSPHQNWFVTYEKKSGGNVLVGNNAPCKTVGMGTIQVRMHDGIFRTLTIVCHIPKLKKNIISMGAMDSKGFTYCVEGGVMKIKGKDKFIVMQGIEQGICISFKVQQ

SEQ ID NO: 119752 - protein, 108 aa, Glycine max
  Coding DNA Sequence Number=SeqID_2974
GALGAETPRCVHHALLAQSRGHVTPAHEQAVHPVGRGCSQSHGVVGEFGGGGVGRQGSEEGPQVELVGTVGGGVAAGTVMVQDDPKSPRISCVGGDYDEGDTSYGSTG

SEQ ID NO: 119753 - protein, 390 aa, Glycine max
  Coding DNA Sequence Number=SeqID_2975
  Gene Ontology: Mol. function=protein serine/threonine kinase activity; Cellular component=membrane; Biological process=protein amino acid phosphorylation
  Homolog annotation: Hit_ID=Q1T3J4; Match level="QueryCoverage=97%, HitCoverage=59%, E-value=0.0, Identity=81%"; Hit description=Protein kinase; EPSP synthase
  Pfam annotation: Domain name=Pkinase; Domain location=75-346; Score =136.6; E_value=6.7e-38; Accession=PF00069.15; Description=Protein kinase domain
  Pfam annotation: Domain name=Pkinase_Tyr; Domain location=75-346; Score=114.3; E_value=3.5e-31; Accession=PF07714.7; Description =Protein tyrosine kinase
  Pfam annotation: Domain name=RIO1; Domain location=88-237; Score= -96.0; E_value=0.068; Accession=PF01163.12; Description=RIO1 family
  Pfam module annotation: Pfam domain module=Pkinase::Pkinase _Tyr::RIO1; Domain location=75-346::75-346::88-237
MCGSVLVLALLIGLATACLRRKNDRERDEEISERTLLQELSTPKSVAVTEEGDLISSDELLFMTLAVIKAATDDFSDTNKLGQGGFGAVYKGVLPDGNEIAVKRLSRKSWQGMEELKNEVILIAKLQHKNLVRLLGCALEGDEKLLIYEFMSNKSLDQFIFDPEKRSKLDWKTYHGIISGIARGLLYLHEESRLKIIHRDLKPNNVLLDHELLAKISDFGMARIFSENQNAANTKRVVGTYGYMAPEYAMEGLFSVKSDVFSFGVIMLEIIIGKRNSGFYMTELAPTLLAYAWRLWNEGKELDFVDPMLLESCDASEIVRCVHIGLLCVQENPEHRPTMSNVVVLLGSESMVLPQPRQPPLSLGRVLRADPSTTTNPSVKEMIFSDILPR

SEQ ID NO: 119754 - protein, 267 aa, Glycine max
  Coding DNA Sequence Number=SeqID_2976
  Gene Ontology: Mol. function=protein serine/threonine kinase activity; Cellular component=anchored to membrane; Biological process=protein amino acid phosphorylation
  Homolog annotation: Hit_ID=Q1T3J4; Match level="QueryCoverage=91%, HitCoverage=39%, E-value=5e-82, Identity=61%"; Hit description =Protein kinase; EPSP synthase
  Pfam annotation: Domain name=DUF26; Domain location=199-250; Score =42.4; E_value=1.5e-09; Accession=PF01657.8; Description=Domain of unknown function DUF26
  Pfam annotation: Domain name=DUF26; Domain location=85-136; Score =42.6; E_value=1.4e-09; Accession=PF01657.8; Description=Domain of unknown function DUF26
  Pfam module annotation: Pfam domain module=DUF26::DUF26; Domain location=199-250::85-136
MFGAKADRCDIGVMVAMLLFMILSLNGVVSGADPIDTYCPSEFPLYSLNSSFHNNLKLVLRLLSSDNASKAGFYDTSIGQGPDKVYGQSLCRGDISNSTACKECIEKASRDIMNRCKSENAMIWYNLCQVRYSFQSFKVVAYTGKYPQQNNEEKKVSDPIRFREYLTYLMSNLSDEAAFNPDKNMFAAGEVDYPGNKTIYGLVQCIPDSQCSSCLTSAFTELTECCSDLEAGIILDRTCNIRFQLSQFFNASSAYRLIYPTSTESRD

SEQ ID NO: 119755 - protein, 521 aa, Glycine max
  Coding DNA Sequence Number=SeqID_2977
  Gene Ontology: Mol. function=extracellular matrix structural constituent; Cellular component=proteinaceous extracellular matrix; Biological process=intracellular signaling cascade
  Homolog annotation: Hit_ID=Q1SKH2; Match level="QueryCoverage=90%, HitCoverage=40%, E-value=2e-22, Identity=27%"; Hit description =Calcium-binding EF-hand
MTEEQVVNVRGEESDSGNDHGSVKANGVAHGVGGDSDLAADNNGAASSGKNCNDAVSNGTAEEGTETATVDVVSREDELKSADSQNGMGSVQNGVVDNDDKSANAVAEELVTDHEEYVVVGDSDVQNGDDVTANGVEECEMLDGAEASGDENGVVVEGEEDVCQSDREFECVDVHDDVTATTDENGGNGNDVQGRSESVSDKDVNKRGESENVVSADVSDEKDIVTDGDHDVEEVVEKNEVPVVVDGGSASTDVKECEPEDAQNSLEKGQVESVSGLAEPVLEPSECTEENEIAVEGEPGSKLERSEEEAGSEIVPEGEILTALSCTDVSDIAVESDGEPSVDVCVMKSNAVESDVDVHELKNSAVDSESEPSNGAVQSEIVSEMKNNTEEREAEPSNGAVDCEAELPNGAVESEAEPSTSAVESEAEPSNGVVERETKPSSGAVERETEPSNGAVESVAEPSNGAIDSEAEPSNGTVEREAAPSNGAVEREAAPSNGVVEREAVPSNGAVRVKLNLQMVQ

SEQ ID NO: 119756 - protein, 277 aa, Glycine max
  Coding DNA Sequence Number=SeqID_2978
  Gene Ontology: Mol. function=acyltransferase activity; Cellular component=chloroplast; Biological process=lipid A biosynthetic process
  Homolog annotation: Hit_ID=Q2HSL8; Match level="QueryCoverage=73%, HitCoverage=97%, E-value=2e-68, Identity=66%"; Hit description =Trimeric LpxA-like
  Pfam annotation: Domain name=Hexapep; Domain location=101-118; Score =20.5; E_value=0.0058; Accession=PF00132.14; Description=Bacterial transferase hexapeptide (three rep
  Pfam annotation: Domain name=Hexapep; Domain location=130-147; Score =16.5; E_value=0.098; Accession=PF00132.14; Description=Bacterial transferase hexapeptide (three rep
  Pfam annotation: Domain name=Hexapep; Domain location=168-185; Score =18.8; E_value=0.019; Accession=PF00132.14; Description=Bacterial transferase hexapeptide (three rep
  Pfam annotation: Domain name=Hexapep; Domain location=190-207; Score =18.7; E_value=0.021; Accession=PF00132.14; Description=Bacterial transferase hexapeptide (three rep
  Pfam annotation: Domain name=Hexapep; Domain location=208-225; Score =16.6; E_value=0.093; Accession=PF00132.14; Description=Bacterial transferase hexapeptide (three rep
  Pfam annotation: Domain name=Hexapep; Domain location=232-249; Score =8.2; E_value=15; Accession=PF00132.14; Description=Bacterial transferase hexapeptide (three rep
  Pfam annotation: Domain name=Hexapep; Domain location=83-100; Score =1.7; E_value=89; Accession=PF00132.14; Description=Bacterial transferase hexapeptide (three rep
  Pfam module annotation: Pfam domain module=Hexapep::Hexapep::Hexapep:: Hexapep::Hexapep::Hexapep::Hexapep; Domain location=101-118::130 -147::168-185::190-207::208-225::232-249::83-100
  Subcellular localization annotation: CTP_CleavageSite=39; ConfidenceScore=5.50e-01
MAVTVRRVLAFASSSSAPFFNLNQNANLRYILPSPRHLSAFSVDSILRLTCVSSLEDGSVADKFHKWHNGGGTLHESASIDSTALVEVGAVVHSESIVGPNVRIGSGTIVGPSVTIAHSTNIGYNVALSNCCIGDSCVIHNGVCIGQDGFGFYVDGDGNMIKKPQMLNVIIGNNVEIGANTCIDRGSWRDTVIGDNSKIDNLVQIGHNVVIGKNCLLCGQVGIAGSATIGDYVTMGGRVAIRDHVSIISKVRLAAASCVTKDIKEPGDYGGFPAVMI

SEQ ID NO: 119757 - protein, 551 aa, Glycine max
  Coding DNA Sequence Number=SeqID_2979
  Gene Ontology: Mol. function=protein serine/threonine kinase activity; Cellular component=membrane; Biological process=protein amino acid phosphorylation
  Homolog annotation: Hit_ID=Q1T3J5; Match level="QueryCoverage=99%, HitCoverage=86%, E-value=0.0, Identity=74%"; Hit description=Protein kinase; N-6 Adenine-specific DNA methylase
  Pfam annotation: Domain name=DUF26; Domain location=1-50; Score=35.1; E_value=2.3e-07; Accession=PF01657.8; Description=Domain of unknown function DUF26
  Pfam annotation: Domain name=DUF26; Domain location=108-162; Score =81.6; E_value=2.4e-21; Accession=PF01657.8; Description=Domain of unknown function DUF26
  Pfam annotation: Domain name=Pkinase; Domain location=237-508; Score =157.4; E_value=3.7e-44; Accession=PF00069.15; Description=Protein kinase domain
  Pfam annotation: Domain name=Pkinase_Tyr; Domain location=237-508; Score=145.5; E_value=1.4e-40; Accession=PF07714.7; Description =Protein tyrosine kinase
  Pfam module annotation: Pfam domain module=DUF26::DUF26::Pkinase::Pkin ase_Tyr; Domain location=1-50::108-162::237-508::237-508
MCLDYITNESCKTCITTATEDIVKLCPLATEAVVWEEFCLLRYSNSNFIGSLNVTGNIGLDNKQNLSEPEKFESAVNQTISNLTKVASFGVSANMYATGEVPFEDETIYALVQCTRDLIASDCSRCLQSAIGDIPGCCYASIGGRVLSRSCYLRYEFYAFYHGATGPTNSTTGKKESKNNSSKLWMITGIIVVVGLVIVFVIFGLYLVGIKRKRQSKNGIDNHQISLGSLRVATNNFSDLNKLGQGGFGPVYKGKLRDGQEVAIKRLSTCSEQGSEEFINEVLLIMQLQHKNLVKLLGFCVDGEEKLLVYEFLPNGSLDVVLFDPKQRERLDWTKRLDIINGIARGILYLHEDSRLKIIHRDLKASNVLLDYDMNPKISDFGMARIFAGSEGEANTATIVGTYGYMAPEYAMEGLYSIKSDVFGFGVLLLEIITGKRNAGFYHSNKTPSLLSYAWHLWNEGKGLELIDPMSVDSCPGDEFLRYMHIGLLCVQEDAYDRPTMSSVVLMLKNESATLGQPERPPFSLGRFNANEPDCQDCSLNFLTLSDIVPQ

SEQ ID NO: 119758 - protein, 252 aa, Glycine max
  Coding DNA Sequence Number=SeqID_2980
MAEIPKLDLSSSCFDNGEPLDSEQKSQKIFVSDHINAFQYADEKADSFVIDMDAFSSGHNKDATNANSRITRSLSRKGSQRLGDWKLNNNATLYDKDTVPAICSPKGTLVGPFTPEKPAGMAVGPMGHSMNPHVHNLTADNIPTESKCSITRRNSFRRPSSWAIDPKRVLLFFATLSSMGTMLLIYFTLTIRFSGGWIINHLLLFLIVDPYLFVVLCSYMQSKRELRERKPIPYHERFLEAIAVFAYRRILA

SEQ ID NO: 119759 - protein, 168 aa, Glycine max
  Coding DNA Sequence Number=SeqID_2981
  Homolog annotation: Hit_ID=Q1SD99; Match level="QueryCoverage=76%, HitCoverage=83%, E-value=3e-43, Identity=58%"; Hit description =Harpin-induced protein 1 (Hin1), putative
  Pfam annotation: Domain name=Hin1; Domain location=59-165; Score=3.6; E_value=0.00077; Accession=PF07320.4; Description=Harpin-induced protein 1 (Hin1)
MPAISPAYYAPNYNNLLHHSPLYNEINALSQISNIFVKSLCIWLLQVIGLLSLIVLCLWLALRPKSPSYSIVFISIGQPSNSNENNTIFYNLDIENPNKDSSIYYDDTILSFLYGEQEDDVGETTIGSFHQGTGNTRDVSDTTWGIKSKFHGLHLKGILPIDSDGEAL

SEQ ID NO: 119760 - protein, 105 aa, Glycine max
  Coding DNA Sequence Number=SeqID_2982
AIISLPSVSDPLAALDGIMGDFTWWPLVKQVGPVGGIVQPFVVALSVGEGGQTTRNRLLTSIIKDFQHRLLTNVETTDVKSLNVNIGFPKPMLSKLHKITTLQLT

SEQ ID NO: 119761 - protein, 244 aa, Glycine max
  Coding DNA Sequence Number=SeqID_2983
MRMEFLSPPTFFPNFQWTHKIYMTSYMVLNGICQPSTSAILQEHKCLTLSSLTPQQTGSPLVKGTSPSRCIKFETALNDVNLDVSRFQILEQDPEDIKRSNIGIGKQTEEKWKNEADKDSGMSDNLHQNRNPHSTSKRLEVSPNTVNPDAGPLLSFTGKGVETRGYADLMTPFSQGKLTRSLTIKYLLVDTDTLYFALMERKTLNELGGIVSTPHLTMTFLALTWEIVTVKTDQKQARSAMQRA

SEQ ID NO: 119762 - protein, 195 aa, Glycine max
  Coding DNA Sequence Number=SeqID_2984
MRIHFFYIYIVSCETNTKDEEKGNDGSCETEKGRKSLNGSSRRRTKIVRVTMRLQHDAIEGDSDVAASQEVALLVVIANAPSSILTKRKRNDAIGSSRCKKSKVPISLCALRQCVGLMPIAGCLSTAQDVSLAPPVIEAPTAATSTPTTLGPSPPRAVVVQEDTLVVPATQADSAMALSSIITHHRDTFIKCWSG

SEQ ID NO: 119763 - protein, 61 aa, Glycine max
  Coding DNA Sequence Number=SeqID_2985
MGVKYLEVVKRGSHPNKQMGFQALEREGEETEAFIPLSACNEYFSLPRHHFTNPNGEDMLE

SEQ ID NO: 119764 - protein, 218 aa, Glycine max
  Coding DNA Sequence Number=SeqID_2986
  Gene Ontology: Mol. function=protein transporter activity; Cellular component=endoplasmic reticulum; Biological process=ER to Golgi vesicle-mediated transport
  Homolog annotation: Hit_ID=Q9C827; Match level="QueryCoverage=53%, HitCoverage=10%, E-value=4e-35, Identity=65%"; Hit description =Coatomer complex subunit, putative; 33791-27676
MVSITLGVAVATYNEAKFDAWVFKLILNVVGSIFWKIYTNSPFQCTCRLESTLNYGLERVWAIGYLKSSHRVVIGYDGGKIMVKLGQEVPVASMDNNGKKFWSKHNEIQTLARQTPNLIETSRDNEIQTVNIKSVGADVEVADEEMLPLVIKESGTCDLYPQEYSASVSRSPFPVGIILFGRIRRSKGVLDLDLALQVGKTATITDASSNEEKTHYKT

SEQ ID NO: 119765 - protein, 115 aa, Glycine max
  Coding DNA Sequence Number=SeqID_2987
  Gene Ontology: Mol. function=protein dimerization activity; Cellular component=nucleus; Biological process=regulation of transcription, DNA-dependent
  Homolog annotation: Hit_ID=Q0GPF1; Match level="QueryCoverage=86%, HitCoverage=66%, E-value=2e-29, Identity=66%"; Hit description=BZIP transcription factor bZIP41
  Pfam annotation: Domain name=bZIP_1; Domain location=20-84; Score =27.8; E_value=3.8e-05; Accession=PF00170.11; Description=bZIP transcription factor
EMTSSQSLVKSDYEGGDPPQMDETNMKRRALNREYARQSRLRKHKRLEDLTNEVNMLQSANKKLVESIKAKEEAYAETEVDNNILRAQTVELTDRLRFLHSIIQVAEKAKGLSVN

SEQ ID NO: 119766 - protein, 111 aa, Glycine max
  Coding DNA Sequence Number=SeqID_2988
MAVEMTTPDRPPFFFMCRSSFEVLGVILPLTTFQWALLEHLNVAPSQLYPNRLVMAIISLPSVSDPLAALDGIMGDFTWWPLVKQVGPVGGTVQPFVVALSVGEGGQTTRK

SEQ ID NO: 119767 - protein, 66 aa, Glycine max
  Coding DNA Sequence Number=SeqID_2989
MGLRKKTGEWRIGEQRYAITSRGSRLEGGGHMNSASGEWRIGEQRYAITSRGSRLEGGGCMNSARQ

SEQ ID NO: 119768 - protein, 34 aa, Glycine max
  Coding DNA Sequence Number=SeqID_2990
  Homolog annotation: Hit_ID=Q8GQC5; Match level="QueryCoverage=95%, HitCoverage=4%, E-value=9e-07, Identity=72%"; Hit description=1,4 -alpha-glucan branching enzyme
MATDRFGRDPPLIAGVAAVIVVRIGIEDLAIVAG

SEQ ID NO: 119769 - protein, 132 aa, Glycine max
  Coding DNA Sequence Number=SeqID_2991
MSTWEELDDTLFGEETKKEEKVNLCLMVDTASEESDSELDEEYELSKNYLKMLLYFIKKLNFRETLSKFVGCNEKLNKMLRYSKCLTNKFGNEYKGKKYVHDCRNLPFSGRATLGLTGASSKRGRCNIPLFP

SEQ ID NO: 119770 - protein, 98 aa, Glycine max
  Coding DNA Sequence Number=SeqID_2992
MEEGYFTNKPPLFRGVKYDYLKERKMQQAQLVDTTLSRKWRPYLTTLRIVKNLNSMSIEELIETLKVHEQELQQDEGFKKGKSLALIDQKAKVSSTCK

SEQ ID NO: 119771 - protein, 44 aa, Glycine max
  Coding DNA Sequence Number=SeqID_2993
MAVLGRCGHNVDGGCHLPYVDDGNQRMMVLLDGYDGGCKREERQ

SEQ ID NO: 119772 - protein, 151 aa, Glycine max
  Coding DNA Sequence Number=SeqID_2994
MAVPKLEKMQRQDETNKKQAVPLGVENNDGLWWLMVAVGDGESSWNFRNGFGRKKEEEMTHLLKDPNGKIMDNCLASSRSFIKRLLTHSKHLLKDPNGQIMDTCLVKLKTKFREDPTVNEGWAALLPRQLHVAFSRSFIKRLPPEASSWLL

SEQ ID NO: 119773 - protein, 390 aa, Glycine max
  Coding DNA Sequence Number=SeqID_2995
MDDIDAILPRKGPITRTMSKRLQEDWARAAKEGPRVLMNLRVILLSDTIAKATRCLREGNTYLEGWERNYNSHITRALYRYNADKASDKKTIVYNFMCGKEKIWDNILNNNIYYVALINKLLWDQGVYYVFNKMDEDSKHILIVNGLVVAKQQKFSKNNLKAMKVSLEQSLKETPKVGVKAINKRKQKEAKKHRTKRRHESITFALTCPPTVNPIAQRLKDLSETDDDDDDEGLVRVALQKMKVVAPDAPTPKKAKKAQPIAKPKTFVLTSAIPCWINTRATKANPKIGDKEWAISFTRNKEDPALSSSDGESIDGTPITPLRKFAPTPQQCPSPSPLHLDRFKRATPRVPLSDAQCFLLVFSHVREEGARVEANYKTAASASYGHPTLT

SEQ ID NO: 119774 - protein, 84 aa, Glycine max
  Coding DNA Sequence Number=SeqID_2996
MVSSSLSYPNFIQGPLFARMQTSFDHFRTLETCPHGIREVPRHSGKGTEPLLITPEHLTLIIVQSVKFREVMERNQQKSTKGCI

SEQ ID NO: 119775 - protein, 154 aa, Glycine max
  Coding DNA Sequence Number=SeqID_2997
MMQGPFGVRSYGWILKKPPPLAMMEVKLLCTAMLFKCYDLLGSITLMTLVSTLLEMMKTTSSSNLYKAQQKKRAKDVVVDATVVIDEQEAATTAEKVQAGASTKAADNTNVCGVIIDLTNTSVMDETGEASNVDEVEPLIPDLASKLLEIGGET

SEQ ID NO: 119776 - protein, 157 aa, Glycine max
  Coding DNA Sequence Number=SeqID_2998
  Gene Ontology: Mol. function=DNA binding; Biological process=DNA integration
  Homolog annotation: Hit_ID=Q1SXA8; Match level="QueryCoverage=45%, HitCoverage=4%, E-value=2e-23, Identity=69%"; Hit description=Zinc finger, CCHC-type; Polynucleotidyl transferase, Ribonuclease H fold
MERTKTQHFIFPSFWMCSKTSKAYRVYKSRTLVEEEAIHTRVSLRQHGYTTLISEVEPKHIDDAMEDENWLIENETISNEHKSAFLNGVIQEEVYVEQPPGFESNTFPHHVFKLHKAMYELKQAPRAWYQHLSSFLVNNDFESRKVDTTLFCKCYNS

SEQ ID NO: 119777 - protein, 65 aa, Glycine max
  Coding DNA Sequence Number=SeqID_2999
MFAYSPFAKRKPRAERIFCYALSGESLALSTQPLHLKLTWSTKLTKAELSPFQLDLNWAKRRLAH

SEQ ID NO: 119778 - protein, 93 aa, Glycine max
  Coding DNA Sequence Number=SeqID_3000
MAYGTRAAYSMNGGSGSLASSPCGSKQWKLGYVGFLVYTGGGLDGCGVGVGVASLSDEQETMKDGILMGSFRVKDLHLGLIFLFFGKEDVIIG

SEQ ID NO: 119779 - protein, 130 aa, Glycine max
  Coding DNA Sequence Number=SeqID_3001
MSNSNENTAPTITIITIDTTTIHTDGEPTVHIEQFFDINSIRPSTHCPHQHTKEHEGLGRSGRYLLCHPHQQTPLGTLVNQDEILQRRQKKLAKTVASEDKPLKTFELDKKVQRVLREQQGKVQTRKQAQ

SEQ ID NO: 119780 - protein, 75 aa, Glycine max
  Coding DNA Sequence Number=SeqID_3002
MELDRACPRLPICDEGKKKGFKLYFNEDMPSQRLIRKLDANDVRTSWNQTVWYDTKGASSSNSTHVPAFQQRNSI

SEQ ID NO: 119781 - protein, 68 aa, Glycine max
  Coding DNA Sequence Number=SeqID_3003
MGPVTRAMRKRLQDNWARAGKEGPRVLMNLRPPSTFSKKLSSLLPKEATFPTSQGSFPLYFLLDKWPQ

SEQ ID NO: 119782 - protein, 166 aa, Glycine max
  Coding DNA Sequence Number=SeqID_3004
  Gene Ontology: Mol. function=RNA-directed DNA polymerase activity; Cellular component=intracellular; Biological process=RNA-dependent DNA replication
MVPEDMEKTTFVTLWGTFCYKVMSFGLKNARATYQRAMVALFHDMMHREIEVYVDDMIAKSKTEEEHLVNLRKLFERLRKYRLRLNPAKCTFEVKSGKLLGFIVRQKGIEVDLEKVKAVLEMPEPRTEKQVQGFLGSLNYIARFISQLTAICEPLFKLLHKNQSIR

SEQ ID NO: 119783 - protein, 310 aa, Glycine max
  Coding DNA Sequence Number=SeqID_3005
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=60%, HitCoverage=25%, E-value=2e-45, Identity=52%"; Hit description =Receptor kinase-like protein
  Pfam annotation: Domain name=Pkinase; Domain location=52-290; Score= -51.2; E_value=1.6e-05; Accession=PF00069.15; Description=Protein kinase domain
  Pfam annotation: Domain name=Pkinase_Tyr; Domain location=68-290; Score=-101.7; E_value=3.1e-06; Accession=PF07714.7; Description =Protein tyrosine kinase
  Pfam module annotation: Pfam domain module=Pkinase::Pkinase_Tyr; Domain location=52-290::68-290
MKKEKQKNSNYYFPSGALDQDPHHGGDGHALDGTKSRLRVVEDVDEEKEKEEKKKKKIKEVSHECSLVNKHKPIWMRKPEEMTKEEYSAIMNSSSISLIRSMTKEEYSAKGSSVLNSWKMRIRIALDASRGIQYLHNYADSFIIHGDIKSSNILLDASWTARVSDFGWKFMRNKQRIIENTDPEYVIRGALSAESDVHGLGVVLFELLTGKRPTFVYGEDGGTLLSRKHLVDFAVTAISNGFLEKFLDQRAGQPDVNEAEAVKLVADTAIRCVNLKLKDRPTMADIVVRLERALAICDYDSIFRALVSNC

SEQ ID NO: 119784 - protein, 42 aa, Glycine max
  Coding DNA Sequence Number=SeqID_3006
MADQQATKSKAKGKQSTRTHLVAHDPGDLNKTSASSEGSKIP

SEQ ID NO: 119785 - protein, 613 aa, Glycine max
  Coding DNA Sequence Number=SeqID_3007
  Gene Ontology: Mol. function=RNA-directed DNA polymerase activity; Cellular component=exocyst; Biological process=exocytosis
  Homolog annotation: Hit_ID=Q1S1D5; Match level="QueryCoverage=95%, HitCoverage=95%, E-value=0.0, Identity=67%"; Hit description=Exo70 exocyst complex subunit
  Pfam annotation: Domain name=Exo70; Domain location=27-590; Score =649.4; E_value=2.9e-192; Accession=PF03081.6; Description=Exo70 exocyst complex subunit
  Subcellular localization annotation: CTP_CleavageSite=26; ConfidenceScore=5.06e-01
MPRKGMRSIFFKPSTSTSSLPPPPSRQRTFSDSLMDENIETAEKLITKWDDSKVPTTTALFSGTRQEAKQYLNAVKGLQSAMQYLVAQDSTSSTLVRAQLLMQLAMKTLQKEFYQILSSNREHLDPETVTTRSSVDLRSVSDYVSDYDDEISITEDEFRVSETERVSMLAMEDLKAIAESMISSGYGKECVKVYIIMRKSIVDEALYHLGVEKLSLSQVQKLDWEVLELKIKSWLQVVKVAVGTLFHGERILCDHVFASDSGKRIAESCFAEITKDGAVSLFGFPEMVAKCKKTPEKMFRILDLYEAISDYLPQIESIFSFESTSNIRSQAVTSMVKLGDAVRTMLTDLETAIQKESSKKPVPGGGVHPLTRYVMNYLTFLADYSGVLVDIIADLPQSPLPESYYRSPMREENPPASELSERIAWIILVVLCKLDGKAELYKDVAHSYLFLANNMQYVVVKVRKSNLGFLLGEEWLDKHKLKVREYASKYERVGWSAVFSALPENPAAELTAEQARACFVRFDAAFHEACRKQASWFVSDPKFRDEIKGSIASKLVQKYSEFYEKNRVGSESVRGFLPDDIGKYLSNILCNGDSGSVSSHSSSTTSSSHRSNR

SEQ ID NO: 119786 - protein, 86 aa, Glycine max
  Coding DNA Sequence Number=SeqID_3008
MMIWKQRAKLVMATARWVLKHPIYGIVILRLGIYTKYKSGDPTVMWLRMPPDSWVTVTKGGVVYKSRAFAPTYPQFVMRNSDLRSS

SEQ ID NO: 119787 - protein, 37 aa, Glycine max
  Coding DNA Sequence Number=SeqID_3009
MVALPMTQDTIVVDLKMKVVKPREPLRMITMAKAVAS

SEQ ID NO: 119788 - protein, 434 aa, Glycine max
  Coding DNA Sequence Number=SeqID_3010
  Gene Ontology: Mol. function=nucleic acid binding; Cellular component= intracellular; Biological process=regulation of transcription
  Homolog annotation: Hit_ID=Q1SGQ8; Match level="QueryCoverage=100%, HitCoverage=96%, E-value=0.0, Identity=78%"; Hit description=Zinc finger, C2H2-type
MPTVWFSLKRSLHCKSEPSDVHDPKTRKQLTTIFTKKGGGSSRSGCSRSIANLKDVIHGSKRHLEKPPSCSPRSIGSSEFLNPITHEVILSNSRCELKITGYGGFQEGGVGSDGGGGGANNGGVNNSSDLSTFVGTLRPGTPGPGGHPTMHYFNPSFRTSSTPPRKSPFLSSDKEGSGLHGVGVLGPHSSTRVPLETDSNVSSTVTCHKCGEQFNKWEAAEAHHLSKHAVTELVEGDSSRKIVEIICRTSWLKSENQCGRIERVLKVHNMQKTLARFEEYRELVKIKASKLPKKHPRCLADGNELLRFYGTTVACSLGLSGSSSLCLSEKCCVCRIIRNGFSAKEELKGGIGVFTTSTSGRAFECIEVFDHDPSLRKALIVCRVIAGRVHRPLENIQEMAGQTGFDSLAGKVGLYSNIEELYLLNARALLPCFV

SEQ ID NO: 119789 - protein, 114 aa, Glycine max
  Coding DNA Sequence Number=SeqID_3011
  Subcellular localization annotation: CTP_CleavageSite=38; ConfidenceScore=5.22e-01
MDVQESQANPMVSTRLGPREKKLAQPTNRSSWRQRPLTAATGQSQRPSRDKQQLAEQQQQQHTFLHKPQAESESEGEIRASIEPASPAPAAAAMPAKEEATPAPPAALNSKSSM

SEQ ID NO: 119790 - protein, 69 aa, Glycine max
  Coding DNA Sequence Number=SeqID_3012
MEKFDKRNFKEKKEKKEKKASITWEDNDMDSSSDSENEIINLGLMAKDYESGEEMHSMTCIKNLSNLPN

SEQ ID NO: 119791 - protein, 85 aa, Glycine max
  Coding DNA Sequence Number=SeqID_3013
MARRKRSWCTLGLRFYNGRSYTQEQPASHVGDPWARQIAITIGDLALTDVLCALSFMTAMAGYSAVGTRQFDWRFPMASANRHYS

SEQ ID NO: 119792 - protein, 55 aa, Glycine max
  Coding DNA Sequence Number=SeqID_3014
MKWEMFVDVEGGVRTEAFTRGKGAIFVPTHILVAFHGANTYALSLLPSTNKQNYQ

SEQ ID NO: 119793 - protein, 91 aa, Glycine max
  Coding DNA Sequence Number=SeqID_3015
  Subcellular localization annotation: CTP_CleavageSite=46; ConfidenceScore=5.36e-01
GSRPQDTQWTRKSPTGPWGSSSDYGPLSVLRSACRPNKVIRPRINRAFIKKYCAPRRAQGETPQQPRDGWQRATNAPPPPLEFISTHPQKG

SEQ ID NO: 119794 - protein, 105 aa, Glycine max
  Coding DNA Sequence Number=SeqID_3016
MVLFVLHRSSLILPQQKTFAKVVQHACTIPLSQLLVLCLKGNALSITIPEEECKVDFHSNDVCQSNAQCRVRIYNLPQEYWRENILFAIARGVGVPLALNEATNN

SEQ ID NO: 119795 - protein, 179 aa, Glycine max
  Coding DNA Sequence Number=SeqID_3017
  Gene Ontology: Mol. function=protein kinase activity; Cellular component=coated vesicle membrane; Biological process=intracellular protein transport
  Homolog annotation: Hit_ID=P93078; Match level="QueryCoverage=89%, HitCoverage=100%, E-value=1e-78, Identity=89%"; Hit description=Ap19 protein
  Pfam annotation: Domain name=Clat_adaptor_s; Domain location=19-160; Score=252.3; E_value=9.9e-73; Accession=PF01217.10; Description =Clathrin adaptor complex small chain
MNWDHQCYTLFPQGILIYLINFVLLISRQGKVRLTKWYSPYSQKERSKVIRELSGMILSRAPKQCNFVEWRGHKVVYKRYASLYFCMCIDQDDNELEVLEMIHHFVEILDRYFGSVCELDLIFNFHKAYYILDEILIAGELQESSKKTVARLIAAQDSLVENAKEEASSFSNIIAQATK

SEQ ID NO: 119796 - protein, 138 aa, Glycine max
  Coding DNA Sequence Number=SeqID_3018
  Subcellular localization annotation: CTP_CleavageSite=27; ConfidenceScore=5.08e-01
MATHGVTPTQTTRFMAMFGVTPTQPTESMAVPSVTHIQPIDQSIEMFAHVTTSQPTVSMEMPCVTHIQPIESMEMHDVTPIQPTRSTTMPGMTSTQQNLTITMSDEAPPSFEFMKQRLEMMASTMETSGHTFSPQMRA

SEQ ID NO: 119797 - protein, 158 aa, Glycine max
  Coding DNA Sequence Number=SeqID_3019
  Gene Ontology: Mol. function=nucleic acid binding; Cellular component= chromatin; Biological process=DNA integration
  Homolog annotation: Hit_ID=Q1T010; Match level="QueryCoverage=77%, HitCoverage=9%, E-value=2e-38, Identity=57%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MMKEFEMSDLGLLCYFLGIEFKTIDNGVPISWCSKKESIVALSSCEAEYITASMSACQDVWLNTLMQEIKVKNSREVKLFVDNKSAINLAKHLVAHGRSKHIETRFHFLRDQVNKGKLILEYCKTELQVAKIFTKALKGEKFRDLRDVLGVISLSHSN

SEQ ID NO: 119798 - protein, 206 aa, Glycine max
  Coding DNA Sequence Number=SeqID_3020
  Homolog annotation: Hit_ID=Q1SWV5; Match level="QueryCoverage=21%, HitCoverage=6%, E-value=1e-08, Identity=68%"; Hit description =Tyrosine protein kinase, active site
MGGRSHSLFGGTEEERKRKLAGSGKHADTSASGSSFPSPSSPSLLLPHPPPSLTPRAAATTAPQAYFSRRNHPLPHHTVSAAFSTKSFCNEILILSSINHAKHVKLHKYCSDPTFLLQGLVDGVVVRREDEGEVATDGGGVEEVRAAEEAEEERHDSVRDLLGARAMGDMGEVGKGVEEHDGGSLDLVIGEANEGFEFEGTVLNTV

SEQ ID NO: 119799 - protein, 62 aa, Glycine max
  Coding DNA Sequence Number=SeqID_3021
MVRSIIQCCLYILNRSPTKRLSGKTLEDAWAGTKPDVTRFKVFSSICFRHVPGQLRRKLDNK

SEQ ID NO: 119800 - protein, 224 aa, Glycine max
  Coding DNA Sequence Number=SeqID_3022
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=98%, HitCoverage=17%, E-value=2e-46, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=11-28; Score =10.2; E_value=0.02; Accession=PF00098.13; Description=Zinc knuckle
GKKKFNKRKIQCYYNYNKWGHFADECRSGKGGKGKLNDEANLAHDDGSNSDPVLLMVTTSSEYECSRTKIDNFSSWYLDTGCTTHMTGKRDWFVSLRAEGVGKVLIKWNDGKQSFIFGVLFMLGMKSNLLSLGQLLEKRFVMKMEDNVLKVYDNKKRLILKALLSKNITFKVGIDVMEHECLATTVRKSEWLCHYRFEHLNFKDLNLLHRDNMVNELPHIQVPN

SEQ ID NO: 119801 - protein, 147 aa, Glycine max
  Coding DNA Sequence Number=SeqID_3023
  Gene Ontology: Mol. function=imidazoleglycerol-phosphate synthase activity; Cellular component=imidazoleglycerol-phosphate synthase complex; Biological process=amino acid biosynthetic process
  Homolog annotation: Hit_ID=P60664; Match level="QueryCoverage=53%, HitCoverage=30%, E-value=7e-35, Identity=91%"; Hit description =Imidazole glycerol phosphate synthase subunit hisF
  Pfam annotation: Domain name=PRA-CH; Domain location=88-147; Score =100.1; E_value=6.6e-27; Accession=PF01502.9; Description =Phosphoribosyl-AMP cyclohydrolase
MMNQDGVRNGYDLDQLRKVREVCNVPLIASGGAGTMEHFLEAFRDANVDGALAASVFHKQIINIGELKTFLAAQGVEIRHAESGEVLMLGYMNEDALAKTQESGKVTFYSRTKQRLWTKGETSGNFLNVVSITPDCDNDTLLVLVNP

SEQ ID NO: 119802 - protein, 462 aa, Glycine max
  Coding DNA Sequence Number=SeqID_3024
  Gene Ontology: Mol. function=binding
  Homolog annotation: Hit_ID=Q7N1A5; Match level="QueryCoverage=99%, HitCoverage=50%, E-value=7e-92, Identity=51%"; Hit description =Complete genome; segment 13/17
  Pfam annotation: Domain name=DUF637; Domain location=88-258; Score =33.9; E_value=9.6e-08; Accession=PF04830.3; Description=Possible hemagglutinin (DUF637)
ALQSAIDALGNTPGTTWVKDLNKRNDVQWSNVKDAYDSWDYKSQHLNPAVAAVIAIAAAAVTAGSSLAATAASSVSGAVGGGAVTSGAVTAGMSSLASQAAVALVENQGNLSKTLQALGSNENVKATATAMAIGGALNGFDSAMGWSKDAAGKPLNPNNVKLPQLSNGDWSKVAQRVAGQSVISSSLNTAINGGSFKDNLTNALLANIGSQVQAEGANLIGDNGDVLGTAGKSVSHAVVAGIAAEIGRGDGKGAAAGALAAELAGVVMQSTLFEPANLNEKERQLYRLQEALNGNEVKEQTARVIGALTGALTTHTPEGAYSAADSAQSVYRYNMTEHMLMQYALDNQKDILAADKGDVAAAKRVVARREAAAIVATVGGGGLVLTAGGMTLVGAAPELVLAARLAIAGCKTNPALCLNQAGIYAADIVAPEAIIGTGAVTTGSTLIPGKTEDGVRKLSRQL

SEQ ID NO: 119803 - protein, 252 aa, Glycine max
  Coding DNA Sequence Number=SeqID_3025
  Gene Ontology: Mol. function=metalloendopeptidase activity; Cellular component=nucleus; Biological process=proteolysis
  Homolog annotation: Hit_ID=Q1T0S6; Match level="QueryCoverage=99%, HitCoverage=29%, E-value=1e-112, Identity=79%"; Hit description =Peptidase M, neutral zinc metallopeptidases, zinc-binding site
  Pfam annotation: Domain name=Peptidase_M3; Domain location=15-252; Score=-82.5; E_value=3.9e-06; Accession=PF01432.10; Description =Peptidase family M3
MAAKIGFTVDKAEELLEKLRRSSWDAAVQGNNLGFASFFLADIEDLKEFSKSQGALEAGDLTHWDITYWSERLPIISTHVNCQPHEELRPFFSLPKVMDGLFNLAKSLFGIEIEPADGLAPVWNNDVRFFCVKDSSGSPIAYFYFDPYSRPAEKRQGAWMNEVFARSRVLSRDGTSARLPVAHMVCNQTPPVGNKPSLMTFREVETVFHEFGHALQHMLTKQDEGLVAGIRGIEWDAVELPSQFMENWCYHR

SEQ ID NO: 119804 - protein, 133 aa, Glycine max
  Coding DNA Sequence Number=SeqID_3026
  Gene Ontology: Mol. function=metalloendopeptidase activity; Cellular component=cytoplasm; Biological process=proteolysis
  Homolog annotation: Hit_ID=Q1T0S6; Match level="QueryCoverage=99%, HitCoverage=22%, E-value=4e-36, Identity=51%"; Hit description =Peptidase M, neutral zinc metallopeptidases, zinc-binding site
MVNHLKVVNDSSELRSTIEHVQLLEIALGLYPEVAAQLLGFCLITWKELQKFGENVLDATKKFGKLITNKNEIEGLPVIALGLAAHSAVSKGHENATTENGEWIITLDAPSFIVVLQHARNRSLREEIYRAYV

SEQ ID NO: 119805 - protein, 154 aa, Glycine max
  Coding DNA Sequence Number=SeqID_3027
  Gene Ontology: Mol. function=unspecific monooxygenase activity
  Homolog annotation: Hit_ID=O04892; Match level="QueryCoverage=60%, HitCoverage=16%, E-value=4e-13, Identity=53%"; Hit description =Cytochrome P450 like_TBP
MNRKLVYGAQLRANLDPTKGFGRLRQQDGGHGSRNPLRRRGGRCKTQGASPGGAVVGADLGGTGEARLIALCARTPKGNRPAHPGNGSAGGRVQRLEEHRTSRGVRQGKSAKWIRNLGKRIGSEGWARGSQSRTRRLSVDCSSCFRGESGSSRA

SEQ ID NO: 119806 - protein, 107 aa, Glycine max
  Coding DNA Sequence Number=SeqID_3028
LGRIDGDPVLRETRIWATWEYVSSVGGGQQGMSGTWRYVAGVRRYVAGVLLPKTKLDQSRPNPGIVSQRELVMYLNRGVIDYQASKRGLEDYGGLCAFFRFSCPEAV

SEQ ID NO: 119807 - protein, 115 aa, Glycine max
  Coding DNA Sequence Number=SeqID_3029
  Homolog annotation: Hit_ID=Q1T010; Match level="QueryCoverage=66%, HitCoverage=5%, E-value=4e-07, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDLRGVSSNLRLGSSGVGSPILSLDLYRNLLVFDGKYFVDWCVMMNVIFGFQGVEEVVKIGFRELERNEIEEQKAEYKEFKKLDSKAHFLIHQYVDVAIFGKISKLQQQNKPRIF

SEQ ID NO: 119808 - protein, 112 aa, Glycine max
  Coding DNA Sequence Number=SeqID_3030
MLATGNRLLSSGNRLPESKTLCDFVGGEHYQDNYYFYSINKSDWRQESTMYNYHEKGRAPDLESVLADFMTYQSSSKGDGYSMQQQETQFEKDYLMEACLWGFYGGWIFELQ

SEQ ID NO: 119809 - protein, 74 aa, Glycine max
  Coding DNA Sequence Number=SeqID_3031
MDGSDRMLRMKVNQRAGHLGNANQSSESHLPQTDLSDQHTRGHTETVKHTVYQRCRSTSATRIATLNSQLRAHS

SEQ ID NO: 119810 - protein, 90 aa, Glycine max
  Coding DNA Sequence Number=SeqID_3032
  Subcellular localization annotation: CTP_CleavageSite=40; ConfidenceScore=5.02e-01
MEAQISRSPGLRSTKKRKKIVYGRIMPSKAGRSNLVIRVSGSLGSGGTDGHAERIVSKGSRERNIVKVNNDIAETGESRKGSSLAEPEFD

SEQ ID NO: 119811 - protein, 610 aa, Glycine max
  Coding DNA Sequence Number=SeqID_3033
  Gene Ontology: Mol. function=transferase activity, transferring glycosyl groups; Cellular component=intracellular; Biological process=protein amino acid ADP-ribosylation
  Homolog annotation: Hit_ID=Q9SWB4; Match level="QueryCoverage=93%, HitCoverage=69%, E-value=0.0, Identity=90%"; Hit description=Poly [ADP-ribose] polymerase 3 (EC 2.4.2.30) (PARP-3) (ADPRT 3) (NAD(+) ADP-ribosyltransferase 3)
  Pfam annotation: Domain name=PARP; Domain location=381-596; Score =330.6; E_value=2.6e-96; Accession=PF00644.10; Description=Poly(ADP -ribose) polymerase catalytic domain
  Pfam annotation: Domain name=WGR; Domain location=123-211; Score =121.8; E_value=1.9e-33; Accession=PF05406.5; Description=WGR domain
  Pfam module annotation: Pfam domain module=PARP::WGR; Domain location= 381-596::123-211
MITQIRYSIITRLIKWVMCHININTISIPSLTINVSNSCRERSIPVVREAWLIDSIEKQEPQPLEAYDLVSDLSVDGKGIPWDKQDPGEEAIESLSAELKLYGKRGVYKDTKLQEQGGKIFERDGILYNCAFSVCDQGRGLNDYCVMQLIVVPENRLHLYFKKGRVGDDPNAEERLEEWDNVDGALKEFVRLFEEITGNEFEPWEREKKFQKKPLKFYPIDMDDGIEVRHGALGLRQLGIAATHCKLEPLVANFMKVCIDGDGLRLSGPSNRNGYKSSSEKIKTDIRTLSGEDVLLEFIDKVKSLKETGPKAEAVWTDFSQRWFTLMHSTRPFNFRDYQEIADHAAAALEGVRDITQASHLIGDMTGSTIDDPLSETYKKLGCSISALDKSSDDYEMIVKYLEKTYEPVKVGDIEYGVSVENIFAVQTGGCPSYEDIIKLPNKVLLWCGSRSSNLLRHLQKGFLPAICSLPIPGYMFGKAIVCSDAAAEAARYGFTAVDRPEGFLVLAIASLGNEITELKTPPEDASSLEEKKVGVKGPGKKKTDESEHFVWKDDIKVPCGKLVASDHQDSPLEYNEYAVYDKKRARISYLVGVKYEEKEEKGAVIDTAE

SEQ ID NO: 119812 - protein, 143 aa, Glycine max
  Coding DNA Sequence Number=SeqID_3034
  Gene Ontology: Mol. function=chitin binding; Cellular component =extracellular region; Biological process=chitin metabolic process
  Homolog annotation: Hit_ID=UPI00006A17C9; Match level="QueryCoverage =69%, HitCoverage=100%, E-value=7e-14, Identity=35%"; Hit description= UPI00006A17C9 related cluster
  Subcellular localization annotation: CTP_CleavageSite=20; ConfidenceScore=5.05e-01
MAPLPSLQNGWTLDYTSSPSEDYASSHQRTTRPHLQRTTRPHLRGLHVLTFVGLHALTFRGLHALAIRGLHVLTFVGLHALAIRGLHVLTFVGLHALTFRGLHALTIKGLHVLTFVGLHALTYRGLHVLAFRGLHSLTFRGLH

SEQ ID NO: 119813 - protein, 414 aa, Glycine max
  Coding DNA Sequence Number=SeqID_3035
RCNLQLVINSNDPGGAFRFPGITHDNYFFESGLKELIQHLTKNNFNHYDTPPASKSVVKGLSDISVIKELLASDSSDHRGGRGNSGDGGGVESGATPQVNWTHDIGPSAESGGNNIGEMGKREKQKQRHEKGHRGRGSFNYLQEDHDFDDTPRPSPSEEECADDSNEEKEEEEEEEEEGHENQSHDMPSKFLLYQQSVQSPKGDISYLQKFFLMYVGGRMPLHLQEDFCGTALLSTEWLRSDSRRTVVGLDLDLEALNWCMESNIPKVGADGFSRMSLFHGNVLQPLQSKLVKIDPQQLVSDISLSQNEENLQTDVPESDAPTGSVAQDDKYTKRNIILPGRDIVCAFNYSCCCLHKRAELVLYFKHAREALSTKGGIFVMDLYGGTSSEHKLRLQRRFPNFTDNVDLIHFDTL

SEQ ID NO: 119814 - protein, 354 aa, Glycine max
  Coding DNA Sequence Number=SeqID_3036
  Gene Ontology: Mol. function=transferase activity, transferring glycosyl groups; Cellular component=integral to Golgi membrane; Biological process=protein amino acid glycosylation
  Homolog annotation: Hit_ID=Q4JEZ1; Match level="QueryCoverage=99%, HitCoverage=91%, E-value=1e-119, Identity=56%"; Hit description =Sialyltransferase-like protein
  Pfam annotation: Domain name=Glyco_transf_29; Domain location=78-335; Score=-7.3; E_value=1.1e-06; Accession=PF00777.9; Description =Glycosyltransferase family 29 (sialyltransferase)
MKRSLRPLFLLLLLIILFAAMLTSRDILRHGIPSIDLESRVPIRYLPLPQLNATLLRHAAAEIGEESISQEIQNLLNFRHWLHFRSLLQNWFRKRRFQPGIMSELTRSIKLPIDLHYKLQTNNKNKYSSCAVVGNSGILLDKNHGSKIDSHEVVIRLNNARVDSFETKVGRKTNISFMKGNILHLCARKRGCFCHPYGDSVPIVIYICEAVQLMDYTVCNASHKAPLLVTDPRFDVLCSRIAKYYSMKRFVEESGGVGEGLEKWGEAHEGGLFHYYSSGMQAVMLALGICDRVSIFGFGKTDSARHHYHTSQKEELHLHDFEAEYDFYRDLVDGDKPIPFLEESFKVPPVVFYQ

SEQ ID NO: 119815 - protein, 306 aa, Glycine max
  Coding DNA Sequence Number=SeqID_3037
  Gene Ontology: Mol. function=catalytic activity; Cellular component =integral to membrane; Biological process=cellular metabolic process
  Homolog annotation: Hit_ID=Q1SGE1; Match level="QueryCoverage=95%, HitCoverage=77%, E-value=1e-153, Identity=88%"; Hit description =Putative dTDP-glucose 4-6-dehydratase
  Pfam annotation: Domain name=Epimerase; Domain location=5-208; Score =88.1; E_value=2.7e-23; Accession=PF01370.11; Description=NAD dependent epimerasedehydratase family
MCRCSYYRMARLTINLAAIYTPADYNTRPLDTIFGNFIDAIPVIKYCTENNKRLIHFSTCEVYGKTIGSFLPEEYRQDPKYFMLKEDVTPCIFGPVEKQRWSYACAKQMTDRLIYAEHAENGLKFTIVRPYNWIGPRMDFIPGVDGPSDGVPRVLACFSNSLLRGEPLKLVDGGRSQRTFLYIKDAIDAVALMIDNPERANGYIFNVGNPDNEVSVKELAELMIKAYAKVSGAPASSLSTVDVSAEDFYGKGYDDSDRRIPDMTIITKQLAWKPKTLLEELLDVTLQYQHKTYSRAIERELSKPSN

SEQ ID NO: 119816 - protein, 353 aa, Glycine max
  Coding DNA Sequence Number=SeqID_3038
  Gene Ontology: Mol. function=transferase activity, transferring glycosyl groups; Cellular component=integral to Golgi membrane; Biological process=protein amino acid glycosylation
  Homolog annotation: Hit_ID=Q4JEZ1; Match level="QueryCoverage=99%, HitCoverage=91%, E-value=1e-139, Identity=63%"; Hit description =Sialyltransferase-like protein
  Pfam annotation: Domain name=Glyco_transf_29; Domain location=78-344; Score=34.8; E_value=2.7e-09; Accession=PF00777.9; Description =Glycosyltransferase family 29 (sialyltransferase)
MKRSLRPLFLLLLIIILFAAMLTSSDILRHGTPSIDLESRVPIRHLPPPQINVTLLRHAAVEIGEESISHEIQNLLNFRHWLHFQNLLQNWFRKRRFQPGIMSELTRSIKLPIDSHNNNNKLQTNSKNKYSSCAVVGNSGILLNRDYGSEIDSHEFVIRLNNARVDHFETKVGKKTSISFMNSNILHLCARRGGCFCHPYGDRVPIVTYICQAMHFMDYTVCNASHKAPLLVTDPRFDVLCARIVKYYSLKRFVEESGKGLEKWGEAHDGSLFHYSSGMQAVMLALGICDRVSMFGFGKSTSAKHHYHTNQKAEHQLHDYEAEYAFYRDLVDGKRPIPFLEDRFKVLPVVMYQ

SEQ ID NO: 119817 - protein, 81 aa, Glycine max
  Coding DNA Sequence Number=SeqID_3039
  Gene Ontology: Mol. function=phosphatase activator activity; Cellular component=cytoplasm; Biological process=negative regulation of protein amino acid dephosphorylation
  Homolog annotation: Hit_ID=Q1SGD6; Match level="QueryCoverage=78%, HitCoverage=16%, E-value=1e-22, Identity=81%"; Hit description =Phosphotyrosyl phosphatase activator, PTPA
MNLAGIAFVKKVKKGVFAEHSPMLDDISGVPNWNKVNSGLLKMYKAEVLEKVPIMQHFLFGSIIKWALGYLLVVSCMECRH

SEQ ID NO: 119818 - protein, 95 aa, Glycine max
  Coding DNA Sequence Number=SeqID_3040
  Gene Ontology: Mol. function=identical protein binding; Cellular component=cytoplasm; Biological process=negative regulation of enzyme activity
  Homolog annotation: Hit_ID=Q1RYB7; Match level="QueryCoverage=83%, HitCoverage=10%, E-value=3e-12, Identity=41%"; Hit description =Protease-associated PA; Proteinase inhibitor I9, subtilisin propeptide
  Pfam annotation: Domain name=Subtilisin_N; Domain location=1-55; Score=32.7; E_value=1.3e-06; Accession=PF05922.7; Description =Subtilisin N-terminal Region
MDPHQSLSEAKAAALHHYSKSFQGFSAMITPEQASQLAEYESVLSVFESKMNKLHTTHSWDFLGLETISKNNPKALDTASNVIVGEFLLRLNENC

SEQ ID NO: 119819 - protein, 215 aa, Glycine max
  Coding DNA Sequence Number=SeqID_3041
  Gene Ontology: Mol. function=nucleoside-triphosphatase activity; Cellular component=membrane; Biological process=proteolysis
  Homolog annotation: Hit_ID=Q1SGD5; Match level="QueryCoverage=91%, HitCoverage=40%, E-value=3e-87, Identity=82%"; Hit description=AAA ATPase, central region; MIT
  Pfam annotation: Domain name=Vps4_C; Domain location=147-212; Score =129.8; E_value=7.6e-36; Accession=PF09336.1; Description=Vps4 C terminal oligomerisation domain
MHPYFPNSEDPRFPTALGVGHNDQKVLVLAATNTPYALDQAIRRRFDKRIYIPLPDLKARQHMFKAWAIYMMMFIGLIVYCEPSKWPYNVHLGDTPHNLAESDFEHLARKTEGFSGSDISVCVKDVLFEPVRKTQDAMFFFRNPEDMWIPCGPKQQSAVQTTMQDLAAKGLASKILPPPISRTDFDKVLARQRPTVSKSDLDVHERFTKEFGEEG

SEQ ID NO: 119820 - protein, 49 aa, Glycine max
  Coding DNA Sequence Number=SeqID_3042
MENWRTALCNNFAGLKTRSGEWRIGEQRYAITSRGSRLEGGGHMNSARQ

SEQ ID NO: 119821 - protein, 172 aa, Glycine max
  Coding DNA Sequence Number=SeqID_3043
  Homolog annotation: Hit_ID=Q1S0F5; Match level="QueryCoverage=38%, HitCoverage=13%, E-value=6e-07, Identity=42%"; Hit description=IMP dehydrogenase/GMP reductase
VRHACPLEGHRSCTEKGGANWDQLLSNKEGASVNWFPRWKEGRTGVLVSFGGFPNVPLMGTRGCISYNPVLTIRQLGYPMRGAALEEVLAPDKELRGSNNGPIGGYRKWLKAHMQGLDWLPSLRTAKREEVEAPEEDEEENIELRDVNVATTKALEQETKRARREEHGRNKF

SEQ ID NO: 119822 - protein, 119 aa, Glycine max
  Coding DNA Sequence Number=SeqID_3044
MASGNRLQRECNRLPGLKTRSGSKEGFWLRKETGMLKGPLRNGSLVIDYQIVMAAQLIHDRVEMECLEGAWETLEGNTRCRFRGTIRFTATSLVHPDEPARTLQRTVEWTAPWISFVYL

SEQ ID NO: 119823 - protein, 61 aa, Glycine max
  Coding DNA Sequence Number=SeqID_3045
MVDDVTEESRPSTQANGREMKIALLLKETEIGKHADNDKHWKFLPSPVKLSRKIKKYSVKQ

SEQ ID NO: 119824 - protein, 370 aa, Glycine max
  Coding DNA Sequence Number=SeqID_3046
  Gene Ontology: Mol. function=zinc ion binding
  Homolog annotation: Hit_ID=Q6H6V3; Match level="QueryCoverage=87%, HitCoverage=58%, E-value=7e-38, Identity=37%"; Hit description=Zinc finger (C3HC4-type RING finger) protein-like
  Pfam annotation: Domain name=zf-C3HC4; Domain location=289-336; Score= 53.5; E_value=7e-13; Accession=PF00097.15; Description=Zinc finger, C3HC4 type (RING finger)
MSAHQKEKHNAPSSKPTVSHPLHKVDDPMGVTDENETLRVSNQWKRQNLLQLEIPARTSEESSSQDFVGIRMPLTPSPTPSQKRVNFLVTSRSVDAPKPPSSSSRAKPSMRNILPKFGFRNRAPSISLDVEKGVTTAAQEGSFSGHQEKSSIPRSVSLTKMFTPKIKRTSSLPVEELGRANVESVLCGTLGASPFYKKESIKFHCVALIGIMVEIDQVYSVAYHGRETQGMIARSRSVPVNTKEKGIRRLDSVFRIIPSTPRVIEVNETRKDTENGDDGEDIAEEEAVCRICLVDLCEGGETLKMECSCKGELALAHQECAIKWFSIKGNKTCDVCKEEVRNLPVTLLRIRSVRAQNTRARSEQGDDFRQ

SEQ ID NO: 119825 - protein, 86 aa, Glycine max
  Coding DNA Sequence Number=SeqID_3047
MSISSPSSYPIPRLFNLVVQAFQGLSHNFTYNAENSQKGGQKGHLGTFFRPLDPSENLGLGEQGCFWLEQQLALTSCYSTPYPHFL

SEQ ID NO: 119826 - protein, 127 aa, Glycine max
  Coding DNA Sequence Number=SeqID_3048
  Gene Ontology: Mol. function=identical protein binding; Cellular component=cytoplasm; Biological process=negative regulation of enzyme activity
  Homolog annotation: Hit_ID=Q40764; Match level="QueryCoverage=96%, HitCoverage=16%, E-value=2e-26, Identity=45%"; Hit description =Subtilisin-like protein
  Pfam annotation: Domain name=Subtilisin_N; Domain location=1-55; Score=33.3; E_value=8.7e-07; Accession=PF05922.7; Description =Subtilisin N-terminal Region
MDPHQSLSEAKAAALHHYTKSFQGFSAMITPEQASQLAEYESVLSVFESKMNKLHTTHSWDFLGLETISKNNPKALDTTSDVIVGVIDSGIWPESESFTDYGLGPVPKKFKGECVTGEKFTLANCNK

SEQ ID NO: 119827 - protein, 399 aa, Glycine max
  Coding DNA Sequence Number=SeqID_3049
  Gene Ontology: Mol. function=identical protein binding; Cellular component=cytoplasm; Biological process=negative regulation of enzyme activity
  Homolog annotation: Hit_ID=Q8H0H9; Match level="QueryCoverage=97%, HitCoverage=78%, E-value=1e-74, Identity=36%"; Hit description =Serine protease-like protein
  Pfam annotation: Domain name=PA; Domain location=245-348; Score=36.3; E_value=1.1e-07; Accession=PF02225.12; Description=PA domain
  Pfam annotation: Domain name=Peptidase_S8; Domain location=66-348; Score=-80.8; E_value=0.019; Accession=PF00082.12; Description =Subtilase family
  Pfam annotation: Domain name=Subtilisin_N; Domain location=1-55; Score=27.6; E_value=4.6e-05; Accession=PF05922.7; Description =Subtilisin N-terminal Region
  Pfam module annotation: Pfam domain module=PA::Peptidase _S8::Subtilisin_N; Domain location=245-348::66-348::1-55
MDPPQSLSEAKAAALNHYSKSFQGFSAMITPEQANQLSEYNSVVSVFESKMNKLYTTHSWNFLGLETVYKSNHISLDTASDVIVGVIDSGIWPESESFTDHGLGPVPKKFKGECVTGDNFTLANCNKEIVLSEEPWLWFVIGPLLQASLFGIANGTARGGAPSARLAIYKVCWFGFCSDADILSAMDDAIHDGVDILSLSLGPDLPHPIYFDEAISIGAFHSFQKGVLVSAGAGNSFFQGSSLNPIRMEQSYGLIYGNSAAATGVSATNASFWKNNILDPTLIMGKTVICTIENFISEDRREKALTIMQGGGVGMILIDHNAKDFGFQFVVPTTLIGLDAAEELQAYINIEKNPTARIYPTITVLGTKPAPDVATFSSMGPNIITPDIIKASLLSRLYV

SEQ ID NO: 119828 - protein, 349 aa, Glycine max
  Coding DNA Sequence Number=SeqID_3050
  Gene Ontology: Mol. function=identical protein binding; Cellular component=cellulose and pectin-containing cell wall; Biological process=negative regulation of enzyme activity
  Homolog annotation: Hit_ID=Q8H0H9; Match level="QueryCoverage=95%, HitCoverage=57%, E-value=7e-82, Identity=47%"; Hit description =Serine protease-like protein
  Pfam annotation: Domain name=PA; Domain location=196-298; Score=50.4; E_value=6e-12; Accession=PF02225.12; Description=PA domain
  Pfam annotation: Domain name=Peptidase_S8; Domain location=9-271; Score=-63.6; E_value=0.0023; Accession=PF00082.12; Description =Subtilase family
  Pfam module annotation: Pfam domain module=PA::Peptidase_S8; Domain location=196-298::9-271
MSPHLEFGFFRKIIGARFYSKGFEAEVGPLEGVNKIFFRSARDGDGHGTHTASTIAGSIVANASLLGIAKGTARGGAPSARLAIYKACWFDFCGDADILSAMDDAIHDGVDILSLSLGPDPPEPIYFENAISVGAFHAFQKGVLVSASAGNSVFPRTACNVAPWILTVAASTIDREFSSNILLGNSKVLKGSSLNPIRMDHSYGLIYGSAAAAVGVSATIAGFCKNNTLDPTLIKGKIVICTIEKFSDDRRAKAIAIRQGGGVGMILIDHNAKDIGFQFVIPSTLIGQDAVEELQAYIKTDKNPTARIYPTITVVGTKPAPEMAAFSSIGPNIITPDIIKASLLSRLYV

SEQ ID NO: 119829 - protein, 108 aa, Glycine max
  Coding DNA Sequence Number=SeqID_3051
  Gene Ontology: Mol. function=RNA-directed DNA polymerase activity; Cellular component=intracellular; Biological process=RNA-dependent DNA replication
MEEDYKPIAHPQRRLNPTMKEVVRKEVVKLLEAGRIYPISASQWLIPNRTITGWRMCIDHRKLNKATRKDHSPLPFMDQMLERLVGQQYYCFLDGYSGYNQITVIPEG

SEQ ID NO: 119830 - protein, 188 aa, Glycine max
  Coding DNA Sequence Number=SeqID_3052
MPWIKDDVGVQGFPFPILKTFQLKIIMFDGEKTWNENIVKVRALVGSKFQLTSQGHNISWSAPRIGFLKCNIAAAFQEASNVIGSAIGIGETRDPGRGAAGCAEMSRDGSAAVPCTFHHYYWQNRCSFAFTFLSGKTCGADPLNSKPSLTLSSALKFLPSFLNFFYLESLQVYDEFGYNNLVFQWKSI

SEQ ID NO: 119831 - protein, 102 aa, Glycine max
  Coding DNA Sequence Number=SeqID_3053
ERPIEHGCDRLERDEDPIEVGVAVLLAADERRKELVATAATVGLGDDDGEVVVGEEEFGGCLTVVVCGVLWWVTTLLEDVGGEGEGRHRASGGLTCDTRGGR

SEQ ID NO: 119832 - protein, 434 aa, Glycine max
  Coding DNA Sequence Number=SeqID_3054
  Gene Ontology: Mol. function=4 iron, 4 sulfur cluster binding; Cellular component=periplasmic space; Biological process=Mo -molybdopterin cofactor biosynthetic process
  Homolog annotation: Hit_ID=P33937; Match level="QueryCoverage=50%, HitCoverage=26%, E-value=1e-109, Identity=82%"; Hit description =Periplasmic nitrate reductase precursor
  Pfam annotation: Domain name=Fer4; Domain location=128-151; Score =14.4; E_value=0.002; Accession=PF00037.17; Description=4Fe-4S binding domain
  Pfam annotation: Domain name=Fer4; Domain location=24-47; Score=21.8; E_value=0.00014; Accession=PF00037.17; Description=4Fe-4S binding domain
  Pfam annotation: Domain name=Fer4; Domain location=56-79; Score=15.9; E_value=0.0012; Accession=PF00037.17; Description=4Fe-4S binding domain
  Pfam annotation: Domain name=Fer4; Domain location=89-117; Score=0.9; E_value=0.27; Accession=PF00037.17; Description=4Fe-4S binding domain
  Pfam annotation: Domain name=Molybdop_Fe4S4; Domain location=233-287; Score=82.3; E_value=1.5e-21; Accession=PF04879.6; Description =Molybdopterin oxidoreductase Fe4S4 domain
  Pfam annotation: Domain name=Molybdopterin; Domain location=290-433; Score=-99.5; E_value=0.00041; Accession=PF00384.12; Description =Molybdopterin oxidoreductase
  Pfam annotation: Domain name=NapD; Domain location=136-211; Score =10.9; E_value=0.00019; Accession=PF03927.4; Description=NapD protein
  Pfam module annotation: Pfam domain module=Fer4::Fer4::Fer4::Fer4::Mol ybdop_Fe4S4::Molybdopterin::NapD; Domain location=128-151::24-47::56 -79::89-117::233-287::290-433::136-211
MALSRRELFTGQRVMPAGGIALPWWRGESGCDGCGRCVEACESGIIRIAAGEAPQLDFLQGECTFCAACADVCPQPLFQPRDTEPFSQRIRIDSRCIAFLGVNCRSCQESCEQQAIRFRLMPNGIGQPEILPQHCTGCGACIAPCPARPTAIAAVRQALLNFADSDIAAEDAARGTLALTLGAADSATLLSNIEATRNIPDVLAANAAAAAATAAGLTIPTVTKAATSLAEPIRWEKAPCRFCGTGCGVLVGTQNGRVVASQGDPQAEVNRGLNCIKGYFLPKIMYGKDRLTQPLLRMTDGKFDKNGEFTPVSWDQAFDIMEAKFKAALKANGPESVGMFGSGQWTVWEGYAASKLMKAGFRTNNLDPNARHCMASAVVGFMRTFGMDEPMGCYDDIEQADAFVLWGSNMAEMHPILWSRLTARRLSNENVKVA

SEQ ID NO: 119833 - protein, 292 aa, Glycine max
  Coding DNA Sequence Number=SeqID_3055
  Gene Ontology: Mol. function=transferase activity; Cellular component= intracellular; Biological process=D-ribose metabolic process
  Homolog annotation: Hit_ID=Q1R8R1; Match level="QueryCoverage=35%, HitCoverage=52%, E-value=2e-43, Identity=79%"; Hit description =Hypothetical protein yffH
  Pfam annotation: Domain name=Phos_pyr_kin; Domain location=1-146; Score=-113.8; E_value=0.00029; Accession=PF08543.2; Description =Phosphomethylpyrimidine kinase
AIQRMIDNARAGGTFVILNPAPWQKVSDALLAKVDLLTPNSTEAMQLSGIKVTDFASAQRAAEVLHRKGARQVIITLGTAGALLSSAEQQLRIPLFPAQPLDTTGAGDAFNGALAARLASGDALPQAALFAAAFASLCVERSGAANSMPSYAEALARMQAHPEVGIRAGPANYRRGYACNQPISCAYGEKVQQFRYAARRHVGLKQLFDLTNLIAGLFHRFFTDAIFRRVVIQQSGAGFNQLTAGVVVNIGRDAELTNQHHAVFFTVVEQDGGAVAAIVDFTFVTYHVAVTA

SEQ ID NO: 119834 - protein, 290 aa, Glycine max
  Coding DNA Sequence Number=SeqID_3056
NVEEQAEGQGIGPSSPQGSNQRSSSEEHFSDEEAIQEAEAGGSDIFPASSTSKLSASIGIAEDTFIQMQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLEKARAAQREVERLTKEAKEGSSDIKACDDNISSWEATITNLLSQKLVAEKGREGLKAFSASQAVADEARAMESADQVLSKEMATLKKLYEDLVLH

SEQ ID NO: 119835 - protein, 58 aa, Glycine max
  Coding DNA Sequence Number=SeqID_3057
MGDLASHCHERVTNTKRKQEPACAREAHMQSPSDISECALSRKVQAKPQMRTKPPHTG

SEQ ID NO: 119836 - protein, 172 aa, Glycine max
  Coding DNA Sequence Number=SeqID_3058
MSCPTIITPTSLCRSVSWCMPPTRHPLDPDKSNRALGFPTLITGLCQSFGVPVTPSKAPDAPLPPHQADPAGSFDTEWYLWHLVFQQGANHRAHVQTHDCLDQLSLSLQSQGFAPFPCLTPDQFRTEVAWPRDWPEAQEGKAPVEAPDDADEARMDEEMTDLLDFLGGSGAT

SEQ ID NO: 119837 - protein, 249 aa, Glycine max
  Coding DNA Sequence Number=SeqID_3059
  Gene Ontology: Mol. function=protein binding; Cellular component =integral to membrane; Biological process=defense response to fungus
  Homolog annotation: Hit_ID=Q1SWI6; Match level="QueryCoverage=76%, HitCoverage=87%, E-value=9e-45, Identity=50%"; Hit description =Leucine-rich repeat, plant specific
  Pfam annotation: Domain name=Conotoxin; Domain location=7-66; Score =5.9; E_value=0.051; Accession=PF02950.8; Description=Conotoxin
  Pfam annotation: Domain name=LRRNT_2; Domain location=26-66; Score =51.6; E_value=2.6e-12; Accession=PF08263.3; Description=Leucine rich repeat N-terminal domain
  Pfam annotation: Domain name=LRR_1; Domain location=115-140; Score =8.7; E_value=6.7; Accession=PF00560.23; Description=Leucine Rich Repeat
  Pfam annotation: Domain name=LRR_1; Domain location=142-164; Score =11.4; E_value=2.1; Accession=PF00560.23; Description=Leucine Rich Repeat
  Pfam annotation: Domain name=LRR_1; Domain location=190-215; Score =12.3; E_value=1.4; Accession=PF00560.23; Description=Leucine Rich Repeat
  Pfam annotation: Domain name=LRR_1; Domain location=217-239; Score =10.9; E_value=2.6; Accession=PF00560.23; Description=Leucine Rich Repeat
  Pfam module annotation: Pfam domain module=Conotoxin::LRRNT_2::LRR _1::LRR_1::LRR_1::LRR_1; Domain location=7-66::26-66::115-140::142 -164::190-215::217-239
MNSSIYILVFVHLLLLSLPCRESVCIPSERETLLKFKNNLIDPSNRLWSWNPNHTNCCHWYGVLCHNLTSHLLQLHLNTTVPAFEFDGYPHFDEEAYRRWSFGGEISPCLADLKHLNYLDLSGNVFLREGMSIPSFLGTMTSLTHLNLSATGFYGKIPPQIGNLSNLVYLDLSYVFANGRVPSPIGNLSKLRYLDLSHNYFLGEGMSIPSFLGTMTSMTHLDLSYTGFYGKIPPQIGNLSNLLYLGLGG

SEQ ID NO: 119838 - protein, 81 aa, Glycine max
  Coding DNA Sequence Number=SeqID_3060
MGMLQKMHRAWNQVERKDKKRRGRSNVRVQEIAWLKKLEGPNEVEMEVPEESEEGHSEMSRRRSALQVEKEAREEVCTHNK

SEQ ID NO: 119839 - protein, 53 aa, Glycine max
  Coding DNA Sequence Number=SeqID_3061
MQFRATVAWPGDRPNFQDEAGPVDAQGAAQGDEGRAENDGDMADLLDYFIGGG

SEQ ID NO: 119840 - protein, 119 aa, Glycine max
  Coding DNA Sequence Number=SeqID_3062
MQSTGRILLPSQPYLSTTLFRCAADVDSDNKEQPFNKDLLTVILVLVSGGVVGVGRGVGVWLRSGPVGVVWMDSGGGACDDGGRRRCGLDLVAYGGLVVVEGRRTVIGGRAHGKDWEVD

SEQ ID NO: 119841 - protein, 296 aa, Glycine max
  Coding DNA Sequence Number=SeqID_3063
  Gene Ontology: Mol. function=zinc ion binding; Cellular component =nucleus; Biological process=ubiquitin cycle
  Homolog annotation: Hit_ID=Q8RUJ8; Match level="QueryCoverage=80%, HitCoverage=58%, E-value=5e-77, Identity=59%"; Hit description =Putative hydroxyproline-rich glycoprotein
  Pfam annotation: Domain name=zf-C3HC4; Domain location=239-277; Score= 12.8; E_value=0.0076; Accession=PF00097.15; Description=Zinc finger, C3HC4 type (RING finger)
MGNIESRRRRRRHPTPPPPQQEANTNYYFAPRLPYYPNTLLPPYHYYPQQPPSLHHEKAVTIRNDVNIKKDTLRMEPDQHNPHHFLVTFTFDSIAPGCITVMFFAKETLDGKLIAVKKSLLKQISMPFQQGLCQKFRQPSGTGIEISMLEETGLTKVGDTEVYPLVLKAEVRPLNHYENEGNPSSQITLASFGKRERGEYKVQVMKQVLWVNGKRYELQEIYGIGNVSDGDSHESGGDCVICLSEPPDITVLPCRHMCMCSGCANLLKVHTANCPICRYPVERLLEIKVNNGYGEQ

SEQ ID NO: 119842 - protein, 248 aa, Glycine max
  Coding DNA Sequence Number=SeqID_3064
LNTFLETPVVLAQGETVPAYSRYCRLPTDFREIEAALCIPGRGFILNSEGQPGKILRKDLTTLAQVWSVLSYSNLAPTSHTSDLIMDRVRLIFGLVSHLDMNIGALISGQMTSIAQSNTSRLGFPALITILCRARVVVSNSLTFKCLSPVINLAYIRKNCWNPEDLTISIRGARRARARLVELPSTSAAPTPTSTSTAPFVPTQTNSQRFEAMLQSIHQGQIILLQSLQMMAPPDSIPIVEQFNEMVA

SEQ ID NO: 119843 - protein, 97 aa, Glycine max
  Coding DNA Sequence Number=SeqID_3065
  Homolog annotation: Hit_ID=Q43588; Match level="QueryCoverage=72%, HitCoverage=43%, E-value=5e-11, Identity=52%"; Hit description=PAR -1b protein
  Pfam annotation: Domain name=PAR1; Domain location=3-94; Score=-75.6; E_value=0.00016; Accession=PF06521.2; Description=PAR1 protein
MALNISSRFLTIVALAFLVIMQGTLHVKRTGEEAYTCRTSAEKQIKGHTESEKCIKACWLDRKSFGISSILLWKVVSHKTFASLSATKAASTLLLVK

SEQ ID NO: 119844 - protein, 412 aa, Glycine max
  Coding DNA Sequence Number=SeqID_3066
  Gene Ontology: Mol. function=protein binding; Cellular component =nucleus; Biological process=ubiquitin cycle
  Homolog annotation: Hit_ID=Q1SJP5; Match level="QueryCoverage=87%, HitCoverage=99%, E-value=0.0, Identity=87%"; Hit description=Cyclin -like F-box; Serine/threonine protein phosphatase, BSU1
  Pfam annotation: Domain name=F-box; Domain location=69-116; Score =20.0; E_value=0.0083; Accession=PF00646.23; Description=F-box domain
  Pfam annotation: Domain name=Kelch_1; Domain location=200-246; Score =34.6; E_value=3.4e-07; Accession=PF01344.15; Description=Kelch motif
  Pfam annotation: Domain name=Kelch_1; Domain location=248-294; Score =40.3; E_value=6.7e-09; Accession=PF01344.15; Description=Kelch motif
  Pfam annotation: Domain name=Kelch_1; Domain location=301-341; Score =0.5; E_value=3.4; Accession=PF01344.15; Description=Kelch motif
  Pfam annotation: Domain name=Kelch_2; Domain location=200-246; Score =19.5; E_value=0.012; Accession=PF07646.5; Description=Kelch motif
  Pfam annotation: Domain name=Kelch_2; Domain location=248-294; Score =16.1; E_value=0.13; Accession=PF07646.5; Description=Kelch motif
  Pfam annotation: Domain name=Kelch_2; Domain location=301-341; Score =13.2; E_value=0.7; Accession=PF07646.5; Description=Kelch motif
  Pfam annotation: Domain name=Kelch_2; Domain location=88-150; Score =1.2; E_value=27; Accession=PF07646.5; Description=Kelch motif
  Pfam module annotation: Pfam domain module=F-box::Kelch_1::Kelch _1::Kelch_1::Kelch_2::Kelch_2::Kelch_2::Kelch_2; Domain location=69 -116::200-246::248-294::301-341::200-246::248-294::301-341::88-150
FQFSNLVGDSFGIVLHSRFSLSVFVKGYGFSFLEGGVGEEDGKKVNNFLEMDRGEGVNDGFSGPGPNDSLIPGLIDDVALNCLAWVSGSDYAVLSCINKRFNKLINSGYLYGLRKQLGAVEHLVYMVCDPRGWVAFDPKINRWISLPKIPCDECFNHADKESLAVGCELLVFGRELMEFAIWKYSMICRGWVKCQEMNQPRCLFGSSSLGSIAIVAGGSDKYGNVLKSAELYDSSTGMWELLPNMHAPRRLCSGFFMDGKFYVIGGMSSTTVSLSCGEEYDLKTRSWRKIEGMYPYVNVGVQAPPLVAVVDNQLYAVEHLTNMVKKYDKERNTWNELGRLPVRADSSNGWGLAFKACGEQLLVVGGQRGPEGEAIVLSSWCPKSGISNGTIDWQVLGVKEHVGVFVYNCAVM

SEQ ID NO: 119845 - protein, 72 aa, Glycine max
  Coding DNA Sequence Number=SeqID_3067
MDKCLRCGVSRYKVKDDDECNNDKSIKKGPSSKVLWYLLIIPRFKCLFDNGDGSKDPTWHVDGRNYDGMLRH

SEQ ID NO: 119846 - protein, 180 aa, Glycine max
  Coding DNA Sequence Number=SeqID_3068
  Gene Ontology: Mol. function=protein serine/threonine kinase activity; Cellular component=nucleus; Biological process=protein amino acid phosphorylation
  Homolog annotation: Hit_ID=Q1SJP6; Match level="QueryCoverage=93%, HitCoverage=41%, E-value=3e-83, Identity=84%"; Hit description =Protein kinase
  Pfam annotation: Domain name=Pkinase; Domain location=1-149; Score= -58.8; E_value=4.7e-05; Accession=PF00069.15; Description=Protein kinase domain
  Pfam annotation: Domain name=Pkinase_Tyr; Domain location=1-147; Score=-172.5; E_value=0.069; Accession=PF07714.7; Description =Protein tyrosine kinase
  Pfam module annotation: Pfam domain module=Pkinase::Pkinase_Tyr; Domain location=1-149::1-147
MQNIVHGDIKPDNLLITHHGTVKIGDFSVSQAFEDGNDELRRSPGTPVFTAPECCLGLTYHGKASDTWAVGVTLYCMILGEYPFLGDTLQDTYDKKSELTVSSLIQIVNDPLVLPDDINPQLKNLIEGLLCKDPELRMTLGDVAEHIWVIGEDGPIPGYLCWCKRKSMVTEDSDGSDILA

SEQ ID NO: 119847 - protein, 190 aa, Glycine max
  Coding DNA Sequence Number=SeqID_3069
MDVNAGYLISHQISIIAQHDSSKLGFLALIIALCKARGVTSDSRTLESLSPAINVAYIKKNCWNLDDPTVTFRGPRKTRGKRSEAPTTSAAPETTAPSSSTPPTPPSSIIPPTPSTSTPAHLKSLGLPSIMNMDEFETQVAWPGVQSSPSREGRTSAAQEPEAVKEQIPAEEDEPTPPEPFEFVSDSVVA

SEQ ID NO: 119848 - protein, 200 aa, Glycine max
  Coding DNA Sequence Number=SeqID_3070
  Gene Ontology: Biological process=cell adhesion
  Homolog annotation: Hit_ID=Q1RVI6; Match level="QueryCoverage=71%, HitCoverage=53%, E-value=2e-13, Identity=39%"; Hit description =Fasciclin domain, putative
  Subcellular localization annotation: CTP_CleavageSite=61; ConfidenceScore=5.28e-01
MHVLKLMVKDKGFSVSLVLVIHQHPYNISSKTLPGSTSDPPTQGMNTVPLVPTSPAGSPVSATPKPPTIDISQSQEILRTHRLTNPVQTQAGDGSPRLQLNVTTYAGSRVSMATGAVNATVTVLVPLDFVLSKAKDPSPTNGVSPKSGETGSSAGGSGKSGSGDDVVPVDASSAGSVSLKKVEKILWMTIVLVLALGVTI

SEQ ID NO: 119849 - protein, 160 aa, Glycine max
  Coding DNA Sequence Number=SeqID_3071
  Gene Ontology: Mol. function=protein serine/threonine kinase activity; Biological process=protein amino acid phosphorylation
  Homolog annotation: Hit_ID=Q1SJP6; Match level="QueryCoverage=100%, HitCoverage=38%, E-value=2e-64, Identity=75%"; Hit description =Protein kinase
MGCCGCFGFVQKPRRRRRDKRGISNLLSQGLLLDGETEGDETYSGDVTSNCTSVDDNEVQAVRNRSEDILNFRAKNGMVCRPFPVKETCKLDRSEDENGNKMINGYVREYKIGSGSYGKVALYRSSVDGKHYAIKSFHKSQLQKLRVAPSETAMTDVLRE

SEQ ID NO: 119850 - protein, 522 aa, Glycine max
  Coding DNA Sequence Number=SeqID_3072
  Gene Ontology: Mol. function=nucleic acid binding; Cellular component= intracellular
  Homolog annotation: Hit_ID=Q1SJQ8; Match level="QueryCoverage=87%, HitCoverage=91%, E-value=2e-84, Identity=41%"; Hit description=Zinc finger, C2H2-type
  Pfam annotation: Domain name=RS4NT; Domain location=145-182; Score =15.2; E_value=0.031; Accession=PF08071.2; Description=RS4NT (NUC023) domain
  Pfam annotation: Domain name=zf-C2H2; Domain location=160-182; Score =19.0; E_value=0.018; Accession=PF00096.16; Description=Zinc finger, C2H2 type
  Pfam annotation: Domain name=zf-C2H2; Domain location=187-208; Score =15.1; E_value=0.24; Accession=PF00096.16; Description=Zinc finger, C2H2 type
  Pfam annotation: Domain name=zf-C2H2; Domain location=83-105; Score =24.8; E_value=0.00031; Accession=PF00096.16; Description=Zinc finger, C2H2 type
  Pfam module annotation: Pfam domain module=RS4NT::zf-C2H2::zf -C2H2::zf-C2H2; Domain location=145-182::160-182::187-208::83-105
  Subcellular localization annotation: CTP_CleavageSite=75; ConfidenceScore=5.47e-01
MMSQEAISVPSNNLRDPSVQLHEPNSNSNSNPNNPNPNSLKRKRSLPGTPGKLFNSFMLYMHCYPNAEVIALSPKSLMATNRFICEVCNKGFQRDQNLQLHRRGHNLPWKLRQRNKEEVVKKKVYVCPEKSCVHHDPCRALGDLTGIKKHFSRKHGEKKWKCDKCSKKYAVQSDWKAHNKICGTRQYKCDCGTIFSRKDSFVTHGAFCDAMAEQNARLPAVLSNLGSEILMNAAQGPRVMPQALQLHGFHNSEFGGPGSEPYMGNFADVNHVEHNKLRMPLWLDQTNNIPLQLNHHHHHHPLSVSSNNSSSLFSPGTTLAEANNMFGTSSSSQGQWLNYRYHPEASFTHANVSIPHGLKLEQEENKGDLSHSVSSLYQSHMEPTRMSGGNNNLAFDNSNFGLLDPNMSSTSSNNNNRYNNNVVEIQKLFKQGNQAVENFNHMVNSQASTNNIIGGGFSLSSTKGLEHMVMPRIEEWESGEPEIMQKQQLRSSTSNATEEHLTKDFMGIGPVINLQSQFRGHY

SEQ ID NO: 119851 - protein, 128 aa, Glycine max
  Coding DNA Sequence Number=SeqID_3073
MARECMQAYLGLRLCLCCVFFLDPIDKKEFAHRNSILVGSQKNIFEGHLWPRLNFSSHLKQRPFSHRIAISFEEKRLKGTGEGLGGRGSKGGDDIGGKGQMGKDPMGTLVLVLPRNIRQESENFSSRR

SEQ ID NO: 119852 - protein, 553 aa, Glycine max
  Coding DNA Sequence Number=SeqID_3074
  Gene Ontology: Mol. function=oxidoreductase activity, acting on single donors with incorporation of molecular oxygen, incorporation of two atoms of oxygen; Biological process=flavonoid biosynthetic process
  Homolog annotation: Hit_ID=Q9LJ66; Match level="QueryCoverage=46%, HitCoverage=76%, E-value=6e-77, Identity=53%"; Hit description =Oxylase-like protein
  Pfam annotation: Domain name=2OG-FeII_Oxy; Domain location=187-279; Score=62.5; E_value=1.4e-15; Accession=PF03171.10; Description=2OG -Fe(II) oxygenase superfamily
MGDIDPAFIQSTEHRPKAKVVEVCEIPVIDLSEGRKELLISQIGKACEEWGFFQVINHGVPFEISREVEIEAKKFFEMSLEEKKKLKRDEFNAMGYHDGEHTKNVRDWKEVFDYLVENTAEVPSSHEPNDMDLRILTNQWPQNSPRFRETLQEYAREVEKLAYKLLELISLSLGLDAEKFHGCFMNQLSMVRLNYYPTCPFPDLALGVGRHKDSSALTVLAQDDVGGLQVKRKSDGEWIPVKPTPNAFIINVGDIVQFGALIELMADFTRFKSNMDRIEEAIAKLTSTQLHLTATQNSLSVKLDDLLQKFAQMETNPYSPMSSTANQHIATQSSTLHRMKLEVPRFDGLDPMGWIFKITQFFEYHSTPDSERLMITSFYMDGSALAWYQWMTHLSRSASILTSDVDSGSFTRSPPGGEVFGLLPDVSRPQMSFKDVLLTADEDAISVGEFLLVDWVQEEDTTETQSQAQISLHALSSHMAPKTLRVLGRVANQQVLTLIDGGSIHNFIQELLATTLGLPTQPTPPLWVLGKNSWWIFMFFDYATKIMYCEFSG

SEQ ID NO: 119853 - protein, 35 aa, Glycine max
  Coding DNA Sequence Number=SeqID_3075
MTCLTEGVTASCRDDVEEAAVERTIKQLKDGFHLT

SEQ ID NO: 119854 - protein, 231 aa, Glycine max
  Coding DNA Sequence Number=SeqID_3076
  Homolog annotation: Hit_ID=Q1SS26; Match level="QueryCoverage=75%, HitCoverage=20%, E-value=8e-07, Identity=22%"; Hit description =Unnamed protein product; no similarity, hypothetical start
MSLKLPYFPELVRVFYNNLKIQDGIIYSEVHGIPMIIDQSLFFSLTKLPSQGVPFEGTIVDDWKFDYSSHDAHRIVCNDKVDMIGRLLSRSLTFDCRIMHYIIVRILLPRSSNLAQASEEDLILMWAFQTGHQIEWAHFDQYQMHKALRANAPLPYPHLVTLFLYHFNIPLDDEPFVKVKRSFSIGAGAVTSFGYRKYVDGLWVRKQDLPPPIPNERTPSPPPQRVDSSSL

SEQ ID NO: 119855 - protein, 150 aa, Glycine max
  Coding DNA Sequence Number=SeqID_3077
MTNVEEYLHGWLHHHIIKVGIIVPVTCCWLIWVTRNTMVFEGSQIPWHNIGNQLIAFHARVVKAFGATKVERMKVDQAGISWRRLNMDEIIFNVDGSVIGIIRREISFVVSMVTWRMLLFSKLVNEGVSDHPLLATTILQIKNFLERLER

SEQ ID NO: 119856 - protein, 187 aa, Glycine max
  Coding DNA Sequence Number=SeqID_3078
  Gene Ontology: Mol. function=oxidoreductase activity; Cellular component=integral to membrane; Biological process=electron transport
  Homolog annotation: Hit_ID=Q53PZ7; Match level="QueryCoverage=88%, HitCoverage=36%, E-value=5e-58, Identity=68%"; Hit description =Cytochrome P450
  Subcellular localization annotation: CTP_CleavageSite=48; ConfidenceScore=5.06e-01
MARSAESFEARSNATARSETGRFGRRQPGSSPNENLHMLSNENLRSISCKSKTQTEFNSPRATRHLALELPRFAVDVEDSSSQKIAEDGGEGFSLGVVLEIRLENVLHVVGIRGDGVPQHVNVDGAGWGFTQEMSVPVAEIGELFQPTHRQVALAKIAVTPGLHPGDEDEEGEEGEEKGEGEEEEAA

SEQ ID NO: 119857 - protein, 65 aa, Glycine max
  Coding DNA Sequence Number=SeqID_3079
MPPWKTCSYSNCKNKEEPRKTQITVNFFNGEEENQLSNSSSVSRETMVVVDLRLQIKALQKKMRN

SEQ ID NO: 119858 - protein, 198 aa, Glycine max
  Coding DNA Sequence Number=SeqID_3080
MACTKKTRQMTFEATKEIAEKIDSLEEKASQGSFVPYGCQYILTAAIGRQEHPGRVRDARAGVTIKQYFGSAPRTSHSSFSIAPEELEQLTQQIRDQLEESITEKGLALPLEPEVGPSAARVSTKESCVDPSRNDLETDDSDKCGLYIEENPSRLVALGRVYEGSTVVHNIPLLHGQVKVSVEEVKDAEALIPVPIDE

SEQ ID NO: 119859 - protein, 302 aa, Glycine max
  Coding DNA Sequence Number=SeqID_3081
  Gene Ontology: Mol. function=protein transporter activity; Cellular component=integral to membrane; Biological process=intracellular protein transport
  Homolog annotation: Hit_ID=Q2HSW7; Match level="QueryCoverage=87%, HitCoverage=99%, E-value=1e-100, Identity=72%"; Hit description =Target SNARE coiled-coil region
  Pfam annotation: Domain name=SNARE; Domain location=176-238; Score =58.5; E_value=2.2e-14; Accession=PF05739.9; Description=SNARE domain
MSVIDILFRVDDICHKYEKYDIDKQRELNAYGDDLFARLYAAVDSSIQSALNKSEVASTEKNRASAAALNAEVRRTKGRLMDELPKLRKLMHKKVKGLTKEDMAVRQDLVLALPERIQAIPDGISGAAVQTAGWTATSSQPHIKFDSSEGHLSSDYFQQSEESSQFRQEYEMRRTKQDEGLDIISEGLDTLKDLAHEMNEEIDRQVPLMDEIDTKVDRAAADVRNTNVRLKKTLTEIRSSRNFCIDIVLLCVLLGIFLYLYNCLIHMLSNMKYHYSFVYFTRLLIVTAFKHTTSFLASKATF

SEQ ID NO: 119860 - protein, 349 aa, Glycine max
  Coding DNA Sequence Number=SeqID_3082
  Gene Ontology: Mol. function=DNA binding; Cellular component=nucleus; Biological process=regulation of transcription
  Homolog annotation: Hit_ID=Q2HSW8; Match level="QueryCoverage=99%, HitCoverage=100%, E-value=1e-135, Identity=69%"; Hit description=No apical meristem (NAM) protein
  Pfam annotation: Domain name=NAM; Domain location=12-140; Score =302.0; E_value=1.1e-87; Accession=PF02365.6; Description=No apical meristem (NAM) protein
MEGDQQGSNYSFPPGFRFHPSDEELIVHYLQNKISSRPLPASIIAEINLYKYNPWELPNKSLFGEEEWYFFSPRDRKYPNGLRPNRAAASGYWKATGTDKPILSSCGSKRIGVKKALVFYSGRPPKGAKTDWIMNEYRLVDTITTSSRLKGSMRLDDWVLCRVRHKGYSPKNSCENQESPNELNLSAKLPRSEEYPTNMNCRADMIPDYQYKDYQIIASILVGGPIPPTESMPNLSFKGCKGNNVVSVYEDDFTKVNSQATIPSLESYFNPLTRKSSEDEQYGNLISFNRKFNTENRMDGSTSKVLTSRELNCYNQNQSQDDIFNVNPPDPSINFQELNELDFSGRYHQ

SEQ ID NO: 119861 - protein, 65 aa, Glycine max
  Coding DNA Sequence Number=SeqID_3083
MAWHGQPVKIEEKENQRQLSSVVVMLLWLSLSHDRVDDQKHISNHDRTIRRLRAMHHGPPNHNLF

SEQ ID NO: 119862 - protein, 214 aa, Glycine max
  Coding DNA Sequence Number=SeqID_3084
  Gene Ontology: Mol. function=calmodulin binding; Cellular component =integral to membrane; Biological process=cell death
  Homolog annotation: Hit_ID=Q2HSW1; Match level="QueryCoverage=98%, HitCoverage=41%, E-value=1e-41, Identity=43%"; Hit description=Mlo -related protein
MGQRIQQRGEVVKGVPLVQPGDDLFWFNKPRLILYLINFVLFQNAFQLAFFSWAADLWVQLLSEQMLLLHFCSHNLPLMNAPIYDEILFPFPKTGCGDQNLNGMGSTMKPTIFNERVARALRKWHHTAKKNVKHNRGLRLQTPNHTKSNANFLRRYHSEMATYPSSPIRFDLDAHLPCEVNATSSSIHHRQMEMGHQAHEIDIERGKDFSFDKK

SEQ ID NO: 119863 - protein, 153 aa, Glycine max
  Coding DNA Sequence Number=SeqID_3085
  Gene Ontology: Mol. function=oxidoreductase activity; Biological process=gibberellin biosynthetic process
  Homolog annotation: Hit_ID=Q9LJ66; Match level="QueryCoverage=97%, HitCoverage=45%, E-value=1e-29, Identity=44%"; Hit description =Oxylase-like protein
MGYYDSEHTKNVRDWKEVFDYTVEEPTMMPASLDPNYHKELTHWYNQWPQYPPEFRVIKRGIPRVCSAHGRTSTQVNGAYCFELRVATKTVSWLLQRPNPNLVLGLGRHKDSGALTVLAQDDVSGLEVKRKSDGEWIRVKPTTPDFILSMLET

SEQ ID NO: 119864 - protein, 50 aa, Glycine max
  Coding DNA Sequence Number=SeqID_3086
MGAKHLTRTKEWSHVIKQRSPDEIREQQAEWANAQRQILRPLSFRNNKLS

SEQ ID NO: 119865 - protein, 159 aa, Glycine max
  Coding DNA Sequence Number=SeqID_3087
MRARADKGRHRGLERAYGHNDGGHDEYEEDDEQMSPSGLNQIIHPTSDMVGQGGKELGSMGAPYFVQVQNKHPFSPYGLPPNYTPPNVVHTPNENVNNSTPILIESQQPQSGHAHILQPMEETHEIPHHNLADIEPCLGYTTEGQAIGGVPLPNTLEGP

SEQ ID NO: 119866 - protein, 116 aa, Glycine max
  Coding DNA Sequence Number=SeqID_3088
MEGSGSPSGAPNDGKGDDNNDSRHVTGKEFSNKKPIEFTPIPVSYADILPYLLDNAIVVITLAKVPQPPFFLGYDPNAACAYHGGVPWHAIKHYMTLKRKVQGLIDTGWLKFEENC

SEQ ID NO: 119867 - protein, 359 aa, Glycine max
  Coding DNA Sequence Number=SeqID_3089
  Gene Ontology: Mol. function=RNA-directed DNA polymerase activity; Cellular component=chromatin; Biological process=RNA-dependent DNA replication
  Homolog annotation: Hit_ID=Q1SLB1; Match level="QueryCoverage=92%, HitCoverage=62%, E-value=3e-58, Identity=34%"; Hit description=RNA -directed DNA polymerase
MLAFKENFRKAYNMVNWKFLDYMLHRLGFNVKWRQWLKIIVSSSNISTLVNGSLTFEFSALRGLKQGDPLSPFLFLIAAQGLTGRFIARWRKDYSKVTHDSLWAIKAIFRGFELVSGLLVNFLKSVFYGIGTNQRFNEPAANFLSCRVASPPFHFLGLPVGALMKVIRELEGIQRHILWNGVSDQAKINWLKWTRVCTPKQMGGLGIKNLSIFNISLLTKAIWAPILKFHYGSLDLSNTGSASRTSQWWRDILRIGNCQYQPGWLTSTFCRKIGDRKDTLFWRHRCLNETPLMQSHARLFSLAMDKDISVQGMSAWDVEQSDSWNWCWSRQPFQWELELIAELEALLAGDFLVQNQNDT

SEQ ID NO: 119868 - protein, 80 aa, Glycine max
  Coding DNA Sequence Number=SeqID_3090
MTLLFSNILPSDHNANLRLQMYQLESHPQRHSVIPALVTGLCSPTGCSFPPASSRHHRDRACKTPSGPEEVQQGLGVVKL

SEQ ID NO: 119869 - protein, 274 aa, Glycine max
  Coding DNA Sequence Number=SeqID_3091
MAERTVVLTSTVDADDAPSTVDGGLWFVAPLHGGSWFVAARASSFVAEEEEEESNGEEEKGSARKKKNGSGEESNALWEKKNQKLGIKGFLSQVLGAPTKMLGAPSSTPKYFPLWIDSSSLPEHRFFFSPGTQILLLSRNTASSSLPEQLLLLPEPASSSLLREASSPRGAPRLSSSSPRTDPLGVLPEVPEEHFPESFWKNCSSGSNQTSSGRTLLPEDSRKTSSGNFPEEVVHPEEFRKTHSSGRTFKFPEDLSGRTPSSGMFPEEPLLPEV

SEQ ID NO: 119870 - protein, 177 aa, Glycine max
  Coding DNA Sequence Number=SeqID_3092
MAMRESVWFLGFSPVSKRKKDVPRGKGEEKEENKDRGGMKGWAPPPPEEALDVASFLASFGSSRFLLPLLRQRHREPSAKLLLLLRERGFEKTRIEDAGKNGKKGLTAAASGRFVRGSSGTSKRSCSGNIPEEVFFRKKPKVFRKNTSSGILPEHLFRKVSRRSSSSGRIPEEVFYR

SEQ ID NO: 119871 - protein, 142 aa, Glycine max
  Coding DNA Sequence Number=SeqID_3093
  Gene Ontology: Mol. function=DNA binding; Cellular component =endoplasmic reticulum membrane; Biological process=DNA integration
  Homolog annotation: Hit_ID=Q1SA33; Match level="QueryCoverage=99%, HitCoverage=15%, E-value=3e-41, Identity=56%"; Hit description =Integrase, catalytic region
MSMMRELKFFLGLQIKKTPQGIYIHHTQYVKQLLKKFNISDANKMKTPMHPTTYLGLDEESTKVDRTQYRAMIGSLLYLTAFRPYIMFNLCLCARFEKETRELITLVLCSKEKKVSDSQAIAMRTMLRIKLKEKAQVKAATL

SEQ ID NO: 119872 - protein, 845 aa, Glycine max
  Coding DNA Sequence Number=SeqID_3094
  Gene Ontology: Mol. function=nucleic acid binding; Cellular component= nucleus; Biological process=ubiquitin cycle
  Homolog annotation: Hit_ID=Q2HSV7; Match level="QueryCoverage=98%, HitCoverage=94%, E-value=0.0, Identity=67%"; Hit description=Zinc finger, FYVE/PHD-type
  Pfam annotation: Domain name=PHD; Domain location=81-135; Score=28.2; E_value=2.8e-05; Accession=PF00628.19; Description=PHD-finger
  Pfam annotation: Domain name=zf-MIZ; Domain location=326-375; Score =91.9; E_value=2e-24; Accession=PF02891.10; Description=MIZ zinc finger
  Pfam module annotation: Pfam domain module=PHD::zf-MIZ; Domain location=81-135::326-375
MVWKTYQSSGHAANQPISKLWTKKNAVGKQEVAKLVDDTFRKLQVSGAIDLASKGQGASDSSNVKIKGEIDDSYQSDTKIRCLCGNVFDTEPLVKCEDTRCHASQHISCVIIPEKPMDGIPPIPDKFYCEICRLDRADPFCISVTHLLFPVKLTTTNIPTDGSNPVQSVERMFQLSRANKELVSKSEYDVQVWCMLLNDKVSFRMQWPQFADLKVNGLPVRAINRPGSQLLGANGRDTGPVITPYTKDGINKISLTGCDARIFCVGVRIVKRLSMPEVLSMIPEESNGEHFEDALARVCCCVGGGNANDNADSDSDLEVVSDTFSINLRCPMSGSRMKIAGRFKPCVHMGCFDLEVFVEMNERSRKWQCPICLKNYALENIIIDPYFNRITTLMKNCGEEIAEVEVKPDGCWRVKAKNESERRELGTLAQWHRPDGSLFVSTDEVKSMENIKLKQEGVSDSPIGVLKLGIRKNSNGVWEVSKPENTNTSSGNNRLNEDLENHEHVIIPMSSSDTGSGRDEDDPSVNQGGGEHIDYSTTNGIEMDSVFNNNIDSAYGYNVNNASALMGDAQVIILSDSEEDNDVLMSHTRITGYKNNQTSDAVDVYSVLQPGIIDPYREDHNPGVFNNPSEDDFGMPSLWPLQSGTPAVPGFQLFSSEVEDDVSDALIDLHHGNINCSSSLNGYTLAPDTLGSGTLIPDSSAGRPDDDLNGGLVDNPLAFPREDPSLQIFLPTKPAESSMQHELRDHADGSNGVFTEDWISLSLGGGASGSNGDTSSANELNLRPQITPREDARDSLTDAAPLLLGVNDVRPDKASRQRSDSPFSFPRQKRSVRPRPYLSIGSDSE

SEQ ID NO: 119873 - protein, 80 aa, Glycine max
  Coding DNA Sequence Number=SeqID_3095
  Homolog annotation: Hit_ID=Q680Q4; Match level="QueryCoverage=93%, HitCoverage=9%, E-value=4e-12, Identity=52%"; Hit description=E3 SUMO--protein ligase SIZ1
  Pfam annotation: Domain name=SAP; Domain location=3-37; Score=41.8; E_ value=2.4e-09; Accession=PF02037.17; Description=SAP domain
EKLQHFRIKELKDVLTHLGLSKQGKKQDLVDRILAILSEDQGIMKKEGLLPSSIQKLIFHYLNQQCAGIFFNCSSGDHID

SEQ ID NO: 119874 - protein, 54 aa, Glycine max
  Coding DNA Sequence Number=SeqID_3096
MAKEMNIVKAPKQANNIPIQLQFTLILAAEPYERTGYHNLSNSTYPGAQFFLLY

SEQ ID NO: 119875 - protein, 50 aa, Glycine max
  Coding DNA Sequence Number=SeqID_3097
MAWMRERLQKKVEMEEVHLSEKLQNGAARRKERYDSERRRRPSRLSITKG

SEQ ID NO: 119876 - protein, 201 aa, Glycine max
  Coding DNA Sequence Number=SeqID_3098
  Gene Ontology: Mol. function=nucleic acid binding; Biological process= DNA integration
  Homolog annotation: Hit_ID=Q1SJY4; Match level="QueryCoverage=50%, HitCoverage=21%, E-value=1e-14, Identity=40%"; Hit description=Zinc finger, CCHC-type
MELNIKAKYTLTCAQSKNKYKKIYKLRTAKEIWESLSINYEDTEDVKLRKVMTLTRRYERFIMKDGEFVDGMFRRLQVLLNNLGTIGHMYSKDQINLKGLDSFPKEYDGSSNSNGSTNNEVTLMSKKFKEMMDSKGKFQHSSKHKGSRFKNKNKEESNEIICFKCRKLEHMKMIRSPGMTQTMRRVIVQVMNKPTFVSWKI

SEQ ID NO: 119877 - protein, 56 aa, Glycine max
  Coding DNA Sequence Number=SeqID_3099
  Homolog annotation: Hit_ID=Q9CA40; Match level="QueryCoverage=57%, HitCoverage=22%, E-value=3e-08, Identity=63%"; Hit description=Nudix hydrolase 1
MVDVDVVKEQVPQNLEPTKCDGWDWYEWDHLSHPLFGPLEKMDARKFVKLLIQKQH

SEQ ID NO: 119878 - protein, 738 aa, Glycine max
  Coding DNA Sequence Number=SeqID_3100
  Gene Ontology: Mol. function=DNA binding; Cellular component=nucleus; Biological process=defense response
  Homolog annotation: Hit_ID=Q1RZ67; Match level="QueryCoverage=99%, HitCoverage=99%, E-value=0.0, Identity=57%"; Hit description=Helix -turn-helix, AraC type
  Pfam annotation: Domain name=PspA_IM30; Domain location=123-327; Score=-57.3; E_value=0.035; Accession=PF04012.3; Description =PspAIM30 family
  Subcellular localization annotation: CTP_CleavageSite=74; ConfidenceScore=5.87e-01
MAASSTFCLLHSPLYQFPSSSSSSSSSSSSSGLRKLRASTTSSCLGQQDKDPVCNKRTILLSSIALLPFRRLKRAPALESPPPPPTPTEETEVKTQEDNQEAEKASEVDQPSNSFLTLLNGIGIFSSGVLGALYTLAQKEKSTAVATIETMSSKLKDKEELIVSLKKNYELKLLNKQEEQAKLVEKAKEEQLALINQLNSANSTIKRLGQELKSERSLIEDLKLQIGQLKTELSKTDTDKKDLENNLKEKIDSIGVLQERINLLSVDLKGKEDVVQNLNSFLAEKELQLKSLNSTYEQTKDDLSNVQLQIQGLKDELLKSQEELEAKDSLVIELNSRVSSLTLENNDFRSKCDVIEKEYNVLKLSAEKKAALDSKVLREKDEELHQLKDQFELALGEASKNQTVIVDLSQERDDLKEALENESSKVNHLKHELQVTQENLAKSRNEFAELENFLTESIKLRKELELKVSKLLSELTEVKESLQRSLEDGKHEAQMLASELTTAKEHLKESQAELQGVSKELTTALEKNDSLQKELIDVYKKAETTAEDLKEQKQLVASLNKDLQALEQQVSKDKESRKPLERDLEEATKSLEEMNRNAVILSGELQRANFLVSSLEKEKEVLTKSLTDQRNACKEAQDNIEDAHNLIMKLGKERENLGKKGKKFEEELASAKGEILRLKSRINSSEVAVNNDQVQKDGGENKVNSSEVAVNEQQKDEGENKVTVSARKTVRRRKANPQ

SEQ ID NO: 119879 - protein, 436 aa, Glycine max
  Coding DNA Sequence Number=SeqID_3101
  Gene Ontology: Mol. function=protein serine/threonine kinase activity; Cellular component=cytoplasm; Biological process=protein amino acid phosphorylation
  Homolog annotation: Hit_ID=Q0WN21; Match level="QueryCoverage=98%, HitCoverage=98%, E-value=1e-150, Identity=62%"; Hit description =Protein kinase like protein
  Pfam annotation: Domain name=Pkinase; Domain location=64-396; Score =221.3; E_value=2.1e-63; Accession=PF00069.15; Description=Protein kinase domain
  Pfam annotation: Domain name=Pkinase_Tyr; Domain location=64-385; Score=-31.2; E_value=1.5e-10; Accession=PF07714.7; Description =Protein tyrosine kinase
  Pfam module annotation: Pfam domain module=Pkinase::Pkinase_Tyr; Domain location=64-396::64-385
  Subcellular localization annotation: CTP_CleavageSite=94; ConfidenceScore=5.74e-01
MESQDLTDHLHSLSFTSTTAEIKRSTSFSSSTTTSTSSHFNTPLPNAKPHAPSFLQRPLSLSDLHFTRRLGSGDMSAVYLAVPKESAGAGGAVFAAKVMEKEDLARRNKEGRARTEREILEMLDHPFLPTLYAFIHAPKWLCFLTPFCPGGDLHVLRQRFPNKRFLESAVRFYASEVLLALEYLHMLGVIYRDLKPENVLIRSEGHIMLTDFDLSLKCDDSTSTAQIISDQNPPRTVPRNDSHVEPTRATSSCMIPNCIAPTASCFHPKRKKKKKQTHFNGPAFVAEPVNVRSMSFVGTHEYLAPEIVSGEGHGSAVDWWTLGIFMFELFYGVTPFKGMDHELTLANVVARALEFPKEPAASAAMKELISQLLVKDPAKRLGSVMGASAIKHHPFFQGVNWALLRCTTPPFVPPPSSAKAIYDDHQTCPEIFIDCY

SEQ ID NO: 119880 - protein, 135 aa, Glycine max
  Coding DNA Sequence Number=SeqID_3102
  Subcellular localization annotation: CTP_CleavageSite=32; ConfidenceScore=5.14e-01
MCFLRINLIRKPSVRPRRTNAICVPCLPPPTTAKLDAGNFTFTAALNLATPTNKRQCRRKKWKMRRKLFENGTYQGNLCGVYPDLSSFTESGVIQISVACIKRSTPTQDHINNGDNVLWVVVVVVVVERWRQQWE

SEQ ID NO: 119881 - protein, 97 aa, Glycine max
  Coding DNA Sequence Number=SeqID_3103
MVACVMLGHRYEPEKGLGWNGNDMASLVEFKEYRGRGQSMGQQQGPQVKGTPLCHINKSLVSAGWTCEGRVTMIHDAVPQDQSNWVHPCPPKFELGN

SEQ ID NO: 119882 - protein, 264 aa, Glycine max
  Coding DNA Sequence Number=SeqID_3104
  Gene Ontology: Mol. function=DNA binding; Cellular component =intracellular; Biological process=base-excision repair
  Homolog annotation: Hit_ID=Q9LU56; Match level="QueryCoverage=64%, HitCoverage=46%, E-value=2e-58, Identity=68%"; Hit description =Arabidopsis thaliana genomic DNA, chromosome 5, P1 clone:MWD22
  Pfam annotation: Domain name=DUF676; Domain location=117-264; Score =133.7; E_value=5.1e-37; Accession=PF05057.5; Description=Protein of unknown function (DUF676)
  Subcellular localization annotation: CTP_CleavageSite=67; ConfidenceScore=5.91e-01
MTSIKFFTSHFQSSVHIFSPFPTLAVPPRVPSFSVLVSFLLSDRIRIRTPSRENSRRFFEFFTTALCAAIGFGFGLRFSPLAKSLGSFALMEGKEVCASESAVDGSRDVWSSEPSLASSADHLVVMVNGILGRETDWKYAAEKFVKELPDKVFVHCSERNVSMHTLDGVDVMGERLAEEVLEVIKRKPNMRKISFVAHSVGGLVARYAIGRLYRPPEKGSMADSCNDESKEGSVGTIGGLEAMNFIAVATPHLGSRGNKQVLTS

SEQ ID NO: 119883 - protein, 429 aa, Glycine max
  Coding DNA Sequence Number=SeqID_3105
  Gene Ontology: Mol. function=histone deacetylase activity; Cellular component=nucleus; Biological process=histone deacetylation
  Homolog annotation: Hit_ID=Q1RZ51; Match level="QueryCoverage=93%, HitCoverage=80%, E-value=1e-160, Identity=72%"; Hit description =Histone deacetylase superfamily
  Pfam annotation: Domain name=Hist_deacetyl; Domain location=1-268; Score=296.7; E_value=4.3e-86; Accession=PF00850.10; Description =Histone deacetylase family
LLANNKFFQFPQSFVSDNLGEDCPVFDNLFEFCQIYAGGTIDAARRLNNQLCDIAINWAGGLHHAKKCEASGFCYINDLVLGILELLKYHARVLYIDIDVHHGDGVEEAFYFTDRVMTVSFHKYGDSFFPGTGDAKEIGEREGKFYAINVPLKDGIDDSSFTRLFKTIISKVVETYQPGAIVLQCGADSLAGDRLGCFNLSIDGAYLPLRKEIQFAIAGEFISVYVCHCWLRIEIYRNELLPKVTGGGGYTKENVARCWTVETGVLLDTELPNEFPCGISLDFFSCAPQSGMMEKYVIPYVSFGSIERVETFLTCFFCLSEIPQNDYIKYFAPEFSLKVPNGPIENLNSKSYLSTIKMQVLENLRCIQHAPSVQMQEGSQVPPDFYIPEFDEDEQNPDERIDQHTQDKHIQRDDEYYDGDNDNDQMNIS

SEQ ID NO: 119884 - protein, 140 aa, Glycine max
  Coding DNA Sequence Number=SeqID_3106
  Homolog annotation: Hit_ID=Q9LU56; Match level="QueryCoverage=97%, HitCoverage=51%, E-value=2e-38, Identity=46%"; Hit description =Arabidopsis thaliana genomic DNA, chromosome 5, P1 clone:MWD22
VPFLLGVPAFEKVASCVIHFIFRRTGRHLFLTDDDEGKPPLLERMWKDTINEKYPHVVYEEHCKACSDAEQCDSTEDYSYDKIEEGLVTGLSRVSWEKVDVSFRNSKNRFASHTIIQVKDQITQIEGADVIQHMIDYFLV

SEQ ID NO: 119885 - protein, 205 aa, Glycine max
  Coding DNA Sequence Number=SeqID_3107
  Homolog annotation: Hit_ID=Q9SJR4; Match level="QueryCoverage=89%, HitCoverage=80%, E-value=3e-38, Identity=51%"; Hit description =Expressed protein
  Pfam annotation: Domain name=DUF662; Domain location=13-204; Score =281.6; E_value=1.5e-81; Accession=PF04949.3; Description=Family of unknown function (DUF662)
MATPKQSYEQQQQQQQPNVQRVRNSGMINSNQSPMRDDKEEEMSRSALAMFRAKEEEIERRKVEVRDKVHAYLGRVEEETKRLAEIREELEGLTDPLRKEVAIVRKKIDSVNKELKPLGQTCQRKAMFGLLVGELQTHFGEKSEFDIMFDFFPKEREYKEALDAFNEKNKEKAQLVTKLMELVTESEKLRMKKLEELSKNVDTLH

SEQ ID NO: 119886 - protein, 60 aa, Glycine max
  Coding DNA Sequence Number=SeqID_3108
MRSKDRIAYFYDGFRLWFTTAIVAAISRFWWLPQPHCRIYLQYQGLQVMSVVFTLGRSIR

SEQ ID NO: 119887 - protein, 214 aa, Glycine max
  Coding DNA Sequence Number=SeqID_3109
  Gene Ontology: Mol. function=nucleic acid binding
  Homolog annotation: Hit_ID=Q1SUD8; Match level="QueryCoverage=55%, HitCoverage=23%, E-value=2e-29, Identity=59%"; Hit description=Zinc finger, CCHC-type; Zinc finger, SWIM-type
MRAAAKVLVKKFEDEGLPTVKVAIVLNNGDSSFSNRDSWNHIKNLRRKNLDVGVIEAVFNYYESESTFTCLFKTWLEAMGGKKNPVSILIDQDLAIGAAIAKRSESINAFFDSFVHTTTTLQEFVVKFEKAVDSRLEAKRREDYESRHKSHILSIWSKLENHAAFVYTRNVLGKFQDELRKINQYTKKKIKRDGSVMSIECLVVMMLDIPLLLM

SEQ ID NO: 119888 - protein, 104 aa, Glycine max
  Coding DNA Sequence Number=SeqID_3110
  Gene Ontology: Mol. function=cytochrome-c oxidase activity; Cellular component=mitochondrial respiratory chain; Biological process =electron transport
  Homolog annotation: Hit_ID=Q6J4I2; Match level="QueryCoverage=58%, HitCoverage=100%, E-value=1e-22, Identity=77%"; Hit description =Putative COX VIIa-like protein
  Pfam annotation: Domain name=COX7a; Domain location=46-99; Score =106.2; E_value=9.7e-29; Accession=PF02238.6; Description=Cytochrome c oxidase subunit VIIa
MDTRDFGDVKTKENIATASLLHTGVGKPASLYISRLQMSEAPFRPREKLAEKQKYFQSIHRHTYLKGPMDKITSVAIPLALAATSIYMIGRGIYNMSHGIGKKE

SEQ ID NO: 119889 - protein, 156 aa, Glycine max
  Coding DNA Sequence Number=SeqID_3111
  Homolog annotation: Hit_ID=Q1SP37; Match level="QueryCoverage=35%, HitCoverage=15%, E-value=3e-07, Identity=50%"; Hit description =Bacterial adhesion
MVVAQQRGHKGGSRADGGCAREGRDGVTWRDGKKKRKRMRKVRSGGDPTEKRKEKVVRERGILNMGKALEVCGEVVYQEANNNYMATPLGIGKEEEWYIRIVKKVMVDYVLNDHDEYFQMRVDALRQIGLSPLQKCTTALCILAYGLPVDSVDKCV

SEQ ID NO: 119890 - protein, 180 aa, Glycine max
  Coding DNA Sequence Number=SeqID_3112
  Subcellular localization annotation: CTP_CleavageSite=45; ConfidenceScore=5.08e-01
MSSSLQVFSNSTTSSLCSKNNTYNEMIITLNKTGSKKEFSNSVVLSRHDEGIQNLFHIPNGGCYKEDAQNKEKKRRRRRNKRKTLGLLRGPQPFSLILSEVRREKVSSEEVQNCEELKPSKDHVGSIKDSLFNTENMQSLFNSPIFDTFVKIICGLHSLHGEPLTFFHSPSSISLQASHY

SEQ ID NO: 119891 - protein, 406 aa, Glycine max
  Coding DNA Sequence Number=SeqID_3113
  Gene Ontology: Mol. function=tRNA isopentenyltransferase activity; Cellular component=intracellular; Biological process=tRNA processing
  Homolog annotation: Hit_ID=Q1RZ48; Match level="QueryCoverage=83%, HitCoverage=60%, E-value=2e-99, Identity=60%"; Hit description=TRNA isopentenyltransferase
  Pfam annotation: Domain name=IPPT; Domain location=37-358; Score= -84.6; E_value=3.2e-05; Accession=PF01715.8; Description=IPP transferase
MAGNYYNVVIIHKQKVRLLIYLCLGMGDRGKHEDLQMAIWMSMQHTTPEPFKKRKERNILQKMKKRALVSPFLLDDSAEDMDESCLGDPPGSGDSLFAEDDCSNNSYDMLKDIDPVAANRIHPNNHRKINQYINLYNRTGVLPSNIFQGKAAECLSSSYRLDKRLQFTNQASSLFPFCSVGGKLMWASSGLIMEEGYSIAHGLLQYMKSNNLRYDCCFICVDASLRVLDRYVEQRVDCMMYEGLLNEVYNIYNLNAVYTRGLRQAIGVREFEPLLRTCVVKDMYERERELTEGPSIEKGATLFNRNLMELVRSSSNTEPTILLEEAIEKVKLNTRRLVRRQKRMLSRLQTLFGWNIHYVDSTESISSKSEDVWTRQVVESAVEIVKSFLMRMEACHPPLGRQMTLG

SEQ ID NO: 119892 - protein, 99 aa, Glycine max
  Coding DNA Sequence Number=SeqID_3114
MNGSNTNKVVGTENVFLVSRVRGKFLVLWKRRMSILRVNSEISCKFEIPSSYEMKYIRVLLLTACHGRVEKAWPRPSAPFYMSLTLAPDRRFANLDSVS

SEQ ID NO: 119893 - protein, 116 aa, Glycine max
  Coding DNA Sequence Number=SeqID_3115
MVQKGGPLGKGKRIAHSPLAPTTPKATPWFSKEHYEPSYKFSYVKKEIIQPKFLNLAWLRSEGFAFPELIGYHGLKKLVEMKGTYYTSLILGTLCCTICEVLRRAKNQKEAGLRDP

SEQ ID NO: 119894 - protein, 161 aa, Glycine max
  Coding DNA Sequence Number=SeqID_3116
  Gene Ontology: Mol. function=porin activity; Cellular component =integral to membrane
  Homolog annotation: Hit_ID=Q15YX2; Match level="QueryCoverage=82%, HitCoverage=70%, E-value=5e-12, Identity=31%"; Hit description=Outer membrane protein, porin family precursor
MNKNSLLALGLLAALPFAASATDGLSYNYVEGGYVNTDAKGGDADGWKVKGSVAVHPNFHIFGDYSAQETDTFKNDVDQWRIGAGYNYGIAPNTDLVARVAYQKSDMKHGLDFNGYSTEVGVRTAFNPYVEGYVMAGYEDYAKKHGINPDGEFYGRVGATA

SEQ ID NO: 119895 - protein, 238 aa, Glycine max
  Coding DNA Sequence Number=SeqID_3117
MAPLPASHTHHARCLMWALILIASPVALLQAQAAERIVSAGHIVVQTDDVTRFFKVMDANQGRPSADELQHGYLDAGTDALRSFTDSRIGSMERLARAIQDKPALFAKAGTCATALPSIRTRVAAAVDQLGALLPSARFPPVTVLVGRGNSGGVTTEAGVVIGLEALCNADWMQADMSDRFVHLIAHEYVHVQQPGARVEVEQPTLLYQTLLEGGAEYVAERISGQPANAHLQRWTQG

SEQ ID NO: 119896 - protein, 237 aa, Glycine max
  Coding DNA Sequence Number=SeqID_3118
  Gene Ontology: Mol. function=sequence-specific DNA binding; Cellular component=nucleus; Biological process=regulation of transcription, DNA-dependent
  Homolog annotation: Hit_ID=P46665; Match level="QueryCoverage=80%, HitCoverage=52%, E-value=2e-43, Identity=50%"; Hit description =Homeobox-leucine zipper protein HAT14
  Pfam annotation: Domain name=HALZ; Domain location=146-190; Score =72.9; E_value=1e-18; Accession=PF02183.8; Description=Homeobox associated leucine zipper
  Pfam annotation: Domain name=Homeobox; Domain location=89-145; Score =59.9; E_value=8.1e-15; Accession=PF00046.19; Description=Homeobox domain
  Pfam module annotation: Pfam domain module=HALZ::Homeobox; Domain location=146-190::89-145
MEDDEACITSLSLGLGIMGGHAQKKENEQKVHCLDLSFELCPKGKEEVEEAIDVDQQQQQHANKAKGLLCLKHPNDETSPDSNNSNNGSRKKLKLTKEQSATLEDIFKLHSTLNPAQKQALAEQLNLKHRQVEVWFQNRRARTKLKQTEVDCEFLKKCCEKLTDENQRLKKELQELRAQKIGPTPLYIQLSKATTLTICSSCEKLLKPNEGNNKGAISNVIRNSSNKLKNSIELGGI

SEQ ID NO: 119897 - protein, 448 aa, Glycine max
  Coding DNA Sequence Number=SeqID_3119
  Gene Ontology: Mol. function=protein serine/threonine kinase activity; Cellular component=membrane; Biological process=protein amino acid phosphorylation
  Homolog annotation: Hit_ID=Q8S407; Match level="QueryCoverage=69%, HitCoverage=75%, E-value=1e-116, Identity=65%"; Hit description =Similar to putative receptor protein kinase from
  Pfam annotation: Domain name=Pkinase; Domain location=131-402; Score =137.8; E_value=2.9e-38; Accession=PF00069.15; Description=Protein kinase domain
  Pfam annotation: Domain name=Pkinase_Tyr; Domain location=131-402; Score=137.4; E_value=4e-38; Accession=PF07714.7; Description=Protein tyrosine kinase
  Pfam module annotation: Pfam domain module=Pkinase::Pkinase_Tyr; Domain location=131-402::131-402
MSFVESLLGQDVAEVTSPSNESHAPPHQSESLFYILGGIVVLAIVLIFLYVVRKRIKRPAQTMTVATNEQQGSLRNEKSITKFGGHNESAEVMKMIFSSNQHSGSKEFFSGNLRTISCFDYQTLKKATRNFHPDNLLGSGGFGPVYQGKLVDERLVAVKKLALNKSQQGEKEFLVEVRTITSIQHKNLVRLLGCCLDGPQRLLVYEYMKNRSLDLFIHGNSDQFLNWSTRFQIILGVARGLQYLHEDSHPRIVHRDIKASNILLDDKFHPRIGDFGLARFFPEDQAYLSTQFAGTLGYTAPEYAIRGELSEKADIYSFGVLVLEIICCRKNTEHTLPSEMQYLPEYAWKLYENARILDIVDPKLRQHGFVEKDVMQAIHVAFLCLQPHAHLRPPMSEIVALLTFKIEMVTTPMRPAFLDQRPREDGENHPLEALSQGFTSPIYVKASD

SEQ ID NO: 119898 - protein, 90 aa, Glycine max
  Coding DNA Sequence Number=SeqID_3120
MYYNGKQNIPRQGEFLDYSFTGTNPIRFGIPSGCDMEKLKDLIKQVAPIGVPPNGIHGSQLEEGKSGCQNPTSVKSFKQCYRAKRFLDSY

SEQ ID NO: 119899 - protein, 375 aa, Glycine max
  Coding DNA Sequence Number=SeqID_3121
  Gene Ontology: Mol. function=drug transporter activity; Cellular component=membrane; Biological process=multidrug transport
  Homolog annotation: Hit_ID=Q1SD91; Match level="QueryCoverage=98%, HitCoverage=80%, E-value=1e-162, Identity=71%"; Hit description =Multi antimicrobial extrusion protein MatE
  Pfam annotation: Domain name=MatE; Domain location=1-113; Score=12.3; E_value=0.00041; Accession=PF01554.9; Description=MatE
  Pfam annotation: Domain name=MatE; Domain location=173-311; Score =66.4; E_value=9e-17; Accession=PF01554.9; Description=MatE
  Pfam module annotation: Pfam domain module=MatE::MatE; Domain location=1-113::173-311
MSSALSTLCGQAYGAKEYDMMGVYLQRSSIVLFLTALCLLPVFIFTSPILMLLGQDENIAQVAGTISLWSIPILFAYIVSFNCQTFLQSQSKNVVIAFLAALSIIIHVFLSWLLTIQFKFGIPGAMISTILAFWIPNIGQLIFITCGWCDETWKGFSFLAFKDLGPVVKLSLSSGAMLCLELWYNTVLILLTGNMKNAEVEINALSICININGWEMMIALGFMAAASVRVANELGRGSSQAAKEKIAYLFTSNEDVVTAVGDLSPLLALSLLLNSIQPVLSGVAVGAGWQSTVAYVNIGCYYLIGIPVGIVLGNIIHLEVKGIWIGMLFGTLVQTIVLTIITYKTNWDEQVTIARNRISKWYKVELDHETSTSDN

SEQ ID NO: 119900 - protein, 104 aa, Glycine max
  Coding DNA Sequence Number=SeqID_3122
MAPPKEIVTIIYQNGHIVDDLVQGSTYTSQLFDNDDLRGAMETILQNPQLNYAEFYVVTELIPQPQPSSPQPSYPQLQLPPPQQLPYNNIDLNNPVSSYNNHAT

SEQ ID NO: 119901 - protein, 229 aa, Glycine max
  Coding DNA Sequence Number=SeqID_3123
  Gene Ontology: Mol. function=transcription factor activity; Cellular component=nucleus; Biological process=regulation of transcription, DNA-dependent
  Homolog annotation: Hit_ID=Q3L8J2; Match level="QueryCoverage=81%, HitCoverage=90%, E-value=1e-49, Identity=50%"; Hit description=CBF -like transcription factor
  Pfam annotation: Domain name=AP2; Domain location=63-127; Score =109.1; E_value=1.3e-29; Accession=PF00847.10; Description=AP2 domain
  Subcellular localization annotation: CTP_CleavageSite=70; ConfidenceScore=5.34e-01
MDFEIINESPDSTSLSSPSSLSPCTPPNSNPLSDSPNPQPSNIYTNPSHKRKAGRKKFRETRHPVYRGVRQRNRNKWVCEIREPIKKSRIWVGTYPTPEMAARAHDVAVLALSGTSANFNFPDSVSLLPLAKSRSAVDIREAAKATTTAEAFIPNTVFACSHKNAEDTCLNIGMHDDGSEMFFDEEAVYNMPGLLDSMAEGLLITPPSMKRAMDWDDIGCVIDLTLWTN

SEQ ID NO: 119902 - protein, 144 aa, Glycine max
  Coding DNA Sequence Number=SeqID_3124
MVVAVEVAVVHLRQAAAVLLPQMCLPWHAPFLNERPINGRLDWLCGHNRHPIELAETCDQSWKSQCSIGLFWVHWVSWRCDTYKLDSVDQLAFRQWKIRIMVAGKDVVEEKRHPDLCQSGHASAHDPHPPSCYTSCKVLSRGAQ

SEQ ID NO: 119903 - protein, 182 aa, Glycine max
  Coding DNA Sequence Number=SeqID_3125
MRSFNGDFPPWRCSGRYRRRGERRRHPLGNEPWKKELRHQECALDKKLGEDASMEEKKEREKERTQPWPVGSEIYPEVHENPKAFFNSSSLILLESSIQYPWGGPDGYASSIGKCVDTSSKRLIGMKSNDCHVFMECLLPNASSAFPEPIWKPLTKLNQSSDIYVQQRYRKIVYCKWKKTFT

SEQ ID NO: 119904 - protein, 63 aa, Glycine max
  Coding DNA Sequence Number=SeqID_3126
MEKFDRKTFKDKKAKKAYITWEDSDMDSSEDSENEVVNLSLMAKNYGSDEEMHSMTYIKKRKF

SEQ ID NO: 119905 - protein, 319 aa, Glycine max
  Coding DNA Sequence Number=SeqID_3127
  Homolog annotation: Hit_ID=Q2HRX8; Match level="QueryCoverage=70%, HitCoverage=45%, E-value=2e-12, Identity=32%"; Hit description=IMP dehydrogenase/GMP reductase
  Pfam annotation: Domain name=DUF1723; Domain location=88-137; Score =35.0; E_value=2.7e-07; Accession=PF08330.1; Description=Protein of unknown function (DUF1723)
MWFPGSFPFTSYPNFVNINQCTLRVRLIASEPNLRSCLMDEGLTGERPELKLSFHGKKVQKFGRPAPEIEGLVTAIGLSPLIACSLDIDDQGLISAFVERWHKEMSSFHLPVREVTITLNAVASLLHLPIIGTFHNFETLHVDKGVLMLVELLEVSGDEARVETIQCHGAYCWIYEQFPSIAEAFTDPDYDEWSPCACQWTSTKASMKSLLALMYRRRRDRLTIADVCWMPYDDYCAVRDFDLISCLSGHIQWGPVVVIHRAERVVRKFGYVQTIPPHTPGSRLSLEDIDDRWMHFSDYLAPMGQICVVSGQCASDYIH

SEQ ID NO: 119906 - protein, 48 aa, Glycine max
  Coding DNA Sequence Number=SeqID_3128
MEMKGSVRGTLGCMWFIGVQNPDEVEPWRQKDEEMKKREEWSLESEIR

SEQ ID NO: 119907 - protein, 57 aa, Glycine max
  Coding DNA Sequence Number=SeqID_3129
  Gene Ontology: Mol. function=drug transporter activity; Cellular component=membrane; Biological process=multidrug transport
  Homolog annotation: Hit_ID=Q1SD91; Match level="QueryCoverage=91%, HitCoverage=10%, E-value=9e-20, Identity=84%"; Hit description=Multi antimicrobial extrusion protein MatE
MWIVAAPAIFTRFTTFGINVISQAFIGHIGSRELAAYALVFTVIIRFANGILIFRVL

SEQ ID NO: 119908 - protein, 464 aa, Glycine max
  Coding DNA Sequence Number=SeqID_3130
MPGTIMVSVLEFMDLPLSSSTFIRASLGKIEYQVNDKGNLSFPLTSLRDDLIFQILDSEGNEISHTGVQIKLILEKGVLEDNFPLGGGHLRLKLQFILSDEERDRIRSLRQSALKKKHDELLSSSRRGEESDSRTVIGNAALPFRRNDEVSESPKIQHQHEADPQSRGPAGSGDGKESETRSVVGAQLEQKKQLTTNIADQYRESSYTKPVSQNVTLTQLQQKGKKPAYQSSSPDRSPSEKHPQRGIGSEEIAVLFGSEKKDALTSNLTQPKIEESDLQYSKKRTSLGRIPSNVKKMISAFEGGLDQDKRPQIKPPPTKQQESSIERRDSSKTQHLEQDKSKNIDPADLQERVKSASLDMVQLKELSTLNILNRHIQMAEINPNKSVRGYCGKSRRLDFSKIENVEKNEANDGTGTEESEYEKIQETKESKPKTSDNNGDENSGGPFNQVIICQTKREEQNIRT

SEQ ID NO: 119909 - protein, 86 aa, Glycine max
  Coding DNA Sequence Number=SeqID_3131
  Subcellular localization annotation: CTP_CleavageSite=16; ConfidenceScore=5.05e-01
MFSSFFAIVGYMSTVYTMESNSCTRRLTTTHTHCSTELDPLSSLKLGLQQTLNSLSLLTTFPQFAWNCYRCEIYIPAEDCIVGFYS

SEQ ID NO: 119910 - protein, 218 aa, Glycine max
  Coding DNA Sequence Number=SeqID_3132
  Gene Ontology: Mol. function=sequence-specific DNA binding; Cellular component=nucleus; Biological process=regulation of transcription, DNA-dependent
  Homolog annotation: Hit_ID=Q9SZI6; Match level="QueryCoverage=64%, HitCoverage=34%, E-value=8e-09, Identity=30%"; Hit description =Putative GATA transcription factor 20
  Pfam annotation: Domain name=GATA; Domain location=192-218; Score =19.6; E_value=0.0011; Accession=PF00320.17; Description=GATA zinc finger
MIPTYRYSVSSPMPIDLNEDHTHHVFSTSHQASSSSSSLSFSILFNPDHQGQGGSCCHWESKHLQSDEEVFWSEGLISRAQKIVPSSESWEHPVSEKDENRSDLKLRVWKKEDKCENFQVEDNSTKWMPLKMRMMRRMMVSDQTGFDTEGMISNSKQIKNEEKNPPLTPLGTDDSNNYNSSANHSKITVRVCSDCHTTKTPLWRSGPKGPKIRWFNSV

SEQ ID NO: 119911 - protein, 62 aa, Glycine max
  Coding DNA Sequence Number=SeqID_3133
MEVEEPWLGLWLPLNYRVDMGSSLAYDNGIWGEPYRLFAAKFLFVGVKGMAFVDNWVVGKEE

SEQ ID NO: 119912 - protein, 64 aa, Glycine max
  Coding DNA Sequence Number=SeqID_3134
MGSSQAPWHKKRFYQVKIKSLGVASLKELGQLMGQVQRQAFHKAYAFEVLHLWGLPVNTHGGRV

SEQ ID NO: 119913 - protein, 56 aa, Glycine max
  Coding DNA Sequence Number=SeqID_3135
MLKDQSDITNQQESNSIWIHKGNQGELGGKVNMNGYKKGVGQKTEPGKVEGSEGEC

SEQ ID NO: 119914 - protein, 389 aa, Glycine max
  Coding DNA Sequence Number=SeqID_3136
  Gene Ontology: Mol. function=transition metal ion binding; Biological process=metabolic process
  Homolog annotation: Hit_ID=Q00WZ0; Match level="QueryCoverage=74%, HitCoverage=87%, E-value=7e-22, Identity=29%"; Hit description =Homology to unknown gene
  Pfam annotation: Domain name=Pox_A_type_inc; Domain location=45-67; Score=15.6; E_value=0.19; Accession=PF04508.3; Description=Viral A -type inclusion protein repeat
  Pfam annotation: Domain name=Pox_A_type_inc; Domain location=93-115; Score=0.9; E_value=60; Accession=PF04508.3; Description=Viral A-type inclusion protein repeat
  Pfam module annotation: Pfam domain module=Pox_A_type_inc::Pox_A_type_ inc; Domain location=45-67::93-115
MDEDSKIIEELRDSNNYLRAQVSHLDRTLKQALASQEELKMANDSEILKSKEAINDLNKKLANCMSTIDAKNIELLNLQTALGQYYAEIEAMEHLERELAHAREEIAKLSQLLKEADHRADVSRNEKEEILGKLSQSEKVQTEWRSRVTKLEDDNAKLRKVLEQSMTRLNRMSIDSDYLVDRRIVIKLLVTYFQRNHSREVLDLMVRMLGFSDEDKQRIGGAQHGSGKGVVRGVLGLPSRLVGGLLGGNSTDTAANAGSDNQLCGCALTLNIFLIYTSRCFSFADLWVDFLLKETEEREKRESSENTGKAMENSSDKSPYTIPVTPPFSNRRFDAGTPSAFQITPTNQNISRPPRGYFQHSEHFDSEFSTVPLTSSDGKTTSSNQHPRY

SEQ ID NO: 119915 - protein, 244 aa, Glycine max
  Coding DNA Sequence Number=SeqID_3137
  Homolog annotation: Hit_ID=O82347; Match level="QueryCoverage=73%, HitCoverage=75%, E-value=1e-67, Identity=66%"; Hit description =Expressed protein
GKAIGSTRGVRISCKVKDCVVLDENVNSYGQFSVPVKQGSKQSKEEEEEKQNYYVNVGYAIRTLREEFPDLFYKELSFDIYRDDIVFKDPMNTFIGIENYKSIFWALRFHGMMFFKALWVEISSVWQPVENVIMVRWTVHGIPRVLWESRGRFDGTSEYKLDKQGKIFEHRVDNIAMNSPPRFKVLGVEELIRSIGCPSIARPTYFEISSPPKRTCEKMVFCHRLGYMVLLAPVIGSVLAIVTS

SEQ ID NO: 119916 - protein, 100 aa, Glycine max
  Coding DNA Sequence Number=SeqID_3138
MWGTIANLKENLNKIALDVHDDDDDDEIFRVYGAGSPSNGGSSAVSDRRSSHGSVRSRSGIRSPLANGIDHASLPEISEISILIGKQHNQHLRNYIQVEK

SEQ ID NO: 119917 - protein, 173 aa, Glycine max
  Coding DNA Sequence Number=SeqID_3139
  Gene Ontology: Mol. function=transition metal ion binding
MAFQDHIVKLNKENGSLKQNLEATNAALRVSRIEGSGASTNGTYTVKGSSDQSPNQQHKFNTQRKNRYAINNGTMSALESDAIQSEMEIKHSNLQGNHQELGDLVDGNTTVAVQHAPEIQKLRLELEQEHNQLANIQLKFQEEQRFNKSFQEELNILKLERDREHTFEPKRAM

SEQ ID NO: 119918 - protein, 357 aa, Glycine max
  Coding DNA Sequence Number=SeqID_3140
  Gene Ontology: Cellular component=chloroplast
  Homolog annotation: Hit_ID=Q84W65; Match level="QueryCoverage=77%, HitCoverage=76%, E-value=3e-69, Identity=56%"; Hit description=SufE -like protein, chloroplast precursor
  Pfam annotation: Domain name=BolA; Domain location=288-353; Score =11.7; E_value=0.00018; Accession=PF01722.8; Description=BolA-like protein
  Pfam annotation: Domain name=SufE; Domain location=94-213; Score =118.6; E_value=1.7e-32; Accession=PF02657.6; Description=Fe-S metabolism associated domain
  Pfam module annotation: Pfam domain module=BolA::SufE; Domain location=288-353::94-213
MDLTAIIAQPVIGYPCVFNDGYEFDYLILLPNSLNQNPSLSLLQNLTFPYIPHKSLSQNPSPSTDFNHHHHPHHHHHQHPFNPSKTFLPSSKGQSVPEPKAKYEQLIFYGKNLKPLEPQFKTNDNKVQGCVSQVWVRAYLDPNRNVVYEADSDSGLTKGLAALLVQGLSGRPVNEIIRVTPDFVTLLGLQQSLTPSRNNGFLNMLKLIQRKALMLYVEAEKGGESDGIVKNSSSGGESSELGGDSKIPLLELGGRGKRGIVENSSGGESYELGGESEIPSVSASRGDENLELGGRGKREVEEVSYQHAGHAGVRGSDGETHFNVRVVSIEFAGKSLVKRQTYLWPATRAVGCWTAHD

SEQ ID NO: 119919 - protein, 85 aa, Glycine max
  Coding DNA Sequence Number=SeqID_3141
MRLHCYQASQRPSMTTNRPPLLVAHIDLVPSGVAICCNLPYDGRARQNAKGVSSKEKTRGSRHQPLLEENIRKTKKRYANIEKTG

SEQ ID NO: 119920 - protein, 62 aa, Glycine max
  Coding DNA Sequence Number=SeqID_3142
MELEHPTATPLNSAMTYDEASMERSKSFVNALQGKLVTVTNCHNLLGISVYRVGDGSDFRMI

SEQ ID NO: 119921 - protein, 793 aa, Glycine max
  Coding DNA Sequence Number=SeqID_3143
  Gene Ontology: Mol. function=protein binding; Biological process =apoptosis
  Homolog annotation: Hit_ID=UPI0000162D33; Match level="QueryCoverage =16%, HitCoverage=60%, E-value=6e-12, Identity=31%"; Hit description =protein binding
  Pfam annotation: Domain name=BAG; Domain location=219-296; Score =59.5; E_value=1.1e-14; Accession=PF02179.6; Description=BAG domain
  Pfam annotation: Domain name=IQ; Domain location=193-213; Score=19.4; E_value=0.013; Accession=PF00612.17; Description=IQ calmodulin -binding motif
  Pfam module annotation: Pfam domain module=BAG::IQ; Domain location =219-296::193-213
  Subcellular localization annotation: CTP_CleavageSite=73; ConfidenceScore=5.71e-01
KKDSCTGDKKRQSASSPKGSKLPPVCLRVDPLPRKKNGNGSLSLSSRSRSPSPPSSKGQSQATTGETFKTPVSGTHDKGQPNSDHQNGPTNTSERVKPKEKTIPVSEICKTNENQGVECRDGCQSQINVNIPSEDPKGTRGTCPDGDDFKTEDKKADKGADKMREKTAELKDVKDSSAQTDAGQKEVRVLSDADASVLIQAAYRGHQVRKWEALKKLKQIDEVRKEVTDVRDRVQAFERSSDLQNDDKQKIAIGETIMRLLLKLDTIQGLHPSIREIRKSLARELTILQERLDYIMAKKPQQQVQDFNVQEHVEVTPMNMQNEEQVAVPADSAEGISDDAKGPCANVGGSESQSPVDPTSDKGAESVVLPNGSHNDDTSQVVTDDTLNSTSDLSETDKMAVEPEAKSEAKDIPTAEDILNEVDKLYKTVLEEFPVGVVDEDIDDVIIEKEEQDDVSSGSLQAMVDDSARDGLENHAMMEMPVGLFDEDERNNEMNISKEGTQTENDIFIELPMGLLDEDTAISEVKKHDRAKPKTYKEVLLAQEGECNADEKTSSSTDNTANETQLGQQQKLEEQKEVHSSGECWVKIKYQEEGELNGDAPIDIRTECKSGEEVENDTKLPPLTTQVNDHGPGNEDVCSKANDVNNISPEAKPMELVPSNETQKEEEPEEKIALRETQEMVTEQAIGADDKDPEALFKEKTELSSPPPALQEPELPAAMRDGEFNGDTKLLEENENLREMMKKLLEAGNEQLSVITNLTGRVKDLEKKLARSRSKRVKTKRYRPATSKMSCMK

SEQ ID NO: 119922 - protein, 206 aa, Glycine max
  Coding DNA Sequence Number=SeqID_3144
  Homolog annotation: Hit_ID=Q5SMS6; Match level="QueryCoverage=66%, HitCoverage=37%, E-value=4e-27, Identity=40%"; Hit description =Fimbriata-like
MMMMVEGRLAREVGSFLEFGEEVDKEGTSVYVGALLPDELVERILAYLPPLQAFSEQDVKLDGPLGLKSRDYNALAMSMNKKSHNYKVAIVKSKQIPEDFVQWGISIHIYDSKNETRMTNSTEVLMGWRGVYSVMGVPSESCHALIAYDISHCSSQTTLRRSFIALPCSPTCGRLMNMNEKLVMVGEIGKHDRPDITKRVGDNSKI

SEQ ID NO: 119923 - protein, 68 aa, Glycine max
  Coding DNA Sequence Number=SeqID_3145
MSLIAIIVQPKLHPHQQIYAPQHHRTMGKSHKQSLGGLVLHTNGGEMMVWRAPCWLLHQGGHAHKFRV

SEQ ID NO: 119924 - protein, 212 aa, Glycine max
  Coding DNA Sequence Number=SeqID_3146
  Gene Ontology: Mol. function=protein binding; Biological process =apoptosis
MMPAYRSMDSYPYQRNQIPFPHYYHPGIEPIHPQMKLDPSKPPFSYDQHWPYAGNLGHPIPPHFCCGHNNFPCHYSYMPSNPHAPSPMYYSGTCPSYSEPYFVPYSLQPHYTMDLPSQKEGRSVKIEEHEPDGGKKVNDALAPIQLKNYPYPLVWIPQEYTSNKQLKNPNTMEVGEQDKSPRFENSNADAQPAQDPRVWNGWLPFNIKGAPN

SEQ ID NO: 119925 - protein, 659 aa, Glycine max
  Coding DNA Sequence Number=SeqID_3147
MDRREKSLEGGDKRGCGLMVEKLREGVSVGKKGGPSTPPPTWRLEQNGGDKVQEFLNFSTSTLSARKLCANLWEVLPHHQQQQQHTPLVKMNKLGTTLRRRRSHRNRRRRSQHPMDTGSEVNNNSQLAEPPGTPSDSDQLASSASSSRRHVAASPVQHHGSVERNGCALQPVSPACYSSSEEVTSYKCTVTPTSSVDFKGRIGESSYNLKTSKELLKVLNRIWNLEEQQASNISVVKTLKMELDRSRAQIKELLREKQMNRHEVENLIKEITVDKLIRKNKEHGRIKAAVQSIREELEDERRLHQHSESLHRKLARELSEVKSSFSGCLRNLERERKARILLENLCDEFAKGIRDYEQEVHSLRRSSEKGQGQVKGNDSLDRLILHISEAWLDERMQMKLAQSDGGLIERNSIVDKLGFDIETFLHAKRSVDLKKYGYSSPKELKEIHPCQQSLDSFPLKEAGSAPQNMAQEDSIDTNFFEPKMANGEGLQNISSRLQANMSRNISYDDNERFFADRKSSEMGEDNTALLNEETRHDPQESDIPWILRMSSSHRPDILVANSSMSSEGDKVYPESICKEDSCVKSAVTANGSPARLWKSKLSASDFDKSESSTKLPKGVKENTLMAKLLEARLEAQKSRSRASKSTYGSTREAYNENME

SEQ ID NO: 119926 - protein, 56 aa, Glycine max
  Coding DNA Sequence Number=SeqID_3148
KLKKAETLIWVDFVECPKVEVVYGSSWKSGDLEMEDLDIDLMGTLIWIWWSGQRFL

SEQ ID NO: 119927 - protein, 65 aa, Glycine max
  Coding DNA Sequence Number=SeqID_3149
MYTWELTLDNIQRIKLVNMARKAMPENLEMSTKLQKQLQGRKFVAQESYAYGSLLYTPKPHITPP

SEQ ID NO: 119928 - protein, 600 aa, Glycine max
  Coding DNA Sequence Number=SeqID_3150
  Gene Ontology: Mol. function=oxidoreductase activity; Cellular component=peroxisome; Biological process=electron transport
  Homolog annotation: Hit_ID=Q84XG2; Match level="QueryCoverage=98%, HitCoverage=99%, E-value=1e-157, Identity=54%"; Hit description =Putative polyamine oxidase
  Pfam annotation: Domain name=Amino_oxidase; Domain location=15-589; Score=203.4; E_value=5.5e-58; Accession=PF01593.14; Description =Flavin containing amine oxidoreductase
  Pfam annotation: Domain name=DAO; Domain location=7-443; Score=-60.2; E_value=0.06; Accession=PF01266.14; Description=FAD dependent oxidoreductase
  Pfam module annotation: Pfam domain module=Amino_oxidase::DAO; Domain location=15-589::7-443
MVVKKPRIVIIGAGMAGLTAANKLYTATASKDLFELCVVEGGTRIGGRINTSEFGGDRIEMGATWIHGIGGSPIHKIAQEIHSLHSDQPWECMDGNTVTDDATTITIAEGGFHLHHPSIVDPITKLFNTLMEYSQGKLNDTTSKGGSELESYQKLAAKVASVSASSNNNNKNNLSVGSFLRQGLEAYQVSKEEQEEVKGCGNWSRKLLEEAIFAMHENNQRTYTSADDLFTLDYGAESEYIMFPGEEITIAKGYLSIIEYLASVLPPGLVQLGKKVTRIEWQLDDEKRKKGGAVENNGCCSSSSRPVKLHFCDGSVMYADHVIVTVSLGVLKAAILDDDDDDSGMFYPPLPPSKTEAISRLGFGVVNKLFMQLSPTHGGLKQHENEQSDKGFPFLQMAFHSPQSEMRNKKIPWWMRRTATLFPIYNNSSVLLSWFVGEEALALESLKDEEIINGVSSTVSFFLQHHSQWQKGSTSCSSHKLCNGNVNSDEGRSHYLQNEVKFSKVLKSKWGTDPLFLGSYSYVAVGSSGDDLDIMAEPLPKDNSSCQASSAASSSPLQILFAGEATHRTHYSTTHGAYFSGLREANRLLQHYHCVGIYNN

SEQ ID NO: 119929 - protein, 333 aa, Glycine max
  Coding DNA Sequence Number=SeqID_3151
  Homolog annotation: Hit_ID=Q5QN81; Match level="QueryCoverage=72%, HitCoverage=43%, E-value=1e-11, Identity=26%"; Hit description =Pentatricopeptide (PPR) repeat-containing protein-like
  Pfam annotation: Domain name=PPR; Domain location=135-169; Score =18.9; E_value=0.019; Accession=PF01535.11; Description=PPR repeat
MSHPSRTRTERDIKERPKEVKSYFSHFQGNQSAPDGSSYGESHHSFALGFFNWASQQPGFTHTPFIFHSLLKSLSHTNHFTAIHSLLKQAKALNFPILPSLLSSIIASHIARNSAREAFLLFSGVGSLCSEIGGATCNFLLAALALDGCLKSAHRVFDEMAERGVGFCMLGFGVFVWRVCGEDDLEKVVSLCWRLCGCWMNLGRGWKPDFMAYWVVAAAFRSMGNVADEVKVLKMKRKLGVAPRSSDYRDLILGLVLERRICEAKEVGEVIVGGNFPVEDDVLNALIRSVSSVDPGAVIVFFDFLVEKERFPTILTISNLSRNLCRHGKAWQV

SEQ ID NO: 119930 - protein, 153 aa, Glycine max
  Coding DNA Sequence Number=SeqID_3152
  Homolog annotation: Hit_ID=Q1SP02; Match level="QueryCoverage=60%, HitCoverage=19%, E-value=2e-09, Identity=36%"; Hit description=IMP dehydrogenase/GMP reductase
MYEYLNDASKSTTRQLAGYITLLQCWIYKHFPIIGAAIAAEDYDERKPRACLWKSEKALSVLTYHKRLHRLTSDAVCWIPYGENNAFKEFEVISLFFEHIRWGGLPSNSLKVGKLAQPKDSDRGNKSIHCHQRMPEDRKRCHCATECLRSIET

SEQ ID NO: 119931 - protein, 219 aa, Glycine max
  Coding DNA Sequence Number=SeqID_3153
MEFYMDGSGGGACSYIEYSPFSSKTCKGLEDTPIDVVAGDVCDSGEDDCIDMELDDGCSVDSIEGSDFSITDNEGYCFDTEVKLMEPPMKTRKGSGARKGKILKNKKGKKFCDKLFCHRKGKREDRGLTNEKHKRYIRRKTRCGCRTECRVHIGINSRLRYVSYIHNGHSHELLNDEECRMLPSHRTMSDFDLMQVNNESCWHKYATNLWSNYISVWRL

SEQ ID NO: 119932 - protein, 149 aa, Glycine max
  Coding DNA Sequence Number=SeqID_3154
MHIINSMNIVTEEVMEYLKRMFTWISKFSYKYTVDEQVRLHVHFGDIRCHVLLLDGPQMPLITIDAHATYHFPFERMVLTSGPLDLLSEDTSVEVLKDMGDFVDDEDLTPFKITFYRGVCDEEISEEDMVSSTTRSAILEKMRATLMRI

SEQ ID NO: 119933 - protein, 398 aa, Glycine max
  Coding DNA Sequence Number=SeqID_3155
  Gene Ontology: Mol. function=protein binding; Cellular component =nucleus; Biological process=regulation of transcription, DNA -dependent
  Homolog annotation: Hit_ID=Q52ZH8; Match level="QueryCoverage=96%, HitCoverage=58%, E-value=1e-144, Identity=69%"; Hit description=FVE
  Pfam annotation: Domain name=WD40; Domain location=10-47; Score=11.5; E_value=1.7; Accession=PF00400.22; Description=WD domain, G-beta repeat
  Pfam annotation: Domain name=WD40; Domain location=153-192; Score =36.2; E_value=1.2e-07; Accession=PF00400.22; Description=WD domain, G-beta repeat
  Pfam annotation: Domain name=WD40; Domain location=202-241; Score =41.5; E_value=2.9e-09; Accession=PF00400.22; Description=WD domain, G-beta repeat
  Pfam annotation: Domain name=WD40; Domain location=85-147; Score =22.6; E_value=0.0014; Accession=PF00400.22; Description=WD domain, G- beta repeat
  Pfam module annotation: Pfam domain module=WD40::WD40::WD40::WD40; Domain location=10-47::153-192::202-241::85-147
MEKTEDSVLRWMILTGHQDNAEFALAMCPTEPYVLSGGKDKTVVLWSIEDHITSAATDSKSGGSIIKQNSKSGEGNDKTADGPTVGPRGIYCGHEDTVEDVAFCPSRKKNGGIHKYLVSSHEKILGISQIAQEFCSVGDDSCLILWDARVGSSPVVKVEKAHNADLHCVDWNPHDDNLILTGSADNSVRMFDRRNLTTNGVGSPIHKFEGHKAAVLCVQWSPDKSSVFGSSAEDGLLNIWDYEKVGKKIERSGKSISSPPGLFFQHAGHRYETAVFWDKVVDFHWNAYDPWTIVSVSDDCESTGGGGTLQILLLEKPFDIKPNERHVSPKDDPFINIHKNTSLRATNLFPLPRTAQTFSRLILIWRMSDLIYRPEDEVLAELEKFKSHVVACASKTEK

SEQ ID NO: 119934 - protein, 137 aa, Glycine max
  Coding DNA Sequence Number=SeqID_3156
  Gene Ontology: Cellular component=nucleus; Biological process =regulation of transcription, DNA-dependent
  Homolog annotation: Hit_ID=O22607; Match level="QueryCoverage=79%, HitCoverage=21%, E-value=2e-49, Identity=88%"; Hit description=WD-40 repeat protein MSI4
MEIDFVVLLFGSSAICVLTDGSVPNTLVIANCEVVKPRVAAAEHISQFNEEARSPFVKKYKTIIHPGEVNRIRELPQNSKIVATHTDSPDVLVWDVESQPNRHAVLGATNSRPDLKSGGSNIGARMGLGAKAYDAHT

SEQ ID NO: 119935 - protein, 261 aa, Glycine max
  Coding DNA Sequence Number=SeqID_3157
MKANMKAMKEQMTMMMEAMMSMRKLMEVNAATTVTANTTTKRDPIHLFDFNQEGHPILDVVGQGGEARRWQMRMGLIMSRSRASLLFHHMVCLQIIHYLLLYMFIVRILVILHLYSLRVNNLNPFIPMPMSLNPWGKHMKLPKTTLWPVSWGPLCFVKGGGPPTIVKKENFDHIEERMWAIEKRGSYGFADMSELCLVPNVVIPPKFKQYNSNMAPDKMRLQNICMRDNESFKEYAQRWRDLAAQVVPPMMENEMHLMLWL

SEQ ID NO: 119936 - protein, 70 aa, Glycine max
  Coding DNA Sequence Number=SeqID_3158
MEPKELFTTQSMNFREHRAEQGAKFSSFREISEFLSDCEIPRGGGNIPTPLDFSIGKCTVSLELDRAGTE

SEQ ID NO: 119937 - protein, 126 aa, Glycine max
  Coding DNA Sequence Number=SeqID_3159
MGIRVRAREEWILLKIIMNSNNDDDRDISGGCINNGDSDDVVMIVNGGNVGSDGDDHNDKDDDSGSDDHQVVAGDGCDDIGGCSDDDEGACGYNDNDDNSDTNNSVMMVMSMTMTITMMMIITMVW

SEQ ID NO: 119938 - protein, 584 aa, Glycine max
  Coding DNA Sequence Number=SeqID_3160
  Gene Ontology: Mol. function=protein binding
  Homolog annotation: Hit_ID=Q9FPW6; Match level="QueryCoverage=99%, HitCoverage=99%, E-value=0.0, Identity=70%"; Hit description=POZ/BTB containing-protein AtPOB1
  Pfam annotation: Domain name=BACK; Domain location=287-389; Score =4.8; E_value=0.00031; Accession=PF07707.5; Description=BTB And C -terminal Kelch
  Pfam annotation: Domain name=BTB; Domain location=170-272; Score =26.0; E_value=1.8e-05; Accession=PF00651.21; Description=BTBPOZ domain
  Pfam module annotation: Pfam domain module=BACK::BTB; Domain location= 287-389::170-272
MKDSNSNSDLFDPVMAMESEWSRGGGGTSDADFAFAFNDSNFSDRVLRIEIMNDPVDARPDSDACATIADWARHRKRRREDIKKDNGVDLASVPDEQVLNGHQSEVDECENQDEEPDAMVEEPHSEKFGCYQRVWYSPFLSNGYGYPLVPSFLKYEGDEATNSNDSDWSMDCSAGAVVRVKTLHISSPILAAKSPFFYKLFSNGMKESEQRHVTLRINASEEVALMELLNFMYSNTLTTTTAPALLDVLMAADKFEVASCMRYCSRLLRNMPMTPDSALLYLELPSSVLMADAVQPLTDAAKQYLAGRYKDITKFQEEVMALPLAGVEAILSSDDLQVASEDAVYDFVLKWSRQQYPKLEDRREVLGARLARLIRFPYMTCRKLKKVLTCSDFDHDIASKLVLEGLFFKAEAPHRQRSLAAEDSASSNRRFVERAYKYRPVKVVEFELPRQQCVVYLDLKREECNNLFPSGRVYSQAFHLGGQGFFLSAHCNMDQQSSFHCFGLFLGMQEKGSVSFAVDYEFAARSRPTEEFVSKYKGNYVFTGGKAVGYRNLFAIPWTSFMAEDSLYFINGVLHLRAELTIKH

SEQ ID NO: 119939 - protein, 162 aa, Glycine max
  Coding DNA Sequence Number=SeqID_3161
  Gene Ontology: Mol. function=transferase activity, transferring glycosyl groups; Biological process=lignin metabolic process
  Homolog annotation: Hit_ID=Q40287; Match level="QueryCoverage=44%, HitCoverage=15%, E-value=1e-18, Identity=54%"; Hit description =Anthocyanidin 3-O-glucosyltransferase
MLRINLIRKKKIKQGQFHHFYRMLGAPAIMLGAPSNTQINLFGLCAHLSPKLAPTTISQQVHLLDMFKLSEEGEIGTTLGSNNEPSNSFPDEFYRIQNNGIVITNWAPQLDILKHPSIGGFVSHCGWNSLIESVSCGVPIIGLPLFGEQMMNATMRVTFYFS

SEQ ID NO: 119940 - protein, 62 aa, Glycine max
  Coding DNA Sequence Number=SeqID_3162
MVGREELSKAIRKIMDKGDKEGSVMRERAKELKHIAKRAWSHDGPTYLALSKITHSNGWYSR

SEQ ID NO: 119941 - protein, 237 aa, Glycine max
  Coding DNA Sequence Number=SeqID_3163
  Subcellular localization annotation: CTP_CleavageSite=55; ConfidenceScore=5.29e-01
MLRLLKPQPFPSGHQLRTVSGTAKGKAKIKAGQALKRSRITTKKPGSAIAAGLPMSRERQERERLYEKCLQAPTPLRHLTPKQRERESEREKLGLVSKDRQREIDMMRRKDDKFRVSEKPTIIGTPGLDYVTLGLVDAEKLPKYGLTVEDGRRLAKEYSRVLMRKHRARQAAESNLLRMKKEAIEALPEGLREAALVPDLAPFPVNRFMATLTPPIEGYIEQVREAANRISGKEKIR

SEQ ID NO: 119942 - protein, 277 aa, Glycine max
  Coding DNA Sequence Number=SeqID_3164
  Homolog annotation: Hit_ID=Q84YF3; Match level="QueryCoverage=89%, HitCoverage=82%, E-value=6e-24, Identity=28%"; Hit description =Hypothetical protein 4B
  Pfam annotation: Domain name=DUF1191; Domain location=4-273; Score =224.7; E_value=2.1e-64; Accession=PF06697.3; Description=Protein of unknown function (DUF1191)
MVASGSQSYFYDRESLDDFLRKQANKETERLRKGVLSNVYLPSNFTGMEVSVVRLRSFSLWSRGMNYSSFNLPPRIVLQPNAKRIAILFENLGNWSSNYYNVPNHTMVASVFGVMAYSSSETAFVDEKINFTTHGDPIRIRFPHVDQHGENDTPICAKFRAGGLVKFKNMTKPYVCEVYSQGHYTLVVPSFPSPKEPNTRSHSKRFTKWWVLGFVIGFAGLVILVLILLALVKEAKKRRIRKMEKNSEGGELFDTFWIGESKLPSASMLRTQPTLEN

SEQ ID NO: 119943 - protein, 52 aa, Glycine max
  Coding DNA Sequence Number=SeqID_3165
MACPFPVLFVPGISRWQQRYGVACWDTGTRVKIKEGECGVKDESCSCNCMRH

SEQ ID NO: 119944 - protein, 134 aa, Glycine max
  Coding DNA Sequence Number=SeqID_3166
  Gene Ontology: Mol. function=ribose-5-phosphate isomerase activity; Biological process=pentose-phosphate shunt, non-oxidative branch
  Homolog annotation: Hit_ID=Q8LBQ2; Match level="QueryCoverage=70%, HitCoverage=46%, E-value=2e-17, Identity=44%"; Hit description =Putative ribose 5-phosphate isomerase
  Pfam annotation: Domain name=Rib_5-P_isom_A; Domain location=1-111; Score=-72.2; E_value=0.00029; Accession=PF06026.5; Description =Ribose 5-phosphate isomerase A (phosphoriboisomerase A)
MVDPFPNFIKDHVSASCEKRWSRVLIIDESKLVNYFGGSGLAMPVEEVGCVAKIRTFGEKKEPYVTNNGNFIVDLYFERSIGDLKVASDAILQLDGDTSNALLFLLSEARTGNMYGNGYSHTESYEEMQKPPSV

SEQ ID NO: 119945 - protein, 1054 aa, Glycine max
  Coding DNA Sequence Number=SeqID_3167
  Gene Ontology: Mol. function=protein serine/threonine kinase activity; Biological process=protein amino acid phosphorylation
  Homolog annotation: Hit_ID=Q5NAH9; Match level="QueryCoverage=40%, HitCoverage=57%, E-value=1e-126, Identity=55%"; Hit description =Protein kinase CDG1-like
  Pfam annotation: Domain name=Pkinase; Domain location=886-1053; Score= 6.4; E_value=6e-09; Accession=PF00069.15; Description=Protein kinase domain
  Pfam annotation: Domain name=Pkinase_Tyr; Domain location=886-1053; Score=11.8; E_value=3.4e-13; Accession=PF07714.7; Description =Protein tyrosine kinase
  Pfam module annotation: Pfam domain module=Pkinase::Pkinase_Tyr; Domain location=886-1053::886-1053
MGVVLALILQLVKLCIIGFVVEFQGSEGSVISPSPAFLPVIHPSGEAPAPIHHGLSWESSPPKSPSDPNEFGISPSNEIIPVDPSPSEPPGTLHPREPWRTIAPIPPEVPNGSFLPPPVTTLPPPTSAPTPQKVKGFEPSISPSPSTSTIASSPPAPYNAAHAPSTSEGSVPPSIQPSPPQSKTTPAIRPPVSTPIAPAPIAITSGNLPKTSPVSQPIEHGSLPPKIDERNKSHKPEPALPALVPIPSTILPKISPVSQPTENGSLPHREAPTVFSFPEHSPESQPTEHGSLPPTVPRRNINTGRTLEPVSQAPVATAPAILPKNSSVSQPTHHGNSPPDVQNRTANNGHSHTPAPEMPPSVTPPRPFPVDPPLVHPVIPAAPPPKSPAPGGEPVSAPVYKTPKPPSAIVHFHAQAPVVSPVSTPSRSFNWTKGGEPVSAPPYKTPKPLPVIVHSPAQAPSSAHKARQFHHAPEPPISSPESPFNKDHPPASSPSTTFYKHHHTRNTVTSPAPASSHSISPSTSKHQDGSNPPLPLPTSRQRHHAPPPMNTGSSVSPSGLPIQSPVSQVSPAPSPLFKISPHSTKIPLPPPKVSPSRPSSKTPKKPVRPRFQALPPPPPNEDCISLVCSDPYTSTPPGAPCKCVWPMKVGLRLSVSLYTFFPLVSEFASEIATGVFMKQSQVRIMGADAANQQPDKTIVFVDLVPLGEEFDNTTAFLTSERFWHKQVVIKTSYFGDYDVLYVTYPGLPPSPPLPPSSISIIDGGPYSGGGNNGRTIKPLGVDISKRQHKGGLSKGIIAIIALSVFLVVVLCFAAALALFKYRDHVSQPPSTPRVLPPLTKAPGAAGSVVGGGLASASTSFRSNIAAYTGSAKTFSMNDIEKATDNFHASRVLGEGGFGLVYSGTLEDGTKVAVKVLKREDHHGDREFLSEVEMLSRLHHRNLVKLIGICAEVSFRCLVYELIPNGSVESHLHGVDKENSPLDWSARLKIALGSARGLAYLHEDSSPHVIHRDFKSSNILLENDFTPKVSDFGLARTAADEGNRHISTRVMGTFG

SEQ ID NO: 119946 - protein, 74 aa, Glycine max
  Coding DNA Sequence Number=SeqID_3168
MGIDHLHVPGNFYLKVWWHCEFLTFEYDYVVAIEFQDEAIVEVVDPFAVKALGPSGGAGAAELLRHWVSMKKMR

SEQ ID NO: 119947 - protein, 173 aa, Glycine max
  Coding DNA Sequence Number=SeqID_3169
MPGNINLEDAQQNKIIETEIDIGQVMKELKKTTRTVVLELHRCTLTLELHWCGLVVSRRIPSPLHSGTERITTNGVDNVYMFDDVDICSSEDEEVDDETFQFEDEEELGCRNESSLITIANYDELLGYLTRQLTKLKLKNGSAEIINEGDTETHVHMEEEPTQESKVQDLPRV

SEQ ID NO: 119948 - protein, 188 aa, Glycine max
  Coding DNA Sequence Number=SeqID_3170
  Gene Ontology: Mol. function=translation initiation factor activity; Cellular component=cellular_component; Biological process =translational initiation
  Homolog annotation: Hit_ID=Q2TVZ2; Match level="QueryCoverage=96%, HitCoverage=82%, E-value=6e-16, Identity=28%"; Hit description =Density-regulated protein related to translation initiation factor 1
  Pfam annotation: Domain name=SUI1; Domain location=81-188; Score =32.8; E_value=2.4e-07; Accession=PF01253.13; Description=Translation initiation factor SUI1
MAEKPQPVRVLYCGVCSLPPEYCEFGSDFEKCKPWLIQNVPDLYPDLLKEEKEADKVADKLQSTGISGAGDGAASSAPKQEEDKQEVVIEKVVRNKRKCITTVKGLELFGVKLSDASKKLGKKFATGASVVKLASSTSAASAIHSFQIIPEPLWPFSGEHGPTEKEQIDVQGDIAYDVVEFITDTWPD

SEQ ID NO: 119949 - protein, 1378 aa, Glycine max
  Coding DNA Sequence Number=SeqID_3171
  Homolog annotation: Hit_ID=Q75LL9; Match level="QueryCoverage=99%, HitCoverage=100%, E-value=0.0, Identity=45%"; Hit description =Expressed protein
MASNQILKELQWAQQAIKSEGLNLHSISFYLSQPTSGCYQETDNSISINISKENLPFFSHLLTTLAAPRSTNSSSLRNLEFHRVEWDSQKVRNLGTLLGNNQNVQQVVFRRNRFNGKSLSELSDILKANKVIKEIMLSESGIGSVGAGLIASALVVNDSLEELQIWEDSIGSRGAEELSKMIEVNSTLKLLTIFDSNAITATPLISAVLARNRTMEVHVWSGENGDKSFKVVEFVPENNTLRIYKLNLSGACRVICSLGMNFTVKSLDLTGVKLKSQCAKEFRWVLEQNQTLKEVNLSRTCLKDKGIVYVAAGLFKNRSLQTLHLSGNWFNGVGVEHLLCPLSRFSALQMQANTTLTCVTFGGGRTRIGRDGLAAIIQFLISNETVRKLGIHDDESLRSDDFVKIFKSLEKNASLKCLSVQGCKRVEGETLLHTIMETIQINPWIEDIDLSRTPLHNSGKTRGIYQRLGQNEKTEPEMDLVKDMPLTEPKSCRVFFCGQESAGKTTLCHSISQNFSALSLPYLDQVRTIVNPVEQAVKAVGMKIKTFKDEDTRISIWNLAGQHEFLSLHDLMFPGHGSASFFIIISSLFRKPSNKEPKSSTEIEEDLQYWLRFIVSNSKRAIQQCMLPSVAVVLTHTDKINQPSQNLQHTVDSIQRLRDKFQGYVEFNPTVFTVDARSSASVSKLTHHIRKTSKTILQRVPRVYQLCNDLIQILSDWRSENYNKPAMKWKEFGELCQVKVPLLRIQSRNENKERVEMKRRAIATCLHHIGEVIYFDELGFLILDCEWFCGEALGQLIKLNVRKQHSSENNGFVSRKELEKILRGSLQSPIPGMGSKVFENLDTSDLVRMMLKLELCYEQDPSDPNSLLLIPSILEEGRGKPQKWQLSMPDCVYAGRHLECDDSSHMFLTPGFFPRLQVHLHNRIQALKDQHGATYSLEKCIISICINGIYIRVELGGQLGYYIDVLACSTKNLSETLRVINQLIIPAIQSVCHGITLTENVIRPECVRKLTPPRYRKTQFASMQQLKQALLSLPADSMYDYQHTWSPVLDSGRPILQDGFDFARDLLSDDDFREVLHRRYHDLYNLAQELQVPPENNPEGQGQSITMSNEAAKVEPTFGGIAKGVEAVLERLKIIEQEIRDLKQEIQGLRYYEHRLLLELHRRVNHLATFNVQVEERKVPNMIYFVKTENYTRRLVTAMLSGMNALRLHMLCEFRGQMHVVEDQLGCEIMQVDNAAVKSLAPYMKKFMTLVTLALKIGAHLAAGMGQMIPDLSKEVAHLAGSSVLCGAAGATAAGVVGVAAMDRRNRSIEGSRDIQQDLRAAQQWVVDFLRERRCSSGKDIAEKFGLWRIRYRDNGQIAWICRQHMYARSAEIIEVPV

SEQ ID NO: 119950 - protein, 211 aa, Glycine max
  Coding DNA Sequence Number=SeqID_3172
  Gene Ontology: Mol. function=nucleic acid binding; Biological process= DNA integration
MAEDMNIDAITLTSMQTSAMSNATFAKPLRDMSKFKEHVGTLLDMHGVAFALTTKKPNSATPTKELEQWNHANKVENTSIQDEFVSKLYIEKLPESWIDYKQQLKHMHKQMSLSDLITHIIIEDTNNKECTITIDKTLYTKANMVNVVTNVSKWVEDFGITKYICADRNAFTSYIVVGDREEHVYLGDSRTTLVLCKEKVLLKLTSRKAIL

SEQ ID NO: 119951 - protein, 226 aa, Glycine max
  Coding DNA Sequence Number=SeqID_3173
  Gene Ontology: Mol. function=DNA binding; Biological process=DNA integration
  Homolog annotation: Hit_ID=Q1SKC8; Match level="QueryCoverage=62%, HitCoverage=33%, E-value=2e-44, Identity=59%"; Hit description =Integrase, catalytic region
ACQLPVELEHKAYWALKFLNFDNSACGEKRKLQLLEWEEMRLNAYESSRIYKQKTKAYHDKKLQKKEFQPGQQVLLFNSRLRLFLGKLKSKWSGPFIIKEIRPHEAVELVDPRVENYEKKWVVNRQRLKIYNGGQLEKLTTGPNRCEQQTGGTKSKGPAGEDSNRRGQPRDASLGALSGHMRARCASLTFLGSISALSPRKGPRGEDRRPTDALSATSQAAAVQWE

SEQ ID NO: 119952 - protein, 114 aa, Glycine max
  Coding DNA Sequence Number=SeqID_3174
MKNRYATNNETTSSLESDASQSKMVSKHSNLQVKGKEQADMIEGKFSPPAAVQHIHEIRKMKLELEQERKKLVNIQLKLQETTNNLDLSLMPEEEKLNKSFQEELKLLKLKRDK

SEQ ID NO: 119953 - protein, 309 aa, Glycine max
  Coding DNA Sequence Number=SeqID_3175
  Gene Ontology: Mol. function=cysteine-type peptidase activity; Biological process=proteolysis
  Homolog annotation: Hit_ID=Q70G10; Match level="QueryCoverage=45%, HitCoverage=29%, E-value=2e-18, Identity=37%"; Hit description=SUMO protease
  Subcellular localization annotation: CTP_CleavageSite=46; ConfidenceScore=5.60e-01
MPNPIPLENMPNSRSNPFRLPPMSSQDSLGTWRFMRLWRGRSMCLVGSENSKFTRFSVSISVTVGDAIGNVSAAKLKEAKHSMVAKCKILVEKGKEVIGVDTKTESNGRYENLSAKEACGDEITNAELKVASGEKVWGYEMQCDLENVHVYKKLLEDVGKRSGTLQSLILRLICMRSAWTIIYNLVRPKKELVKCEFWKMGGSKEEEVSQEPFVALTSEEEDEVDRVGSWLSTREKFQCLIPTEWLNEVINLYLTLLKEKEQREPQKFLKCHVFNTFLYKKMIDNHCEEEGHFPPLQALVSVMQEFLII

SEQ ID NO: 119954 - protein, 251 aa, Glycine max
  Coding DNA Sequence Number=SeqID_3176
  Gene Ontology: Mol. function=protein serine/threonine kinase activity; Cellular component=nucleus; Biological process=protein amino acid phosphorylation
  Homolog annotation: Hit_ID=Q9LDC1; Match level="QueryCoverage=69%, HitCoverage=28%, E-value=9e-64, Identity=70%"; Hit description=CRK1 protein
  Pfam annotation: Domain name=Pkinase; Domain location=134-251; Score=- 114.7; E_value=0.099; Accession=PF00069.15; Description=Protein kinase domain
  Pfam annotation: Domain name=Pkinase_Tyr; Domain location=134-251; Score=-149.8; E_value=0.0028; Accession=PF07714.7; Description =Protein tyrosine kinase
  Pfam module annotation: Pfam domain module=Pkinase::Pkinase_Tyr; Domain location=134-251::134-251
MGGVCCKPSAIEDSKESPRERMSTKSASLDSCVPRGASLRREDAYRVKDRYDGNNVRTALIDKQGNGSVRLQSENVERKRERMECVVAAQQHPGAGSVPKALEGEQVAAGWPSWLAAVAGEAIKGWLPRRADSFEKLDKIGQGTYSNVYRARDLEQKKIVALKKVRFDNLEPESVRFMAREIHILRRLDHPNVIKLEGLVTSRMSCSLYLVFEYMEHDLAGLASHPKLKFTEAQLIAYSKKNLMATYICVM

SEQ ID NO: 119955 - protein, 492 aa, Glycine max
  Coding DNA Sequence Number=SeqID_3177
  Gene Ontology: Mol. function=protein serine/threonine kinase activity; Cellular component=nucleus; Biological process=protein amino acid phosphorylation
  Homolog annotation: Hit_ID=Q6ZCC7; Match level="QueryCoverage=95%, HitCoverage=58%, E-value=1e-117, Identity=50%"; Hit description =Putative CRK1 protein
  Pfam annotation: Domain name=Pkinase; Domain location=1-180; Score =47.3; E_value=2.2e-11; Accession=PF00069.15; Description=Protein kinase domain
MQQLLRGLEHCHNCGVLHRDIKGSNLLIDNNGILKIADFGLASVFDPNRTQPLTSRVVTLWYRPPELLLGATYYGTAVDLWSTGCILAELYAGKPIMPGRTEVEQLHKIFKLCGSPSEDYWRKSKLPHATIFKPQQPYRRCVADTFKDFAAPALALMETLLSIDPADRGTAASALKSEFFTTKPLPCDPSSLPKYPPSKELDAKLRDEQARRQGATGSKGQRHDLERRGARESRAVPAPDANAELPLSMQKRQSQAQSKSRSEKFNPHLEEASGFPIDPPRPSQAVEVGIEPQVPQHKRASHSGPLAHRTAWGKAGKNQDDAPKISVGGDLSTISGLVAARSMLSDDRRERSGSSQMEASKLMNRFPGSFKDISELLIKQDQRHHVPGQVGTSQKEEGRSSNKDLVLVDLMAFTTGISLSFYKEDLKVGYGSKGHKIHYSGPLTSSNMDQVLKDHDRQIQEAVRRARLDKAKMRRLQAEGNQITNSLFVSGR

SEQ ID NO: 119956 - protein, 166 aa, Glycine max
  Coding DNA Sequence Number=SeqID_3178
  Gene Ontology: Mol. function=protein transporter activity; Cellular component=cytoplasm; Biological process=intracellular protein transport
  Homolog annotation: Hit_ID=Q2QP84; Match level="QueryCoverage=73%, HitCoverage=13%, E-value=9e-33, Identity=53%"; Hit description =Vesicle tethering family protein, putative, expressed
MADCLELLNNFLSSNAFNQKKVLDHLLILGVESQWVPVPICCAAMQCIGDLIVGDSKNRDLLASKVLREEPHVEPTLNSILRILLRTSSMQEFIVADYIFKSFCKKNDDGQSILASTLIPQPYSMNHVFLKEDVNMPFGRIKFKEKNDHYILQDRMTKKIKRIMYR

SEQ ID NO: 119957 - protein, 118 aa, Glycine max
  Coding DNA Sequence Number=SeqID_3179
PRSLDHGVPHCRRHHPLVLQALNVSRAPPCNRDWHLDTPVWLQMKILKPYINDMFLDMLQIAESGGLNHEGWFHGCSKVCKDDKWVLPKLGGLQFDVPTAISKNGLSLSSSSSYRKQY

SEQ ID NO: 119958 - protein, 287 aa, Glycine max
  Coding DNA Sequence Number=SeqID_3180
  Gene Ontology: Mol. function=structural constituent of ribosome; Cellular component=ribonucleoprotein complex; Biological process =translation
  Homolog annotation: Hit_ID=Q6UNT2; Match level="QueryCoverage=85%, HitCoverage=87%, E-value=1e-106, Identity=75%"; Hit description=60S ribosomal protein L5
  Pfam annotation: Domain name=Ribosomal_L18p; Domain location=67-210; Score=232.4; E_value=9.7e-67; Accession=PF00861.12; Description =Ribosomal L18pL5e family
MAQNNSLQPTHPNLIKHCLIALTLSLNPKETQALLPFSPSAMVYVKSQKSKAYFKRYQVKFKRRREGKTDYRARIRLINQDKNKYNTPKYRFVSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEILAEDEPEKYQSHFSEYIKRGIEADGIEALYKKVHAAIRADPSLKKSEKQPPKEHKR

SEQ ID NO: 119959 - protein, 320 aa, Glycine max
  Coding DNA Sequence Number=SeqID_3181
  Gene Ontology: Mol. function=phosphogluconate dehydrogenase (decarboxylating) activity; Cellular component=mitochondrion; Biological process=valine metabolic process
  Homolog annotation: Hit_ID=Q84VC8; Match level="QueryCoverage=97%, HitCoverage=97%, E-value=1e-120, Identity=73%"; Hit description =Gamma hydroxybutyrate dehydrogenase-like protein
  Pfam annotation: Domain name=NAD_binding_2; Domain location=1-191; Score=149.4; E_value=9.2e-42; Accession=PF03446.5; Description=NAD binding domain of 6-phosphogluconate dehydrogenase
MEVGFLGLGIMGKAMAINLLRHGFKVTVWNRTLSKCDELVQHGASVGETPATVVKKCKYTIAMLSDPSAALSVVFDNDGVLEHINGKGYIDMSTVNADTSSKISEAIKAKGGYFLEGPVSGSKKPAEDGQLIILAAGHKMYPVLPPPPHEERLFLGFEPVTSRSQGSAKALYDEVLPAFDILGKKSFFLGEVGNGAKMKLVVNMIMGSMMNAFSEGITLAERSGLNPGTLLDVLDLGAISNGMFKLKGPTMLQNSYSPAFPLKHQQKDMRLALALGDENAVSMPVAAAANEAFKKARSMGLGDLDFSAVHETLKAPDHSS

SEQ ID NO: 119960 - protein, 292 aa, Glycine max
  Coding DNA Sequence Number=SeqID_3182
  Gene Ontology: Mol. function=RNA-directed DNA polymerase activity; Biological process=RNA-dependent DNA replication
MVTSFLKNLFKEEGEHEQLCLKGKFPSLDFTEVEMLGRGITDEEIRRGIFGMRSFKAPREDGFHALFYQSQCDGQSQDNIIITQEVIHSMRRKKGKKGWMAINIGLQQAYDRLNWNFIIDTLKEIGLPTSFIDVVYHCISSFLSACFRKGRLSRQVEVSGKGEEISDTIGFQRTDDLGKYLGVKLHHERVFRNSYDHILERAQQRLSAWKAKNLSFAGRLMLAKSSLSALPLYTMQSDFIPRYVVRSKYGCGEGVMPIVEKKIAGSNLWNGVKHMWDCFLLNCEMIGLSDMR

SEQ ID NO: 119961 - protein, 291 aa, Glycine max
  Coding DNA Sequence Number=SeqID_3183
  Gene Ontology: Mol. function=sequence-specific DNA binding; Cellular component=intracellular; Biological process=base-excision repair
  Homolog annotation: Hit_ID=Q9SU12; Match level="QueryCoverage=68%, HitCoverage=31%, E-value=4e-43, Identity=45%"; Hit description =Adenine DNA glycosylase like protein
MIGGISMSVSLPAKWGCKTDGVNPSEFCHALSNAKHDSTVAVTDYPVKGVKVKQRCDFSAVCVVELVGAETLDKNQSSSKFILVKRPEEGLLAGLWEFPSVLLDGEAVPLARREAMDPFLKKNLKIDIRKTCNIVLREDIGEFVHIFSHIRLKLYVELLVLQLKGGVDDLFKSLDNKATTWKCIYSNALSSMGLTTSVRKIASKFKTASRNRITCSAVQESSPSTAATTAETKEEVKEAPKAAAPAKKPPAKAPAKPLPQMMEEDVIPSLKAIFEAQEDFSNIELVFKDNK

SEQ ID NO: 119962 - protein, 130 aa, Glycine max
  Coding DNA Sequence Number=SeqID_3184
  Gene Ontology: Mol. function=transferase activity, transferring glycosyl groups; Biological process=metabolic process
  Homolog annotation: Hit_ID=Q9FUJ6; Match level="QueryCoverage=90%, HitCoverage=24%, E-value=4e-14, Identity=41%"; Hit description=UDP -glucosyltransferase HRA25
MKSEIDHLGAQIKLVTLPHGLDPEDDRSDQPKVILSLKSTMPTKLHELILDINNNNALDADNNNKITCLVVSKNIGWALEVAHKLGIKGALLWPASATSLASFESIRLIDEGIIDSQTGVWLGWAPLVLN

SEQ ID NO: 119963 - protein, 85 aa, Glycine max
  Coding DNA Sequence Number=SeqID_3185
  Gene Ontology: Mol. function=nucleic acid binding; Cellular component= ribonucleoprotein complex; Biological process=nuclear mRNA splicing, via spliceosome
  Homolog annotation: Hit_ID=Q41498; Match level="QueryCoverage=86%, HitCoverage=32%, E-value=8e-21, Identity=64%"; Hit description =U1snRNP-specific protein, U1A
  Pfam annotation: Domain name=RRM_1; Domain location=16-80; Score=3.6; E_value=0.067; Accession=PF00076.12; Description=RNA recognition motif. (a.k.a. RRM, R
MSEVNATPEIPQNKAIYINNLNEKIKIDGMLLFREILEVLAFKTLKHKGQAWVFFEDASSASNVVRQMQGFPFYDKLMVFGYTFN

SEQ ID NO: 119964 - protein, 108 aa, Glycine max
  Coding DNA Sequence Number=SeqID_3186
  Homolog annotation: Hit_ID=Q1RV95; Match level="QueryCoverage=42%, HitCoverage=10%, E-value=2e-08, Identity=56%"; Hit description=E -class P450, group I
MVWLWRVTWRRRLFGDIRRATSCFLTPPPRSQDGWVYIFLRTHVWSFYTTWLSGTIGLRMMLFGVGIEPMTSMRRKPPSEVVVEGLKGFNRVETERAEGEKEERPSLD

SEQ ID NO: 119965 - protein, 336 aa, Glycine max
  Coding DNA Sequence Number=SeqID_3187
  Gene Ontology: Mol. function=catalytic activity; Cellular component =endoplasmic reticulum; Biological process=protein transport
  Homolog annotation: Hit_ID=Q9LTZ8; Match level="QueryCoverage=72%, HitCoverage=23%, E-value=2e-87, Identity=66%"; Hit description =Similarity to negative regulator of vesicle formation
  Pfam annotation: Domain name=PGAP1; Domain location=16-284; Score =280.6; E_value=3e-81; Accession=PF07819.3; Description=PGAP1-like protein
MVVASNRQGPLSSCSDLVKVGLLLCLLFSKFEVRSLAAESDRAYQNGPLERTFYQEASLRPEEEDVDINLSSFQLPSQYTSRLDWFAFNLEGEHSAMDGAILEEHTEYVVYAIHKIWDQYKVSYDAGTRESVAVSGSLPKSVILVGHSMGGFVAKAAIIHPRLRKSAVETVLTLSTPHQYASLGHYFARANSEWIKGYKVQTTNTGHYVSDPVLSHVVVVSISSAYNDYQVRSKLTSPDNIVPPTHGFMISSTAMKNVWLSMEHQAILWCNQLVVQVGFYIGYQSTDVEWEEYGLMIIPENLGQAFIATIDCGLKYKGKVAEIAVKNRNLLCEKLQ

SEQ ID NO: 119966 - protein, 184 aa, Glycine max
  Coding DNA Sequence Number=SeqID_3188
  Gene Ontology: Mol. function=nucleotidyltransferase activity; Biological process=metabolic process
  Homolog annotation: Hit_ID=Q09WE7; Match level="QueryCoverage=70%, HitCoverage=21%, E-value=9e-54, Identity=90%"; Hit description=UDP -sugar pyrophosphorylase
  Subcellular localization annotation: CTP_CleavageSite=24; ConfidenceScore=5.38e-01
MLFRTHIVFPSPFSLHAVAVTSASSSLKGEGRKARKESGSPEGSSYLLQRRDSISMASSLDDNFNLLSPEQQELVKVLLDNGQEHLFRDWPAPGVDDNHKKAFFDQLTQLDSSYPGGLESYIKNAKRLLADSKAGINPFDGFTPSVPTGETLAFGDESYIKFEEAGVLEARLLLFLLPVVLASV

SEQ ID NO: 119967 - protein, 49 aa, Glycine max
  Coding DNA Sequence Number=SeqID_3189
  Homolog annotation: Hit_ID=Q56XI7; Match level="QueryCoverage=92%, HitCoverage=8%, E-value=1e-12, Identity=73%"; Hit description=DNA mismatch repair protein
MALARQNNYVRPSLTKENLLDIKNGRHVLQEMTIDTFIPNDTKILHDGI

SEQ ID NO: 119968 - protein, 192 aa, Glycine max
  Coding DNA Sequence Number=SeqID_3190
  Gene Ontology: Mol. function=dopamine beta-monooxygenase activity; Cellular component=integral to membrane; Biological process =histidine catabolic process
  Homolog annotation: Hit_ID=Q8S0J6; Match level="QueryCoverage=80%, HitCoverage=41%, E-value=2e-19, Identity=33%"; Hit description =Membrane protein-like
  Pfam annotation: Domain name=DOMON; Domain location=53-153; Score =1.7; E_value=0.036; Accession=PF03351.8; Description=DOMON domain
MKPSPRLLLILTFLGSFFLASPEAYSCTSNLSLNVSIPFDTTNLHCLSVWDAQSFILRYVQTSASTWSFILSTPDTNSYIAIGFSAGGGMVGSSAMVGWVASRGASGGIKQYYLGGVTPNQVVPDKGNLQLETTEPLSSLIFATGSTGLFPAPPSFALTKHLDKVSTRIDYSKETVLRTLVNIGLFLKGQSI

SEQ ID NO: 119969 - protein, 162 aa, Glycine max
  Coding DNA Sequence Number=SeqID_3191
  Gene Ontology: Mol. function=endoribonuclease activity; Cellular component=lysosome
  Homolog annotation: Hit_ID=Q8LJP5; Match level="QueryCoverage=92%, HitCoverage=63%, E-value=3e-53, Identity=54%"; Hit description=S -like RNase
  Pfam annotation: Domain name=Ribonuclease_T2; Domain location=1-125; Score=18.6; E_value=1.4e-09; Accession=PF00445.9; Description =Ribonuclease T2 family
MVDGLWPDYNDGSWPSCCSGSSFDPKEISTLTNALEQYWPSLSCSKPSLCHGGKGTFWAHESVLNDAGYVPSNTEKYPLGGIISAIENAFHASPQIVCSKDSIEELYLCFYKNFQPRDCALGSDIKIDMVTSKKSCPKYVSLPESVSVVALNHQTSLLKVTY

SEQ ID NO: 119970 - protein, 381 aa, Glycine max
  Coding DNA Sequence Number=SeqID_3192
  Gene Ontology: Mol. function=dopamine beta-monooxygenase activity; Cellular component=integral to membrane; Biological process =histidine catabolic process
  Homolog annotation: Hit_ID=Q8LHG0; Match level="QueryCoverage=84%, HitCoverage=85%, E-value=7e-68, Identity=41%"; Hit description =Membrane protein-like
  Pfam annotation: Domain name=Cytochrom_B561; Domain location=184-377; Score=-67.1; E_value=0.0086; Accession=PF03188.6; Description =Cytochrome b561
  Pfam annotation: Domain name=DOMON; Domain location=69-189; Score =23.3; E_value=0.00042; Accession=PF03351.8; Description=DOMON domain
  Pfam module annotation: Pfam domain module=Cytochrom_B561::DOMON; Domain location=184-377::69-189
  Subcellular localization annotation: CTP_CleavageSite=61; ConfidenceScore=5.51e-01
MKASLAFLIFTICFHASANIGSSQGDGNSSQVNGSTSQSADSCGSNLNLSVPLLFDTTNLNCLPVWNAQGYILRYSQTSQNIWSFILSAPNPNSYIAIGFSPNGGMVGSSAIVGWISSNGAGGGMKQYYLTGLTPNQVVPDRGNLKVLTNSTFITSQSSRLYMAFQLETNQPLSKLIYAFGPNGVFPSAPSFALALHQDKVSITLNYATGSSATTGKSYNLKRSHGLLNILGWGILIIMGAIVARYFKEWDPFWFYFHASVQSLGFVLGIVGVISGFVLNNQLHTDVSLHKALGIIIFVLGCLQIMALLGRPKKESKVRKYWNAYHHNMGRILIILAIANIFYGIKLGKEGSGWNIGYGIVLAVLFTMAITFETQLCSRDD

SEQ ID NO: 119971 - protein, 81 aa, Glycine max
  Coding DNA Sequence Number=SeqID_3193
MGKVAKKKREEINKKKKKRKNEKERCQWKVLKAKGAKVGNSQAPLQAIKVLSDPTKTLVSREKHQLCKEVRQAGPVGIPDN

SEQ ID NO: 119972 - protein, 189 aa, Glycine max
  Coding DNA Sequence Number=SeqID_3194
QGQGVMPGFDGCLSFLETKAIKRGENDNFMEFSDLNSPRPASGSPGPWERRRVSGVGKLRKERKNAEKEKEEKEKKQSQGAAESNRESFPTSFLLLALYPVQQSICRSKGRWRHLNEYSIFFQCPVVNQVATDGDSAGEIVRELRHLINVAPFTHDTYTFCIDFETLGPIPGSVRAIGNGGRSVVMLGL

SEQ ID NO: 119973 - protein, 119 aa, Glycine max
  Coding DNA Sequence Number=SeqID_3195
MHPIFVLLAGFFPKLPGTLWIPWRWVLNVLKWSNEGSMPTNNYPRTKLGYDKRAFLIDHQSQKREKTSFVLEKQTVVNQEAGLLISKFSKHKGRISLGGSEVVKEFTSIVEILSGLLED

SEQ ID NO: 119974 - protein, 100 aa, Glycine max
  Coding DNA Sequence Number=SeqID_3196
MKLGSDTLWRMLQRCCNLPFNGRVMRGSRVRLPREENAQSHHQRLFEENVRKTETCGLRTLSVKGSGVVFTHGEGVVDKNGAFAPTYPQLVVRNSDLRGS

SEQ ID NO: 119975 - protein, 105 aa, Glycine max
  Coding DNA Sequence Number=SeqID_3197
  Homolog annotation: Hit_ID=Q1S4N4; Match level="QueryCoverage=84%, HitCoverage=26%, E-value=2e-08, Identity=31%"; Hit description =Ribonuclease H
MIQPKLLGLIWINLNSQILKPDYRVRIDKGEVSLFYDSFLDEGPLYSKVDFAHYADMNLITKDILGNDQWHWNLIATPLSADIKNQLLHIILNESVDDVFPAFAV

SEQ ID NO: 119976 - protein, 545 aa, Glycine max
  Coding DNA Sequence Number=SeqID_3198
  Gene Ontology: Cellular component=microtubule; Biological process =microtubule cytoskeleton organization and biogenesis
  Homolog annotation: Hit_ID=Q1SS78; Match level="QueryCoverage=98%, HitCoverage=99%, E-value=2e-84, Identity=35%"; Hit description=ABI3 -interacting protein 2
  Pfam annotation: Domain name=Frigida; Domain location=106-393; Score =187.4; E_value=3.5e-53; Accession=PF07899.2; Description=Frigida -like protein
MATLKTISAALNLVDSKKENLKKAFDDLQSLFSPLPLSWSDLDSHFTTVHHSLTHRFHLLQSQSETLTLTPNSDPPPQTPQNANFSSNPTDPSSNHDESSPGVSPQNDAVKGSVTPRNELVAFCEKMDGVGLMNYVNDNFQDRARIQAELPGAFRHAPDAGAMVLGALERFHGEGSGNELKEWELRRIRKTCIVMLKQFRVAALSVSAEASVRARKLALAWKERLVGDDDNMFGALGLLHLVCAFGFVSEFSLDELVGFSVAAPTNEEDFPELCRAVGLTERVPDIVQKLIDKDKHILAVKYILEFNLADRISPVPILKACVDEAKKLGKRLFQEGKSLNESMSREINTLRSVIKTIESYKLESEYPLASLEQHIEQLKRQKTNNKRAAPAPAAKPPQHQQQQQQQKRNMQNQQQQTGIKRPRASAPVGPAAVLKNVNSTIHHYQQSLAHQSGLFPEHPNPYMSSPAMPFGMVAPTPNVPPYAGPSAGPYGHDGVPMGPSGNPNLGGSHLSLSEPHVQTGGYYDRASTYGGIGLQHYYQASYYPQ

SEQ ID NO: 119977 - protein, 112 aa, Glycine max
  Coding DNA Sequence Number=SeqID_3199
  Homolog annotation: Hit_ID=Q1S0A6; Match level="QueryCoverage=49%, HitCoverage=5%, E-value=3e-09, Identity=69%"; Hit description=Zinc finger, CCHC-type; Peptidase aspartic, catalytic; Polynucleotidyl transferase, Ribonuclease H fold
MYMYIKLGDEDCEFQPCLVEKESKDCISNKLAVHFDMLGVFIGKDKILNNVQCCLTVTIKLHGLRCSLLAHFPIQELQETHDVPKKSDHNSNDVKEDRHPNVLRCLSEGGCT

SEQ ID NO: 119978 - protein, 250 aa, Glycine max
  Coding DNA Sequence Number=SeqID_3200
  Gene Ontology: Mol. function=nucleic acid binding; Biological process= RNA-dependent DNA replication
  Homolog annotation: Hit_ID=Q1T6D0; Match level="QueryCoverage=63%, HitCoverage=39%, E-value=7e-32, Identity=36%"; Hit description=Zinc finger, CCHC-type; Lipocalin
MEATQGFSFSSDYLNGLGSGKDPSDDGGGGGPPNQKSFRDLVVSQRQLLSPHPNVDLIQQKLARIKYEGGNPMKPMVFIDDSIYEGLCAPWEDTLLIKLLGKTVGYHFLKEKLVRLWKLSSYFDIFDIGNGYYMLKFSDEDDKKKVMEERDMDDLQSLLNVVGRPTKVDSNVKDDRRGRLARVCIEVDLTKQVVGKGVSYLSSHLDMYKNSSKGVESSSTAINVESAFTITNKKDTIIEEFDFSVVSIVP

SEQ ID NO: 119979 - protein, 138 aa, Glycine max
  Coding DNA Sequence Number=SeqID_3201
MPSNEEAFHQGMYVKISHASTSSDIAHILQSGDVPPDIQNNLWNHLTSMSNSIDGPWILLGDFNKILHPFEVTGGNFSVSRSLLLAQVANDCGISDLDTQSGHSLLGGRTFKMKVISAKSWTRVWLILTGVFFFLMSL

SEQ ID NO: 119980 - protein, 80 aa, Glycine max
  Coding DNA Sequence Number=SeqID_3202
  Gene Ontology: Mol. function=sequence-specific DNA binding; Cellular component=nucleus; Biological process=regulation of transcription
  Homolog annotation: Hit_ID=Q1SS80; Match level="QueryCoverage=81%, HitCoverage=11%, E-value=9e-15, Identity=65%"; Hit description=DNA -binding WRKY
  Subcellular localization annotation: CTP_CleavageSite=62; ConfidenceScore=5.13e-01
MDAGEALSDDPNRPNSAADAAPATAGARYKLMSPAKLPISRSPCVTIPPGLSPTSFLESPVLLSNMKGFLFFGARFNVRD

SEQ ID NO: 119981 - protein, 354 aa, Glycine max
  Coding DNA Sequence Number=SeqID_3203
  Gene Ontology: Mol. function=sequence-specific DNA binding; Cellular component=nucleus; Biological process=regulation of transcription
  Homolog annotation: Hit_ID=Q7XJB6; Match level="QueryCoverage=89%, HitCoverage=81%, E-value=1e-120, Identity=61%"; Hit description =Putative WRKY-type DNA binding protein
  Pfam annotation: Domain name=WRKY; Domain location=145-203; Score =144.9; E_value=2.1e-40; Accession=PF03106.6; Description=WRKY DNA -binding domain
  Pfam annotation: Domain name=WRKY; Domain location=320-353; Score =9.8; E_value=4.5e-05; Accession=PF03106.6; Description=WRKY DNA -binding domain
  Pfam module annotation: Pfam domain module=WRKY::WRKY; Domain location=145-203::320-353
  Subcellular localization annotation: CTP_CleavageSite=28; ConfidenceScore=5.39e-01
MHQDALVEPSPTTGSLSLLHQTAHGSVTSAASSTFPVTTLVKLMNINLQVPADFDNHASEKSTQIDGQGKAQAFDSSPLVKNESASPSNELSLSSPVQMDCSGGSARVEGDLDELNPRSNITTGLQASQVDNRGSGLSVAADRVSDDGYNWRKYGQKHVKGSEFPRSYYKCTHPNCEVKKLFERSHDGQITEIIYKGTHDHPKPQPNRRYSAGTIMSVQEERSDKVSLTSRDGNGSYMCGQGSHLAEPDSQPELSPVATNDGDLDGLGVLSNRNNDEVDDDDPFSKRRKMDLGIADITPVVKPIREPRVVVQTLSEVDILDDGYRWRKYGQKVVRGNPNPRYVLSLTTIQHKEN

SEQ ID NO: 119982 - protein, 73 aa, Glycine max
  Coding DNA Sequence Number=SeqID_3204
MEIKQSFFSVRRAKAFFFFSANSTSNLRVEDERGEDESMPEKVGEKADGGVFRKTRSGRTSSGKFPEEVFFRK

SEQ ID NO: 119983 - protein, 138 aa, Glycine max
  Coding DNA Sequence Number=SeqID_3205
MGTRTEADISNNKCKSRSSREVGAVKSTSSTSMEEQQATGNWMTPLPVKEDKSGSGSFDTGYEGLDDATSGEGSQGRRHKDYLDKSDNWFNKEPREKLSPNFIKCQKPSSFSTWAFILLHSGALSFSTWAFALLHLGL

SEQ ID NO: 119984 - protein, 63 aa, Glycine max
  Coding DNA Sequence Number=SeqID_3206
MALHESGVCIKEWQFVNKDIGVTAKKPGKIFEQQLIPTSLGCKRKENNNPQMQNLLTLQYQKL

SEQ ID NO: 119985 - protein, 59 aa, Glycine max
  Coding DNA Sequence Number=SeqID_3207
MDKNVYEPTGGAYGTGRGESKREVDEGFHAQEQGEGEEDQLEAEDAALSALMVGALGGR

SEQ ID NO: 119986 - protein, 45 aa, Glycine max
  Coding DNA Sequence Number=SeqID_3208
MDRIETSSKRTYRGKVKKSELVQKEVSNALDVLNDEVVTIPTNLR

SEQ ID NO: 119987 - protein, 50 aa, Glycine max
  Coding DNA Sequence Number=SeqID_3209
MHSISFLLCQYLLAKVCDIYPRIELANGQTKYAKYSDSKSIQMPKVRRIL

SEQ ID NO: 119988 - protein, 97 aa, Glycine max
  Coding DNA Sequence Number=SeqID_3210
MGNRLLELGGNNHSYDVDQLRNMRVPIEDRITEDNNMVSTGDALSIPRNQPVDRHIIQETPMQERANNNNNNNLENEVNVPTRLVDDREQPNPILVT

SEQ ID NO: 119989 - protein, 756 aa, Glycine max
  Coding DNA Sequence Number=SeqID_3211
  Gene Ontology: Mol. function=1-phosphatidylinositol-4-phosphate 5 -kinase activity; Cellular component=membrane; Biological process =phosphatidylinositol metabolic process
  Homolog annotation: Hit_ID=Q9SFB8; Match level="QueryCoverage=95%, HitCoverage=99%, E-value=0.0, Identity=64%"; Hit description =Phosphatidylinositol-4-phosphate 5-kinase 6 (EC 2.7.1.68) (AtPIP5K6) ...
  Homolog annotation: Hit description=(1-phosphatidylinositol-4 -phosphate kinase 6) (PtdIns(4)P-5-kinase 6)
  Pfam annotation: Domain name=MORN; Domain location=105-127; Score =32.4; E_value=1.6e-06; Accession=PF02493.10; Description=MORN repeat
  Pfam annotation: Domain name=MORN; Domain location=128-150; Score =33.6; E_value=6.7e-07; Accession=PF02493.10; Description=MORN repeat
  Pfam annotation: Domain name=MORN; Domain location=151-173; Score =35.0; E_value=2.6e-07; Accession=PF02493.10; Description=MORN repeat
  Pfam annotation: Domain name=MORN; Domain location=174-196; Score =31.5; E_value=3e-06; Accession=PF02493.10; Description=MORN repeat
  Pfam annotation: Domain name=MORN; Domain location=197-219; Score =26.9; E_value=7.1e-05; Accession=PF02493.10; Description=MORN repeat
  Pfam annotation: Domain name=MORN; Domain location=220-241; Score =3.5; E_value=2.8; Accession=PF02493.10; Description=MORN repeat
  Pfam annotation: Domain name=MORN; Domain location=59-81; Score=29.2; E_value=1.4e-05; Accession=PF02493.10; Description=MORN repeat
  Pfam annotation: Domain name=MORN; Domain location=82-104; Score =23.1; E_value=0.00098; Accession=PF02493.10; Description=MORN repeat
  Pfam annotation: Domain name=PIP5K; Domain location=447-752; Score =448.3; E_value=1e-131; Accession=PF01504.9; Description =Phosphatidylinositol-4-phosphate 5-Kinase
  Pfam module annotation: Pfam domain module=MORN::MORN::MORN::MORN::MOR N::MORN::MORN::MORN::PIP5K; Domain location=105-127::128-150::151 -173::174-196::197-219::220-241::59-81::82-104::447-752
MSREINGIVKGWEATVRKSSGAKKRANNIFTPMFVAHVDDDKSTEVCQVEKILPNGDFYIGQWLERYPHGQGKYLWTDGCMYVGEWSKGTNMGNGRFSWPSGATYEGEFKSGNMDGRGTYIGSNGDTYKGSWVMNLKHGQGIESYPNGDFYDGEWRKGLQNGHGRYQWKNGNQYIGQWRSGVFCGNGTMMWSTGNRYDGCWAEGLPKGNGTFRWGDGSFYVGVWSQDPKEQSGTYYSSRSSDDHMDRDPHDVFKVELNDFQICPCEKVAIYPSQKTLSVCGKEDDNKPVHKKRTDESGRPWWTSEDGRVSNYNSKNRSYAFDVGRKSRFSSLGDHSILSRNSLDCLRIKNPKRQGETISKGHKNYELMLNLQLGIRHSVGRPAPSASLDLKSSAFDPKVKVWTRFPPEGSKHTPPHPSCEFRWKDYCPVVFRALRKLFKVDPADYMISICGNDALRELSSPGKSGSFFYLTNDECYMIKTMKKAEVKVFLRMLPTYYKHVWAFENTLVTKFFGLYCVRQTGATQKKVRFVIMGNLFCSKYVIHRRFDLKGSTFGRTTNKPESEIEPTTTLKDLDLNFIFRLQKSWFQEFCRQVERDCDFLEQERIMDYSMLVGLHFKETTSVGTIAPSCHSSTSCTTPTGVDDGLPHLSGVDANHFIIDPSRRIQLGVNMPAKAEMTTRKSTSDTPRLVGEPTGKFYEIIIFFGIIDILQDYDISKKLEHAYKSFQYDSTSISAVDPRLYSKRFRDFIFGVFVEDT

SEQ ID NO: 119990 - protein, 303 aa, Glycine max
  Coding DNA Sequence Number=SeqID_3212
  Gene Ontology: Mol. function=nucleic acid binding; Biological process= DNA integration
  Homolog annotation: Hit_ID=Q1T4S3; Match level="QueryCoverage=63%, HitCoverage=14%, E-value=9e-19, Identity=31%"; Hit description=Zinc finger, CCHC-type
  Pfam annotation: Domain name=zf-CCHC; Domain location=70-87; Score =27.1; E_value=3.4e-05; Accession=PF00098.13; Description=Zinc knuckle
MWPFPVLCHPLHNLIPTLFFASATANYVQQNSYSSHTDWNQNQNAGRGGCINGRSGGRGGHGGRGGHSSLQCYICQKFGHVAADCWHKPSTTVSPYSMMFPCPTPNGSYAANATTCYATGIHAAPSHAATCYATTSHAASGSHTDGYGLPSPNDKLHSQIESCSQAMTIGSTFDQSNIWYSDLCASHHVNANVENIKQCSSFEGLDQVIVVNGQGLLIKSIGSSSFISPYNHSADLVLNRILHVSNEVLLKGHLGSNGLYTFPKLLSNSTSSSSIAKSTSKTDLLPSIVKSHFPVNSASINTV

SEQ ID NO: 119991 - protein, 128 aa, Glycine max
  Coding DNA Sequence Number=SeqID_3213
  Subcellular localization annotation: CTP_CleavageSite=40; ConfidenceScore=5.55e-01
MNTVLSFLTLSKTSVSFCPLFFNFAVPSSKSTHIELPRKRGSQNTGLRCKCSIWPGGPGSGDSDSSNRSVLDAFFLGKAVAEALNERIESTVGEILSTVGRLQAEQQKQVQDFQVWSSLNWHYLVLDK

SEQ ID NO: 119992 - protein, 40 aa, Glycine max
  Coding DNA Sequence Number=SeqID_3214
MGDEAMWHSLVREDKRRSISSCLFIFPRSGFSVFELPKPL

SEQ ID NO: 119993 - protein, 68 aa, Glycine max
  Coding DNA Sequence Number=SeqID_3215
MRERRAKRNSNPRENCTECELSRLAQEELCSVRIVAISENFNLRGIALSTKNSRLAPKMDSCLARRVG

SEQ ID NO: 119994 - protein, 358 aa, Glycine max
  Coding DNA Sequence Number=SeqID_3216
  Gene Ontology: Mol. function=chitin binding; Cellular component =extracellular region; Biological process=chitin metabolic process
  Homolog annotation: Hit_ID=UPI000044A8F0; Match level="QueryCoverage =52%, HitCoverage=99%, E-value=2e-29, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=15; ConfidenceScore=5.07e-01
DYTSSPSEDYTSSPSKGHVPSPFVGLHVLTFVGLHALTFRGPHVLTFRGLHALAIRGLHVLTFVGLHALTFRGLHVLAFRGLHVLAFRGLHVLAFKVSWLHALTFRGPHVLTFRGLHALAIRGLHVLTFVGLHALAFRGLHALTFRGLHVLANRGLHALTLRGLHVLASRGLHDLTLRGLHVLANRGLHALTSRGLHILALRGLHALTFRGLRVLIFRTSSFLLTVPGPPPDIGGGPTVRAQPEREAITRLLCIPGQDFTRAAAKRRQHSAQRPQYRSPPAEVSVGLCRPDIGIAPTKTPSGPEEVQQGPGVSSSGYGPLDPARKTPSGPEEGQQGLGVASSKYGSLSVIGSVCRPQQ

SEQ ID NO: 119995 - protein, 140 aa, Glycine max
  Coding DNA Sequence Number=SeqID_3217
  Gene Ontology: Cellular component=photosystem I reaction center; Biological process=photosynthesis
  Homolog annotation: Hit_ID=Q06H28; Match level="QueryCoverage=95%, HitCoverage=90%, E-value=2e-31, Identity=55%"; Hit description =Photosystem I psaH protein
  Pfam annotation: Domain name=PSI_PsaH; Domain location=6-126; Score =105.7; E_value=1.4e-28; Accession=PF03244.4; Description=Photosystem I reaction centre subunit VI
  Subcellular localization annotation: CTP_CleavageSite=48; ConfidenceScore=5.47e-01
MASLASLDIVQPSTIKGLAGSSLTGTKLSFKPSHQSFRPKNFRNGVVVANYGDKSVYFDLEDLGNTIGQWDLYVFDAPSPYNPLRALEAIILDSFSFFLLAFTKFLYCMAYANLDINGQGSGYATWFGDLIDIRQFAVGG

SEQ ID NO: 119996 - protein, 100 aa, Glycine max
  Coding DNA Sequence Number=SeqID_3218
MAVASFQRTFKEYKNQSVTIDFPCDFLGISMLEQPNKYYFIICGHKIVLEVDSSILLIMEKLQSYNSKVALHFKCVYDVIAVFAEASLQWSRNSGLEDFR

SEQ ID NO: 119997 - protein, 85 aa, Glycine max
  Coding DNA Sequence Number=SeqID_3219
  Subcellular localization annotation: CTP_CleavageSite=48; ConfidenceScore=5.45e-01
MDTTTKTTPKKYPKKIPERISHKPSFGSSSGSSSIASSMSLLITIKSRASLLAYGVAKTKYCVVKGIRLKVSNAALGIATLEGVA

SEQ ID NO: 119998 - protein, 49 aa, Glycine max
  Coding DNA Sequence Number=SeqID_3220
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q2PMM9; Match level="QueryCoverage=98%, HitCoverage=8%, E-value=1e-19, Identity=75%"; Hit description=NADH -plastoquinone oxidoreductase subunit 5
MGEYNQLSLRISSLDQKQAKGGIPQRESVPTKKEVFVIAGEYPTRASIE

SEQ ID NO: 119999 - protein, 114 aa, Glycine max
  Coding DNA Sequence Number=SeqID_3221
MTAMTTTLHRLMLQRRRVRQRQYNPDSELVMEKGCNGELVARPPRRQTGCAEDLNFRWIHILSEIPPVIFDKTKSMDKNLSIIKVFQQDIYMSVNFVNNVTISDKILSAKKFCQ

SEQ ID NO: 120000 - protein, 88 aa, Glycine max
  Coding DNA Sequence Number=SeqID_3222
  Gene Ontology: Mol. function=ribonuclease H activity
  Homolog annotation: Hit_ID=Q1SDD8; Match level="QueryCoverage=97%, HitCoverage=21%, E-value=1e-08, Identity=41%"; Hit description =Ribonuclease H; Glutathione S-transferase, C-terminal-like
MMCSPLDEGGLDIPLASLINDAASLKLYWNFVFSNEIWEQFLRVRLLPNSCQVLVTIPIFGMIHGVLIDQSLMFLISLPLLEGCFLPQ

SEQ ID NO: 120001 - protein, 90 aa, Glycine max
  Coding DNA Sequence Number=SeqID_3223
MGPTYRDLSLISGPLNLGGSTCKVQTRGQQRGFGRVSLIGDQQRQGKQEIAKRWNWKGSADRGAFFINGIIEYHDFVGTPMFFIYFPHFT

SEQ ID NO: 120002 - protein, 64 aa, Glycine max
  Coding DNA Sequence Number=SeqID_3224
MEWKTLEFVEEAKNSNCSRARLTISNWSKAVNGFFTFTRDIGTCSVFQDGNQTMVARGRDGYFE

SEQ ID NO: 120003 - protein, 196 aa, Glycine max
  Coding DNA Sequence Number=SeqID_3225
MARTKLTGQMTSEAAKEIAEKIDSLEEQASQGSFVPHGRQDVLTVAIGASVTIKLYFGPAPRTSRTSSSMTLEELEQLTQQIRDQLEESITDKLEAGPSAARVSIKENYVDPSGNDPDTGDSDKCGLYINENPPCLVALRKVYEGSITMHNIPLMHDQVIRRHYKKNDLYLQTKTITISKKSIGKCLDLRESLEHT

SEQ ID NO: 120004 - protein, 75 aa, Glycine max
  Coding DNA Sequence Number=SeqID_3226
PASGPAPDHAELAGCGPPATSYERGGVSAEATPTPPEPFIFEDDPVTAEGTQQASPAGTLTLDLNEHAMNSAQDH

SEQ ID NO: 120005 - protein, 135 aa, Glycine max
  Coding DNA Sequence Number=SeqID_3227
  Homolog annotation: Hit_ID=Q2HRE1; Match level="QueryCoverage=48%, HitCoverage=14%, E-value=4e-14, Identity=50%"; Hit description =Lipopolysaccharide-modifying protein
  Pfam annotation: Domain name=DUF821; Domain location=1-129; Score= -217.3; E_value=6.7e-08; Accession=PF05686.3; Description=Arabidopsis thaliana protein of unknown function (DUF821)
MFQFNHDRADIRCTLKVLLGQSVKNTFCHVTLPLYVYDYMFHLLNSYAKLFRYKPSISANATELCVESMVCGAEGSVKKFMMESLVKVPANTDPCTMPAPFDPPTLYATLQRKESSIQQVESWEKSYWDNQTITS

SEQ ID NO: 120006 - protein, 107 aa, Glycine max
  Coding DNA Sequence Number=SeqID_3228
  Subcellular localization annotation: CTP_CleavageSite=50; ConfidenceScore=5.01e-01
MPPTNLAKVDFKAQVCFLFSFFIRGVVIQVLPGPHETLRVLRLEMFLKMNASSSSSPDSPSEKFSMLRALDEHLDIDLEDDSLDNGIFLGFWALSSEYFPFLTHPSC

SEQ ID NO: 120007 - protein, 421 aa, Glycine max
  Coding DNA Sequence Number=SeqID_3229
  Gene Ontology: Mol. function=protein binding; Biological process =defense response
  Homolog annotation: Hit_ID=Q1STU5; Match level="QueryCoverage=50%, HitCoverage=69%, E-value=5e-21, Identity=33%"; Hit description =Leucine-rich repeat
MDIIGNFLGFGPNIIAICKIPDYCQSKWSREQHDLGLGTTTKQQPKFYSLLSWLIFAWDQQNSSKINSKTRDSSTIGREAMRSHIKSAKHGVVVPDRCFGNLNSLVVEGCEFLSKGVVLPSHLLCFLNNLKVLQVRKCNSVQAVLDHTTDLVSIPLRKLILDQLPNLKHVWNGGSQGSLNLPHLEEVLVDGCENIESLFPASMANDELRILEVENCVSLVEIVAKDEVATEEVNTERIIFQSLTLLRLWNLPKLRCIYPGMLILKWPKLQKLDVLHCEVLRFFATEFQNSPDSHLEDRNSFPTDQQESVSLRKRFDESDVFPFVFVSEKLEVLKDGFDKGHDLNSVIKEQSDDASSVMTDSNDFYNFARKRIWWRTRSLLSFPCLMQIFQQQQSRKPECGFSHLCAFIFPSCAKMHEYDRT

SEQ ID NO: 120008 - protein, 105 aa, Glycine max
  Coding DNA Sequence Number=SeqID_3230
MEARATKQAEDDVAKITKVLIDLNISNALQEFEEQAVSTAKSNATKAASALIEDNIQEMLNQAMQIQREKTRQALQVIVEQWSLENEQYRLSMQNAIATQFTNLS

SEQ ID NO: 120009 - protein, 79 aa, Glycine max
  Coding DNA Sequence Number=SeqID_3231
  Gene Ontology: Mol. function=electron carrier activity; Cellular component=anchored to membrane; Biological process=electron transport
  Homolog annotation: Hit_ID=Q1SDF8; Match level="QueryCoverage=70%, HitCoverage=31%, E-value=6e-14, Identity=64%"; Hit description=Blue (Type 1) copper domain
MALVERVVVLFTVMTIVKVSYEVIYKVGDSAGWTTLGTIDYRKWAATKNFQIGDTITAPMVTRNNDDKVMVVWQNAAMS

SEQ ID NO: 120010 - protein, 97 aa, Glycine max
  Coding DNA Sequence Number=SeqID_3232
MKFTEIEGLKRKLTSKLGANSSVVVPDWWLLSSLLDWIVALFLDCAAHHHRWSLSYLLDCCFDFGPCCSSSQLFSECILDYQGINLTNFMSCTWRPT

SEQ ID NO: 120011 - protein, 202 aa, Glycine max
  Coding DNA Sequence Number=SeqID_3233
  Gene Ontology: Mol. function=transition metal ion binding; Cellular component=cytoplasm; Biological process=electron transport
MQSGSQSESFDVEMRDRLEDMICDLGQESFQQAHAPMYGTLQTDSKKPLYPRCKNSLTLLSAMLSLVNVKADMGRVTKASLLQVVHDMLPEKNMLPKSYYQAKKILCPMGIEYQKVHACLNDYILYRHEFQEMPKCPRCGVLHYKVKDDDECSSDENSKKGPSVKVLWYLPIIPRFKRLFANRDDAKGLTWHCINAMTVSDA

SEQ ID NO: 120012 - protein, 100 aa, Glycine max
  Coding DNA Sequence Number=SeqID_3234
MVVHSNLASSEKKSSNGVNELLNFNAENMQSNMKIIYYRFGLLAGVALTISMLTKTKQHKHMLSTNNKLESTLVGFIPFKELTDEVVRCIFEHLQLRDLG

SEQ ID NO: 120013 - protein, 238 aa, Glycine max
  Coding DNA Sequence Number=SeqID_3235
  Gene Ontology: Mol. function=microtubule motor activity; Cellular component=microtubule associated complex; Biological process =microtubule-based movement
  Homolog annotation: Hit_ID=Q9C9S6; Match level="QueryCoverage=71%, HitCoverage=21%, E-value=2e-18, Identity=35%"; Hit description =Kinesin-related protein; 103921-99132
MLLPIMLSFHSQNALYWDSFYFHEKILGWIEFRVSIRVNMPYIPMLVLHMASETLQNNLFKAREEKCQSRIRVLEALAFGTIDESEGEKIKEKVKKVDENEVFRLIKEQEDKNMEISALKVELVTTKRTYEVQFSQMEEEAKSFKASLTWKVQEYEQQLEELRNEAEKINEEVKTTDEEESIKFMKEQEEKKLEISSLKQCSQLEEDAKDAKAELTQKAQEYENQLEALGNNVIVSLP

SEQ ID NO: 120014 - protein, 360 aa, Glycine max
  Coding DNA Sequence Number=SeqID_3236
MNSRFKRRNQEATSQDFTREVLARIFQKPSIAQFCFTKRVFSNFSKLPEYLLSVEGTSTWVVVIENKRGYISCGSVQVEGTSTWLFKENKGGYIPCGSLLVKDFTRLKEISRTDGCLGTGSTHSPSTLKRTRKATRLRSLATRPVGAERPLVHVDPTARKTVCPHRKKLRTYLWIVARDKVDVTYENWKQVLTAHKDWIWEDIQWWRQFKSDLTVKWTFPAKKDSVDDTVCEKYGIIKEKWTQFRQSRRDPSWEEKKKKQLEEAAKSGSTNTVIDPPSPIRRHVKWKMARTKKIGQMTSEAAKEIADKIDVLTATIGRPEHPGRVCAARAGVTIKQYFGLAPRTSRSSLSLALKDLEQLM

SEQ ID NO: 120015 - protein, 246 aa, Glycine max
  Coding DNA Sequence Number=SeqID_3237
  Gene Ontology: Mol. function=metallopeptidase activity; Cellular component=mitochondrion; Biological process=protein maturation via proteolysis
  Homolog annotation: Hit_ID=Q8VY06; Match level="QueryCoverage=87%, HitCoverage=28%, E-value=7e-58, Identity=43%"; Hit description =Presequence protease 2, chloroplast/mitochondrial precursor
  Pfam annotation: Domain name=M16C_assoc; Domain location=84-242; Score=-125.7; E_value=0.082; Accession=PF08367.1; Description =Peptidase M16C associated
MVYLNWLLSNKPIDLETELTLGFLNHLLLGTSTSPLRKILLESRLGDAIVGGGVEDELLQPHFCIGMKGVFEDDIHKGQWIYDMNPFEPLKYQKHLQHLKSKIAKEGSKFGFSPLIEKFILNNPHQLTMGMQFLYYLSLETSHPPEALKTVPSLSLQKFPKEPIHVPTEVRDINGVKVLQYDLFTDDVLYTEIVFNMKSLKQELLPLVPLFCEALVEKVVETPYMTPTTSPPFFTPPFTTPISPCN

SEQ ID NO: 120016 - protein, 99 aa, Glycine max
  Coding DNA Sequence Number=SeqID_3238
MMKTVHYGDIPSPKDSRGTLRNSFFLPSLWESYMQYLQLLEELSFATAMSKLKFKHHLDSDIVDFEVLASLVIVVCLIEMVVLAGTFGTNVVNIVMLNL

SEQ ID NO: 120017 - protein, 363 aa, Glycine max
  Coding DNA Sequence Number=SeqID_3239
  Gene Ontology: Mol. function=transporter activity; Cellular component= integral to membrane; Biological process=transport
  Homolog annotation: Hit_ID=Q6EU94; Match level="QueryCoverage=74%, HitCoverage=95%, E-value=1e-137, Identity=86%"; Hit description =Aquaporin PIP1.1
  Pfam annotation: Domain name=MIP; Domain location=43-272; Score =440.5; E_value=2.2e-129; Accession=PF00230.10; Description=Major intrinsic protein
MEGKEEDVRVGANRYGERQPIGTAAQAKDYREPPSAPLFEAGELSSWSFYRAGIAEFVATFLFLYITVLTVMGVAKSKSKCSTVGIQGIAWAFGGMIFALVYCTAGISGGHINPAVTFGLFLARKLSMTRAIFYIIMQCLGAICGAGVVKGFEPHLYERLGGGANTIAKGYTNIAGLGAEIVGTFVLVYTVFSATDAKRNARDSHVPILAPLPIGFAVFLVHLATIPVTGTGINPARSLGAAIIFNKDQAWDDHWIFWVGPFIGAALAALYHGSCYVHPALLLGHPANSEVAKLPFINSSSGRRFFPETFRKTSFRKFSGRRICDFWKYPETTSGKTSFGMFPEESSSGNFRKKVLPEVSFFF

SEQ ID NO: 120018 - protein, 163 aa, Glycine max
  Coding DNA Sequence Number=SeqID_3240
  Gene Ontology: Mol. function=catalytic activity; Biological process =metabolic process
  Homolog annotation: Hit_ID=Q9FWQ0; Match level="QueryCoverage=96%, HitCoverage=44%, E-value=1e-24, Identity=38%"; Hit description =Putative enoyl-CoA-hydratase
MKKLLNWLLFYAGEYLALTGEKLNGVDRDGYLLACYTLLNTRLPLIIEQLGKLVTDDPSVIETTLEQYGELVHPDSSSIREGRFQTLDQCLLREYRMALQAIHRQIFGDSGVRARVVDKDLAPKWDPPTLEKVSQDMVDQYFLSLSESEPDLELPTNSSEAFL

SEQ ID NO: 120019 - protein, 171 aa, Glycine max
  Coding DNA Sequence Number=SeqID_3241
MTGLVTILSGKGLGWNRVKGWETLVASRRKWPKGNHHRGWRPDPNTASVRLNNMRPPQGQQRCDGGEGFAVVSPAAQVHNSKMKRKKNGGKGKSEEEKKEAKRKEKRKKKMRGRQTAKGRERNRGYLETPLPSLIAVPNVTLLLANSLPQDPCSSPRLSFFPFFDAVLSSS

SEQ ID NO: 120020 - protein, 123 aa, Glycine max
  Coding DNA Sequence Number=SeqID_3242
MASNRNKSSSRARGGGELTGSRKREKHKQEEERAFPALRRNCRSIFAGGTSFVVQVECTSTWVVITENKREYISCGSVQVEGTSTWLFKENKGGYIPCGSFLVKDFTRLKRNLKDCRSLGDWM

SEQ ID NO: 120021 - protein, 74 aa, Glycine max
  Coding DNA Sequence Number=SeqID_3243
MGGFRIELGQPDPTRDYATGLENPSCLTQKTARPKGNHHGGWRAAPDTVSVGPDNMIPPQGRWWCDGSEGFAVV

SEQ ID NO: 120022 - protein, 143 aa, Glycine max
  Coding DNA Sequence Number=SeqID_3244
  Gene Ontology: Mol. function=protein binding; Cellular component =membrane; Biological process=defense response
  Homolog annotation: Hit_ID=Q1SY04; Match level="QueryCoverage=99%, HitCoverage=12%, E-value=5e-31, Identity=53%"; Hit description =Disease resistance protein; AAA ATPase
MDEMLKRLDIVLNSINQVLEDAEEKQYRSPNVMKWLDELKEAIYEAELLLGEVATEASRQNLEAEFQPATSKVRGFFMALINPFDKEIASRVKELLENINFLAEQMDVVGLRKGICAGIEVGNSPKDCQLHPWWMNPPYVVER

SEQ ID NO: 120023 - protein, 220 aa, Glycine max
  Coding DNA Sequence Number=SeqID_3245
MNNFFTVQCSQNTRGLPSCPLNKGCLNPTCEIVEPTLATSTLTQPAPDFGKYIWCPPWDRGKTYPVASLSPMVSIRFDLRCKISFEGSNPRPTTMADIDTLQQLQTRIAEIERRHEEELRKLKAGHDQLKDHVRCPKSDEHYAHTMPEHTQGESHPQNTSTPKIILVSPTYTVLKGGLLVNTPFVDRIMEADMPLGWKPLNLEQCDGTIDLNEHLDIFLT

SEQ ID NO: 120024 - protein, 94 aa, Glycine max
  Coding DNA Sequence Number=SeqID_3246
MMKGLSFVLLLILVIIHYKVVNANNNNNCVTEDCLIGDNFESEFSFGSHVARMLYDICIIYLFFSDLLPFAYSTLTAGVAGVNFEYHCGIVPSI

SEQ ID NO: 120025 - protein, 85 aa, Glycine max
  Coding DNA Sequence Number=SeqID_3247
MRIKRSFKVVMGPRTRLVVSFKTRKGKQGSKGLSKELIQGKSIWLEAYKNKIASIISKYACELGRINKHQAKAIVQAINRAKHTK

SEQ ID NO: 120026 - protein, 69 aa, Glycine max
  Coding DNA Sequence Number=SeqID_3248
  Subcellular localization annotation: CTP_CleavageSite=60; ConfidenceScore=5.04e-01
MSLLGNETSWTADFSKVLLFPNLVKHVVYSLSANGNTFPNHALRNVCHNRVVIETDEAVNANVFVTVDQ

SEQ ID NO: 120027 - protein, 263 aa, Glycine max
  Coding DNA Sequence Number=SeqID_3249
  Gene Ontology: Mol. function=nucleic acid binding
  Homolog annotation: Hit_ID=Q1RSN0; Match level="QueryCoverage=67%, HitCoverage=29%, E-value=2e-10, Identity=27%"; Hit description=Zinc finger, CCHC-type
  Pfam annotation: Domain name=zf-CCHC; Domain location=83-100; Score =13.1; E_value=0.0068; Accession=PF00098.13; Description=Zinc knuckle
MSLEELVGPSRFIYKNFNRTKEPKEKILWLSTTKRTRRHNRPENMYREVRLNLLSGRNKGGSKWKNSSRRMPKDKKDRDKSSIIYYECKYPGHFKSRCPKLEKGQDKKKYFKTNEKKGLMSTWEDLDDTSSGKDDEEAYICLMENTTFDESESDQEDEVNLDDPEVECEEHKRTVKFFNDKFLKNKKVMGQPQDVVKLHEEIRTLKTTLAKFVNGTNNLNKMLGYCRSSSYKFGNGYDGKVYVHDKDTTVYYFCGKTGHMTSV

SEQ ID NO: 120028 - protein, 816 aa, Glycine max
  Coding DNA Sequence Number=SeqID_3250
  Gene Ontology: Mol. function=protein serine/threonine kinase activity; Cellular component=membrane; Biological process=protein amino acid phosphorylation
  Homolog annotation: Hit_ID=Q70I29; Match level="QueryCoverage=95%, HitCoverage=89%, E-value=0.0, Identity=59%"; Hit description=S -receptor kinase-like protein 2
  Pfam annotation: Domain name=B_lectin; Domain location=66-179; Score =129.5; E_value=9.4e-36; Accession=PF01453.15; Description=D-mannose binding lectin
  Pfam annotation: Domain name=PAN_1; Domain location=336-410; Score =4.1; E_value=0.062; Accession=PF00024.16; Description=PAN domain
  Pfam annotation: Domain name=PAN_2; Domain location=336-399; Score =109.2; E_value=1.2e-29; Accession=PF08276.2; Description=PAN-like domain
  Pfam annotation: Domain name=Pkinase; Domain location=497-768; Score =154.5; E_value=2.8e-43; Accession=PF00069.15; Description=Protein kinase domain
  Pfam annotation: Domain name=Pkinase_Tyr; Domain location=497-768; Score=131.8; E_value=1.9e-36; Accession=PF07714.7; Description =Protein tyrosine kinase
  Pfam annotation: Domain name=S_locus_glycop; Domain location=193-319; Score=110.3; E_value=5.6e-30; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=66-179::336- 410::336-399::497-768::497-768::193-319
MVRFFFFCFFISTLLIQGTLAIITPNESIQGNRTLVSSAGTFEAGFFNFGNSQGQYFGIWYKNISPKTIVWVANKDAPVKDSTAFLTLTHQGDPVILDGSRSTTVWFSNSSRIAEKPIMQLLDSGNLVVKDGNSKKENFLWESFDYPGNTFLAGMKLRTNLVSGPYRSLTSWKNAEDPGSGEFSYHIDAHGFPQLVTTKGEILFSRAGSWTGFVFSGVSWRRMLSLVTFSLAINDKEVTYQYETLKAGTVTMLVINPSGFVQRLLWSERTGNWEILSTRPMDQCEYYAFCDVNSLCNVTNSPKTCTCLEGFVPKFYEKWSALDWSGGCVRRINLSCEGDVFQKYAGMKLPDTSSSWYDKSLNLEKCEKLCLKNCSCTAYANVDVDGRGCLLWFDNIVDLTRHTDQGQDIYIRLAASELDHRGNDQSFDNKKLVGIVVGIVAFIMVLGSVTFTYMKRKKLAKREMLKIFHWKYKREKEDVELSTIFDFSTISNATDQFSPSKKLGEGGFGPVYKGLLKDGQEIAVKRLAKTSEQGAEQFKNEVMLMAKLQHRNLVKLLGCSIHQKERLLIYEYMSNRSLDYFIFDSTQSKQLDLTKRLQIIDGIARGLLYLHQDSRLRIIHRDLKVSNILLDNDMNPKISDFGLARTFGGDQAEANTNRVMGTYGYMPPEYALHGRFSIKSDVFSFGVIVLEIISGRKNRNFQDSEHHLNLLSHAWRLWIEEKPLELIDDLLDDPVSPHEILRCIHVGLLCVQQTPENRPNMSSVVLMLNGEKLLPDPSQPGFYTGTIQYPIQLESSSRSVGACSQNEATVSLLEAR

SEQ ID NO: 120029 - protein, 307 aa, Glycine max
  Coding DNA Sequence Number=SeqID_3251
AQRFPLAFINGNHAPKIPYSKFIYVEHVDKETINDQAPTWTKYDYEHTPSKAFKALPIDAIVHLPFPQWTCLAQPNVIKMPPHWNAYAAKKKGFKFNYNEEIPSRKMKMEIVITLRIEAPYSMKKGFFVLLMPMMLGPFGIRLYGRTLRKPLLLVMMEGIMMIIAMSFKCYVMLGSITLMMLAPALQNILIMTLDASILDEASTKDMDDTIVLGVIIDLTNTGVMDATPKASNAAIVDEVELNTIELASKKSTTSNKATSRDMGEPNVIIIYSNSSGTTPFNYAQPSIVIRDQVQDMIGQVMETFIE

SEQ ID NO: 120030 - protein, 965 aa, Glycine max
  Coding DNA Sequence Number=SeqID_3252
  Gene Ontology: Mol. function=RNA-directed DNA polymerase activity; Cellular component=nucleus; Biological process=RNA-dependent DNA replication
MVIENEYRDLEKMLEVTDLHEKDSSGGYYTWTNNQANGVIYSRIDHVLGNLSWLQQHVDFNLQIMNSGVSDHSLLCLRKQEDRRPSRTPFKFQNVVTNVLGFQESVRDNWNNPITGATAMCRLWKKLKRLQPVVKSLSRTFQGISRELIKARDQLNVVQQELLTDRFNMQVIENVKRCPIQVLNLSNLEEQLLKQKSKVEWLKLGDGNNAYFHASLKSKSRKTQILSLVTENGDTIFEQEKIEDEIVNFYRKLVGTRSSQLNSIDLVAMRQGKQLTSDQRASLTAPITEEEIVNSLKGISDISAPGIDGYNAKYFKATWNITKVDVISAVKEFFEECLIYKAVNCSLITLIPKSDNANMVKDFRPISCCTVVYKIISRIMSTRLGKVLSSVLHQSQAAFIPGQHIHDHILLAYELIKGYNTKGGTPRCMLQMDLQKAYDSVEWSALEAILNELSIPHMFIKWIMITVTTVSYRYQVNGVLSNIVQAKRGLRQRDPLSPLLFVIVMEYLYRVLQKLKQVPNFNFHPKCEKLAIINLSFADDLLMFTRGDPMSVRLAMNAFNDFSAATGLRVNPSKCNIYFGNVADEVKKEIQANVNYNEGTIPFRYLGIPLSNKRLSVAHCLLIADKITARIKHWSARLLSFAGRAQLINSVLFAVSNFWLQCIPLPKEVIKRINAICRSFLWSGGDKLTRKSPISWKRVCTPTKQGGLNIISIEEWNKANLIKLLWNLNGKTDSLWIKWVHCYFLKKWSIMNVPMKTNTSWILKAVLSQRQEVCINPIWQSMLQGQNYQTGRMYKSLIHQFQEVKWRYLFKGNMARPRALFILWMACHERMATKDRLMRFGMLNDDTCCYCKEKETIQHIFFQCNVLSQFWKHTLKWLEVPHSPGGWNEELDWIIKKCKSKGSKAKIIKCAFTEAVYETWMFRNNKCFGLDTTSSNVGTRITDTIVHICWLNPKLRNHLGRLMIP

SEQ ID NO: 120031 - protein, 831 aa, Glycine max
  Coding DNA Sequence Number=SeqID_3253
  Gene Ontology: Mol. function=binding; Cellular component=ubiquitin ligase complex; Biological process=protein ubiquitination
  Homolog annotation: Hit_ID=Q8GSZ9; Match level="QueryCoverage=79%, HitCoverage=98%, E-value=1e-172, Identity=51%"; Hit description =Armadillo repeat-containing protein-like
  Pfam annotation: Domain name=Arm; Domain location=324-364; Score=5.1; E_value=2.8; Accession=PF00514.13; Description=Armadillobeta-catenin -like repeat
  Pfam annotation: Domain name=Arm; Domain location=365-405; Score =21.7; E_value=0.0027; Accession=PF00514.13; Description =Armadillobeta-catenin-like repeat
  Pfam annotation: Domain name=Arm; Domain location=406-449; Score=9.0; E_value=0.92; Accession=PF00514.13; Description=Armadillobeta-catenin- like repeat
  Pfam annotation: Domain name=Arm; Domain location=491-531; Score=4.6; E_value=3.3; Accession=PF00514.13; Description=Armadillobeta-catenin -like repeat
  Pfam annotation: Domain name=Arm; Domain location=627-667; Score =13.1; E_value=0.28; Accession=PF00514.13; Description=Armadillobeta -catenin-like repeat
  Pfam annotation: Domain name=Arm; Domain location=699-739; Score =23.5; E_value=0.00073; Accession=PF00514.13; Description =Armadillobeta-catenin-like repeat
  Pfam annotation: Domain name=Arm; Domain location=743-783; Score=6.6; E_value=1.8; Accession=PF00514.13; Description=Armadillobeta-catenin -like repeat
  Pfam annotation: Domain name=HEAT; Domain location=497-533; Score =8.6; E_value=3.8; Accession=PF02985.12; Description=HEAT repeat
  Pfam annotation: Domain name=HEAT; Domain location=633-669; Score =14.6; E_value=0.37; Accession=PF02985.12; Description=HEAT repeat
  Pfam annotation: Domain name=HEAT; Domain location=709-741; Score =14.5; E_value=0.39; Accession=PF02985.12; Description=HEAT repeat
  Pfam annotation: Domain name=HEAT; Domain location=754-785; Score =7.3; E_value=5.6; Accession=PF02985.12; Description=HEAT repeat
  Pfam module annotation: Pfam domain module=Arm::Arm::Arm::Arm::Arm::Ar m::Arm::HEAT::HEAT::HEAT::HEAT; Domain location=324-364::365-405::406- 449::491-531::627-667::699-739::743-783::497-533::633-669::709 -741::754-785
MEVMEERKFSKLLSELIVLADEVSSIAMNSEIEVDIFAEFAMLVEKLPPIFNDLREKNTVLDKPPIRKSLESLENELRRAKALIKSSNLRQPIKQIEDITHDIGRSLGLLLVASLEVSTDFREKIGTLQRQLMNVRFDGSLSLASSPKSEFSTSDMKLTGEIEEEIVNVSIDDVVLQLKNGNDEEFAVAILRLKQFMRSERLDGGLFNEEATLAILFNRLGSCKADNRLAIIRLLRSIAFGNDEKKDKMVDIEYLSAVVKSLTRDSEERKEAVGLLLDLSDIQAVRRRIGRIQGCIVMLVAILNGDDSDASHDAAKLLDILSSNTQNALHMAEAGYFRPLVQYLKEGSDMNKILMATALSRLELTDHSKLSLGEAGAIEPLVNMFCTGKLESKLSSLNALQNLSTMKENVQHLISSGIAGSLLQLLFSVTSVLMTLREPASAILARIAQSESILVNEDVAQQMLSLLNLSSPIIQGHLLEALNNIASHPGASKVRSKMKEKGALQLLLPFLKENTTKVRSKVLQLLYTLSKDLTDELTEHLDETHLFNIVNIVSTSTLDSEKAAAVGILSNLPASNKKVTDILKRANLLPILISIMYSSTGSNSSTTNSFLTESIASVIIRFTISSDKKLQLFSAEQGVIPLLVKLLSSGSPITKSRASISLAQLSQNSLSLRKSRKSRWSCVLPSVNAYCEIHEGYCFVNSTFCLVKAGAVSPLIQLLEDTEREVVEAALHALSTLLQDEIWEGGVNSIAKLSGVQAIIKSLQVEDAKVQEKAIWMLERIFKVAEHRLKYGESAQVVLIDLAQKSDSRLKSTVAKVLAELELLQSQSSYF

SEQ ID NO: 120032 - protein, 217 aa, Glycine max
  Coding DNA Sequence Number=SeqID_3254
MKHILHRSSTIVVAGVIECVMVYDDDSQPAVECSAFYDDRLHRPSGGVLLGFQSENHRPGEGDALSVQNTTSFNTGNPIVSLPTPGFLGMTAPEPWRPPASRWAAPSQGLPPVNVGGWVGLGQGCSHVNTNADWVGPSQGLALGNASPSWVAPIGNPGMWGSEQSHNGDRFPNQGDCRHSGYSGKSRNKLSSFGNGGRGGSSSPPLGDKRIFSNCLS

SEQ ID NO: 120033 - protein, 90 aa, Glycine max
  Coding DNA Sequence Number=SeqID_3255
  Homolog annotation: Hit_ID=Q1S8R9; Match level="QueryCoverage=52%, HitCoverage=10%, E-value=5e-07, Identity=54%"; Hit description=Beta -Ig-H3/fasciclin
MAKHPKTRACNWNRIWQIWVCIWTKMMVYGVDLTAGGDVRGGCLQRRFRMEHEKHVQREASEGVKIAEGSIQGTKAVVVASKSDDVAVVS

SEQ ID NO: 120034 - protein, 94 aa, Glycine max
  Coding DNA Sequence Number=SeqID_3256
MTVVEVAGGSGDGDNDGVDGMVVVVVVMVVGVEATTVGCDGGGGGGNGYGGGRVITATMARMMVVVVGVTAAADSGANGMLMVVTTVVGLKSWW

SEQ ID NO: 120035 - protein, 74 aa, Glycine max
  Coding DNA Sequence Number=SeqID_3257
MGGGGWNSCITTTIMMEVIKCDDGDDNDGGGKMMVATIMVVVVKAKKTRCSNSGDDNVDGGRMVKTIMVLSMWW

SEQ ID NO: 120036 - protein, 310 aa, Glycine max
  Coding DNA Sequence Number=SeqID_3258
  Homolog annotation: Hit_ID=Q94GE4; Match level="QueryCoverage=96%, HitCoverage=35%, E-value=1e-128, Identity=74%"; Hit description =Putative dex1 protein
  Pfam annotation: Domain name=FG-GAP; Domain location=102-132; Score =4.8; E_value=1.9; Accession=PF01839.13; Description=FG-GAP repeat
  Pfam annotation: Domain name=FG-GAP; Domain location=6-35; Score =23.0; E_value=0.0011; Accession=PF01839.13; Description=FG-GAP repeat
  Pfam module annotation: Pfam domain module=FG-GAP::FG-GAP; Domain location=102-132::6-35
MCSSEPINGPTVGDVDGDGHTELVVPTLSGKIHVLDGRDGSSIGRYPYPTHGRIMNQVLLVDLSKHKEKRKGLTIVTTSFDGYLYLIDGPTGCADVVDIGETSYSMVLADNVDGGDDLDLIVTTMNGNVFCFSTPSPHHPLKAGYAWRLPSQGRNNVANRYNREGIYVTHPSRAFHDEEGKSFWVEIEIVDNYRYPSGHQGPYKVTTSLLVPGNYQGERTIKLNNTYDQPGKYRIKLPTVSVRTTGTVLVEMVDRNGLYFSDDFSLTFHMHYYKLLKWLLVLPMLGMFGVLVILHPQGSMPLPSFSRNID

SEQ ID NO: 120037 - protein, 282 aa, Glycine max
  Coding DNA Sequence Number=SeqID_3259
  Gene Ontology: Mol. function=protein tyrosine/serine/threonine phosphatase activity; Biological process=protein amino acid dephosphorylation
  Homolog annotation: Hit_ID=Q9LFA7; Match level="QueryCoverage=56%, HitCoverage=41%, E-value=4e-41, Identity=63%"; Hit description=MRNA capping enzyme-like protein
MEDALFLNWTWLKTRDKHFSISFNQWSSNLEREERKRRLKRERPDDRPVHVSQSPGYDQLFHTKNQRSYDKSRLPPGYGSRETWGVHGICNGHGGISLEKKEAKGLGWLDCPSSGQEICCMIPSKVPLGESFNDCIPPGYMIIHYLMRAMSMSVTQAIKIFSEARPPGIYKPDYIDALYSFYHEKKPEMVVCPPTPEWKRSSEFDLNGEAVPDDDDDGVPGPDLHENHETDTRMTNDDVLGDEIPTDQQDALRQFCYQTLKLGVGVSLFKWLSFMHEYIAYI

SEQ ID NO: 120038 - protein, 402 aa, Glycine max
  Coding DNA Sequence Number=SeqID_3260
  Gene Ontology: Mol. function=RNA-directed DNA polymerase activity; Biological process=RNA-dependent DNA replication
MAFMEAYNEYLCLVYFDHSLLLMRCGGKQPNKPKCLFRFQATCSSHKGFELIVKKAWAKQAFNIQGKLDNVKENALVFNKKVFGNIFWRKQDIEARLKGVQRSLEKQDFESLKRLEKELHEEYNEVLLRKNSCGQKSHEKWPDMIPHPYLPNEDCCALLAPITKEEVRKVMMKMKLFKATSPNGFQVFFHKQYWLTVEEELWKMVSEAFRNGTLDQSLLDTLIVLISKGSFIPGKGTMNNAILAQEVLNHISHSKTKEGSIVIKIDLEKAYDHINWNFLEDMFNLFGIPRRMIGLIMLRQRDPVSPYLFVIGMDDDILLFCRATEEQPCAGQNSIDWHHGRDDSLTKLDIDRTCRNFLWPKNCNTRSWNLVKLEKIIKPKGMGGLGMKLARTMNVALLGTLI

SEQ ID NO: 120039 - protein, 562 aa, Glycine max
  Coding DNA Sequence Number=SeqID_3261
  Homolog annotation: Hit_ID=Q94GE4; Match level="QueryCoverage=95%, HitCoverage=59%, E-value=1e-177, Identity=59%"; Hit description =Putative dex1 protein
  Pfam annotation: Domain name=FG-GAP; Domain location=31-56; Score =21.2; E_value=0.0038; Accession=PF01839.13; Description=FG-GAP repeat
  Pfam annotation: Domain name=FG-GAP; Domain location=367-391; Score =10.4; E_value=0.34; Accession=PF01839.13; Description=FG-GAP repeat
  Pfam annotation: Domain name=FG-GAP; Domain location=448-477; Score =30.8; E_value=4.7e-06; Accession=PF01839.13; Description=FG-GAP repeat
  Pfam annotation: Domain name=FG-GAP; Domain location=494-523; Score =24.9; E_value=0.00028; Accession=PF01839.13; Description=FG-GAP repeat
  Pfam annotation: Domain name=FG-GAP; Domain location=79-108; Score =21.5; E_value=0.0031; Accession=PF01839.13; Description=FG-GAP repeat
  Pfam module annotation: Pfam domain module=FG-GAP::FG-GAP::FG-GAP::FG- GAP::FG-GAP; Domain location=31-56::367-391::448-477::494-523::79-108
MGVVRDEDALVNSKCPKNLELRWQTEVSSSIYANPLIADINSDGKLEIVVPSFVHYLEVLEGADGDKMPGWPAFHQSTVHSSPLLYDIDKDGVREIALATYNGEVLFFRVSGYMMSDKLEVPRRRVLKKWFVGLDPDPVDRSHPDVHDDQLIQDATIKNSMSQMNGSRHEARSSAAISTENHLDSKKLPNPEPEKKINGSQADESIKVPNPEPEKKINGSQVDESIKVPNPEPEKKINGSQVDESIKVPTIVDNSSVNAGSLETVHADNKTSTGRRLLEDNNSKGAEQGGSESKDKEGIHAATVENDEGLEADADSSFELFRNSEDLADEYSYDYDDYVDESMWGDEEWTEVKHEKLEDFVNVDSHILCTPVIADIDNDGVSEMIVAVSYFFDHEYYDNQEHRKELGDIDIGKYVAGGIVVFNLDTKQVKWTAELDLSTDTSNFRAYIYSSPTVVDLDGDGNLDILVGTSYGLFYVLDHHGKVRQKFPLEMAEIQGAVVAADVNDDGKIELVTADTHGNVAVWTPKGDLIWEKHLKSLIPQWFPSQYSSRINSSLLKALTVV

SEQ ID NO: 120040 - protein, 92 aa, Glycine max
  Coding DNA Sequence Number=SeqID_3262
MAATMVTMIMVTKVVVVVDDDGGYSDDHGGGSNSSGHGGGSDDNDKVLDLVIGTPIPCKGSLDELVAPPSFTQSERWCLAPKLEFYLVRRAH

SEQ ID NO: 120041 - protein, 87 aa, Glycine max
  Coding DNA Sequence Number=SeqID_3263
MNESVTFRGIRGSRQRLRARGRCFSCRNHRRERRWRGGEVAERAEEEEEALSASTRSEFVGSGWNETLASAVAVAGFLWVRSIYKSE

SEQ ID NO: 120042 - protein, 169 aa, Glycine max
  Coding DNA Sequence Number=SeqID_3264
MKILPLYKMIVGLQGCIYKIDSLYGGSLKLEDRDFPSYLSSLSKRLFLTLRSGFTLCLGWVKINSLECSTHSRSLYTLLLPSILFHKVSEGSTHLQNILQVIAILAMSLNPVGVTNSCPSKGNAPVKILCFNYHPQDPGPRHSKDNDSFSQGSSQLEIVAPTTNMDMVM

SEQ ID NO: 120043 - protein, 61 aa, Glycine max
  Coding DNA Sequence Number=SeqID_3265
MDLNASPVPEEDEDIFEEKIHVEEFHEPEERIETGADIARRHHDSDSVCWPCAWCLGLGLL

SEQ ID NO: 120044 - protein, 98 aa, Glycine max
  Coding DNA Sequence Number=SeqID_3266
MALELGLRNLCWAYNLHYRAVRGCLVFDVHRVDFVADLGMTFMDDWAFLAAGASLSEACALSESHALSEALSPLSELEESAHLARHQLAQRGVCLFPR

SEQ ID NO: 120045 - protein, 140 aa, Glycine max
  Coding DNA Sequence Number=SeqID_3267
  Gene Ontology: Mol. function=protein binding; Cellular component =ribonucleoprotein complex; Biological process=rRNA processing
  Homolog annotation: Hit_ID=Q6ZJR7; Match level="QueryCoverage=97%, HitCoverage=44%, E-value=1e-44, Identity=64%"; Hit description =Putative U3 snoRNP protein IMP4
  Pfam annotation: Domain name=Brix; Domain location=1-82; Score=-13.8; E_value=0.0024; Accession=PF04427.8; Description=Brix domain
MPEAYPHLILDNFSTKLGDRTANILKHLFPVPKPDTKRIVTFSNQSDYISFRHHIYEKHGGPKSIELKEIGPRFELRLYQCFTLNSSILPKSIVVETGPIPHNTTLKQIKLGTVDQAEAQIEWVIRPYMNTTKKRKFLSN

SEQ ID NO: 120046 - protein, 136 aa, Glycine max
  Coding DNA Sequence Number=SeqID_3268
MDFESTNTLPKNTLPLNQEPKNLIIGVFMRPLRHLQPFLVNRTPQIVKLHASKWWMIAITSLMKDLIKAHDLQFMAIVKPHISRDLSNASAEDSLIWLVFNDGNLSTKDVYLIYQCGWFLYINHGQSCLWWSCSRL

SEQ ID NO: 120047 - protein, 96 aa, Glycine max
  Coding DNA Sequence Number=SeqID_3269
MSYFVVPIFLDLDDSHRRCHLLVLLISFETYTRSKKQEQAQQRTKPRTTERFYVVQQCVYIHGKASNYMTLARCFQLAFSPGASLWTKKCMHVVQL

SEQ ID NO: 120048 - protein, 383 aa, Glycine max
  Coding DNA Sequence Number=SeqID_3270
  Gene Ontology: Mol. function=amylo-alpha-1,6-glucosidase activity; Cellular component=membrane; Biological process=carbohydrate metabolic process
  Homolog annotation: Hit_ID=Q5JKX1; Match level="QueryCoverage=84%, HitCoverage=45%, E-value=2e-98, Identity=55%"; Hit description=Early- responsive to dehydration protein-like
  Pfam annotation: Domain name=DUF221; Domain location=36-380; Score =137.5; E_value=3.7e-38; Accession=PF02714.6; Description=Domain of unknown function DUF221
MAKRRKNKLSLLGLLHQETSKAAFLEEKLQALCHRIHQLQCKDTLQKKELPVAFVTFKSRSGAAAAAHLQHHSHPLLWITELAPEPRDVSWRNMRVSYRVVPLYKLGVLIAASLLTVFFAIPVTAVQGIAKYEKLKQWFPPARAVQLIPGLSSIVTGYLPSAVLKGFIYIVPLTMFAMAKIAGCIARSKEEIKACNMVFYFLVGNVFFWSVLSGSLLDLIGQFISHPKNVPSQLAGAVSAQADFFVTYILTDGLSGFSLELLQPGMLIWDILKSCVHGCQRETSPYLYSLPYFRIIPLVSLSVLIGIVYAVVAPLLLPFLILYFCLGYVVYVNQDAAENDELDEKCGLLELHYENAINAYCPPGLRPVNFMASESSSTPLVSS

SEQ ID NO: 120049 - protein, 75 aa, Glycine max
  Coding DNA Sequence Number=SeqID_3271
MVLLYDGGGFVSGGDGAMRPTGLTGEEWSEKTKTQQRAARMIGKKHLQANNSTQDEAEYVVVLAIAAFISRSLEG

SEQ ID NO: 120050 - protein, 159 aa, Glycine max
  Coding DNA Sequence Number=SeqID_3272
  Gene Ontology: Cellular component=membrane
  Homolog annotation: Hit_ID=Q5JKX1; Match level="QueryCoverage=89%, HitCoverage=20%, E-value=6e-34, Identity=53%"; Hit description=Early- responsive to dehydration protein-like
  Subcellular localization annotation: CTP_CleavageSite=69; ConfidenceScore=5.09e-01
MNPHSLLASAAINIGLALVTLPLFSVLKKQPSNAPIYYARPLSRRHHLPFDDSSSSLNRFLPSLAWLSRAFRVTEDEIVQDHGLDALVIIRLFKFGIKFFTVCSLVGLVVLLPTNYGAQEVQNGSYFTMDSFTISNVKRGSNRSCHIENLTSFRNTRLA

SEQ ID NO: 120051 - protein, 83 aa, Glycine max
  Coding DNA Sequence Number=SeqID_3273
  Homolog annotation: Hit_ID=Q1SAV4; Match level="QueryCoverage=38%, HitCoverage=8%, E-value=2e-07, Identity=73%"; Hit description =Integrase, catalytic region
MRDGGRWLAKCQWRKPCGRMNKSVIRPFSQCEKKQSHFSEATSSLSEWETLEEDKSEICTLSAQPACSARTLSLFALSTPKLA

SEQ ID NO: 120052 - protein, 122 aa, Glycine max
  Coding DNA Sequence Number=SeqID_3274
  Gene Ontology: Mol. function=chromatin binding; Cellular component =chromatin; Biological process=chromatin assembly or disassembly
  Homolog annotation: Hit_ID=Q1SAV4; Match level="QueryCoverage=62%, HitCoverage=28%, E-value=2e-10, Identity=34%"; Hit description =Integrase, catalytic region
MPSYPCMPLHEVADRGLSYTKASLVSSWAFRWVLGLCCYQHPPLESQPCSQGCMQSTETPNSPRWCLQGISHTIGRAPFWKETTLYDSTSRIHEILGVFWSLMTVGGGTRWSQYVLIPGKGR

SEQ ID NO: 120053 - protein, 41 aa, Glycine max
  Coding DNA Sequence Number=SeqID_3275
MVGGRQRIGVEVVEGLAYMGLVIAMGINAKLKHIIGRQCKD

SEQ ID NO: 120054 - protein, 194 aa, Glycine max
  Coding DNA Sequence Number=SeqID_3276
  Gene Ontology: Mol. function=nucleic acid binding; Cellular component= nucleus; Biological process=mRNA processing
  Homolog annotation: Hit_ID=Q10KN7; Match level="QueryCoverage=92%, HitCoverage=95%, E-value=6e-57, Identity=58%"; Hit description =Polypyrimidine tract-binding protein, putative, expressed
  Pfam annotation: Domain name=RRM_1; Domain location=117-185; Score =0.5; E_value=0.13; Accession=PF00076.12; Description=RNA recognition motif. (a.k.a. RRM, R
  Pfam annotation: Domain name=RRM_1; Domain location=26-89; Score =30.4; E_value=6.4e-06; Accession=PF00076.12; Description=RNA recognition motif. (a.k.a. RRM, R
  Pfam module annotation: Pfam domain module=RRM_1::RRM_1; Domain location=117-185::26-89
MACSLRIDEGVSAQTEKQFTVPSKVVHFRNLPKQCSEEELIKLCSPFGKVVNIMSGVGPNRNQGFVEFEDINEANSIVSYYLSSNPVQLRGKTIYVQYSERPELVINKYTKGNILIVTMEGIQAGDVGIDVIHLVFSEFGFVQKISTFEKNACFQAMVQFPDVKTASSAKDALDGKSIPRQLMLLHFLLCSSPS

SEQ ID NO: 120055 - protein, 253 aa, Glycine max
  Coding DNA Sequence Number=SeqID_3277
  Gene Ontology: Mol. function=nucleic acid binding; Cellular component= mitochondrial outer membrane translocase complex; Biological process =protein import into mitochondrial outer membrane
  Homolog annotation: Hit_ID=Q1S2B6; Match level="QueryCoverage=92%, HitCoverage=63%, E-value=4e-47, Identity=43%"; Hit description=RNA -binding region RNP-1
  Pfam annotation: Domain name=RRM_1; Domain location=46-114; Score =4.8; E_value=0.051; Accession=PF00076.12; Description=RNA recognition motif. (a.k.a. RRM, R
MCSRTAISTILIGIAKYKDYTNPTLPVNQTSIDRAIQPFENHVLWASFENMQYDVTVDVLHSVFSEYGTVQKISIFEKNGQTHALIQYPDIATATAAKKALMGHCIYDGGCCKLRLSYSHHTDINVKGSSDKSRDYTMPNHGVFEEQVETTDLENPHSTSMSHNSSNSSSAHALQAQVHGGQIPSWNPIHNYMFAPGTFPNQTYAVPPYLVYAVHNESYMEITPPGVPGFSPHMQAGFVGFLPLGVQPYYYGY

SEQ ID NO: 120056 - protein, 77 aa, Glycine max
  Coding DNA Sequence Number=SeqID_3278
MNGEVALIKWMMDIDTLECSGQRVHMVPVDRPDVMSITIDHSRYCYIPWGFKSRQQLKWFEDIFMWAWKCLTMLKNS

SEQ ID NO: 120057 - protein, 77 aa, Glycine max
  Coding DNA Sequence Number=SeqID_3279
  Gene Ontology: Mol. function=RNA-directed DNA polymerase activity; Biological process=RNA-dependent DNA replication
MVKLLNNFNPSSRRVRQGDPISPLLFVLCIERLFHMINVALDENLWNPITLSRGGPKLAYLAFVDDILRQLQMLKWN

SEQ ID NO: 120058 - protein, 105 aa, Glycine max
  Coding DNA Sequence Number=SeqID_3280
  Gene Ontology: Mol. function=RNA-directed DNA polymerase activity; Cellular component=chromatin; Biological process=RNA-dependent DNA replication
  Subcellular localization annotation: CTP_CleavageSite=80; ConfidenceScore=5.25e-01
MALVSSEGGFGISASAICIWWNPWQRSNLENHDTSPSSSRSSSMVGITNFSFTDIAFNKGSMNKSWNLERMATMAGGVVSLEMGEEDKSWVRSGIWVMWNKADRN

SEQ ID NO: 120059 - protein, 61 aa, Glycine max
  Coding DNA Sequence Number=SeqID_3281
YFIDPRPLEPERLKALHNQWAKKYLTTMHWDIVAIADASADSDQDGNEVIVGGKLWLVLDM

SEQ ID NO: 120060 - protein, 61 aa, Glycine max
  Coding DNA Sequence Number=SeqID_3282
MFWDYAGADPKLNHLFNDAMARSENLKYVAGDMFEAIPPADAILLKLKKKRNTWLKSTVRV

SEQ ID NO: 120061 - protein, 380 aa, Glycine max
  Coding DNA Sequence Number=SeqID_3283
  Gene Ontology: Mol. function=O-methyltransferase activity; Cellular component=intracellular; Biological process=lignin biosynthetic process
  Homolog annotation: Hit_ID=Q1T3W1; Match level="QueryCoverage=93%, HitCoverage=97%, E-value=1e-150, Identity=71%"; Hit description=O -methyltransferase, family 2
  Pfam annotation: Domain name=Dimerisation; Domain location=33-81; Score=68.8; E_value=1.7e-17; Accession=PF08100.2; Description =Dimerisation domain
  Pfam annotation: Domain name=Methyltransf_11; Domain location=201 -295; Score=0.8; E_value=0.046; Accession=PF08241.2; Description =Methyltransferase domain
  Pfam annotation: Domain name=Methyltransf_2; Domain location=97-338; Score=382.2; E_value=7.7e-112; Accession=PF00891.8; Description=O -methyltransferase
  Pfam module annotation: Pfam domain module=Dimerisation::Methyltransf_ 11::Methyltransf_2; Domain location=33-81::201-295::97-338
QQIMDSHDEEHAAKLLRAQTHIWNHIFSFINSMSLKCVVDLGIPDIIHNYGQPMPLSNLIASLPIHPSKTCFVHRLMRIMIHSGFFSQQNHDMENQLDAKYVLTDASVLLLKNHPMSVTPFLHAMLDPILTNPWNQFSTWFKNGDTTPFETAHGMMLWDYAGADPKHNNLFNDAMASDARFVTSLVIEKCKGMFMGLESLVDVGGGTGTMAKAIAKSFPRVECIVFDLPHVVSGLKGSENLKYVAGDMFEAIPPADAILLKWILHDWNDKECVDILKKCKEAITRKGKEGKVIIIDMVVENEKRDDESVETQLFFDMLMMVLVTGKERSKKEWAKLISSAGYNNYKITPVLGLRIGVSVVSAVGINAIIGGRSYVELVIA

SEQ ID NO: 120062 - protein, 63 aa, Glycine max
  Coding DNA Sequence Number=SeqID_3284
MSRVYVGNLDSGVTERDLEDEFCVFGVIQSEGLREAYDGDIAFASAWKLLVVGIMTQSVWLWE

SEQ ID NO: 120063 - protein, 264 aa, Glycine max
  Coding DNA Sequence Number=SeqID_3285
  Gene Ontology: Mol. function=serine-type endopeptidase inhibitor activity; Cellular component=intrinsic to endoplasmic reticulum membrane; Biological process=electron transport
  Homolog annotation: Hit_ID=A0FIZ7; Match level="QueryCoverage=82%, HitCoverage=47%, E-value=4e-60, Identity=54%"; Hit description=FMO -like protein
  Pfam annotation: Domain name=DAO; Domain location=6-225; Score=-36.8; E_value=0.0015; Accession=PF01266.14; Description=FAD dependent oxidoreductase
  Pfam annotation: Domain name=FMO-like; Domain location=6-260; Score= -366.4; E_value=6.5e-07; Accession=PF00743.9; Description=Flavin -binding monooxygenase-like
  Pfam annotation: Domain name=Pyr_redox_2; Domain location=6-244; Score=-30.8; E_value=0.022; Accession=PF07992.4; Description =Pyridine nucleotide-disulphide oxidor
  Pfam module annotation: Pfam domain module=DAO::FMO-like::Pyr_redox _2; Domain location=6-225::6-260::6-244
MTHPLRVAVIGAGVAGLAAARSLRREGLDVVVFEKSNHLGGTWSYDPRTDSDPVGLDPNREVVHTSLYRSLRTNLPRQLMGFLDYPFPNRNNGDPRTFPGHEEVLWFLNRFSDEFGLRGLTRFGSEVVRVELVSEKSDSWVVESRRNRDSVLTREVFGAVVVCTGHFTQPRLPTIPGIEKWPGYQIHSHNYRVPEPFQGQIVVVIGFASSAFDISREIAKVAKEVHIATRSPDVKVMKLANHDNMWQHKMDMYEECNIWYLRIH

SEQ ID NO: 120064 - protein, 215 aa, Glycine max
  Coding DNA Sequence Number=SeqID_3286
MEAQPVPAMIVVEAVASGVVVVDVVADGARPSLDGEKNPNQARRNLMLDGIVAEQDGVIAVRDFAAMVVAITTELEVARGSGSGAMGATVVGAVVGGGCAEDGADMGAVVGGGCAEEDGAVLAKSIVGSSGGGGGSGGCTEEGNHGIRVSHKASKWIRGRVGTETEGMAPAEGGVLWHSRSRGRGSHGRKEEEGESNGERRVFLDSRPRNLLTKL

SEQ ID NO: 120065 - protein, 1094 aa, Glycine max
  Coding DNA Sequence Number=SeqID_3287
  Gene Ontology: Mol. function=nucleoside-triphosphatase activity; Cellular component=membrane; Biological process=defense response
  Homolog annotation: Hit_ID=Q1SY09; Match level="QueryCoverage=98%, HitCoverage=99%, E-value=0.0, Identity=60%"; Hit description=TIR; Disease resistance protein; AAA ATPase
  Pfam annotation: Domain name=LRR_1; Domain location=582-603; Score =0.9; E_value=1.9e+02; Accession=PF00560.23; Description=Leucine Rich Repeat
  Pfam annotation: Domain name=LRR_1; Domain location=639-660; Score =2.4; E_value=1e+02; Accession=PF00560.23; Description=Leucine Rich Repeat
  Pfam annotation: Domain name=LRR_1; Domain location=662-684; Score =10.4; E_value=3.2; Accession=PF00560.23; Description=Leucine Rich Repeat
  Pfam annotation: Domain name=LRR_1; Domain location=709-731; Score =5.5; E_value=27; Accession=PF00560.23; Description=Leucine Rich Repeat
  Pfam annotation: Domain name=LRR_1; Domain location=733-754; Score =11.7; E_value=1.8; Accession=PF00560.23; Description=Leucine Rich Repeat
  Pfam annotation: Domain name=LRR_1; Domain location=756-778; Score =9.0; E_value=5.9; Accession=PF00560.23; Description=Leucine Rich Repeat
  Pfam annotation: Domain name=LRR_1; Domain location=811-834; Score =5.3; E_value=29; Accession=PF00560.23; Description=Leucine Rich Repeat
  Pfam annotation: Domain name=LRR_1; Domain location=836-857; Score =10.1; E_value=3.7; Accession=PF00560.23; Description=Leucine Rich Repeat
  Pfam annotation: Domain name=LRR_1; Domain location=859-884; Score =9.9; E_value=4; Accession=PF00560.23; Description=Leucine Rich Repeat
  Pfam annotation: Domain name=NACHT; Domain location=215-367; Score= -27.0; E_value=0.0073; Accession=PF05729.3; Description=NACHT domain
  Pfam annotation: Domain name=NB-ARC; Domain location=177-479; Score =102.5; E_value=1.3e-27; Accession=PF00931.13; Description=NB-ARC domain
  Pfam annotation: Domain name=TIR; Domain location=19-152; Score =157.5; E_value=3.4e-44; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::NACHT::NB-ARC::TIR; Domain location=582-603::639-660::662-684::709-731::733-754::756-778::811 -834::836-857::...
  Pfam module annotation: Domain location=859-884::215-367::177-479::19- 152
MEHRVIPFSTRGWRRTYDVFLSFRGEDTRFGFTGHLYNTLRHRGINTFMDDEALERGEQISEAIFKAIEESGKAIVVFSKNYASSTWCLEELVKILSCMKTKELKVYPLFYNVDPSEVRYQRASYGQQLAKHEIKMKYSKQKVQNWRLALHEAANLVGWHFKDGHGYEYEFITRIVDVVGISKPNLLPVDEYLVGIESRIPKIIFRLQMTDPTVIMVGICGVSGIGKTTLAQALYNHISPQFEGSCFLNDVRGSSAKYGLAYLQEGILSDIAGENIKVDNEHKGIPILIRKLHGKRVLLILDNVDKLEQLEYLAGECNWFGLGSRIIITSRCKDVLAAHGVENIYDVPTLGYYEAVQLLSSKVTTGPVPDYYNAIWERAVHCSHGLPLVLKDIGSDLSEKMNVIGSDLSWPSIDELGIALERYERVCDGEIQSILKVSYDSLNECEKKIFLDIACFFIGEPVSYVEEILSAIGFNPQHSINRLIDRSLLSIDSSGRLMMHDHIKDMAMKIVQQEAPLHPEKRSRLWCPQDVLQVLNENELVVFNLFLLSKGSDKIEVMMLVDLPRGNDVLKLSDKAFKNMKSLRMLIIKDAIYSGIPQHLSNSLRVLIWSGYPSGCLPPDFVKVPSDCLILNNFKNMECLTKMDFTDCEFLSEVPDISGIPDLRILYLDNCINLIKIHDSVGFLGNLEELTTIGCTSLKIIPSAFKLASLRELSFSECLRLVRFPEILCEIENLKYLNLWQTAIEELPFSIGNLRGLESLNLMECARLDKLPSSIFALPRLQEIQADSCRGFDISIECEDHGQPRLSASPNIVHLYLSSCNLTTEHLVICLSGFANVVYLDISYNSFTVLPACIKECINLKTLLLSNCNQLQDILVIPSKLEDIDALNCTSLTSQSSSVLLSQAFHGTGQKTVILPGLRIPEWFDHCSSERSITFWGRERFPRICVCVSFGMLENSLHHHFQVTFCIVINGHKRILSNRCYDWSVQTDHVWLFDLTALVSYEDLRGTLVKSDWNHVEIEMEWNCCIQGDHGPTRMAIVKWYGIHVYRQESKMEDISFTNPKNLQENITSKRVGTEVLDSSEKSQKKLKAISQWD

SEQ ID NO: 120066 - protein, 427 aa, Glycine max
  Coding DNA Sequence Number=SeqID_3288
  Homolog annotation: Hit_ID=Q689Z6; Match level="QueryCoverage=53%, HitCoverage=84%, E-value=1e-09, Identity=29%"; Hit description =Asparagine-rich cocoon silk protein
MLLYRVPLLLFVCFCFANSAAVSANEASTGTEVTIDAKPSDKKLKGTESFPKEKKTFSIPFFKPVPKLVPIVKPIPMPFPKPLPLPIPVFQKPIPKWIPDVKPIPKPIPIPVFRPVPVPVKPIPKPSPTIEKPKPCPIAKKPVPTPVVKKPLPKPIPIVKSIPKPSPTVKKPLPIPSIKPVPKSIPIAKPIPIPVFKPIPKPFPIEPLPIPVIKPIPTPIPIPLFKPIPKPFPIVVKPLPIPIIMPVPKPIPIFKPIPIFEPIPKSIPIVQRPQPIPITKPVPKSIPIVIPIPIPVSKPIPKPTPIMKKPLPIPVTKPIPKPVPIVKPIPKSIPKPVPIVKPIPTSIFKPIPKPFPLVKKPLPIPIIKPIPESVPLVKPIPIPVFEPIPKPFPMVKKPLPISIFKPIPKSFPVGKMPQPVQVSKPIP

SEQ ID NO: 120067 - protein, 507 aa, Glycine max
  Coding DNA Sequence Number=SeqID_3289
  Homolog annotation: Hit_ID=Q3MJK9; Match level="QueryCoverage=91%, HitCoverage=99%, E-value=2e-13, Identity=21%"; Hit description =Cement protein 3B variant 1
  Pfam annotation: Domain name=Antimicrobial11; Domain location=135 -149; Score=7.1; E_value=5.4; Accession=PF08106.2; Description =Formaecin family
  Pfam annotation: Domain name=Antimicrobial11; Domain location=168 -182; Score=7.6; E_value=4.4; Accession=PF08106.2; Description =Formaecin family
  Pfam annotation: Domain name=Antimicrobial11; Domain location=198 -212; Score=4.9; E_value=14; Accession=PF08106.2; Description =Formaecin family
  Pfam annotation: Domain name=Antimicrobial11; Domain location=325 -339; Score=0.4; E_value=1e+02; Accession=PF08106.2; Description =Formaecin family
  Pfam annotation: Domain name=Antimicrobial11; Domain location=362 -376; Score=1.2; E_value=71; Accession=PF08106.2; Description =Formaecin family
  Pfam annotation: Domain name=Antimicrobial11; Domain location=413 -427; Score=4.5; E_value=17; Accession=PF08106.2; Description =Formaecin family
  Pfam annotation: Domain name=Antimicrobial11; Domain location=432 -446; Score=0.5; E_value=94; Accession=PF08106.2; Description =Formaecin family
  Pfam annotation: Domain name=Antimicrobial11; Domain location=47-62; Score=0.7; E_value=89; Accession=PF08106.2; Description=Formaecin family
  Pfam module annotation: Pfam domain module=Antimicrobial11::Antimicrob ial11::Antimicrobial11::Antimicrobial11::Antimicrobial11::Antimicrobia l11::Antimicrobial11::Antimicrobial11; Domain location=135-149::168 -182::...
  Pfam module annotation: Domain location=198-212::325-339::362 -376::413-427::432-446::47-62
MRKSYTFQRVPLLLLLCFCFANSAAVTANEDSTAGTEVNIDGKPLHTKPFPIEEKTLPIPLFKPLPKLVPIVTPIPNPLPIPVFQKPIPKWIPDIKPIPNPIPIPVFPIPVFKKPIPDVMPIPKPSPIVEKPKPKPCPVAKKPIPTPVIKKPIPKPSPIVEKPKPKPKPCPVAEKPIPTPVIKKPIPKPIPIVKPIPKPSPIVKKPLPIPVIKPVPKSTPTVKPVPIPVFKPIPKPFTIVKKPLPIPVIKPVPVPVPIIKPIPIPVFKPIPKPFPIPLFKPIPKPFPIPFFKPIPKPIPTVKKPQPIPVTKPLPNPVPVVKPIPKPTPMVKKPLPIPVTKPIPKPIPIVKPIPIPVFKPIPKPIPIVKKPLPIPVTKPIPKPVPIIKPIPIPVFKPVPIIKPIPIPVFKPIPKPFPIVKKPLPIPAIKPIPKPIPSLKKPLPTPTIKPVPEPVPTVKPIPIPTFKPFPKPFPFVKRPLPIPPMMKPIPKPFTSVKKPPPIPISKPIP

SEQ ID NO: 120068 - protein, 36 aa, Glycine max
  Coding DNA Sequence Number=SeqID_3290
MAPSQQLSMVQSLHTYTNMFITATNFYKLFEFRGFG

SEQ ID NO: 120069 - protein, 71 aa, Glycine max
  Coding DNA Sequence Number=SeqID_3291
RAKSRWHWQCSTVDTQRCDREGDGGGDDDNNKVERKRDLLDRDTILQRDLTVAEDVDNGVRRHKELRQRKR

SEQ ID NO: 120070 - protein, 169 aa, Glycine max
  Coding DNA Sequence Number=SeqID_3292
  Subcellular localization annotation: CTP_CleavageSite=69; ConfidenceScore=5.03e-01
MLVVVASGGSGRGGINGGGGGSNSDGGGRSVDGDGGDSTSGGIVGSGGVMVVAMPVVMVMVMSMVTMVVVTMVVVVLVVVPMNSSGDVGYDGGGNDDGGGDFDDAKKQMIEREKQNNMKSLGQEQVKHLEDLISMVAEWRRKKDDWRCHFKEKTSQAQAHHHRKSWIKA

SEQ ID NO: 120071 - protein, 51 aa, Glycine max
  Coding DNA Sequence Number=SeqID_3293
MEHNRMRPLPHRAVDCGMFLEPGEINEMQRRAKEVTRLTTVTRQSRDLGMV

SEQ ID NO: 120072 - protein, 180 aa, Glycine max
  Coding DNA Sequence Number=SeqID_3294
  Homolog annotation: Hit_ID=Q5BLY1; Match level="QueryCoverage=33%, HitCoverage=6%, E-value=9e-25, Identity=80%"; Hit description =Plastid alpha-amylase
MPPPTTTTLNIATFTFTEPNCCQGAKENTAPKREKREEECATMAALRKKAEAILPFLKNVGCTSKNARNIDELKDLVKRFHEVGIKVLGDAVLNHRCAHYQNQNGMWNIFGGPLNWDDRSVVADDPHFEAAWIVDDSDEEESDCDNENNDGMVLDEGEDEFPCQEENMVVIMAPGWVAFS

SEQ ID NO: 120073 - protein, 131 aa, Glycine max
  Coding DNA Sequence Number=SeqID_3295
MVPAGEVCVVSGQCVSDYMDWFFHISHPFMTPDHASDPLSDGHAPQPQVVPQAPRIDIPHVPEPGAPSTSARPVVEEPRHVVEVCLWITERLERHLSLGVVTPGSSTHEVIEECLRMARSVTQDQLVYVRS

SEQ ID NO: 120074 - protein, 185 aa, Glycine max
  Coding DNA Sequence Number=SeqID_3296
MVRAFEVLYPFSNIWPSVLVFLFFFQMKLSGKIGWVSLNSMSKKLFEFDSNIFRCFKDHFFKVLATDVVADSMPLMLNRDGEPYFLFYWQFDPTGFKSDPLASLDGIMGDFAWRPLVKQVRPANGTVPSSTAALSVGEGGQPASEVGLVVVTTDVTPNTFSSILAKRKRDNVVKQIEVVPESNKH

SEQ ID NO: 120075 - protein, 1109 aa, Glycine max
  Coding DNA Sequence Number=SeqID_3297
  Gene Ontology: Mol. function=nucleic acid binding; Cellular component= intracellular
  Homolog annotation: Hit_ID=Q6H4V9; Match level="QueryCoverage=71%, HitCoverage=82%, E-value=0.0, Identity=52%"; Hit description =Putative RNA-binding protein 10
  Pfam annotation: Domain name=DUF1777; Domain location=175-345; Score=- 83.4; E_value=0.014; Accession=PF08648.2; Description=Protein of unknown function (DUF1777)
  Pfam annotation: Domain name=G-patch; Domain location=991-1075; Score= 25.2; E_value=0.00016; Accession=PF01585.13; Description=G-patch domain
  Pfam annotation: Domain name=RRM_1; Domain location=317-390; Score =56.2; E_value=1.1e-13; Accession=PF00076.12; Description=RNA recognition motif. (a.k.a. RRM, R
  Pfam annotation: Domain name=RRM_1; Domain location=474-547; Score =76.2; E_value=1e-19; Accession=PF00076.12; Description=RNA recognition motif. (a.k.a. RRM, R
  Pfam annotation: Domain name=zf-RanBP; Domain location=417-446; Score= 24.0; E_value=0.00052; Accession=PF00641.9; Description=Zn-finger in Ran binding protein and others
  Pfam module annotation: Pfam domain module=DUF1777::G-patch::RRM _1::RRM_1::zf-RanBP; Domain location=175-345::991-1075::317-390::474 -547::417-446
MDPGRYALHQGWDNNSVIVALEGYSTVHDPNFRVGGSYDERRFIDERYPRDAVYQRNNFPRDILDREAYLPPGPPVGHWSQTKRRGYDEDYPLDRESRRFQRPHHESYDQIDGFRDREIDTYPEYERFRDGYTGIENYGDRGYDKPARFVGHDRDDYAYDDDYDYKSRASSHHRREDSHERDHDHGRHSYDSDYERSSRRDSNWRRRKSRDRERVKSGHSRERDLSPHRRHERSHSHSHSRSRSCSRSRSPSHSHSRSQSRGYDDHPRSRSPRGRSHGRSYREDSYTDSRYDKSERRRDRDDKRQWEHYSVAPSATVVVKGLSQKTTEEDLYQILAECGPLRHVRVIKERNSGVSRGFAFIDFPSVGAAQGMMDKLGDDGLVVDGRKLFFEYSSKPTGGPGPDGAMKSGHNYKSMMVPSDWMCTICGYINFARRTSCYQCNEPRTDDAPAADISLSNSAAIGKKGSEAGPTHVLVVRGLDENADEEMLRYEFSKHAPIKDLRLVRDKFTHVSRGFAFVHFYSVEDATKALEATNGTMLEKNGQILRVAYAKSILGPGSGTSGTSQSSSLAAAAIEAATFAQQYDSVGWAPKEYNPDAKQSTGPEQTGAEVGAPQSGFVWDEASGYYYDAASGFYYDGNTGLYYDGNNGIWYSYDHQTQQYIPCTDQNQNKASNESEPSKVSDGSGSKKVISAPATAVAPVEKPASLADAVQAAATAALAAEKKEKEKSKEIKLASKSSILANKKKMNNVLTMWKQRSHEGQATRVALEDNQPSVSADDRSYSSGHYAKNKLKNETMVRESNASNPGSHTTLAQSAAIDSQAQPQPVSNSLGGTVMGVIRGSGRGVVKADTYSGSTSVASSMPSLSTANVDAQTVATPFRTDVSALGSYTQSVIVGSGRRRFSEMPHSASTHKEQPQTTYRDRAAERRSLYGSSSSVGNDLADLEIGDSNRDFASRKGDPMPFPPGVGGGRIVGDANLDTFEVITADKAIDENNVGNRMLRNMGWQEGLSLILFVAASCNKFQYSKFPLYRDMLSVSTSRIGWDTPGNLGLGKDGSGMIEPVLAQATENRAGLGSQQKKLDPSLEVQAGDSYKMLIHKKALARFREMSES

SEQ ID NO: 120076 - protein, 74 aa, Glycine max
  Coding DNA Sequence Number=SeqID_3298
  Subcellular localization annotation: CTP_CleavageSite=30; ConfidenceScore=5.05e-01
MIVACPLSSDSCSNPNWSLTLEGKYPPCVRSSQKQDLASRNVACEVRTEITQREATFRDEAPPVRKTRLRRFCE

SEQ ID NO: 120077 - protein, 312 aa, Glycine max
  Coding DNA Sequence Number=SeqID_3299
  Gene Ontology: Mol. function=transcription factor activity; Cellular component=intracellular; Biological process=regulation of transcription, DNA-dependent
  Homolog annotation: Hit_ID=Q10P86; Match level="QueryCoverage=86%, HitCoverage=44%, E-value=4e-34, Identity=34%"; Hit description =Expressed protein
MAFSPVPTALDCLPVEESYNTEANAFFDSRFGSGKRQKIENLLDAKSLLFAEPWYKTVNNLHLWNASFIDVVLISSPMGIMGLPFLTRTKGFSAKIYVTEASARIGQLMMEDLVSMHAEFRQFYGPGESNFPSWLRHEELEVLPSELRELILGKDGVELGGWMPLYSAADVKDFMLKIHTVNYAEEVCFNGTLVIKAFSSDFLSLGDTQDGENGDNYSVSTADKLLPISNEYLCLFILTFMLVIAESSQDLAGFNHNSVEYSEEKEKLVFICSHAMEHIKQGGSVLIPFDRLGTILLLLEEMTASLEASDTK

SEQ ID NO: 120078 - protein, 82 aa, Glycine max
  Coding DNA Sequence Number=SeqID_3300
  Gene Ontology: Mol. function=calcium-dependent phospholipid binding
  Homolog annotation: Hit_ID=Q1SXY9; Match level="QueryCoverage=98%, HitCoverage=82%, E-value=3e-27, Identity=73%"; Hit description =Annexin
  Pfam annotation: Domain name=Annexin; Domain location=26-82; Score =37.3; E_value=5.3e-08; Accession=PF00191.10; Description=Annexin
KLFDEGSDEFHKAANLAVSCINDHKKYCQKVLCNAMEHVGTDEDALTRVIVTRAEKDLKEIKEMYYKRNIVHLEHVAAKETS

SEQ ID NO: 120079 - protein, 45 aa, Glycine max
  Coding DNA Sequence Number=SeqID_3301
MEMVAASCDTVFVHVNEGTMAVAWRAWKREGGRFSDVEERSTTSF

SEQ ID NO: 120080 - protein, 102 aa, Glycine max
  Coding DNA Sequence Number=SeqID_3302
  Gene Ontology: Mol. function=calcium-dependent phospholipid binding
  Homolog annotation: Hit_ID=O65848; Match level="QueryCoverage=95%, HitCoverage=46%, E-value=7e-23, Identity=47%"; Hit description =Annexin
  Pfam annotation: Domain name=Annexin; Domain location=38-101; Score =33.7; E_value=6.2e-07; Accession=PF00191.10; Description=Annexin
MATLIAPSNHPPVEDTESLRKAVKAMYRWILEHVHVEREALLANIALKSADKNYQVIVEISCVLSPEELFVVRRAYHNKYKRSLEEDVAANTSGHLRQATQC

SEQ ID NO: 120081 - protein, 185 aa, Glycine max
  Coding DNA Sequence Number=SeqID_3303
  Gene Ontology: Mol. function=RNA-directed DNA polymerase activity; Biological process=RNA-dependent DNA replication
  Homolog annotation: Hit_ID=Q2HTR6; Match level="QueryCoverage=56%, HitCoverage=44%, E-value=7e-18, Identity=40%"; Hit description=RNA -directed DNA polymerase
MRLNLYGVAMKIKAPAVTSSFIALIPKKDNPQSLSDYGPISLIVSMHKIISKLLALRVKKEVGENNCVFWSYVYLVNGSPMAEFGVERGLKQGDPLSPFLFLMAVEGLCGLVKKAELVDVFKGLLEEHLAIKGIVRSFELMSELKGSLLGLGGRITLINAVLSSLPVYMFSVTTCCLLVLMAYSK

SEQ ID NO: 120082 - protein, 161 aa, Glycine max
  Coding DNA Sequence Number=SeqID_3304
  Gene Ontology: Mol. function=protein binding; Cellular component =chromosome; Biological process=autophagy
  Homolog annotation: Hit_ID=Q4A189; Match level="QueryCoverage=78%, HitCoverage=25%, E-value=3e-72, Identity=100%"; Hit description =Beclin 1 protein
YIGVFYTILGHAMALGSGLRFCMYAEIMVGVLRFGPVNLFWSTRYDKAMTLFLACLKDFADFAKSKDQENNIPPEKCFKLPYKIENDKVENYSITQSFNKQENWTKSLKYTLCNLKWALYWFVGNTNFQPLSAMVSSHAEVPAVGPLYTKRGVDAKSESRN

SEQ ID NO: 120083 - protein, 246 aa, Glycine max
  Coding DNA Sequence Number=SeqID_3305
MLQTEDLIVETNAMKIPIIVVERVWYELVSRALVVMQFNNGSTNVKHFRVKLVVIHFEGKALQWHTSFVKTLPESNLPKWTKFTNILIDRFGEVCDDPMAELMQLRQKGKEPELILDRATVKKGNRAVKGVGQVETPINRRCYLEGTRNHEVIQIIMTACNKHLAHFDRSHHQNEYLMMNIDAAIFQQLTKFGIGCCIRDDHGTFISAKTTHFEGLPEPREAEANGSSSWITLGSRTWSPTEYVST

SEQ ID NO: 120084 - protein, 116 aa, Glycine max
  Coding DNA Sequence Number=SeqID_3306
  Gene Ontology: Mol. function=zinc ion binding; Cellular component =chromosome; Biological process=autophagy
  Homolog annotation: Hit_ID=Q4A189; Match level="QueryCoverage=91%, HitCoverage=21%, E-value=1e-53, Identity=95%"; Hit description =Beclin 1 protein
  Pfam annotation: Domain name=APG6; Domain location=1-116; Score= -115.6; E_value=5.4e-05; Accession=PF04111.3; Description=Autophagy protein Apg6
RREIEAVIEETERQNAEVNAELRELELKSSRFNELEERYWHEFNNFQFQLISHQEERDAILAKIEVSQAHLELLKRTNVLNDAFPISHDGEFGTINNFRLGRLPKIPIKLWRQFGN

SEQ ID NO: 120085 - protein, 123 aa, Glycine max
  Coding DNA Sequence Number=SeqID_3307
MAMRCGGGIGGWCLSVEVVFECNGAVWGCSGHGGLGERHLGLLGKKESSRTNPPSPAAPVPFPVNRDAIGTGSPPPHTQIPPSQSQRLPTEQGHPLPSISGGSFQFFRSGATSAILEGLSFTG

SEQ ID NO: 120086 - protein, 91 aa, Glycine max
  Coding DNA Sequence Number=SeqID_3308
MDVGSWSSSPSKMKFRFSSKIASSAERILKKTEDEQFSMVHPLRHDGRRPQPRSSVFHGLVVSHALNGDEEAARVGCRATTGSRDFVGIDK

SEQ ID NO: 120087 - protein, 245 aa, Glycine max
  Coding DNA Sequence Number=SeqID_3309
  Gene Ontology: Mol. function=molecular_function; Cellular component =cytoplasm; Biological process=red or far red light signaling pathway
  Homolog annotation: Hit_ID=Q8GWZ6; Match level="QueryCoverage=97%, HitCoverage=99%, E-value=1e-61, Identity=46%"; Hit description =Protein SENSITIVITY TO RED LIGHT REDUCED 1
MAASEKTLTNKCTTNEGWTVVLPRRSRQRRKATKSGVLEEKQEPWTPTDSQTDPSKEATLVQKMERCINRIERSEFYHTFRDQIQTSVVDYFNRVLGSEIKMQMVIYEVFDPILSATESRVLEALGCSVMSINEHGRREALKPTMFFMPHCEAELYNNLLQANWKLNLLKNMVLFGHSFETYEQHVSLCKNSPILNSMGHILAAQGFTNEFRIQTVSDDYYNAFHDSSWHFFSPLLETELPIINS

SEQ ID NO: 120088 - protein, 95 aa, Glycine max
  Coding DNA Sequence Number=SeqID_3310
MRFSNQDSSKISLKLGKVEENGIEKEFDPRKKAALPKCYHHLEGHHRANLMDHANLCKYIAQFTGGFDTENIEAFEELRSCIHAPPGEDNNQKHS

SEQ ID NO: 120089 - protein, 107 aa, Glycine max
  Coding DNA Sequence Number=SeqID_3311
  Subcellular localization annotation: CTP_CleavageSite=34; ConfidenceScore=5.03e-01
MGGHIAESQLHLLSLARPSFRLLFFQPHFCIPVSQSNHDPAFSFSDVQRLSPVLVEKAHHFVDSGTTMSEKPMPVAENSKELGTLEPPNVSFNTLLEELSMFLILSW

SEQ ID NO: 120090 - protein, 97 aa, Glycine max
  Coding DNA Sequence Number=SeqID_3312
  Gene Ontology: Mol. function=pepsin A activity; Biological process =proteolysis
  Homolog annotation: Hit_ID=Q2HUN7; Match level="QueryCoverage=69%, HitCoverage=31%, E-value=6e-19, Identity=63%"; Hit description =Peptidase M, neutral zinc metallopeptidases, zinc-binding site; Peptidase aspartic, catalytic
MAFAHEPLHLLLLLSLSRCCFSSTNTISSGKPQRLVSKLIHPGSVHHPHYKPNETAKDRMELDIQHSAARLANIQARIEGSLVSNNDYKARVSPSLT

SEQ ID NO: 120091 - protein, 83 aa, Glycine max
  Coding DNA Sequence Number=SeqID_3313
MAVSAIDDNNGGRRSNVKEKRTSRKKLSVEDEAEMRRRTTPTVLCRNAKNNEGIETPRSRNAKSSEEDGITATHKKKIEEADE

SEQ ID NO: 120092 - protein, 128 aa, Glycine max
  Coding DNA Sequence Number=SeqID_3314
  Gene Ontology: Biological process=regulation of GTPase activity
  Homolog annotation: Hit_ID=Q8L7A4; Match level="QueryCoverage=74%, HitCoverage=24%, E-value=2e-37, Identity=81%"; Hit description =Putative GTPase-activating protein
MGHLLILPFVDDTQHKQMLVEISWASLQNFLDINMLVYDKDTFSTDDFMGEAEIDIQPLVSAAKAYEKSSINESMQLGKWVASGDNTLVKDSIISLEEGKVKQEISVRLQHVERGVLEIELECVPLTQ

SEQ ID NO: 120093 - protein, 247 aa, Glycine max
  Coding DNA Sequence Number=SeqID_3315
  Gene Ontology: Mol. function=RNA-directed DNA polymerase activity; Biological process=RNA-dependent DNA replication
MFGVNCGFNKIEFIVTTLSPHGLEHLTVHSLLDYDNRSWRLDLLQQIFNNIDIQQIQNIHILNSNEVDARTWKLTTSGNYMISSTYLHIDDSLFNDANVKIEGNWKQIWSLPIQLKINHLIWRIQRDCLSSRVRLQSKGVQFPSTCHSCHNNLEYNWHIFFGCENIVSIWVVAGFWMEIQPLAHQAKAQTARTNGSSNPIEAEAWSLLHALTWINDQNSQNIDVEMVAKVIVDKVYNNSTGKSVLQQ

SEQ ID NO: 120094 - protein, 144 aa, Glycine max
  Coding DNA Sequence Number=SeqID_3316
MVVLESESNYEVIRGGRLKTKQPNNSFSQDDIVFIKEVTNVKEDKVRIIFKGIGPQPFLKNIFKMVKDSNTNPIVSRGEASSSEREEIKIMVPEGEFNHEVIGGGRLKAKQSNNVGSQDDIVFIKEATNVKGDKTMIIFKGIDL

SEQ ID NO: 120095 - protein, 117 aa, Glycine max
  Coding DNA Sequence Number=SeqID_3317
  Subcellular localization annotation: CTP_CleavageSite=58; ConfidenceScore=5.91e-01
MNMFSSSSRTASSFFSSSSPPVFFFFFVAIAAIVVVFRRKVWVFAFVVWVFAFGLLLRISASSSHLCFFFEVSLSFAFWFLPAMAKNAVGKLLGCLVIRKHFSDQVDPEDAYGSSDP

SEQ ID NO: 120096 - protein, 437 aa, Glycine max
  Coding DNA Sequence Number=SeqID_3318
  Gene Ontology: Mol. function=protein binding; Biological process =hypersensitive response
  Homolog annotation: Hit_ID=Q6GUF3; Match level="QueryCoverage=93%, HitCoverage=69%, E-value=1e-161, Identity=72%"; Hit description=Non -inducible immunity 1
  Pfam annotation: Domain name=Ank; Domain location=132-165; Score =17.9; E_value=0.037; Accession=PF00023.20; Description=Ankyrin repeat
  Pfam annotation: Domain name=Ank; Domain location=166-198; Score =20.1; E_value=0.008; Accession=PF00023.20; Description=Ankyrin repeat
  Pfam module annotation: Pfam domain module=Ank::Ank; Domain location =132-165::166-198
MKCKICSSIQQHILFAFCSNAGHLLDILEKVAIDDILVVLSVANICGIVCERLLARCTEMILKSDADITTLEKALPQHLVKQITDKRIELDLYMPENFNFPDKHVNRIHRALDSDDVELVRLLLKEGHTTLDDAYALHYAVAYCDVKTTTELLDLGLADVNHKNYRGYSVLHVAAMRKEPKIIVSLLTKGAQPSDLTLDGRKALQISKRLTKAVDYYKSTEEGKVSCSDRLCIEILEQAERREPLLGEASLSLAMAGDDLRMKLLYLENRGIFSHYIFFIGLAKVLFPMEAKVIMDISQIDGTSEFPSTDMYCPNISDHQRTTVDLNDAPFRMKEEHLVRLRALSRTVELGKRFFPRCSEVLNKIMDADDLTQLTCMGDDSPEDRLRKRRRYVELQEVLNKVFNEDKEEFDRSAMSSSSSSTSIGVVRPNANLAMKN

SEQ ID NO: 120097 - protein, 476 aa, Glycine max
  Coding DNA Sequence Number=SeqID_3319
  Gene Ontology: Mol. function=RNA-directed DNA polymerase activity; Cellular component=nucleus; Biological process=RNA-dependent DNA replication
  Homolog annotation: Hit_ID=Q1RTD3; Match level="QueryCoverage=49%, HitCoverage=36%, E-value=3e-66, Identity=52%"; Hit description=IMP dehydrogenase/GMP reductase
MVNWRRKKNMLRGLRVGEAWVEEPVRVKEEEEIKEAVWDCGSLKSPGSDGFNFKFIKSFWILLKNDVYRSAKEFHRNEVLPRGVNSTFIILIPKVIDPLSLKKFRPISLVGLMYKILAKRLAKVLPKIIDECQSAFLSERSLLHSALVANEVVEEVKRRKGKCVIFKVDYEKAYDSVNWEFLLYMMRRLGFCTKWVNWIKECLASGFASILVNESPTSEFKMEKDLRQGDSLAPFLFTMVAEGFSVLMREAMEKNMFKGVLVGEKKVELVSGLKVNFAKKQFCSYRCGGKLNGNGIYSIAKKLFGESSWTLSMMVGGTLGGKRMYLNSKKRRFLLEIWDNGVLLDGSNLVKGEVDSWRWEGDAWGLFSVSSAYRVIHSRGRGSTCDDRLARGSGMCSICGSHMETVQHLFFTCPKIDSVWKHCSKWFNTLTVFPENVDMNFQHLPGEFRLKHHIQCWKVIWSAIVWCLWRTRNHCV

SEQ ID NO: 120098 - protein, 97 aa, Glycine max
  Coding DNA Sequence Number=SeqID_3320
MEKSKAQLEEEKWHVSPALWASPTWPVSPVLMAVPTWRCVANAKGDTLLSPSYVAYNATGTGGFTLAANGYGGFTLVVSGSGGFHPHNRPPPLILLK

SEQ ID NO: 120099 - protein, 240 aa, Glycine max
  Coding DNA Sequence Number=SeqID_3321
  Gene Ontology: Mol. function=translation initiation factor activity; Cellular component=eukaryotic translation initiation factor 2B complex; Biological process=cellular metabolic process
  Homolog annotation: Hit_ID=Q9SPU4; Match level="QueryCoverage=87%, HitCoverage=50%, E-value=6e-61, Identity=58%"; Hit description =Putative translation initiation factor 2B beta subunit
MPDVQALVNDFVNLLKKRRIEGSQATAKQTAVLLRSVISQQRVPHTNQATVLINAVRAVGEQIIDVNPIELAVGNIVRRVLHIIREEDLSLVTDAVAGFGMFAGSDDEDDVERDDYPALSAASVAAAARSTSRPPSLQTLLEDVTDSAVVPPTPSSGGDSEGISRTLEKGSSGRKLKHDVIEAVNELIQDITSCHEQIAEQAVEHIHQKFVSPELLEIYCLSLATLKILKTCHTRSQKPD

SEQ ID NO: 120100 - protein, 95 aa, Glycine max
  Coding DNA Sequence Number=SeqID_3322
MIESFQQQQQMSVLELYVEKDVAGGSMFHVANSVTSCGRNVSHHESELPRNISNLHVDEDDDDDDDDDYLTSNSYVDESFDEDDSDDGLSHTDDE

SEQ ID NO: 120101 - protein, 217 aa, Glycine max
  Coding DNA Sequence Number=SeqID_3323
  Gene Ontology: Mol. function=translation initiation factor activity; Cellular component=cytosol; Biological process=cellular metabolic process
  Homolog annotation: Hit_ID=Q9SFW0; Match level="QueryCoverage=91%, HitCoverage=49%, E-value=6e-95, Identity=85%"; Hit description =Putative translation initiation factor EIF-2B beta subunit
  Pfam annotation: Domain name=IF-2B; Domain location=2-191; Score =63.8; E_value=5.5e-16; Accession=PF01008.8; Description=Initiation factor 2 subunit family
MFRDLIQSEKGEVILTLGSSKTVLEFLCAAKEKKRSFKVVVAEGAPRYQGQVLAKELAARGIQTTVIADSATFAMISQVNMVIVGAHAVMANGGVIAPIGLHMVALAAQRHAVPFVVLAGSHKLCPLYPHNPQVLLTELRSPSELLDFGEFSDLMDSATGSGSLHVVNPAFDYVPPNLVSLFITDTGGHNPSYMYRLIADYYSADDLVVKQRPTTGS

SEQ ID NO: 120102 - protein, 110 aa, Glycine max
  Coding DNA Sequence Number=SeqID_3324
MDEQFPMQHSGSFDNTYTNAYGVSETQHQSHALFQHGWFTYIGPVLAKIVALFTSLLSFKSTMKENTIPRYSSARKLTSEMDARPTPKSSSLHIQMMGYYSSPSQVIRGN

SEQ ID NO: 120103 - protein, 141 aa, Glycine max
  Coding DNA Sequence Number=SeqID_3325
MWYHVTEKPPWVLRSIYQDTPHNGYVRSLSLSKITRSPDRVTLFCENASTIWDQHRLKGALKPSSLSQHALLRACEARLTGVLSKGGKMRGVATNAYLWKTSKKTKGNRSKRKFQVRELYLRLRKVLAPLTFVSKDNNLIF

SEQ ID NO: 120104 - protein, 144 aa, Glycine max
  Coding DNA Sequence Number=SeqID_3326
MALPSYIIDLDRILFCSIQGVTDLDTVCCLALGMGWGWVSGLEYMDLPAGLAARGPVRLTRGIRGAGVDQFIRSIREDLEMLLKGSLSESHWVSEVHPLSEKDSSLSESETLDNVESESSVLSAQSVCPVMISSLLALSAFKPA

SEQ ID NO: 120105 - protein, 83 aa, Glycine max
  Coding DNA Sequence Number=SeqID_3327
MDGTIKDNVHDIENARKYLQVVGEKFKRFDKVEKAHYLTLLRKTTYDGVRGIREHVMEMVKQYNKLKIHECKARRELSYLAGV

SEQ ID NO: 120106 - protein, 258 aa, Glycine max
  Coding DNA Sequence Number=SeqID_3328
  Gene Ontology: Mol. function=DNA-directed RNA polymerase activity; Cellular component=nucleus; Biological process=transcription
  Homolog annotation: Hit_ID=Q2HW77; Match level="QueryCoverage=82%, HitCoverage=94%, E-value=2e-68, Identity=61%"; Hit description=RNA polymerase subunit, RPB5; RNA polymerase Rpb5, N-terminal
  Pfam annotation: Domain name=RNA_pol_Rpb5_C; Domain location=185-258; Score=63.6; E_value=6.5e-16; Accession=PF01191.9; Description=RNA polymerase Rpb5, C-terminal domain
  Pfam annotation: Domain name=RNA_pol_Rpb5_N; Domain location=54-148; Score=46.2; E_value=1.1e-10; Accession=PF03871.5; Description=RNA polymerase Rpb5, N-terminal domain
  Pfam module annotation: Pfam domain module=RNA_pol_Rpb5_C::RNA_pol _Rpb5_N; Domain location=185-258::54-148
MEGKRERCTVQVTVLALAWALLVLSSFTSVTEKSLTEHFIFQNAMECIAKMTKDNGSMESLRYFLSRRTLLEMLQDRGYDVVQHANLSPSLAEFRSRFGQNPNPQTLAFCVSHLSNPSNTVQVVFAGTDDIRKGTVNEICTQIADKGRLKGLILVVQSKMTSFAKKDLESLPFKVEIIRIDDLLVNITKHVLQPKYEILTDDEKKALLTKHNLDEKQLPHMLKTDAIASYYGLEKGQVVKITHRGPVVDFHVSYRCVV

SEQ ID NO: 120107 - protein, 92 aa, Glycine max
  Coding DNA Sequence Number=SeqID_3329
MTGVYLEKNVYCEKRKNKKVAVAGVSLREAYALSEQHPLSEASARLMSEENLEENLSRMHALSALSARPASHLSILAPSAPNSLSQKSLTHT

SEQ ID NO: 120108 - protein, 95 aa, Glycine max
  Coding DNA Sequence Number=SeqID_3330
MTEARQKGVRKVNENENKSTRNKWGPPRQNRGGVCHPAHPGEPGCFLQKQPPSGGRIWKAQLSKKLRKLTDCVTILPFDFRHITEFHGSHNHASF

SEQ ID NO: 120109 - protein, 203 aa, Glycine max
  Coding DNA Sequence Number=SeqID_3331
MKGVPRITSFLRSSIVVGLAKVFSNLLSVEAKLHDESRLIQRCFDDNKDDDKGDDKKLEDSRGKLKNTSRFKRKVEFKNQESRFKDQASKNQDQDSRLKIQESREDLTKISMKRCFQKLSSTWIFLKTCLPKSFYSLRVHLLGLLTENKRGYISCGSVLVEGTSTRFKENKGGYIPCGSLLVKGFLQGWKRNLKDRRSLGDWM

SEQ ID NO: 120110 - protein, 280 aa, Glycine max
  Coding DNA Sequence Number=SeqID_3332
MPFDPPLFLHNVLFWEGFVRSNGGMMLLSEVCPIRESSNDDLSHCHNGSNTTSDHVSSVPAGDVVAANGMTCHDAIDVKVIDPCPFIHPPSLLPRKLNKAKKRVPLITLPGYSWVHEEVGSYANSFLTYESIIIFLKSVECCHVDRLDGMIIKSCLVSEHVFICASLGEIHFMYMYSTLLLNLHLIVPFDKFEVDAPCRVSCGSFETPPDGTISVRDLLGFIVRAALVWDFRPPTCEVVATMHFLAAARSKRPSTTSSTQGELLVSEQGTPSSSSSSYYY

SEQ ID NO: 120111 - protein, 314 aa, Glycine max
  Coding DNA Sequence Number=SeqID_3333
MDCFQLANIIWGEGGESVDHIVPYPEVNEDVSNIKEWNQEAAATKLTKLKRPEAKTDFHERKLGSSSNLDNSGELLTSGYGTNAWPDLSLSTSANIDQGSLGTEVSKNLSELSKFSSSRGEETTQHEKDAEIFQTAHEGKEQGDFVDYGWVNIGSFDDLDQIFSNDDPIFGHASLDNSNELWSSKDVSKNAAPLPLDTPSSSGALRNRTEPLEIKEEYAQCSDESLDLNNEKIGGPASQVIENACTITAKVGNDGVRSKPPGKEQQEIGYSRRQQEVRWERRFAAMNHGLSNHRMVRINEGGRDSRHKGREGGQ

SEQ ID NO: 120112 - protein, 164 aa, Glycine max
  Coding DNA Sequence Number=SeqID_3334
  Gene Ontology: Mol. function=DNA binding; Biological process=DNA integration
  Homolog annotation: Hit_ID=Q0KIN0; Match level="QueryCoverage=49%, HitCoverage=7%, E-value=4e-22, Identity=47%"; Hit description =Integrase core domain containing protein
MTSWAGSPNDWRSTSGYYVLIGGNLISWKSKKQNVVARSTAEAEYRAMAVTTYYHFIHEKITSGENTTSFVNSNDQLTDIFTKSLQVELMRASPGAAVKLCLGDLLVMGSNPETVSLHMQGNSRLQEKTKEEGMEEHENALQGMEGPITRDRSKWIHEELARKA

SEQ ID NO: 120113 - protein, 53 aa, Glycine max
  Coding DNA Sequence Number=SeqID_3335
MPALTDTSSYFVNATDETPSTSTEKLIILITCMHETVSQDSTVIVALAYDPNG

SEQ ID NO: 120114 - protein, 179 aa, Glycine max
  Coding DNA Sequence Number=SeqID_3336
MYINPQESLERKINLLENELSSFSEKEYIINGILDLGPNPDHWAEQNKDQLLDPSHMESVCYYIGAYLANDVENPGYRIGASATTVVETKTSAADGDEAIENGDLDVVEGLLDLAAARKCIVATTSHVGGRKSHTSAALTMKPNKSLTLMVPSGGVSKLPQLTRPKLQRSPFVVLMKVV

SEQ ID NO: 120115 - protein, 115 aa, Glycine max
  Coding DNA Sequence Number=SeqID_3337
  Gene Ontology: Mol. function=catalytic activity; Biological process =metabolic process
  Homolog annotation: Hit_ID=Q1STD6; Match level="QueryCoverage=97%, HitCoverage=41%, E-value=1e-27, Identity=64%"; Hit description=CBS
LEALVNYRISGLPVIDEVWNLVGVVSDYDLLAIDSISEGKEDIATVTENVRGTVKGVKIGEWRKQLGVHIQVSITTFNELQKLLSKTNGQVVGDLMTPTPLVVHESTSLEEAARY

SEQ ID NO: 120116 - protein, 283 aa, Glycine max
  Coding DNA Sequence Number=SeqID_3338
MMVATVFGKLREYELELGRLKDEKEIDKKKKGLTLKKSTSHHEASDEDPLKNLDNENMNFLVKKFCKGRDKGNIQKNSTKNCDFTPTTYTCFECAKQGHIKLHKAYMTGDKSKFVSLRAKQNGLVTYGDNNKGRTLGYGNVGNFESSSNLEGTRPLIMEKQNVDTSQQSTMELPKEWRTSRDLSLDNIIGDINKGICGFCISNTSFLAFTMHSPLFPAFFTMMMAQVWFYFGISHLHNNVSRQLCCQRVVQVHKSVFFVIVALHLHTVELPPNIVTSSVDLGV

SEQ ID NO: 120117 - protein, 185 aa, Glycine max
  Coding DNA Sequence Number=SeqID_3339
  Gene Ontology: Mol. function=nucleic acid binding; Biological process= transposition, DNA-mediated
  Homolog annotation: Hit_ID=Q1S1X7; Match level="QueryCoverage=60%, HitCoverage=8%, E-value=1e-21, Identity=44%"; Hit description =Integrase, catalytic region; Zinc finger, CCHC-type; Peptidase aspartic, catalytic
MCHTKSLHVYRQLAPRPCSDCYLCGLSRGVVILTLDDQKQPCGLKARVGPKRWLDNAIWSLSSHTIRGMPNSLSYLLDEKNASSLWLKLKKLFMTKSIYNKLMLKRRLFGLRMIKGMPLKEHLHELNSILMELHYIDVKIKDKDLAMILLACLPPSYDNFVSSLSVGKDSITLEEVKSNLYSREL

SEQ ID NO: 120118 - protein, 100 aa, Glycine max
  Coding DNA Sequence Number=SeqID_3340
MVESEEAEEMRTRVKDIAEKARRAVEKETDSQIAITLLTTGCPTYHPCFSLTQEILKFLELGGSISWHHALREGNQVADCLAKFGLSYLTRLKKIVNSPI

SEQ ID NO: 120119 - protein, 337 aa, Glycine max
  Coding DNA Sequence Number=SeqID_3341
  Homolog annotation: Hit_ID=Q2HRX8; Match level="QueryCoverage=31%, HitCoverage=16%, E-value=4e-12, Identity=37%"; Hit description=IMP dehydrogenase/GMP reductase
  Pfam annotation: Domain name=DUF1723; Domain location=80-129; Score =42.8; E_value=1.2e-09; Accession=PF08330.1; Description=Protein of unknown function (DUF1723)
MNSLKTTTDDVVTDTESFLGESHDTSVLMDYVHHVAMTVWNGKLSSHGRKAEKFGRPAVEIESLVAATGLSPLITCSLDTGDRGLIYTFVERWHKETSSFHLSVGDVTITLDDVASLLHLPIIVQKKQELRQNNVMGHMFGYPGCETFIVANHFPSIASFIAAKDYDERKPHACYWKSGKALPVSAYHKRLDRLTSDVIIPPHPAIPSLCIEDIDDRWIQFSEYLPPSRTARDPPRHPLVVHDDTFVEPILHQQPVATIAMDEAPIDALADVEQPRHALEACQTIAERLERLINLKVVIEGTEAYTVTKECLRITKGVIAEWNVYVRSRRRRRMEDA

SEQ ID NO: 120120 - protein, 125 aa, Glycine max
  Coding DNA Sequence Number=SeqID_3342
MKLCFYTSSESEEKKGEESNEEIYPQEEGQPLMVKEECKEVSVSSKRLAKKESHFEIKTNIKEVSPLRQPPHLLLCKKTLVSIATPLRLKVIPQVKELLDKGLVRKILNPCALLVSKIGIINMKI

SEQ ID NO: 120121 - protein, 85 aa, Glycine max
  Coding DNA Sequence Number=SeqID_3343
MTQFKVRFKFNINFWFPMIHSKLNKRKRNINLLYSMVVFLCKEEYGVLLGNDWAATHEFGHNFCISNEGDDDDDDNGVIDVAPAA

SEQ ID NO: 120122 - protein, 131 aa, Glycine max
  Coding DNA Sequence Number=SeqID_3344
MVCFGGKFGSECFGLSLFLFLFSVGRESRQHTGFELAIKGKGPLQVVVSFLSLFGCEYSVLFGYLSDPKTLLSTMSDPSFLGDPTVPSSEGKDRNSHPGSRFMVSWDFGSRHVERPDMMYAKVLVWPVVQG

SEQ ID NO: 120123 - protein, 418 aa, Glycine max
  Coding DNA Sequence Number=SeqID_3345
MGGELIKIGVRKQLGGKLLHVLLKNGFWGFRGFYGFRKISENLGNLPQEASGQQAPPFFPINRGKEGRSPSVTLSRRFREQICEDFPPFFTVLHPFFVLQPGWLDTLFGEVIIESLETSTREEELRQAVASDQVPDEVRLEAVKPAYEKELQKAKFDTRSVIKVSLQGSDVATNSNFIKTDPGVAPLHSHPVAIDDELVANALLSQPMPEVDISRLESIYGATESVSFDTIKTKPKLVPVSNGNVRLYHGFRGYKLSEGKTSNQSWREKMDIGTQCLNPEMQKIELQKLNLVKLWKGVQGIDHFSYSSIETHREEKFHALSNYIGRASHIREFTSPPNLLNNIIFEHTPFERKVYPPSAIVWRRREGKASFLQMTTMTKCASTFHANFYKDKENMIEDDEDAPPTCYVKARPNRLFKH

SEQ ID NO: 120124 - protein, 108 aa, Glycine max
  Coding DNA Sequence Number=SeqID_3346
MAEDIFVFKMRADYRIGVQMTTLVSACHRARLSLADESEIETFLRSWPEDFDNFGKGISACYWTLKSDGRNDTFSRSRPEDADIFGKDADISGKGADDDVSHCMLPDP

SEQ ID NO: 120125 - protein, 483 aa, Glycine max
  Coding DNA Sequence Number=SeqID_3347
  Gene Ontology: Mol. function=nutrient reservoir activity; Cellular component=extraorganismal space; Biological process=defense response to bacterium
  Homolog annotation: Hit_ID=Q2HSU3; Match level="QueryCoverage=94%, HitCoverage=99%, E-value=0.0, Identity=71%"; Hit description=Cupin region
  Pfam annotation: Domain name=Cupin_1; Domain location=289-438; Score =133.7; E_value=5.1e-37; Accession=PF00190.13; Description=Cupin
  Pfam annotation: Domain name=Cupin_1; Domain location=43-173; Score =51.5; E_value=2.7e-12; Accession=PF00190.13; Description=Cupin
  Pfam annotation: Domain name=Cupin_2; Domain location=324-400; Score =8.8; E_value=0.036; Accession=PF07883.2; Description=Cupin domain
  Pfam annotation: Domain name=Cupin_2; Domain location=77-151; Score =2.6; E_value=0.14; Accession=PF07883.2; Description=Cupin domain
  Pfam module annotation: Pfam domain module=Cupin_1::Cupin_1::Cupin _2::Cupin_2; Domain location=289-438::43-173::324-400::77-151
MGSRMSLLMLFLVLCHGVALTMGLWRTEVEEREEGHPRPDKLFMMLKSKRVAQTDAGEMRVLESYGGRILERRLNIGFINMEPRSLFIPQYIDSTLIIFLRSGEAKLGFIYKDKLAERHLKMGDVYQIPAGSAFYLVNIEEAQKLHIICSIDPSESLGIDIFQSFYLGGGAHPASVLSGFEPQILETAFNASGEELRKMFTRQHEGPIVHVGDSHATSIWTKFLQLKEEDKLQHLREMVQQEQEEEEEEFVAEEEKQTSWSWRKLLESVFGDEIKNTREKVTKKSPHSCNLYDRKPDFKNSYGWSVALDGSEYSPLKSSGVGIYHVNLSAGSMMAPHVNPRATEYGIVLKGSGRIQIVFPNGSNAMDAHIKEGDVFFIPRYFAFCQIASRGEPLEFFGFTTSAQKNRPQFLVGATSLMRTMVGPELAAAFGVSEETMNRVARAQHEAVILPTPWAAHAHDHKVKEEVVVDIFQKLARNEIMGF

SEQ ID NO: 120126 - protein, 81 aa, Glycine max
  Coding DNA Sequence Number=SeqID_3348
MWGVELNLLLSFTKIFYKDIRPTNKKPIISLVKSVLSLFHYYLCYLNHGYSIRSSSSHMNYSQLSFTFTYTTSSRIHQSSN

SEQ ID NO: 120127 - protein, 274 aa, Glycine max
  Coding DNA Sequence Number=SeqID_3349
  Gene Ontology: Biological process=multicellular organismal development
  Homolog annotation: Hit_ID=Q6L463; Match level="QueryCoverage=70%, HitCoverage=62%, E-value=3e-22, Identity=64%"; Hit description=LOB domain protein 1, putative
  Pfam annotation: Domain name=DUF260; Domain location=30-206; Score =138.0; E_value=2.5e-38; Accession=PF03195.5; Description=Protein of unknown function DUF260
  Subcellular localization annotation: CTP_CleavageSite=25; ConfidenceScore=5.27e-01
MESDTNTTFSHSSNTTPSSPPQQVQVVMIPCAACKILRRRCAEKCVLAPYFPPTEPAKFTTAHRVFGASNIIKFLQSMMISDTNSDVVTNVALLSGKNNCSTRQKTSPTSFYICILFRVPGDKLIDDKTSLQRMEYLILHDPIKLQQRRQINELPESQRADAVASMVYEAGARIRDPVYGCAGAICHLQKQVNELQAQLAKAQAEVVNMQFQQANLVALICMEMAQTQTPQESPQQSVDNFISSPSHSSGYQNNLNFFEENTNNLNSLWEPLWT

SEQ ID NO: 120128 - protein, 94 aa, Glycine max
  Coding DNA Sequence Number=SeqID_3350
MTELKWYNHILSSVCALACAAWSTRGTSCCLMLVPSGQGFDITVGKNGLFQKTICMHVCVICMFAQDLIGGARLVELVEHTGKDKLVIIKVFCH

SEQ ID NO: 120129 - protein, 66 aa, Glycine max
  Coding DNA Sequence Number=SeqID_3351
MVLYIDWAIAAYREIAQVARFGSGGRIALGCFHLLSKVSRLDIMQLMLMLLSHFIYKAFTFINPYN

SEQ ID NO: 120130 - protein, 274 aa, Glycine max
  Coding DNA Sequence Number=SeqID_3352
  Gene Ontology: Mol. function=hydrolase activity
  Homolog annotation: Hit_ID=Q1RTJ6; Match level="QueryCoverage=73%, HitCoverage=67%, E-value=5e-98, Identity=81%"; Hit description =Sialidase
  Pfam annotation: Domain name=BNR; Domain location=117-128; Score =11.5; E_value=3; Accession=PF02012.10; Description=BNRAsp-box repeat
  Pfam annotation: Domain name=BNR; Domain location=170-181; Score=9.7; E_value=6.6; Accession=PF02012.10; Description=BNRAsp-box repeat
  Pfam annotation: Domain name=BNR; Domain location=219-230; Score=5.5; E_value=24; Accession=PF02012.10; Description=BNRAsp-box repeat
  Pfam annotation: Domain name=BNR; Domain location=78-89; Score=13.2; E_value=0.92; Accession=PF02012.10; Description=BNRAsp-box repeat
  Pfam module annotation: Pfam domain module=BNR::BNR::BNR::BNR; Domain location=117-128::170-181::219-230::78-89
MVKGKNGIHLDHTKLVDVAIGVGSMVIKLVAVGYREERENEIGENHFWVAVAAGQRSFPSLICLLSLSVAIQWSGFIKRSYDKGKTWTEREQLPSGILGPIKNKLKAGTPAWGAWVEVTTDFGRSWSKHGPIYIENEPLSVIQPVPYQTADGKLRVLLRSFDGIGRVCMSESSDGGKTWGYAKPTQLPNPNSGIDGVKLRDGQLLLAYNTVSRSVLKVALSKDDGDSWCEVLTLEDTSGMEFSYPAVIQDSDGRIHITYTYNRTQIKHVVLRPS

SEQ ID NO: 120131 - protein, 305 aa, Glycine max
  Coding DNA Sequence Number=SeqID_3353
  Gene Ontology: Mol. function=protein binding
  Homolog annotation: Hit_ID=Q69L12; Match level="QueryCoverage=82%, HitCoverage=62%, E-value=4e-82, Identity=59%"; Hit description =VirR/VirH-like protein
  Pfam annotation: Domain name=UPF0066; Domain location=113-257; Score =94.0; E_value=4.4e-25; Accession=PF01980.7; Description =Uncharacterised protein family UPF0066
MHEKKWVIGTEVMRGNIWETQWLTVSITVTVTAISISAYVLKRKWNHLNSKIEELEASLKSCSDKCASERQGRIRAQLALRKQVTQSQPKSQNLNLTSYPMIPIGVVHSCFSTRNGTPRQPLLVPLARACLVFNTTRVPPASLEGLAEYSHCWILYVFHLNTDLEKLWKHPSKSGFKAKVRVPRLKGGRKGLFATRSPHRPCPIGLTVAKFNSTPPPKYGFSVVEAVLGNMILLSGVDLVDGTPVLDIKPYLPYCDSIQEAAVPNWLMEDNLLSVASISFSDHFTSALEDCWIMANGCTPSVLTV

SEQ ID NO: 120132 - protein, 402 aa, Glycine max
  Coding DNA Sequence Number=SeqID_3354
  Gene Ontology: Mol. function=hydrolase activity
  Homolog annotation: Hit_ID=Q1RTJ4; Match level="QueryCoverage=87%, HitCoverage=79%, E-value=1e-174, Identity=83%"; Hit description =Sialidase
  Pfam annotation: Domain name=BNR; Domain location=151-162; Score =12.4; E_value=1.7; Accession=PF02012.10; Description=BNRAsp-box repeat
  Pfam annotation: Domain name=BNR; Domain location=203-214; Score=3.9; E_value=38; Accession=PF02012.10; Description=BNRAsp-box repeat
  Pfam annotation: Domain name=BNR; Domain location=256-267; Score=8.9; E_value=8.4; Accession=PF02012.10; Description=BNRAsp-box repeat
  Pfam annotation: Domain name=BNR; Domain location=305-316; Score =11.1; E_value=4.1; Accession=PF02012.10; Description=BNRAsp-box repeat
  Pfam module annotation: Pfam domain module=BNR::BNR::BNR::BNR; Domain location=151-162::203-214::256-267::305-316
  Subcellular localization annotation: CTP_CleavageSite=66; ConfidenceScore=5.40e-01
MSLFLTSVHLVFILSSIIQRAYSFSGPNSTNSGADSLGNKNSSYVKGPVVEEFTFPERSTPFNSCHASTIVEVVGKGHFLVAYFGGSSEGAPDVKIWLQTYKSGRWKSPIIADEEPNVPMWNPVLFKLPSNELLLFYKIGLDVQKWSGFMKRSYDKGITWTEREQLPSGILGPIKNKPLLLENGDLLCGSSVESWNSWGAWAEVTTDFGGAWRKYGPIYIENKPHGVIQPVPYQTAKGTLRVLLRSFTGLGRIYMSESFDGGKSWGYAKPTQLPNPNSGIDGVKLKDGRLLLAYNTISRGVLKLALSEDDGDSWHEALTLEDTLGMEFSYPAVIQASDGRVHVTYTYKRTQIKPMRLLCLFQHVRKIPTKFPALLLLLHASCCTSIRNAMGCTRKQLWEYKK

SEQ ID NO: 120133 - protein, 144 aa, Glycine max
  Coding DNA Sequence Number=SeqID_3355
MNVEQFQLHQSERLTNHQLGGSTSEKISESHSKYNPMVVSSAADETMLLQRKDGKITAGTTNAKGKGSTPTIASDKLGKAVDAGAHLSNQPRVSHLMESIEKDYVFVNSHFASLEAFSDYFEASVQDSSSHRISLFPSKRTNME

SEQ ID NO: 120134 - protein, 1036 aa, Glycine max
  Coding DNA Sequence Number=SeqID_3356
  Gene Ontology: Mol. function=protein binding; Biological process =protein metabolic process
  Homolog annotation: Hit_ID=Q1RTI7; Match level="QueryCoverage=99%, HitCoverage=100%, E-value=0.0, Identity=75%"; Hit description=IMP dehydrogenase/GMP reductase
  Pfam annotation: Domain name=AAA_2; Domain location=688-950; Score= -41.4; E_value=0.013; Accession=PF07724.4; Description=ATPase family associated with various
MRAGLSTIQQTLTPEAASVLNHSIAEAGRRNHGQTTPLHVAATLLASPSGFLRQACIKSHPNSSHPLQCRALELCFSVALERLPTSQNTSSSMEPPISNALMAALKRAQAHQRRGYPEQQQQPLLAVKVELEQLIISILDDPSVSRVMREASFSSPAVKATIEQSLNAVPSTVNSGLGFRPSAVAPVNSAPGRNLYLNPRLQQQQQQGSTAQHRGDEVKRILDILLRTKKRNPILVGESEPEAAIKEVIKKIENKELGEGAFANAHVIHLEKELPSDKAQIPARLKELGDLIETRIGNSGCGGVFVDLGDLKWLVEQPVGFGIGGGLGNMQQLTLAEAGRAAVAEMGRLVSKFGEGGAGRLWLLGTATCETYLRCQVYHPTMENDWDLQAVPITTRASLPGIFPRLGTNGFLGTSLESLSPLKTLSTTTIPPLRRASENVDPAAVSICCPQCMQSCEQEVAEMLKETEKSDTELKSEAAKPSLPQWLQNAKTNKDNGKVMDQAQNQEVNVKKRTQEIQKKWHDSCLSLHPKFHQLNVSTERLVPTSLSMTGLYNMNLLGRQFQPKIPLNKNLGTSLQLSSNPTPIHPSEHVVSPQQIPVTTDLVLGQTKPADATPEETHKEGINDFLSCLSSESQDKFDELQSKKLLDADSFKKLLKGLTEKVWWQQDAASAVATTVTQCKLGNGKRRSKGDTWLLFVGPDRIGKKKMAAALSELVSGSTNPIIIPLAQRRADGDSDAPHLRGKTALDRIAEAIRRNPLSVIVLEDIDEANILLRGSIRRAMEQGRFPDSHGREISLGNVMFILTANWLPEDFRCLSNGSPLDEEKLENLAKGGWQLRISVGKRASKRRPSWLSDEDRSLKPRKEVNSGLSFDLNEAADDAEDGRGDGSLNSSDFTVEHEDNNHDVGGSLSAVPRELLDSVDDAIVFKPLNFDLLRRNFSSSIIKRFSAVVGNGVSIEVQGEALDKITSGVWLGQTTIDEWMDKALVPSFHQLKKNLNSTTHDHNSSMLFRLEDDGYSDRWGSQEWLPATVRVVGE

SEQ ID NO: 120135 - protein, 48 aa, Glycine max
  Coding DNA Sequence Number=SeqID_3357
MKPRLYQIAIVINLYIIPHLVFFVLPSHTNFQTKELRRSEFLITPEDT

SEQ ID NO: 120136 - protein, 71 aa, Glycine max
  Coding DNA Sequence Number=SeqID_3358
MTVMEVVILVMSVVMVTHRDNDCSGDDKCGIDGSDNDGDSYCVNGGGDERGDISSDDGNSDIDGSDDSGVF

SEQ ID NO: 120137 - protein, 54 aa, Glycine max
  Coding DNA Sequence Number=SeqID_3359
MNDLVDKGIVIVPADEVESLARRGDGTVVNVFDCGGRLTRKGIVDKGILVIILM

SEQ ID NO: 120138 - protein, 224 aa, Glycine max
  Coding DNA Sequence Number=SeqID_3360
  Gene Ontology: Mol. function=ionotropic glutamate receptor activity; Cellular component=membrane; Biological process=ion transport
  Homolog annotation: Hit_ID=Q84QE2; Match level="QueryCoverage=81%, HitCoverage=18%, E-value=1e-29, Identity=39%"; Hit description =Avr9/Cf-9 rapidly elicited protein 141
MAKCFSSLLSWFLIFLFVLLHTQTGYGSNATSKSEAIINLRVGVPLKNGFPQFVNVVWDSHEKKYNVSGYCIDVFYAVVNILPFKVSLDIQPFEVESRDNSGAGSYDSLLQQIPAKYDVVVGDITILANRSNMVDFTLPYTGSGFKMLVTVQHGRQQTMWIFVKPFSWDLWLSIVIISTFIGVSILVMERNVNAPTDQEGLPNRKKLSPATILWFPISQAILPE

SEQ ID NO: 120139 - protein, 79 aa, Glycine max
  Coding DNA Sequence Number=SeqID_3361
  Gene Ontology: Mol. function=protein binding; Cellular component =ribonucleoprotein complex; Biological process=mRNA metabolic process
  Homolog annotation: Hit_ID=Q8LAK5; Match level="QueryCoverage=98%, HitCoverage=100%, E-value=8e-32, Identity=81%"; Hit description =Small nuclear ribonucleoprotein homolog
  Pfam annotation: Domain name=LSM; Domain location=8-76; Score=64.0; E_ value=4.7e-16; Accession=PF01423.12; Description=LSM domain
MASTKVQRVMTQPIKARIQIWLFEQKDLRIEGRIIGFDEYMNLVLDDAEEVNIKKKSRKTLGRILLKGDNITLMMNTGK

SEQ ID NO: 120140 - protein, 82 aa, Glycine max
  Coding DNA Sequence Number=SeqID_3362
MRSFNKLIYKRILVNLSMLDLDKHMKNLRLDYLKLFDAASGVGESQLTPLDPPEEQRLRSRCWVATAGPKRKGRLYGTGDLA

SEQ ID NO: 120141 - protein, 148 aa, Glycine max
  Coding DNA Sequence Number=SeqID_3363
MAGTNFEGLCGGSNSELKLRREEMDQSRVDGLILKDELRTETNMLAIIGKYQEELNLATTHEHKVADEYARVYAEKETRGRVIDSLHQEAMMWMDQFALTLNKSQELHRLLAKAKAMANTYSAPKEIHRLLRYCQHMIDLMTHIIRSH

SEQ ID NO: 120142 - protein, 45 aa, Glycine max
  Coding DNA Sequence Number=SeqID_3364
MEFAELENLEEAMLQFAIEASLRHGMRQRCQLCGDFFVDHDISMK

SEQ ID NO: 120143 - protein, 112 aa, Glycine max
  Coding DNA Sequence Number=SeqID_3365
  Subcellular localization annotation: CTP_CleavageSite=29; ConfidenceScore=5.23e-01
MQIQTLPLPCSPPKPITTISPPPPSKLARRSHSMAPEKIEIFKSLEGWASQQPLSFLPKHCKRDLEATNLLDGALEVTDLFIDLSGVPARVCCHNWNQHGLEDDNLVGLLPE

SEQ ID NO: 120144 - protein, 66 aa, Glycine max
  Coding DNA Sequence Number=SeqID_3366
MDDIRENVSVLTLLAEVLCLLDMINVISINMFLINLNLYRLTKPLQKLRQSVAKKLKNAKKNKGSS

SEQ ID NO: 120145 - protein, 94 aa, Glycine max
  Coding DNA Sequence Number=SeqID_3367
  Gene Ontology: Mol. function=acyl-[acyl-carrier-protein] desaturase activity; Cellular component=chloroplast; Biological process=fatty acid biosynthetic process
  Homolog annotation: Hit_ID=P32061; Match level="QueryCoverage=92%, HitCoverage=22%, E-value=1e-36, Identity=80%"; Hit description=Acyl -[acyl-carrier-protein] desaturase, chloroplast precursor
MELPDEYFVVLVGDMITEEALPTYQTTMNNLDGVRDEYGACQSPWAVWTRAWSVEENRHGDLLKTYMYLSGRVDMERVEKTIHYLIASGWVSTE

SEQ ID NO: 120146 - protein, 120 aa, Glycine max
  Coding DNA Sequence Number=SeqID_3368
MGETHEVPRDCTLANFEPHLGYAIKGQAFCGIPMPNTSGGPQYHPQPQPLHFALERLPPTMLEREKFDHIEERLRAIEGGENYVFADMAELCLVPDVVVPPKFKVPDFDKYKGTTCPKIT

SEQ ID NO: 120147 - protein, 101 aa, Glycine max
  Coding DNA Sequence Number=SeqID_3369
MIIFICNTLYDDGGSHVCGDDTGGISDHIGGDDDSYGDDHDDGDSGCHVGGDDSDHDGYYDHGSRDNNNNGHVGGDDDDCDGNHGGGDGGDCDCGDDFDIN

SEQ ID NO: 120148 - protein, 267 aa, Glycine max
  Coding DNA Sequence Number=SeqID_3370
  Gene Ontology: Mol. function=ionotropic glutamate receptor activity; Cellular component=membrane; Biological process=ion transport
  Homolog annotation: Hit_ID=Q84QE2; Match level="QueryCoverage=91%, HitCoverage=25%, E-value=1e-52, Identity=42%"; Hit description =Avr9/Cf-9 rapidly elicited protein 141
  Pfam annotation: Domain name=Lig_chan; Domain location=55-267; Score=- 2.6; E_value=1e-10; Accession=PF00060.17; Description=Ligand-gated ion channel
MEQEYDVVVGDVTILANRSNFVDFTLPYTGSGVKMLVPAQHGRKQTMWIFVKPFSLDLWLSIVIISTFIGVSILIMERNVDALPHHEDSPNRTKLSPATILWFPISQAILPERQVVVKNCSRFVLMVWLLLAFVLMQSYTANLTSILTLEQLRPSFPGKGDYYVGYQTGSFVKDVLVKQFNFLPSKLRPYSNSAEYYNALKSGSQGGGVAAIFDDVPYLKVFLQEYGSKSSYILAGQTFRDDGFGFVSASSLFLILEQSTVAFAFGV

SEQ ID NO: 120149 - protein, 56 aa, Glycine max
  Coding DNA Sequence Number=SeqID_3371
MGSSLAMGCSFRFDVCVCGCCEGGVKRDEGWFCWSKEAIVVVVDMRVVETMVVVKE

SEQ ID NO: 120150 - protein, 38 aa, Glycine max
  Coding DNA Sequence Number=SeqID_3372
MVVLVGYEWKYYEVGGISGKVSYGTMYTCERTVCNPTH

SEQ ID NO: 120151 - protein, 46 aa, Glycine max
  Coding DNA Sequence Number=SeqID_3373
AFPLNSNLTAYFSRAILKVTESDLMKEIEEKYFGKNDVLEQISFNL

SEQ ID NO: 120152 - protein, 140 aa, Glycine max
  Coding DNA Sequence Number=SeqID_3374
MKISAYMFDAKYIGDNEIDLGHMKLNYAFIEDYLTVVEKDDFVKKYPEFEEKRILRDGREFYIANNLSKLVFDNGTIDPNSCITNGAPLLKKKTSKNYFLKVEFILDQSNQISNIVVSDIEEDDIRQQVIQSIKRCGQVL

SEQ ID NO: 120153 - protein, 135 aa, Glycine max
  Coding DNA Sequence Number=SeqID_3375
LRAIKGGEDYAFANLEELFLVPNIITPPKFKVLDFDKYKGTTCPVNHLKMYCRKMGAYAKDEKLLMHSFQGSLTGGSVSIMALDRMQLLNICKKGARTFQRIRPKVEGSGSPSGTPNDGKGDDNRNGRHITSILL

SEQ ID NO: 120154 - protein, 126 aa, Glycine max
  Coding DNA Sequence Number=SeqID_3376
MLFGSCLGDLDGGGERGVVHDDVVVARSLLLCAHRGGSGWSWCARAMTGLGRELLHLYHTTFLDTVDSTCVVDNLVDDFVVVIIGLGRGGRRQWCIGMVGGGGKVVVVSIGEREEGKKGKKVMMWH

SEQ ID NO: 120155 - protein, 378 aa, Glycine max
  Coding DNA Sequence Number=SeqID_3377
  Gene Ontology: Mol. function=acyl-[acyl-carrier-protein] desaturase activity; Cellular component=chloroplast; Biological process=fatty acid metabolic process
  Homolog annotation: Hit_ID=Q9XFC1; Match level="QueryCoverage=99%, HitCoverage=97%, E-value=1e-174, Identity=78%"; Hit description =Stearoyl acyl carrier protein desaturase Lldd3A20
  Pfam annotation: Domain name=FA_desaturase_2; Domain location=44-376; Score=732.4; E_value=3e-217; Accession=PF03405.5; Description=Fatty acid desaturase
  Subcellular localization annotation: CTP_CleavageSite=25; ConfidenceScore=5.11e-01
MQIQTLPLASPAPRITRHHFPRPPKCAVTATPPPLKERRNHSMPPEKIEIFKSLEGWASQRVLPLLKPVEQCWQPQKFLPDSTLPFDEFIEAVRSLRHRTKELSDEYFLVLVGDMVTEEALPTYQTIMSGLDGVGDKCGSNPSPWAVWTRAWSAEENRHGDLLRTYLYLSGRVDMKMIERTIHNLIAAGMDPGFENNPYLGFVYTSFQERATFVSHGNTARLAKEGGDPVLACICGTIAADEKRHENAYSRIVEKLLEVDPTGAMLAIGTTMEKKITMPAHLMYDGEDPRLFEHYSTVAQRMGVYTAKDYADILEFLIGRWRLEKLEGLTAEGKRAQDFVCGLAPRIRKLQERADERARKMKPHGVKFSWIFNKELHL

SEQ ID NO: 120156 - protein, 70 aa, Glycine max
  Coding DNA Sequence Number=SeqID_3378
  Subcellular localization annotation: CTP_CleavageSite=36; ConfidenceScore=5.68e-01
MPSTSQGPKKGRMSSSKGPRTKLGYSSFFRYSSFFLAASASIIFLLQELLQSSLQLTSPPLFQALLSYVE

SEQ ID NO: 120157 - protein, 111 aa, Glycine max
  Coding DNA Sequence Number=SeqID_3379
MQQGQADILIARFPDPNYGVRTITFTKSLFLGFFKGSAKHIMVVPKSEKMQRQAETNKEQEYNHGYLKENHEGQTGTSFSTETARQVWKIPLRLKGSSRCGVSTENNGGSW

SEQ ID NO: 120158 - protein, 144 aa, Glycine max
  Coding DNA Sequence Number=SeqID_3380
MDRSWMKSSCISDEYQNEVDELLQFTKRNTPYLRGKFFCPCVNYGNGRHQSINDIRSHLICEGIIPTYTKWIWYGELPDMPQVPHIKSVDEDVGHRIEDMIRDLGQDGFQQAHSALYDKIENDSKKPLYSGCTTFTRLSAVLAL

SEQ ID NO: 120159 - protein, 64 aa, Glycine max
  Coding DNA Sequence Number=SeqID_3381
METVDPFVKFSHDLAIKDGIVAGLPFEGHNFLSIYGESLKHLLDDGLEVSDLLGASQLGDQVCS

SEQ ID NO: 120160 - protein, 54 aa, Glycine max
  Coding DNA Sequence Number=SeqID_3382
MMYAPDLTLRWNVGTIQSLSRPPDCARNCPPPIGDQPGSVFTEAASCSFLEKPH

SEQ ID NO: 120161 - protein, 98 aa, Glycine max
  Coding DNA Sequence Number=SeqID_3383
MESGDMRGYHMVIRTFRQPGANEPVDVQRLTSSSAPFAIQGQRVRWQVEIPYSHPHLSSTEVNKFDGIRMMLGVPTVGGAFLWKQPSSPGQAELTWAS

SEQ ID NO: 120162 - protein, 81 aa, Glycine max
  Coding DNA Sequence Number=SeqID_3384
MHVAPHCTSLGSYWVRTSNLPPGSLEVYAWCLSLPQCRALRLMQSYPVRALDRRLQVDWARDPREGPRVLMSLRVDFEPMG

SEQ ID NO: 120163 - protein, 122 aa, Glycine max
  Coding DNA Sequence Number=SeqID_3385
  Pfam annotation: Domain name=DUF1795; Domain location=3-122; Score =27.9; E_value=4.9e-07; Accession=PF08786.1; Description=Domain of unknown function (DUF1795)
MHYQFNEGAFALFPAGWQDTSMNILRDEATGLALIVSRGPIAEGSDFEQEFHRQWDTLRSQMGHVEQSEFTRVLAGADNTLRAIEVETAFDRNGQALWQRQLAPCGLLMKKTGHAGMPSNRA

SEQ ID NO: 120164 - protein, 76 aa, Glycine max
  Coding DNA Sequence Number=SeqID_3386
ITLNKPGVKTARGISVGDSKVQLESKYGSGAVDDSDNQYWLYYDGDGKRILFQIERGKALLVQTERCLFRYKEIEV

SEQ ID NO: 120165 - protein, 262 aa, Glycine max
  Coding DNA Sequence Number=SeqID_3387
  Gene Ontology: Mol. function=DNA binding; Biological process=DNA recombination
  Homolog annotation: Hit_ID=Q0QCC5; Match level="QueryCoverage=92%, HitCoverage=93%, E-value=1e-127, Identity=94%"; Hit description=ResA resolvase
  Pfam annotation: Domain name=Phage_integrase; Domain location=44-239; Score=168.2; E_value=2.1e-47; Accession=PF00589.13; Description=Phage integrase family
MTVPILSGQNGAYPSAQLPVAIDYPAALALRQMALVQDELPKYLLAPEVSALLHYVPDLHRKMLLATLWNTGARINEALALTRGDFSLAPPWPFVQLATLKQRTEKAARTAGRSPAGSQAHRLVPLSDNQYVSQLQMMVATLKIPLERRNKRTGRTEKARIWNITDRTVRTWIGEAVEAAATDGVTFSVPVTPHTFRHSYAMHMLYAGIPLKVLQSLMGHKSVSSTEVYTKVFALDVAARHRVQFAMPETEAVALMKQLPRV

SEQ ID NO: 120166 - protein, 393 aa, Glycine max
  Coding DNA Sequence Number=SeqID_3388
  Gene Ontology: Mol. function=DNA binding; Biological process=plasmid partitioning (sensu Bacteria)
  Homolog annotation: Hit_ID=Q93GQ7; Match level="QueryCoverage=67%, HitCoverage=94%, E-value=1e-79, Identity=51%"; Hit description =Plasmid partition protein B
  Pfam annotation: Domain name=ParB; Domain location=266-392; Score =170.5; E_value=4.4e-48; Accession=PF08775.1; Description=ParB family
  Pfam annotation: Domain name=ParBc; Domain location=130-210; Score =2.3; E_value=0.03; Accession=PF02195.8; Description=ParB-like nuclease domain
  Pfam module annotation: Pfam domain module=ParB::ParBc; Domain location=266-392::130-210
LKENIIEKLKSDYDFILVDTGPHLDAFLKNAIAAADLLLTPLPPATVDFHSSLKFVASLPALIESIEAEGQKYMLDVVLPRLDGFERCGETFDTVISANPATYDGSAEALKSSRIAAEDFAKGVFDRATVEPSTSGLQVQYFTLKTGRKVKFALMTVPAAEVGVMDGEKIEILDGSRRRAAAIEVHSALNVMVTSDKLTAEEARQLAKDIQTAKEHNIREIGLRLLSLKESGLNQKEIAEQEGLSQAKVTRAIQAATVPQELISMFPVQYELSFSDYKNLSELNDRLRENKIEYSQLVEQISLQLDSLVADDQLLEDEKKSAILKLIAKGAASLIAEPPKEKTIVSSLWDFADKDKYARKRVKGRSYIYEFNRLPKNLQNDIEEAIQDVLKRH

SEQ ID NO: 120167 - protein, 46 aa, Glycine max
  Coding DNA Sequence Number=SeqID_3389
MSDKEKCLCIAGYGKEFSASALFSWYRVVHDIWKLNCLDIVEARRG

SEQ ID NO: 120168 - protein, 116 aa, Glycine max
  Coding DNA Sequence Number=SeqID_3390
  Gene Ontology: Mol. function=ribonuclease H activity; Biological process=DNA integration
MKNAFDKKVRSCKFHEGDLVLKKVSHAVKDNRGKWAPNYEGPFVVKRDFFGGALVLTNMNGEELPSPVVATCPSAGGRRVTRGCVFLERNTRGVATHVYLRKTSEKPKKTWSTHFK

SEQ ID NO: 120169 - protein, 134 aa, Glycine max
  Coding DNA Sequence Number=SeqID_3391
MKRSKRFVEAEDEDSVVHKKKTADKKSIDGKKNEVRGESNQEKEKQIMVKNKELKDQEKEKEVENEKNEKEEKIIRMQRRVGVKKLWMKGKDHEALEGPMTRGMLKKAQHSDEDTTKGKDHEALEGPMTRDKLK

SEQ ID NO: 120170 - protein, 144 aa, Glycine max
  Coding DNA Sequence Number=SeqID_3392
MAATSGLWVVGSRGCDDPPRRYDITTLNHPSSPRLASGSPRPCNGFVPKQPARLGELIPSKLSISSPGHYRIATVIIPYIVLLFYVPRATARKVDDHNLSLCANGLDCLWKVRKADDHDLSPRANRLDCLWKAKETLIVSVERH

SEQ ID NO: 120171 - protein, 221 aa, Glycine max
  Coding DNA Sequence Number=SeqID_3393
MSLDLYKTKDQKNYFKSKDKKVLMSTSEDLDDMLFDEETYEKAKFCLMADTTSEESYSNLDVVAHQDINLLIEPDQDSKNYDTLKEKESQLLLENEKVSKEHDTLMKSFKIFGDKIQSLQLELKQLNVLYDHVKEERSNLCKECSQPHPDYDKLEINKLNLWVECESYKKTLKFINDKLEKNDNPKGQSQDEAKLYQEIQSLRENVSKFFGSIENHYKLLR

SEQ ID NO: 120172 - protein, 67 aa, Glycine max
  Coding DNA Sequence Number=SeqID_3394
MGSEIYPEVHENPRAFFSSSSPILLELLADGSSDWSLPREDCITGAPGDDRGALEVDDMANILNFFT

SEQ ID NO: 120173 - protein, 227 aa, Glycine max
  Coding DNA Sequence Number=SeqID_3395
MEKMNMHIITEGTLKAWLFIGKSHFRAWEAHPGELMLSFEGMSSPRRAGCLGTKPLHGLGEPDASLGELGSRKIQKQTFLPPSLSSDIIATRRVITSSATHNPQPTGGCHETSSLVTGPPHREEHFNWSGIFKIHLKDLIESGALNPSFVVSSRALHWTNKLERIRVSFINQSSRQGDLDTYCLVFLSVSAMRTRLGYFLMNGTALHLRVELGSCMILCIIDELSKS

SEQ ID NO: 120174 - protein, 218 aa, Glycine max
  Coding DNA Sequence Number=SeqID_3396
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=70%, HitCoverage=15%, E-value=2e-31, Identity=55%"; Hit description =Multidrug resistance-associated protein 3
MEFKDKRMKATFEILNNIRILKLQAWEMKFLSKIIQLRKTEEIWLKKFLAEELQTDVVEKLPWGSSDKAIELVDGYFSWDLSSINTTVKNINLAIFHGMRVAVCATVGSDKSSLLSCIIGEVPKISGTLKICGTKAYVSQSPWTQGKSISFQIASNYWMTVATPVSSTAEPDMRSFTLMVASTDQSALDMKIANILWAITLNLVQLLGNVEMSQAAWQ

SEQ ID NO: 120175 - protein, 1304 aa, Glycine max
  Coding DNA Sequence Number=SeqID_3397
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=85%, E-value=0.0, Identity=65%"; Hit description =Multidrug resistance-associated protein 3
  Pfam annotation: Domain name=ABC_membrane; Domain location=110-379; Score=76.6; E_value=7.9e-20; Accession=PF00664.13; Description=ABC transporter transmembrane region
  Pfam annotation: Domain name=ABC_membrane; Domain location=733-1010; Score=76.5; E_value=8.3e-20; Accession=PF00664.13; Description=ABC transporter transmembrane region
  Pfam annotation: Domain name=ABC_tran; Domain location=1082-1268; Score=144.7; E_value=2.5e-40; Accession=PF00005.17; Description=ABC transporter
  Pfam annotation: Domain name=ABC_tran; Domain location=453-624; Score= 146.9; E_value=5.3e-41; Accession=PF00005.17; Description=ABC transporter
  Pfam annotation: Domain name=MMR_HSR1; Domain location=1083-1151; Score=-20.3; E_value=0.072; Accession=PF01926.13; Description=GTPase of unknown function
  Pfam module annotation: Pfam domain module=ABC_membrane::ABC _membrane::ABC_tran::ABC_tran::MMR_HSR1; Domain location=110-379::733- 1010::1082-1268::453-624::1083-1151
MAKLASLEEPLLNGDSKVQNNSDPSKTKGNNYSIAGVFSILTFSWISPIITLGNEKTLEHEDLPLLATDDSAYGVFPTFRNKLESECGSVRNVTTLKLVKVLFLSTWQGILLSGLFALLYTCASYVGPFLIEIFVQYLNGEQKFKNEGYVLAMAFVAAKLVECLSQRHWMFRFQQVGVRMQSKLVAMIYAKGLTLSCQSKEVRSTGEIINLMTVDAERIGEFCWYMHDPWMCVLQVALALLILYRSVGVASIAALAATVIVMLLNFPVSSLQEKFQGKVMEFKDKRMKATSEILKNIRILKLQAWEMKFLSKIIQLRKTEEIWLKKFLASTAIIKFLFHNAPTFIAVVTFGACALIGIPLESGKVLSALATFRILQMPIYGLPDTISMIAQTKVSLERIASFLRLEELQTDVVEKLPWGSSDKAIELVDGYFSWDLSSPNTTLKNINLTIFHGMRVAVCGTVGSGKSSLLSCIIGEVPKISGTLKICGTKAYVSQSPWIQGGKIEDNILFGKEMDRGKYKKVLEACSLTKDLEILPFGDQTIIGEKGINLSGGQKQRVQIARALYQDADVYLFDDPFSAVDAHTGSHLFKECMLGLLKSKTVIYITHQVEFLPDADLILVMREGSITQSGKYNDILKTGTDLMELVGAHREALSSIKSLERKPTFKISSTSEEDPNSLSDFELEKNVENTNDQIDKSNDTVEPQGQLVQEEEREKGRVGFKVYWKYITTAYGGTLVPFILLSQTLTISFQIASNYWMTVATPVSATAEPDIRSFTLMVVYVALAVGSSIFTFARAFLAAIAGYKTATVLFNKMHLSVFRAPISFFDATPSGRILNRASTDQSTLDMYIADILWAVTLNLVTLFGNIFVMSQAAWQVFIVLIPVMAACIWYQRYYSASARELARLVGTCQAPVIQHFSETISGSTTIRSFEQESRFNDINMKMIDRYSQPKLYSATAIEWLNFRLDILSTLTFACCLVFLISFPSSMTAPGIAGLAVTYGLNLNAVQTKVIWFSCNLENKIISVERMLQYTSLPSEAPLVIKDNQPDYSWPSFGEVHIRDLQVQYAPHLPIVLRGLTCTFTAGAKTGIVGRTGSGKSTLVQTLFRLIEPVAGQILIDSINISFIGIHDLRSRLSIIPQDPTMFEGTIRTNLDPLEEYTDEQIWEDFQALYMCQLGDEVRKKEGKLDSVVTENGENWSMGQRQLVCLGRVLLKKSKILVLDEATASVDTATDNIIQQTVKQHFSECTVITIAHRITSILDSDMVLFLNQGLIEEYDSPKKLLKNKSSSLAQLVEEYTRRSNSGFGN

SEQ ID NO: 120176 - protein, 140 aa, Glycine max
  Coding DNA Sequence Number=SeqID_3398
  Gene Ontology: Mol. function=zinc ion binding
  Homolog annotation: Hit_ID=Q1S5F3; Match level="QueryCoverage=35%, HitCoverage=24%, E-value=2e-12, Identity=75%"; Hit description=Zinc finger, C3HC4 type (RING finger), putative
MSALQMSHVDLEQGNGNHRRSVVGSDVSGEGSLCFSDVDDGSCYSRFYSTNGGSYDDYSFACVSDAEVGGVPHSGRASSASECSVEVEARSGKRIVGFVTWVWRVIEFGAPIELGCSCKDDLAAAHKHCAEAWFKIKGNR

SEQ ID NO: 120177 - protein, 120 aa, Glycine max
  Coding DNA Sequence Number=SeqID_3399
MKETGTTPTPLELFRRMHQRKDNTWVDRRSQLLNEAFTHTLKQLTERALAQGKPPPRRPCYHDSSSSIEWVKKQEFDELRKKMEGVINGRDGLQTKVANIERLLEQNNALIRQLMESMNR

SEQ ID NO: 120178 - protein, 72 aa, Glycine max
  Coding DNA Sequence Number=SeqID_3400
MHCCHLHLTMQWKVDKDGGGKGFECVSVSSFGHAIEVVAVVVDNVATENKIIMKSGFSRHCVDLSGDRKMHA

SEQ ID NO: 120179 - protein, 86 aa, Glycine max
  Coding DNA Sequence Number=SeqID_3401
MKHGHAAEVPRPASEAHRTRKRVRLQCDAVFAASAVTGHGWTQEAHDWTRPTKWTCAGIALERDSNEGAAAAERYAEHGGGGGGGL

SEQ ID NO: 120180 - protein, 445 aa, Glycine max
  Coding DNA Sequence Number=SeqID_3402
  Pfam annotation: Domain name=Transposase_24; Domain location=286-416; Score=20.9; E_value=6.3e-06; Accession=PF03004.5; Description=Plant transposase (PttaEnSpm family)
MMAVKDQNKGKAFKSHPTIQLARHLAEITSQIPPCVSSHAISHPTDPPARTSDVIPPPSILGVHSPCTSQPTNPDAECSLDMASEKTTSVRKKFVRQQVAEKDPNKGKASKSHPTKHRTAYLSQMTSQNPPCASRPTNSMEGAHLPARISDVSLPPSVEGVHSPCTSQPMNSDAGRTDRSFAALETQRNDAKPILYLDEQGFLPSRSAANGIGDILKRNFTDPWPSWKKIPISTRNSWFEEFLENFSVSPPDYNWAKKNFEMRGSVLMKNYLNKARTTMDKPHWIKDVVWERLCEHWTSEGFKKKSTQAKTNRASNYGASHTGGSISASQHRANMMKETGTAPTPLELFRRTHQRKDNTWVDRRSQHEAFARTLKHMTKRALAEGKPSPSELDVWCDVARSKKGKVYGLGMKSTVMATKEGEDDSQDEGEDDSEYEDDEESLSEP

SEQ ID NO: 120181 - protein, 52 aa, Glycine max
  Coding DNA Sequence Number=SeqID_3403
MNEIRNERDKLQSKVANMERLAEHNNALIQELMESMNKSSTIDEIQDEDGIV

SEQ ID NO: 120182 - protein, 46 aa, Glycine max
  Coding DNA Sequence Number=SeqID_3404
MRSDDKRVLELVNKRVTILEFLEDDGTRMEIDVPHVDSTIGWLVEP

SEQ ID NO: 120183 - protein, 297 aa, Glycine max
  Coding DNA Sequence Number=SeqID_3405
  Gene Ontology: Mol. function=monooxygenase activity; Cellular component=membrane; Biological process=electron transport
  Homolog annotation: Hit_ID=Q1SS95; Match level="QueryCoverage=99%, HitCoverage=56%, E-value=4e-76, Identity=55%"; Hit description=E -class P450, group I
  Pfam annotation: Domain name=p450; Domain location=1-297; Score= -183.2; E_value=0.012; Accession=PF00067.12; Description=Cytochrome P450
MAKEIMKTHDIIFSNRPQILVAKVAYNAKDIAFSPCGSYWRQLRKMCKEELLASKRVQCFRSIREEEVSALIKTISQSVGFVVNLSEKIYSLTYGITARAALGEKCIHQQEFICIIEEAVHLSGGLCLADLYPSITWLQMFSVVKAKSEKLFRKIDGILDNIIEDHKNRRRLGQLFDTDQKDLVDVLLGFQQPNKDIPLDPPLTDDNVKAVILVSLDSISHYSSSMCHPGFAGTETSSAVVEWAMSEMVKNPKVMKKAQAEVRRVYNSKGHVDETDLDQLTYFRNNEATPSCTNVAT

SEQ ID NO: 120184 - protein, 125 aa, Glycine max
  Coding DNA Sequence Number=SeqID_3406
MNHFAPWAVYGGGRLTHGAYFVPRLLLGKNEEPSDLLHPGCRMLPPVTENTQSERGGIYSSKTRVRTRWRLSESSTLLPWESMTKNGGGMDDEGGGVGAIRVVGGDSGGGGGFAGGSSQQNVLAR

SEQ ID NO: 120185 - protein, 48 aa, Glycine max
  Coding DNA Sequence Number=SeqID_3407
MRGSAHPQFNVGPSLASMAMGKEKGKENMENENLIHGIGGSEDPKRKA

SEQ ID NO: 120186 - protein, 133 aa, Glycine max
  Coding DNA Sequence Number=SeqID_3408
MLCLECHPIPEAVENEDDLDDVLVAGHEEDVGGGEKEMLVVVKRDAGAGEQRDAGAGEETDVGGGEEEKVGNPNNEDDNDEWFTDFSSMRKEVEVETDDHHSEELKNLISSDDEYEDVDKVYPRYNESSRVGE

SEQ ID NO: 120187 - protein, 70 aa, Glycine max
  Coding DNA Sequence Number=SeqID_3409
MSSDIGEHQHHDPGQHYLSSHFFYDRLFQLVPDFLRQLLQVFRSHGRRRAGGPWSQSKVLFDRDTGSNST

SEQ ID NO: 120188 - protein, 98 aa, Glycine max
  Coding DNA Sequence Number=SeqID_3410
MMMQRLMQNVRLECDNGQMQERYVHYDAEEMFMRCMIWIVLLAHLGAKCPMCAIKKTIWIFRLPSTKDETHIQRMCDGIMQMRKSATGGFTQHGNILK

SEQ ID NO: 120189 - protein, 93 aa, Glycine max
  Coding DNA Sequence Number=SeqID_3411
MPPHNASHNHYMQVKGVSLGFSSLVIDYTALVIDYQRPNSNYTASGHENLKKALCNRLHRLVIDYQRPPQSSSSLFKPGNRLHPLVIDYQKLS

SEQ ID NO: 120190 - protein, 115 aa, Glycine max
  Coding DNA Sequence Number=SeqID_3412
VKKRLSHEELKVTVELNSSVGLSAQLALSSNPLTRAKRKGGTKCNVAELGKQSRESPSHIEVRAHHNAYFGKRAMEATRRAAFAEIPRFCNYREISELQSYCEMLRRGGGIPLLV

SEQ ID NO: 120191 - protein, 120 aa, Glycine max
  Coding DNA Sequence Number=SeqID_3413
MSLKFPYYPELVKVFYCNLKIQDGIIISEVHGIPMVIDQSLFFSLTNLPSQGVPFEGTIVDDWKFDYSSHDARRMVCNDQAEMTGRLLAGILLPRSSNLAQASEEDLIIMWAFLTGRQID

SEQ ID NO: 120192 - protein, 124 aa, Glycine max
  Coding DNA Sequence Number=SeqID_3414
MNHFFRKVPGRGFSGSLPEEVFFRKTFGYFRKNPSSGNFPENVLPELPEEPLTGLPEVSVVSLLSPFFPASSPLVFYPKVTILSKGELGRLTSFAEKKKTRFALALPEKKKQFAEKGEQASRKE

SEQ ID NO: 120193 - protein, 500 aa, Glycine max
  Coding DNA Sequence Number=SeqID_3415
  Gene Ontology: Mol. function=monooxygenase activity; Cellular component=membrane; Biological process=electron transport
  Homolog annotation: Hit_ID=Q1SDT3; Match level="QueryCoverage=87%, HitCoverage=88%, E-value=0.0, Identity=73%"; Hit description=E-class P450, group I
  Pfam annotation: Domain name=p450; Domain location=40-491; Score =340.5; E_value=2.8e-99; Accession=PF00067.12; Description=Cytochrome P450
  Subcellular localization annotation: CTP_CleavageSite=29; ConfidenceScore=5.07e-01
MDLGHQNIPSLAILPFFLFMFTVFSLFWRTKTKPSNSKLPPGPPKLPLIGNLHQLGAMPHHGLTKLSHQYGPLMHIKLGALSTIVVSSPEMAKEVLKTHDIIFANRPYLLAADVISYGSKGMSFSPYGSYWRQMRKICTFELLTPKRVESFQAIREEEASNLVREIGLGEGSSINLTRMINSFSYGLTSRVAFGGKSKDQEAFIDVMKDVLKVIAGFSLADLYPIKGLQVLTGLRSKVEKLHQEVDRILEKIVRDHRDTSSETKETLEKTGEDLVDVLLKLQRQNNLEHPLSDNDIFSAGSGTSAKTSEWAMSELVKNPRVMEKAQAEVRRVFGEKGHVDEANLHELSYLKSVIKETLRLHIPVPFLLPRECSERCEINGYEIPAKSKVIINGWAIGRDPNHWTDAKKFCPERFLDSSVDYKGADFQFIPFGAGRRMCPGSAFGIANVELLLANLLFHFDWNMPNGKKPEELDMSESFGLSVRRKHDLYLIPSICLSFGN

SEQ ID NO: 120194 - protein, 302 aa, Glycine max
  Coding DNA Sequence Number=SeqID_3416
MAPDPESETGLGPRLKLSNMSIPELISELRDSFLSRDFDRVEEVLVARDARLTKELEEKKREIGSLRERIDFERLEKINAELELKRLREKEKGCGEKLVKSDNNNNNNNNNGFGLGGGIVVKSEKKCMDEEGVVEVVEGGKIGVLREKERGVDGLENEKGKKVVGINNSVSLNRNGGGIGASGGELGLKPVIVIVDSDDECNSQATLNKKETTSCINIIDDEHRSSSSGAPQKNLLTGLAERIGNLKRKFVSSRELDANINALDDFDSDSSCSGSSSSSSSGPYDKDLPTNHKKLRADATSP

SEQ ID NO: 120195 - protein, 498 aa, Glycine max
  Coding DNA Sequence Number=SeqID_3417
  Gene Ontology: Mol. function=monooxygenase activity; Cellular component=membrane; Biological process=electron transport
  Homolog annotation: Hit_ID=Q1SDS7; Match level="QueryCoverage=99%, HitCoverage=99%, E-value=0.0, Identity=70%"; Hit description=E-class P450, group I
  Pfam annotation: Domain name=p450; Domain location=36-491; Score =356.9; E_value=3.3e-104; Accession=PF00067.12; Description =Cytochrome P450
MDLQTLYFTSILSIFIFMFLGHKIITKKPASTPNLPPGPWKIPIIGNIHNVVGSLPHHRLRDLSAKYGPLMHLKLGEVSTIVVSSPEYAKEVLSTHDLIFSSRPPILASKIMSYDSMGMSFAPYGDYWRRLRKICASELLSSKRVQSFQPIRGEELTNFIKRIASKEGSPINLTKEVLLTVSTIVSRTALGNKCRDHKKFISAVREATEAAGGFDLGDLYPSAEWLQHISGLKPKLEKYHQQADRIMQNIVNEHREAKSSATHGQGEEVADDLVDVLMKEEFGLSDNSIKAVILDMFGGGTQTSSTTITWAMAEMIKNPRVMKKVHAEVREVFGGKVGHPDESDMENLKYLKSVVKETLRLHPPGPLLLPRQCGQACEINGYYIPIKSKVIINAWAIGRDPNHWSEAERFYPERFIGSSVDYQGNSFEYIPFGAGRRICPGLTFGLTNVEFPLALLMYYFDWKLPNEMKNEDLDMTEAFGVSARRKDDLCLIPITFHL

SEQ ID NO: 120196 - protein, 81 aa, Glycine max
  Coding DNA Sequence Number=SeqID_3418
MAHYRQDKVSSDELKLKDPRCRIQCPDILLENTGSAVQCKIKIFQKKIDLLQHQELAAQNRTRLYNHGGCTSSGPSPGLKS

SEQ ID NO: 120197 - protein, 189 aa, Glycine max
  Coding DNA Sequence Number=SeqID_3419
  Gene Ontology: Mol. function=enzyme inhibitor activity; Cellular component=cell wall; Biological process=cell wall modification
  Homolog annotation: Hit_ID=Q43111; Match level="QueryCoverage=98%, HitCoverage=35%, E-value=9e-55, Identity=52%"; Hit description =Pectinesterase-3 precursor
  Pfam annotation: Domain name=Pectinesterase; Domain location=2-189; Score=213.7; E_value=4.2e-61; Accession=PF01095.10; Description =Pectinesterase
MIYVKKGVYYENVRVEKTRWNVMIIGDDLLGVKQVVFGRNFIAGDMGFRNTIGPQKHQAVALMTSSDQVVYYRCHIDAYQNTLYAHSNCQFYRECNIYGTIDFIFGNFAVVIQNCNIRPKLPMHDQINTITAQEKTDPNMNTGISIQHCNISPFGNLSSVETYLGRPWKNYSTTLYMRSRMDGLVSPRG

SEQ ID NO: 120198 - protein, 219 aa, Glycine max
  Coding DNA Sequence Number=SeqID_3420
  Gene Ontology: Mol. function=monooxygenase activity; Cellular component=membrane; Biological process=electron transport
  Homolog annotation: Hit_ID=Q1SKI2; Match level="QueryCoverage=78%, HitCoverage=34%, E-value=2e-64, Identity=69%"; Hit description =Arthropod hemocyanin/insect LSP; E-class P450, group I
  Pfam annotation: Domain name=p450; Domain location=1-187; Score= -192.3; E_value=0.032; Accession=PF00067.12; Description=Cytochrome P450
DIFGAGGETSATTIDWAMAEMMKNPKVMKKAEAEVREVFNMKVRVDENCINEIKYLKLVVKETLRLLPPIPLLLPRECGQTCEIHGYLIPAKSKVIVNAWAIGRDPNYWTEPERIYPERFIDSTIDYKQSNFEYIPFGVGRRICPGSTFASRIIELALAKLLYHFDWKFPNGMISNPCGVYPDLSSFTGSGVYPDLSSFTGSGVIQISVTCIKRSAPSQ

SEQ ID NO: 120199 - protein, 73 aa, Glycine max
  Coding DNA Sequence Number=SeqID_3421
MGVNWIGEGVRGEVLYKGEVRKRPRARTFMENRKIFREKIILERKGCYWSYGGHIRDLKERFATSFIEDITTS

SEQ ID NO: 120200 - protein, 122 aa, Glycine max
  Coding DNA Sequence Number=SeqID_3422
  Gene Ontology: Mol. function=structural constituent of ribosome; Cellular component=ribonucleoprotein complex; Biological process =translation
  Homolog annotation: Hit_ID=Q9LK61; Match level="QueryCoverage=83%, HitCoverage=53%, E-value=7e-54, Identity=99%"; Hit description=30S ribosomal protein S10, chloroplast precursor
  Pfam annotation: Domain name=Ribosomal_S10; Domain location=25-120; Score=190.7; E_value=3.5e-54; Accession=PF00338.12; Description =Ribosomal protein S10pS20e
MWIQHAASLFFMSFFVKLSMAPKQKIRIKLRSYWVPLIEDSCKQILDAARNTNAKTMGPVPLPTKKRIYCVLKSPHVHKDARFHFEIRTHQRLIDILYPTAQTIDSLMQLDLPAGVDVEVKL

SEQ ID NO: 120201 - protein, 35 aa, Glycine max
  Coding DNA Sequence Number=SeqID_3423
MGGKEDKSYPVWIRTRMKRKHGYEGRIGEHNIVEP

SEQ ID NO: 120202 - protein, 107 aa, Glycine max
  Coding DNA Sequence Number=SeqID_3424
  Subcellular localization annotation: CTP_CleavageSite=61; ConfidenceScore=5.42e-01
MGPKSTLRLMRALGLSLASLTQSSWSLLSNALVGSLKLQKCCGRSLPLVSIQNVITCPLVRQVNDTHTKPYRLSEMMTMRIAIEFLQPGGSTSSRAAATAVELQFAL

SEQ ID NO: 120203 - protein, 47 aa, Glycine max
  Coding DNA Sequence Number=SeqID_3425
MEQNQQKLRKAVLDVSNEIGRYYNELELEKILGAIEEVEQAKCQSLF

SEQ ID NO: 120204 - protein, 52 aa, Glycine max
  Coding DNA Sequence Number=SeqID_3426
AQGETPQQPGDGWQGATDAPSPPPRPLCSSTKAGALPTTSDRLAGDQVQSQR

SEQ ID NO: 120205 - protein, 226 aa, Glycine max
  Coding DNA Sequence Number=SeqID_3427
  Pfam annotation: Domain name=Transposase_23; Domain location=129-199; Score=0.7; E_value=0.00095; Accession=PF03017.5; Description =TNP1ENSPM transposase
MAEKTKKRLEEAAQSGNTEGVIDPPSPIRSHVKWKMARTKKTGQMTFEAPKEIADRIILWKSRRHRDLSSAMDIRMSSLLPLDDQSILAVFVLLEPGLALPPEPEIGPLGPRVSTKESCVALSGNDSGTSDSENCGLYIEENLSRLVALGRLYEGSTTVHNIPLLHGQVKVCVEEVKDAEALVPVPTDDVTLLENMLSTSVFQPMLKVPTLIVLSLTSVFQKPMLT

SEQ ID NO: 120206 - protein, 95 aa, Glycine max
  Coding DNA Sequence Number=SeqID_3428
MIARSHNPYSPYLLAYDDGGGGGGSKQVRMKETSSSTLVILDSIASNRMLSQRALSRASEGEAHGCAFRRRKGARSCHQRLFVENVGKTEGNRSK

SEQ ID NO: 120207 - protein, 382 aa, Glycine max
  Coding DNA Sequence Number=SeqID_3429
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=5e-34, Identity=28%"; Hit description= UPI00006A17C9 related cluster
STLEDPTGLHVLAIRGLHVRTLRGLHALAVRGLHVLAFRGLHVLTFRGIHVLTFRGLHVLAFRGLYDLANRGQHALTFRGLQALTFRGLHALTFRGLHVLPIRGLHGLNLRGLHVLTIRGLHVLAFRGLHVLAFRGLHVLPIRGLNALTFRGLHRTTRPHLERATRPHLQRTTRPRHHRATRPHLQRISRPHLNRAVRPRHQRARRLHVLPIRGLHALTLRGLHVLAIRGLHVLAFGGLHVLAIGGLHVHTFRGLLVHAFKGLYDLAIRGLEALTFRGLHVLTIIGLQVLTFRGLHALAIRGLHAFPIRGLRVLPFTRLHVLTIKGLHALTFRRLHALSFRGLHVLTFRGLQAFTFRGLHVLAFRGLHALTFRGLHVLAIRG

SEQ ID NO: 120208 - protein, 165 aa, Glycine max
  Coding DNA Sequence Number=SeqID_3430
  Subcellular localization annotation: CTP_CleavageSite=64; ConfidenceScore=5.37e-01
MARTNYGHSAPFHPGSIVSDGTQRQIMVILRPFVIQRQSCPMTSSRVINAQRQIMVILRPLSFRSSESSDKRVETNYGAASPVINAQRQIMVILRPLSFRSSESSDKRAETNYGHSTPFVIQKQRVKWWAETNYGPIVSDGVQRQIIVILRLVSTKRNEFGSIRM

SEQ ID NO: 120209 - protein, 65 aa, Glycine max
  Coding DNA Sequence Number=SeqID_3431
MVSEMTIICLYMSSGPPPLDEKRRRMTIICLCVPSDTIVSEQQKGQYDKDCGVADKSEVLAPTYP

SEQ ID NO: 120210 - protein, 43 aa, Glycine max
  Coding DNA Sequence Number=SeqID_3432
MAPKTCSLVLASVPDRTSSIKRCINYLCKKKENHVREMMCKNK

SEQ ID NO: 120211 - protein, 82 aa, Glycine max
  Coding DNA Sequence Number=SeqID_3433
  Gene Ontology: Mol. function=transporter activity; Cellular component= integral to membrane; Biological process=transport
  Homolog annotation: Hit_ID=Q6DB27; Match level="QueryCoverage=100%, HitCoverage=26%, E-value=1e-17, Identity=54%"; Hit description=ABC transporter permease protein
MDHIAAQPFVAVARAKGMSETRVLWRHVTGNALLPTLNIAGLLLGELIAGALITETVFGRSGLGQLTQQAVNNQDIAILQAV

SEQ ID NO: 120212 - protein, 301 aa, Glycine max
  Coding DNA Sequence Number=SeqID_3434
  Gene Ontology: Cellular component=membrane
  Homolog annotation: Hit_ID=UPI00005F9C0A; Match level="QueryCoverage =90%, HitCoverage=95%, E-value=7e-96, Identity=68%"; Hit description =COG0697: Permeases of the drug/metabolite transporter (DMT) superfamily
MNTLLYLAVVLIWGTTWIAITLQQEGPVAIPVSIAYRFAISAAVMFAVLLLTRRLRRLAPRDHLFCVLQGCCVFGFNFFCFYHAAAYISSGLESVIFSMAPQPAAGGAAGFDRHRGAVLARSGRHPHGAGAAQRHRPERARHLRLLAGQHDQHAPSAPRAGYLFHQHLRHDLRRAADGADRPGAGRIVPDRIQQPLYRLPAVPGDFRVGDRLRRLLQPARPHRRRRGGLQHPVVPAGGADHLNDLRRLSVALQRRAGPVPDPAGQPGDVRQAGAEMATARYLKTKLNPLKPLANIVIIRFC

SEQ ID NO: 120213 - protein, 91 aa, Glycine max
  Coding DNA Sequence Number=SeqID_3435
  Gene Ontology: Mol. function=protein kinase activity; Biological process=protein amino acid phosphorylation
  Homolog annotation: Hit_ID=Q9ZQR0; Match level="QueryCoverage=95%, HitCoverage=7%, E-value=2e-11, Identity=40%"; Hit description =Putative helicase
  Pfam annotation: Domain name=DUF889; Domain location=1-91; Score= -129.9; E_value=0.011; Accession=PF05970.5; Description=Eukaryotic protein of unknown function (DUF889)
MRLQGNAQLIDDQETTKFAKWILDIGDGVIGNQNDGYATIEIPEYLLITEYNDPIDAIVKSTFPYLYQHHSNPDFFKSRAILTSTNETIEE

SEQ ID NO: 120214 - protein, 320 aa, Glycine max
  Coding DNA Sequence Number=SeqID_3436
  Gene Ontology: Mol. function=RNA binding; Cellular component =ribonucleoprotein complex; Biological process=mRNA processing
  Homolog annotation: Hit_ID=Q6Z4U2; Match level="QueryCoverage=78%, HitCoverage=67%, E-value=1e-80, Identity=54%"; Hit description =Putative CRS2-associated factor 1
  Pfam annotation: Domain name=CRS1_YhbY; Domain location=113-189; Score=58.9; E_value=1.7e-14; Accession=PF01985.11; Description=CRS1 YhbY domain
  Pfam annotation: Domain name=CRS1_YhbY; Domain location=224-307; Score=59.3; E_value=1.2e-14; Accession=PF01985.11; Description=CRS1 YhbY domain
  Pfam module annotation: Pfam domain module=CRS1_YhbY::CRS1_YhbY; Domain location=113-189::224-307
RRFLSHFIPDHQYDPPFSPSPKPYYKSKKNHAEKKKKNNSENGDPNKNGAPKLPFKSNLPFDFRYSYSESDPSVGPISFRESPKFSPFGPGRIDRKWTGVSAPVQGEPDRERVEEERNRILGEPLSEVEGGVTHNMLGDIHNHWKKAEAVRIKCLGVPTLDMDNVCFHLEDKSGGKVIYRNINILLLYRGRNYDTKNCPVIPLMLWKPYAPIYPRLVKNVIEGLTYEETKEMRKSGLNSDPLLKLTRNGVYVNVVERVREAFKTQEVVKLDCIHVGTSDCKKIGVKLRDLVPCVPILFKDEQIILWRGNFKEEQPSDSQC

SEQ ID NO: 120215 - protein, 406 aa, Glycine max
  Coding DNA Sequence Number=SeqID_3437
  Homolog annotation: Hit_ID=Q1SFS3; Match level="QueryCoverage=37%, HitCoverage=28%, E-value=6e-14, Identity=31%"; Hit description =Lambda repressor-like, DNA-binding
KVKSLGIASLKELGQLMGQLQRQAFRKAYGKICDLTMAELTPTVEEFEEILGCPLEGRKPYLFSRFYPSLARISKIVKISAQELDRRKRVENGVVRVPRKCLEAKARVLASQGEWAPFIDILALLIFGVVPFPNVDGLVDRAVIDAFLAFYDRKESPVVAILADLYDTFDRRCEKNNARIVCCMPALYVWGCINYNPVLAIRQLGYPMRGAPSEEGLIPFIVRGFNSTNTGVLQRVHKACNGPIGGYNRWLKAYAQDLNWLPSLRTPKGMEIETPEEDEETKRARREEHGRNKFRGALWGSNSELKLRREERDQSRVDSLILKDELKVCLRSKRSLSQRLSETETNMLAIISKYQEELNLATANEHKVADEYARVYAEKEARRRVMDSLHQEATMWMDRFALTLNG

SEQ ID NO: 120216 - protein, 33 aa, Glycine max
  Coding DNA Sequence Number=SeqID_3438
MKDENTSPTNTRQDVSYRHDQELLHQNVAIMRI

SEQ ID NO: 120217 - protein, 77 aa, Glycine max
  Coding DNA Sequence Number=SeqID_3439
  Gene Ontology: Mol. function=transition metal ion binding; Cellular component=proteasome core complex (sensu Eukaryota); Biological process=DNA integration
MTYFGVIEEIWELNYVKLVVCVFKCKWVDSNIGVQTDDFGFTLVDLNKLAYQDVSFIMVEQAKQVFYVQDPCDERWF

SEQ ID NO: 120218 - protein, 129 aa, Glycine max
  Coding DNA Sequence Number=SeqID_3440
MALARDFCKETTHGAFWFRIGSKIPLAIYTLGMIAKYLDVLEIPGCARMQFSIAKVLRVCMKWPRGSLPQRGPGRTRQPKELVPLRSMTITALGALYTSSASRPSRDGRFSGSDASSSGTTSILISRRK

SEQ ID NO: 120219 - protein, 312 aa, Glycine max
  Coding DNA Sequence Number=SeqID_3441
  Homolog annotation: Hit_ID=P55886; Match level="QueryCoverage=63%, HitCoverage=93%, E-value=1e-73, Identity=71%"; Hit description =Hypothetical protein yigA
  Pfam annotation: Domain name=DUF484; Domain location=52-273; Score =137.0; E_value=5.2e-38; Accession=PF04340.3; Description=Protein of unknown function, DUF484
  Subcellular localization annotation: CTP_CleavageSite=40; ConfidenceScore=5.30e-01
MNAARAKPRRAAAAPAPQWPAAFSRAFWRRKCASICPAARCISPGKGPTDSAVLLDDQAVSAWLRHNPDFFIRNARQVEQMMVPHPVRGSVSLVEWHMARQRNHIQQLEEEITLLMEQATANHQLFDRLLALQSHLAAADSLQEMLTRLHRWARELGLAGANVRLFSDRWRIGAPSDFTQLGLSRQAFEPLRIQRFGKSRRIGGDVADGRAGRSRRTALQQPRQPALSGGHGHAAAAASGTNAARPAVSLGGARMSSASPLLPAVEGFLRYLKVERQLSPLTQKNYQRQLQALIAMADDMHITAWSQLEPAQ

SEQ ID NO: 120220 - protein, 72 aa, Glycine max
  Coding DNA Sequence Number=SeqID_3442
MPKSSPNMHVNQEVSTRVKSRLLCKQSMGQNTPNKIDDDGSKSHQGEKQGFQFTKCQETPISKTITHYLYIN

SEQ ID NO: 120221 - protein, 120 aa, Glycine max
  Coding DNA Sequence Number=SeqID_3443
MMKVYGKTFLQAECESNALFNVIMATDPTSPPQSDGQSEATSKRSRTTTRLRTLTLRTVDQPRPAVYVDPATGRASGPMREKFHSYLGVVAREKVPIIHNNWKDVPETLKDIVWNDILLI

SEQ ID NO: 120222 - protein, 112 aa, Glycine max
  Coding DNA Sequence Number=SeqID_3444
  Subcellular localization annotation: CTP_CleavageSite=47; ConfidenceScore=5.33e-01
MSKIDQIMLRFRPIAPKPLPSAAALSDAFSSENTGVSKRKDNTGSKRCSRGIRRRRNAPPPPPPPPPAVTLPLLPETPDPKKTTSELKNKNVPVWLSFENSFKNRGGTASEK

SEQ ID NO: 120223 - protein, 164 aa, Glycine max
  Coding DNA Sequence Number=SeqID_3445
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q0KFL6; Match level="QueryCoverage=69%, HitCoverage=77%, E-value=7e-25, Identity=57%"; Hit description =Predicted membrane protein
MPDSAATSRISSSFMIDLNLALSCTLVDRVALTHKRKNKLKMIVAVQILLTGLGATLVMDLWSLFQKHILKIAPLNYALVGRWALWLSLGKVRHNTIAATPPLEGERFIGWLCHYLIGIAFAAVPLVLSGADWFYAPTLATALLPHLVLASRPHGLPDHGWRVR

SEQ ID NO: 120224 - protein, 309 aa, Glycine max
  Coding DNA Sequence Number=SeqID_3446
  Gene Ontology: Mol. function=isomerase activity
  Homolog annotation: Hit_ID=Q1MJE9; Match level="QueryCoverage=98%, HitCoverage=99%, E-value=1e-120, Identity=67%"; Hit description =Putative myo-inositol degradation/rhizopine catabolism protein
  Pfam annotation: Domain name=AP_endonuc_2; Domain location=31-261; Score=150.5; E_value=4.6e-42; Accession=PF01261.14; Description=AP endonuclease family 2
MTNPITITTAPCCWGVDDVKNPHLPHWERVLDEAKAAGFGGLELGPYGYLPLDLRRVSQALDERGLKIVAGTIFDDLVSPGNRDNLLRQTEEICALITRLPKPETHAGQRFSAPYLTVMDWGHDERDYAAGHSDRAPRLDKTAWRGMVENIRAIATLARDKYGVRATLHPHAGGYIEFADELQQIVEDIPADLAGLCLDTGHMAYSGMDPVATLRRYWDRVDYIHFKDIDAAVFQEVMAERIRFFEACAKGVMCPIGRGSIDYPAIRSLLTELGYGGYITIEQERDPRNTGSILDDLAASRAFLAKSGF

SEQ ID NO: 120225 - protein, 60 aa, Glycine max
  Coding DNA Sequence Number=SeqID_3447
MAKEVLPVASLEEGSSGRRKVLSEKLPKEPLPVALPKELSFGRMFCYIGRRFFRKSYWKN

SEQ ID NO: 120226 - protein, 195 aa, Glycine max
  Coding DNA Sequence Number=SeqID_3448
MAPVLMAPRGQGSAIPSSVFAFAELALEAPAAVATSGSISQYSVFTFDALEASLVPAICMETPMVMAFEGKYIALQICDDEDIETMLESFKQQDEMSVLELYIEKDVASGSMFHSANSLTSCGNYLSNDETQPATNMSNLHIEEDDDDDDDDDYLVSNSYVKESLDEDDSVDGISDTDDEVTNIPQLVRIVHPTE

SEQ ID NO: 120227 - protein, 59 aa, Glycine max
  Coding DNA Sequence Number=SeqID_3449
MAPGKLHGNATMAYGMRGGRRNEDKKKEGQFCHFIKLLSAPETLLGAPSMSLLKILKLI

SEQ ID NO: 120228 - protein, 48 aa, Glycine max
  Coding DNA Sequence Number=SeqID_3450
MVEYRAKSKTEMNRGTRRRARMDTRPVINRSLSRVRLQTIEKRYWEAP

SEQ ID NO: 120229 - protein, 262 aa, Glycine max
  Coding DNA Sequence Number=SeqID_3451
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-32, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHGLTFRGLLALTLKGLHVLAFRGLHTLAFRGVHALAFRGLHVLTFRGLHVLTFRGQHARTIKAYTPSPSEGNKPSPSEDYSSLPSQDYMSSPSEDYTSLPSEGYTSSPSDDYIGLHVLAFGGLRALAFVGLHALPFRGLHVLALRGLHTLAFRGVHVIAFRGLHVLTFRGLHVLTFRGLHTVTFRRLHVLTFRGLHVLAFRGLHALTFGGVHVLAFVGLHALAFRGLHTLAFRGVHVFAFVGLHALTFKGLH

SEQ ID NO: 120230 - protein, 325 aa, Glycine max
  Coding DNA Sequence Number=SeqID_3452
  Gene Ontology: Mol. function=sugar porter activity; Cellular component=1-2nm peptidoglycan-based cell wall; Biological process =phosphoenolpyruvate-dependent sugar phosphotransferase system
  Homolog annotation: Hit_ID=P39301; Match level="QueryCoverage=59%, HitCoverage=41%, E-value=6e-67, Identity=66%"; Hit description =Ascorbate-specific permease IIC component ulaA
MVVVIVRGQHGVELGDGERVEYEWGGAQVRLQFPHPGHALHLVAGFHQRVAVALLAGATPKIDAQVGAFFRLEPDAGAAQPPHGEGAGRDFLLLYLFVQPSAPFGKGVQYPGLAGDVVDFTHGSFLVGGDDQCTAAAGAGYTAGLHVAAQKRGGHHQRHHQDHYRFHVIAGRLRHPDRHVQTRCGEVVRGIRHQRGDFGHLCFDDGHHRTYGGRLQLGRLRGIAGIGAEHSLRTAAAYYRDSYHHAHRPHHVSAGRADRGIFLHSGLRHVDDGIVQRAIGFTVLGHHLQHDVQADAGGNGKQRLLDRASTAVRFVAGLQGRTVSR

SEQ ID NO: 120231 - protein, 54 aa, Glycine max
  Coding DNA Sequence Number=SeqID_3453
AMNSLSEHAALSEFIYTHCIEAFSEELAKRDYRAKRVHPLRMNIYPLVELPVAK

SEQ ID NO: 120232 - protein, 106 aa, Glycine max
  Coding DNA Sequence Number=SeqID_3454
MRILFYRPRFKKSKVVFQWGLLSWEPNLDIWGETNLGVKVSISGRASILFHKARVTMMIRKQRAKLVMATARWALKHPVYGIVILRLGIYTNRPNISKKLCTYGPL

SEQ ID NO: 120233 - protein, 269 aa, Glycine max
  Coding DNA Sequence Number=SeqID_3455
  Gene Ontology: Mol. function=gamma-glutamyltransferase activity; Cellular component=integral to membrane; Biological process=response to antibiotic
  Homolog annotation: Hit_ID=Q4B9J7; Match level="QueryCoverage=100%, HitCoverage=44%, E-value=1e-138, Identity=88%"; Hit description =Gamma-glutamyltransferase
  Pfam annotation: Domain name=G_glu_transpept; Domain location=1-269; Score=49.7; E_value=7e-18; Accession=PF01019.11; Description=Gamma -glutamyltranspeptidase
LAKDGARAFYEGALAERIAAFAREGGGALTEADLRAYRPEWVEPIGKRFGRHTIHEIPPNGQGIAALIALGIAEHAGVTEWPVDSVDSQHLQIEAMKLAFADVYRYVADPRAMEVTPEQMLDDAYLAERAKLIDRARATHFAAGRPHSGGTIYLSAADERGMMVSFIQSNYMGFGSGLVVPGTGIALQNRGHGFSMDPASPNVVAGGKRPFHTIIPAFVTEEANGRTEAVMSFGVMGGDMQPQGHLQTIVRRLDYHQNPQAACCAPRWK

SEQ ID NO: 120234 - protein, 49 aa, Glycine max
  Coding DNA Sequence Number=SeqID_3456
MNPNGCRETRGTGTREVARKPRQDFNIQKAPKFLLISTPNCKEKPFSES

SEQ ID NO: 120235 - protein, 188 aa, Glycine max
  Coding DNA Sequence Number=SeqID_3457
AKRESAAMASKKRKAPSTPSQVRYDQSRFTSQEAWERYTDIIVPRKLLPERNVVVYYTEFDEFKEELKRRHWDEELTDFADCSIDVAIVKEFYANLYDPEDKSPKGFELNADGQPLKILRKNITNLAQTWSILSFSNLIPTSHTFDVTLDRAKLIYGIIMKMHMNVGSMQGQRNPIRFKIPEEPEHCH

SEQ ID NO: 120236 - protein, 77 aa, Glycine max
  Coding DNA Sequence Number=SeqID_3458
  Homolog annotation: Hit_ID=Q6Q2Z9; Match level="QueryCoverage=67%, HitCoverage=5%, E-value=3e-16, Identity=75%"; Hit description =Phosphoenolpyruvate carboxylase
MTDITDDIAEEISFQGFEDDCKLLGNLLNDILQREAGSTFVDKLEKIRVLSQSLVLFGCGENGRRLKHDMRNAFRLS

SEQ ID NO: 120237 - protein, 260 aa, Glycine max
  Coding DNA Sequence Number=SeqID_3459
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=3e-36, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPLPSEDCTSSPSEDCPSSPLEGCTPSPSKGDTGLHVLATRGLHVLTFRGLHAFAFRGLHTLAFRGLHARTFKRQHVLNISGLHAHAFRGLHVLAFTRLHVLTIRGLHALTFRGLHVLTFRGLHVLTFRGLHALAFRGLHVLTSKGLHALACRGLHVLTSKGLHALACRGLHVLAFRGLHTLAFRGRHVLNFSGLHAHAFKGLHVLAIRGLHVLAFRGLHVLTFRGLHAFAFVGLHVLNFTGLHALTFRGLHVLIFRGLH

SEQ ID NO: 120238 - protein, 632 aa, Glycine max
  Coding DNA Sequence Number=SeqID_3460
  Gene Ontology: Mol. function=siderophore-iron transporter activity; Cellular component=outer membrane; Biological process=siderophore transport
  Homolog annotation: Hit_ID=O86424; Match level="QueryCoverage=99%, HitCoverage=87%, E-value=0.0, Identity=59%"; Hit description =Ferrichrome iron receptor
  Pfam annotation: Domain name=Plug; Domain location=2-89; Score=62.4; E_value=1.5e-15; Accession=PF07715.5; Description=TonB-dependent Receptor Plug Domain
  Pfam annotation: Domain name=TonB_dep_Rec; Domain location=395-632; Score=86.1; E_value=1.1e-22; Accession=PF00593.14; Description=TonB dependent receptor
  Pfam module annotation: Pfam domain module=Plug::TonB_dep_Rec; Domain location=2-89::395-632
MDMRQPDTVKGALAYTPGVMIGNRGASTAYDAVNIRGFSSVGTNMYLDGLKLQDDNYSIYQIDPYFLERAEVLRGPSSVLYGKSNPGGVVALVSKRPTTETLREVQFKMGTDNLFQTGFDFSDALDDAGVYSYRLTGVARDEDQQQVGEKSKRYAIAPSFSWRPDDRTSLTFLSSFQDDPSVGFYGWLPKEGTVQNGINGKLPTSFNDGEPGYNNISRKQQMVGYAFEHSFDDVWTVRQNLRYSKMDVDYRSIYGLGIDPDNSAELKRGVMNSKEHMSSFAVDTQAQAKFATGQVDHILLMGVDYMRMRNDVVYQYGSASNLNVIAPQYGNRSYTITGGASQVNRQEQTGLYVQDQAEWNNWVLTMGGRYDWSDTNSTNRLNQNSVSKQQDNQFTGRAGLNYVFENGIAPYVSYSESFEPTSGTDFSGNTFAASKGKQYEAGVKYAPKDRPITASVALYQLTKTNNKVADLEHPFFSVQGGEVRSRGIELEAKAALSANLNLLGSYTYTDAEYTKDTSLQGNTPSAIPKHMASLWADYTFHETAISGLTLGSGVRYVGSSYGDEANTFKVKDYTVFDAAIKYDLARFNLPGSSIGINVNNLFDKEYVSSCFATYGCYWGAERQVVATATFRF

SEQ ID NO: 120239 - protein, 85 aa, Glycine max
  Coding DNA Sequence Number=SeqID_3461
  Subcellular localization annotation: CTP_CleavageSite=64; ConfidenceScore=5.15e-01
TYQGNPSGVYPDLSSLTGGGVYPDLSSFTGSGVYPDLSSFTGSGVIQIFVTCIKRSAPTQVHINAGVGRHTTSVELVRKNLIDVH

SEQ ID NO: 120240 - protein, 136 aa, Glycine max
  Coding DNA Sequence Number=SeqID_3462
  Gene Ontology: Mol. function=nucleic acid binding
QMPLYSKFLKDMLTRKHKYIHQENIIVEGNCSAVIQKILPPKHIDPGSVTIPCSMGEVTVGKALIDLGAIELAKRTYCAKQVYHLRMNTHPLAEIPVAKRALLAKLPYLVYFVNCMVPLSAAYEELSAYPCGRHLA

SEQ ID NO: 120241 - protein, 79 aa, Glycine max
  Coding DNA Sequence Number=SeqID_3463
  Subcellular localization annotation: CTP_CleavageSite=23; ConfidenceScore=5.10e-01
MALRSANMHNSSFFQILPRAQLRSFALSGWLAKPTGWLSERNQKDFPRLVVRLGYKNSLVFLGFKGLDSKRAQILDLSM

SEQ ID NO: 120242 - protein, 255 aa, Glycine max
  Coding DNA Sequence Number=SeqID_3464
MDNILGRNIVPGRKVEIYHTELDDLKTKLERRNFHKRLSNLVDGSIDLALVKEFYANLYRSEGPSPKQVRVRGHLVKIDVDSLNTFLETPVVLADGETLPTYSKYCRLPIDYREIEAALCIPGRGFILNIEGHPGKILRKYLTTLAQVWSVLSYSNLAPTSHISDLTVDRARLIFGLVSRMDMNLLSEGLGGRGRDQLSFLPHLQLLLQHPLRQLLLSQLIQILSALKPCFRAFIRDKSFYYRVYRWWHLQDLFL

SEQ ID NO: 120243 - protein, 56 aa, Glycine max
  Coding DNA Sequence Number=SeqID_3465
RFLDYGKLNPLLDLPYRYLIGNWSDSKVLDRICECGLIRTRLGYHEESGLAVQETT

SEQ ID NO: 120244 - protein, 106 aa, Glycine max
  Coding DNA Sequence Number=SeqID_3466
MVAGENVAKQQRHLDLREGGDAGAHDSHPSPCYAPGKVLPRNAQQLADSLLVEARGLTPPLGKLTTLAFFQDQWMPQKLVDGILIERNPLAPHPGALVSDSLFCRP

SEQ ID NO: 120245 - protein, 276 aa, Glycine max
  Coding DNA Sequence Number=SeqID_3467
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=100%, E-value=2e-34, Identity=27%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VYTPSPSEDYMSCPSEDYTLHAFAFTGLDALTFRGLHVLAFRGLRALAFVGLHALPFRGLHFLTFTGLHALTFRRLHALAFRGLHILPFRGVHFLTFRGLHVLAFRWLHTITFRGLHVLAFRGLHFLAFKGLHVLTFRGLHVLTFRALHALTFRGLHALTFRGLYVLPFRGLHILAFRGLHTLTSEDYTGLHALSLKGLHVFDFRGLHTLAFRGVHALAFRGLHVLTFRGLHVLTFRGQHALTLKGLHGLTFKGLHTITFRGIHVLAFRGHHAPRF

SEQ ID NO: 120246 - protein, 149 aa, Glycine max
  Coding DNA Sequence Number=SeqID_3468
  Subcellular localization annotation: CTP_CleavageSite=15; ConfidenceScore=5.07e-01
VDSRGSHPVRPQPVRAGAGGAGTGRVRPRTGAYRGRNAAAVHHWHARVPAANGVPVPVTAAGCRSAASGPTTSPAGPAAVAPTVASPGRTCATTATAGGWRRSARPHPCRSSDRADSGSGRGATRRAGRRWPCPLPMPGALPVSPPRCA

SEQ ID NO: 120247 - protein, 324 aa, Glycine max
  Coding DNA Sequence Number=SeqID_3469
  Homolog annotation: Hit_ID=Q1SKD7; Match level="QueryCoverage=65%, HitCoverage=58%, E-value=1e-15, Identity=26%"; Hit description =Ankyrin
MAQKKLSEKRSRRDAAAEGTSAAPEFDSHCFRSAEHQQRFEAIKGWSFHRERRVQLRNDEYTDFQEEIARQRWTSLVTPMAKFDPDIVLEFYANAWPTEEGVRDMRSWPVPGDPLVLEEGQECEFSQRRNRADGFDEEAIAQLLCIPGQDFAQTAAGWRVRIMHTSITTLTQICMTLLLSNVLPSDHNSDLPLPKCQLVYAILTRMSVHVAQLIADAIYLFAGMSPTRHPLDPDKSNRALGFPKLITGLCQSFGVPVTPSKVIRPPITRAFIEKYCTPRQAQGDAPQAAHAPPPPHQADPAESLGMEQYLQHLVRQQAANHTGA

SEQ ID NO: 120248 - protein, 142 aa, Glycine max
  Coding DNA Sequence Number=SeqID_3470
  Gene Ontology: Mol. function=unspecific monooxygenase activity
  Homolog annotation: Hit_ID=O04892; Match level="QueryCoverage=67%, HitCoverage=23%, E-value=2e-28, Identity=58%"; Hit description =Cytochrome P450 like_TBP
  Subcellular localization annotation: CTP_CleavageSite=62; ConfidenceScore=5.42e-01
PEVGSSGWKSTARRVVSASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLWRKSAGKEDPV

SEQ ID NO: 120249 - protein, 217 aa, Glycine max
  Coding DNA Sequence Number=SeqID_3471
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=7e-29, Identity=39%"; Hit description= UPI00006A17C9 related cluster
VDPWVLVPITLRGLHVLAIRGLHVLNLRGLHVLALRGLHVLTFRGLHALTSRGLHVLALRGLHALTLGLHVLTIRGLHALTSRGLHVLALRGLHALTLGLHVLTIRGLHALTSRGLHVLALRGLHALTLGLHVLAIRGLHALTSRGLHVLALRGLHALTLGTSYPHQGYTPSPWVLVTLTVERTTRPRLERTTRPHHQRVARPHLQRTTCPRLERTT

SEQ ID NO: 120250 - protein, 105 aa, Glycine max
  Coding DNA Sequence Number=SeqID_3472
MDDAPVSLASLTRKRRVPKIPQAFLQVALLGFPSIREKEKGLEPQFYYLQERGNSLSLDIISQIPTVFIFQNELRRNKAKLVAKEYNQEEGIDYDETYAPVVGSY

SEQ ID NO: 120251 - protein, 135 aa, Glycine max
  Coding DNA Sequence Number=SeqID_3473
MPLKVKQLVVCPQFLPQPQPLHFVAGRIPLTMAEKGKLDHIKERLRAFEGGGSYVFANTTELCLVPNITIPLKFKVSDFNKYKGTTCPKNHLKMYCRKMGAYTKDEKLLIYKTCAKGSMNLSKGTPKGGWIWQLQ

SEQ ID NO: 120252 - protein, 60 aa, Glycine max
  Coding DNA Sequence Number=SeqID_3474
MEITWNIYKLLASSSPHGIGLCPRFMVVPPPPPELGSSCNISFSLGTYGKFVANYAGMDS

SEQ ID NO: 120253 - protein, 292 aa, Glycine max
  Coding DNA Sequence Number=SeqID_3475
  Gene Ontology: Mol. function=DNA topoisomerase (ATP-hydrolyzing) activity; Cellular component=chromosome; Biological process=DNA topological change
  Homolog annotation: Hit_ID=Q3GV52; Match level="QueryCoverage=91%, HitCoverage=34%, E-value=1e-126, Identity=82%"; Hit description=DNA topoisomerase
  Pfam annotation: Domain name=HATPase_c; Domain location=42-202; Score= 92.1; E_value=1.7e-24; Accession=PF02518.16; Description=Histidine kinase-, DNA gyrase B-, and HSP90-like ATPase
MPGWRRVSLSAYGEAGKCFSVGSVLEGLEAVRKRPGMYIGSNGSPGLMHCLWEIIDNGVDEALGGFARRVEVTLHPDDSVEVYDDGRGIPTDKEPKTGLPGVEVVATKLHAGGKFGGGSYVATGGLHGVGLSVVNALSSRMDIDVDRSPARQGLSFRRGVPGVFAGEGPSAPFEPQSGLTRKGARVAKGKSGTRIQFWPDRQIFTKDAEFVLDGLIGRARQTSFIVPGLELVIRDQRAADKSEWTEEKFRHDGGIGEFCDYLATGDPVTDVLRLQGSDVFTETVPLLDDRGT

SEQ ID NO: 120254 - protein, 321 aa, Glycine max
  Coding DNA Sequence Number=SeqID_3476
  Gene Ontology: Mol. function=RNA-directed DNA polymerase activity; Biological process=RNA-dependent DNA replication
  Homolog annotation: Hit_ID=Q8H6Q8; Match level="QueryCoverage=82%, HitCoverage=48%, E-value=2e-41, Identity=35%"; Hit description=CTV.20
MEPEYWDKNPFKATAKVFPPGFHYRPTATNKTRKFYEFILIDTNFVSIKHFKDPKDPNLNTHSTIQILKVMQPRHYGSNLNQPKKFSAPFDPAGYNYWDYIDAWTNVFWHQNSKFKHSWLIYFKNNTVYNFPNWFLQWWNYFGPIPQIFPEEVQQGFQQFSKLFNSKESRIPTDLKYFSSFAMSWIFSWQYRYGKTENSKQYPPLQRHAFVKWWSQFDTSNAAPEQVKNWFQSNPEFLKPADPETSLFLNQKSQLAAFLASSKSKESLAQNLKEVLQLLQQEEEEEPPKKEAESSENNDDQEDDPFYQNEDDCFGISLDDD

SEQ ID NO: 120255 - protein, 72 aa, Glycine max
  Coding DNA Sequence Number=SeqID_3477
  Gene Ontology: Mol. function=transporter activity; Cellular component= integral to membrane; Biological process=transport
  Homolog annotation: Hit_ID=Q9SHZ3; Match level="QueryCoverage=80%, HitCoverage=11%, E-value=7e-20, Identity=81%"; Hit description =Putative membrane transporter
GDKAQVIQTLLFVAGINTLLQALFGTRLPAVVGGSFAYVIPIAHIISDSSLQRINDPHEMTCRVPWFCASWY

SEQ ID NO: 120256 - protein, 182 aa, Glycine max
  Coding DNA Sequence Number=SeqID_3478
  Homolog annotation: Hit_ID=Q1SVD1; Match level="QueryCoverage=31%, HitCoverage=6%, E-value=3e-08, Identity=47%"; Hit description=Zinc finger, CCHC-type
  Pfam annotation: Domain name=zf-CCHC; Domain location=86-103; Score =19.7; E_value=0.00056; Accession=PF00098.13; Description=Zinc knuckle
MDKSLKVGEDEWRERERERGGHEFYASNEPMSPKSTLRLMKILGHSPTPLAQSSWNFLSNALGRCPINKSGHGYEGEIYVHDEDIVVYYFCGKVGHMMSKCRDLPKKGVSNAFRTNKRGPKKIWVPKDKIIPVADVLDNRQDTPIMVPRQWFLTTHDMRKVYVQWPTPMHGGTITFKGNKKG

SEQ ID NO: 120257 - protein, 96 aa, Glycine max
  Coding DNA Sequence Number=SeqID_3479
  Gene Ontology: Cellular component=integral to membrane
  Homolog annotation: Hit_ID=Q9ZTM8; Match level="QueryCoverage=97%, HitCoverage=64%, E-value=1e-21, Identity=57%"; Hit description =PGPS/D12
  Pfam annotation: Domain name=PLAC8; Domain location=3-85; Score=52.0; E_value=2.1e-12; Accession=PF04749.7; Description=PLAC8 family
MVSMCYLCPSCRNSRQGIHIIYAACGASGALYTLICCVIGCGWLYSCFYRSKMRQQYGLKGNGCTDCLLHCCCESCTLSQEYRELKQRGFDMIIGM

SEQ ID NO: 120258 - protein, 199 aa, Glycine max
  Coding DNA Sequence Number=SeqID_3480
LVENSTVAGFAQADANFVQSQRNRELVFYRLFPEKIDKGRAADAIDWIVDRLRDGNRVATPRDLINAVDAARTYQLEDFNREPSASMDGPLLYEDSIRKSVRKISKDNLETRIYAEYPDLRSAIEKFRGGKADHNEVTLAALLGKGWANILSQLLRIGFMYKRTRSGVDMWTIPFFFSFGLDVTRGAAFEMAGSNDDED

SEQ ID NO: 120259 - protein, 76 aa, Glycine max
  Coding DNA Sequence Number=SeqID_3481
MKANKTRKELKVSDSKTYRLKNEEWMKNGGKPSQICSWKRLRSVAEAPRLGFSSRKQLFSPKTTEMHSIGVRDPME

SEQ ID NO: 120260 - protein, 291 aa, Glycine max
  Coding DNA Sequence Number=SeqID_3482
MGRQRTGRNYPKSGKNIWRPSWGQSGISFGHKIYGSDQELDTTVNYHGREFNNIRVFQISLKGFALSWWHQLPSRMIDIQADNESLRDFMGRFSQIAVMIHDLELGVALHAMIAALKPGMEELFEYRDKDNVVTTINIKSEKVNKDNKKTQTPQGAVRGVINTITGGFTCGGCMKSARNVTFEHSKDDPMVISIVIASWTVQKTLIDQGSGADILYQSMSFNGDFPPWRCMGRQRRRGEGRHHSLGNKPWNKELHHQECALDKKLEEDALMEENKERRGEHEIEGIKEGEK

SEQ ID NO: 120261 - protein, 158 aa, Glycine max
  Coding DNA Sequence Number=SeqID_3483
MKQQGRQSKSCRGVGSVNIGEHVVCVKVGDVEDARGLLEQEKVAVEFHVHHSLVHDAFMKEPRSTRLREPISASSASTLSSQSFNGLVDSNNYAKGKTSTESAYFVNLHTRLHGHSIESNLLVLLLGGEFGGFKIMMLEEMCECERCGEGCWFCTLDG

SEQ ID NO: 120262 - protein, 121 aa, Glycine max
  Coding DNA Sequence Number=SeqID_3484
MESCNVKNKSSGKRKMSSEDTRSYFAWNLEMEHVLADVLRDQRNLGNKGDGNWKAIAYSTAAQSLSKHFGVHLMADNVKNCFKLWRTWYEIDRATGLGAKNALDADDIMSKETNEEETIHS

SEQ ID NO: 120263 - protein, 80 aa, Glycine max
  Coding DNA Sequence Number=SeqID_3485
MDAKHLTRTKERSHVIKQRSPDEIRVMAKDKVDTSKPYTGSMRGTVHEPQANLGADQKYLPIDVFKQKWGGKTLGFQWID

SEQ ID NO: 120264 - protein, 38 aa, Glycine max
  Coding DNA Sequence Number=SeqID_3486
MGEAKVGSYMEVTKTSINGWKLHGSYMEVTKTSINGNF

SEQ ID NO: 120265 - protein, 46 aa, Glycine max
  Coding DNA Sequence Number=SeqID_3487
MELTPLLDLARNLRNHLGVGGITVVNRMLVYLITYIFTSRSSNHAQ

SEQ ID NO: 120266 - protein, 131 aa, Glycine max
  Coding DNA Sequence Number=SeqID_3488
MKGLQKARDARNNGVCTVPYIGPIQHKRVIAAPGVWSEWIELLNSFANENSPNVYTVNFNPSSNMESSFDVEIKYPEHSGMKTINTMGPGSYTIKATGIGNTYIRRNSRLVERSHHILVAQALEIYLQLII

SEQ ID NO: 120267 - protein, 70 aa, Glycine max
  Coding DNA Sequence Number=SeqID_3489
MGRRQRTNFFVDELRGFGGGNGASVARCQPSPGYCGVLPYACLGAQYFLMKARLMGGLMTLLGATGTLWN

SEQ ID NO: 120268 - protein, 72 aa, Glycine max
  Coding DNA Sequence Number=SeqID_3490
MENFVAEKEKLLHAHGMGYAAMKRRHWEEEVQYEQKFDEELANLMEKYSPLEKFNENRPVGGRHAYSSVSTH

SEQ ID NO: 120269 - protein, 797 aa, Glycine max
  Coding DNA Sequence Number=SeqID_3491
  Gene Ontology: Mol. function=binding; Cellular component =intracellular; Biological process=metabolic process
  Homolog annotation: Hit_ID=Q9FNN9; Match level="QueryCoverage=94%, HitCoverage=96%, E-value=0.0, Identity=42%"; Hit description =Selenium-binding protein-like
  Pfam annotation: Domain name=PPR; Domain location=110-144; Score=0.1; E_value=7.2; Accession=PF01535.11; Description=PPR repeat
  Pfam annotation: Domain name=PPR; Domain location=177-211; Score =35.4; E_value=1.9e-07; Accession=PF01535.11; Description=PPR repeat
  Pfam annotation: Domain name=PPR; Domain location=282-316; Score =19.6; E_value=0.011; Accession=PF01535.11; Description=PPR repeat
  Pfam annotation: Domain name=PPR; Domain location=385-419; Score =21.6; E_value=0.0029; Accession=PF01535.11; Description=PPR repeat
  Pfam annotation: Domain name=PPR; Domain location=458-492; Score =10.6; E_value=0.41; Accession=PF01535.11; Description=PPR repeat
  Pfam annotation: Domain name=PPR; Domain location=521-555; Score =16.6; E_value=0.082; Accession=PF01535.11; Description=PPR repeat
  Pfam annotation: Domain name=PPR; Domain location=582-616; Score =47.3; E_value=5e-11; Accession=PF01535.11; Description=PPR repeat
  Pfam annotation: Domain name=PPR; Domain location=617-651; Score =11.4; E_value=0.33; Accession=PF01535.11; Description=PPR repeat
  Pfam annotation: Domain name=PPR; Domain location=7-41; Score=5.5; E _value=1.6; Accession=PF01535.11; Description=PPR repeat
  Pfam module annotation: Pfam domain module=PPR::PPR::PPR::PPR::PPR::PP R::PPR::PPR::PPR; Domain location=110-144::177-211::282-316::385 -419::458-492::521-555::582-616::617-651::7-41
MLGRDFKTWGSVIRSLCLEARHSEALSLFHHCLKGYEAFKPDHTVLAAIFQVLFCPFGVELCIVMLLNKATFLAMLPIKGCSTWSNKCDDDVMRVFRMMHLSGEAMPNSVTVACVLPVCAHLGDLDAGKCVHGYIIKSGFGQDMLGGNALVSMYAKCGLVSHDAYAVFDNIAHKDVVSWNAMIAGLAENGLVEDAVLLFSSMVKGPTRPNYATVANILPLCASYDKSVVYRCGRQIHSYVLQWPELSADVSVRNALISFYLKVGQTREAEVLFWTTDARDLVTWNAIFAGYTSNGEWLKALYLFGSLVSLETLLPDSVTMVSILPACVQLKNLKAEKLIHAYIFRHPFLFYDTAVVNALVSFYAKCGYTEEAYHTFSMISRKDLISWNSIFDVFGEKRHHSRFLSLLDCMLKLGTMPDSVTILTIIRLCASLLRIEKVKEIHSYSIRTGSLLSDAAPTVGNAILDAYSKCGNMEYANKMFQNLSEKRNLVTCNSLISGYVGLGSHHDAHMIFSGMSETDLTTRNLMVRVYAENDCPEQALGLCYELQARGMKSDTVTIMSLLPVCTGRAYKIFQLSAEKDLVMFTAMIGGYAMHGMSEEALWIFSHMLKSGIQPDHIIFTSILSACSHAGRVDEGLKIFYSTEKLHGMKPTVEQYACVVDLLARGGRISEAYSLLTSLPIESNANLLGTLLGACKTHHEVELGRIVANQLFKIEADDIGNYIVLSNLYAADARLDGVMKVRRMMRNKDLKKPAGCSWIEVERTNNIFVVGDCSHPQRSIIYSTLQTLDQQVKEPAEF

SEQ ID NO: 120270 - protein, 472 aa, Glycine max
  Coding DNA Sequence Number=SeqID_3492
  Gene Ontology: Mol. function=metal ion binding; Cellular component =intracellular; Biological process=protein kinase C activation
  Homolog annotation: Hit_ID=Q6ZLQ1; Match level="QueryCoverage=94%, HitCoverage=82%, E-value=4e-92, Identity=43%"; Hit description =Putative pentatricopeptide (PPR) repeat-containing protein
  Pfam annotation: Domain name=PPR; Domain location=116-150; Score =24.3; E_value=0.00043; Accession=PF01535.11; Description=PPR repeat
  Pfam annotation: Domain name=PPR; Domain location=199-233; Score =46.4; E_value=9.6e-11; Accession=PF01535.11; Description=PPR repeat
  Pfam annotation: Domain name=PPR; Domain location=270-304; Score =12.7; E_value=0.23; Accession=PF01535.11; Description=PPR repeat
  Pfam module annotation: Pfam domain module=PPR::PPR::PPR; Domain location=116-150::199-233::270-304
  Subcellular localization annotation: CTP_CleavageSite=46; ConfidenceScore=5.19e-01
SLPPNLHSPLRRLIVTPRDRPLRRRRAPPLPHRRRPLPLQRRHPPRGTPRSLPRLHPLLPHAPNQCPLRPLHTLILKLGFHSNVYVQNALISSYGTSGSLHVSLKLFNEMPHRDLFSWSSLISCFAKHGFPDESLALFQQMQLLESDILPDGVVMLSVISAVSSLGALELGIWVHAFISRIGLNLTVPLGSALIDMNVVTWTTLINGLAVHGRGREALEAFYVMVESGLKPDRVAFMGALVACSHGGLVEEGRHVFSSMRSEYGVELALEHYGCVVDLLGRAGLVLEAFEFVDGMRVRPNSVIWRTLLGACVNHNHLVLAEKAKERIKELDPHHDGDYVLLSIAYGGVGNWVKKEGVRNSMRESRIVKEPGLSLVHIDQVAHEFESGDNSHPQWKEITSFLGSVIDTVKLGGYTVPLLLPLCCMTFKRKRRSIVWAITVRNWQWLLFFFIIGIERPLGSLRSLGYVMTAIVS

SEQ ID NO: 120271 - protein, 531 aa, Glycine max
  Coding DNA Sequence Number=SeqID_3493
  Homolog annotation: Hit_ID=Q2QWE9; Match level="QueryCoverage=84%, HitCoverage=77%, E-value=1e-127, Identity=50%"; Hit description =Expressed protein
  Pfam annotation: Domain name=XS; Domain location=316-436; Score= -10.6; E_value=4.8e-05; Accession=PF03468.5; Description=XS domain
  Pfam annotation: Domain name=zf-XS; Domain location=246-284; Score =43.3; E_value=8.5e-10; Accession=PF03470.5; Description=XS zinc finger domain
  Pfam module annotation: Pfam domain module=XS::zf-XS; Domain location= 316-436::246-284
MSLKRGGGRPVTVANNDMSKGKSISEPQPKVEQLTQGIADTKLNSEQDDGEWEVYARKSKNKAGSSAAKPWGPPVHNSNPRAWGNAEMVQKPGIRSHGGVGRSSGNPWQTPNANFRRPAGRGNGRPQLGTSGYESNYVTPNPVIRPPLEHGWNWQSRPGAMQSNVRDEISPEDLQKNYGVDDDGEEEESDDLEDTDDDLMSDDDDSDASQKSHETRKKSKWYKKFFEILDGLTVEQINEPERQWHCPACQGGPGAIDWYRGLQPLVTHAKTKGSKRVKIHRELAILLDEELRRRGTSVIPAGEVFGKWKGLKEEEKDHEIVWPPMVVIQNTKLEQDENDKWIGMGNQELLDYFSTYAAAKARHSYGPQGHRGMSVLIFEASASGYLEAERLHKHFAEQGTDKDAWFNRPILYLPGGNRQLYGYMATKEDLDFFNRHSQGKSRLKYDIMSYQEMVVHQIRQMNEDNQQLLYFKDKAVKGAKHTKALEESIGIMSEKLRKTMEENRIVRRRTKMQHEETKEEVILTSNRLHGY

SEQ ID NO: 120272 - protein, 141 aa, Glycine max
  Coding DNA Sequence Number=SeqID_3494
MSNLVENCTHIIIFVVPCPQLPPHGSVITLRTRISIIITSTIAELAAIKQRLVHDTDYGDSNVIRENIDLDSLPNRSRSCFRLKEIHFGMFIYSKIVKHTKMTRWNSFKPALDRGKVTFLACFWVAGGDPIAKSKAFSPQK

SEQ ID NO: 120273 - protein, 445 aa, Glycine max
  Coding DNA Sequence Number=SeqID_3495
  Homolog annotation: Hit_ID=Q3S4D9; Match level="QueryCoverage=32%, HitCoverage=23%, E-value=2e-23, Identity=40%"; Hit description =FRIGIDA
MAIDVADGMIKKGMAVKAVDLAYTFGFEEKYSPRTALTSFLQKSEETWKKAKQDARDFPSALVAHEKYLAALKSVVNCLEGHKIDFVKLLPGWQLKNKITNLEKDIGDANKKIEEKSMLKRKVDKNNSSNKMKIPEAKRTRFTGKDASVLSPSLAILQEQRIVSHMDGNSSYDGSLSALLLDGRSYGNYPNNYLAAASISDSLAEKYLGSTVASGANMLGGAMGGSYSGYQGDMIRDNVGTVLNSNSHLYRYHGIGEGALSHDRPVGQSFVGQSASTLNNLYGKTSTEGFAGVPEHLSIGASSRSGGSDLYGFADASSVVECCRRQEDQWLVLRCAITGIEVAVVVASNICCEATVDVVSGSCCMLKLTIPATMRWIVYANIKLGVTDSSIRKLVKLVLYPIVIVAVVVVVAPPLPSLQLWQQHQFQRHLIVDLINDYWPTSRYS

SEQ ID NO: 120274 - protein, 72 aa, Glycine max
  Coding DNA Sequence Number=SeqID_3496
MREEFLKRKKWRFKEKVNRPIGIKWYLQLPLNSQASDQTLVSGLRTQIWNHLYQSLSVAEILQSQIDLCQSS

SEQ ID NO: 120275 - protein, 84 aa, Glycine max
  Coding DNA Sequence Number=SeqID_3497
  Subcellular localization annotation: CTP_CleavageSite=42; ConfidenceScore=5.65e-01
MKTYGSWIHALFAKWSNRAKRTLWAQRASTAKRSFNTLSVTRESRRAQGSRLRAKREINSLSKTFVFCQAQRTTGAKPKSTYSR

SEQ ID NO: 120276 - protein, 269 aa, Glycine max
  Coding DNA Sequence Number=SeqID_3498
  Gene Ontology: Cellular component=nucleus; Biological process =multicellular organismal development
  Homolog annotation: Hit_ID=Q3S4D9; Match level="QueryCoverage=85%, HitCoverage=43%, E-value=2e-30, Identity=33%"; Hit description =FRIGIDA
  Pfam annotation: Domain name=Frigida; Domain location=97-269; Score= -85.3; E_value=0.00039; Accession=PF07899.2; Description=Frigida-like protein
MEETPEHVSYCPLSLPPEDENNSGAKLAKSVNELNDLAVAIQAFKNRYDELQKHLEFIEQAIHTRTKELRALGANSAQGTAENGVVQLDSNPKPEVTQAEEREEEEEEDELLTLCKTMNSRGLRKYVLTRLSETASLREQGSKAYTKDSPMIPARQVSVLVLEYYLLSGCVGNEVDLEASLKREVDSAAVAWRKRIFVEGGLLKAAEVDARGLILFIAIFGIPTVFKDEDIYSLVSASNGREFSDALLKSQPLLKRVSGKCNSHSDGYA

SEQ ID NO: 120277 - protein, 114 aa, Glycine max
  Coding DNA Sequence Number=SeqID_3499
MVVSYPNFVRKPSFANIWILANRIELLNTNCHAIHTVLQRFGRKCARYSKEGKNGHFWDIFQPLGPLEDLGVKKPAHLGVGRVKEKGPLGSPRSRGLERRERKKKEEKTRLKRY

SEQ ID NO: 120278 - protein, 173 aa, Glycine max
  Coding DNA Sequence Number=SeqID_3500
MAKKCWVGWLRDLTLYDKVNEAYVFGGMGLSRLKYLGGLKCTGLPLHAWDLESFSKVVAAFGMLLGSTSFSTKYAWLRRWGIKKGSLVKASISECSMDDGEWVLGRWWHGGRRYCFGDRNGSITKATSEFGKRMSTPTFSSYKLRNGIIVLLGCRNKKGRCKKQLPMKNSMDI

SEQ ID NO: 120279 - protein, 69 aa, Glycine max
  Coding DNA Sequence Number=SeqID_3501
  Subcellular localization annotation: CTP_CleavageSite=33; ConfidenceScore=5.84e-01
MGSPSASTTPSPPPSPPSSPRPPPISDASASTSAVKRTRKASRLRSLSTRPPSVERPVVHVDPATGKAD

SEQ ID NO: 120280 - protein, 112 aa, Glycine max
  Coding DNA Sequence Number=SeqID_3502
  Gene Ontology: Mol. function=RNA-directed DNA polymerase activity; Cellular component=chromatin; Biological process=RNA-dependent DNA replication
MSTDCRAINNITVKYRHPIPRLDDMLDELHGANIFSKIDLKSGYYQIRMREGDEWKTAFKTKFGLTSKASSDVAPCGACRPWIFFINGFICFLRSDCSGMEKEKYEWRRHFK

SEQ ID NO: 120281 - protein, 99 aa, Glycine max
  Coding DNA Sequence Number=SeqID_3503
  Homolog annotation: Hit_ID=Q1RUD8; Match level="QueryCoverage=88%, HitCoverage=18%, E-value=9e-09, Identity=32%"; Hit description=IMP dehydrogenase/GMP reductase
KFPLEAIASLTQYYDQSLRCFTFGDFQLAPTVEEFEGILGCPLGGRKPYLFSGLYPSMARVAKVVKISVQELDQVKQNRNGVVGIPRKHLEEKAKALAG

SEQ ID NO: 120282 - protein, 57 aa, Glycine max
  Coding DNA Sequence Number=SeqID_3504
MVHDIFVKVKLEVIGTSTVLNVFGSRRSSDRKMQGSRMREHENKRYAVCRTTSMLNA

SEQ ID NO: 120283 - protein, 38 aa, Glycine max
  Coding DNA Sequence Number=SeqID_3505
MDAHPRQDGVHQLTLRVVILVRMIRTRLPAAVWAKSCP

SEQ ID NO: 120284 - protein, 214 aa, Glycine max
  Coding DNA Sequence Number=SeqID_3506
MTTLTQIWMTLLLSNILPNDHNSDLPLPKCQLVYAILTRMSVHVAQLIADAIYIFVGMAPTRHPLDPNKSNRALGFPALITGLCQSFGVPVAPTKVIRPPITWAFIEKYCTQRQAQGDAPQAAGAPPPPHQAGQAGAFDMEQYLRHLVRQQAANHRAHVQTHDYQFRTEVACPGDWPEAQAEEAPPEAPGDGEEAHEDEEMADLLDFLGGSGDT

SEQ ID NO: 120285 - protein, 145 aa, Glycine max
  Coding DNA Sequence Number=SeqID_3507
  Gene Ontology: Mol. function=chromatin binding; Cellular component =chromatin; Biological process=chromatin assembly or disassembly
  Homolog annotation: Hit_ID=Q1SJF7; Match level="QueryCoverage=98%, HitCoverage=28%, E-value=1e-31, Identity=40%"; Hit description =Chromo; Polynucleotidyl transferase, Ribonuclease H fold
MTFLKDCDFELKYHPGKANIVANALSRNSLHMSSLMVQEMNLIEDFKDLNLNMSLNALSMREQLLKQELESLVNQEEESHNGKFTIYLGITKMNQDLKMMYRWLGVKKDMVYFVSRCLVCQRVKIEHKKPLGLLQPLEVPEWKWE

SEQ ID NO: 120286 - protein, 130 aa, Glycine max
  Coding DNA Sequence Number=SeqID_3508
MGSEIYHEVHENPKAFFNNSSLILLEPLAHGSNDWSLPREDCIITCLDKKCIVRKKVNLYRSVLTCTSVVKLREPCIKLYSNNFLLRNAQVEVGLINHRLGYFIEKDPLILVEYTSESDCSCARTMKEYK

SEQ ID NO: 120287 - protein, 76 aa, Glycine max
  Coding DNA Sequence Number=SeqID_3509
MRRVQGLWKVQRKEGREGEEGLRKAFVTLLGFGRCQVGRNEIGERANEVLERLGKESGLIRVIWSLPNCLEGVGFK

SEQ ID NO: 120288 - protein, 65 aa, Glycine max
  Coding DNA Sequence Number=SeqID_3510
MTQTNEHDYLTVSGRTSSRRSSVHYWKKFPEEVLPEADTPYYGRTSSGISSINFRKKFPEEVFTE

SEQ ID NO: 120289 - protein, 56 aa, Glycine max
  Coding DNA Sequence Number=SeqID_3511
MWFSTAFFLICNYGTPNAGFKPLQVSISLAKPTFPMPLLLGYKCEVKSHIEQKWKS

SEQ ID NO: 120290 - protein, 372 aa, Glycine max
  Coding DNA Sequence Number=SeqID_3512
  Gene Ontology: Mol. function=binding; Cellular component =mitochondrial inner membrane; Biological process=transport
  Homolog annotation: Hit_ID=Q1RYX7; Match level="QueryCoverage=99%, HitCoverage=90%, E-value=1e-141, Identity=70%"; Hit description =Adenine nucleotide translocator 1
  Pfam annotation: Domain name=Mito_carr; Domain location=182-270; Score=124.1; E_value=3.8e-34; Accession=PF00153.17; Description =Mitochondrial carrier protein
  Pfam annotation: Domain name=Mito_carr; Domain location=276-368; Score=121.8; E_value=1.9e-33; Accession=PF00153.17; Description =Mitochondrial carrier protein
  Pfam annotation: Domain name=Mito_carr; Domain location=88-175; Score= 100.8; E_value=4.2e-27; Accession=PF00153.17; Description =Mitochondrial carrier protein
  Pfam module annotation: Pfam domain module=Mito_carr::Mito_carr::Mito_ carr; Domain location=182-270::276-368::88-175
  Subcellular localization annotation: CTP_CleavageSite=49; ConfidenceScore=5.13e-01
MASISRMGMGFGVQQPNPSSSDDNNSQHNGGMSMSMRIPCTELYVRYVQSEGKVKILGVPEEEEVVEGVKKKKKGGAFKGLRIKVKNPSLRRLVSGAFAGAVSRTTVAPLETIRTHLMVGGSGNSTGEVFRNIMKTDGWKGLFRGNFVNVIRVAPGKAIELFAYDTVNKNLSPKPGEQPKLPIPASLIAGACAGVSSTICTYPLELLKTRLTIQRGVYDGLVDAFLKIVREEGAGELYRGLTPSLIGVIPYSATNYFAYDTLRKAYRKIFKKEKIGNIETLLIGSAAGAISSSATFPLEVARKHMQVGALSGRQVYKNVIHALASILEQEGIQGLYKGLGPSCMKLVPAAGISFMCYEACKRILVEDDDDEE

SEQ ID NO: 120291 - protein, 230 aa, Glycine max
  Coding DNA Sequence Number=SeqID_3513
  Gene Ontology: Mol. function=nucleotide binding; Cellular component =intracellular; Biological process=protein transport
  Homolog annotation: Hit_ID=Q6ASS4; Match level="QueryCoverage=70%, HitCoverage=76%, E-value=6e-52, Identity=65%"; Hit description=SNF7 family protein
  Pfam annotation: Domain name=Snf7; Domain location=29-199; Score =103.6; E_value=5.9e-28; Accession=PF03357.11; Description=Snf7
MVCILRYLDLERYRRSPYTDHCDAMVCILSLLSVSFTEVIFRNSQSLTRTYFLNKSETPAFVYAPSLKAATRILARQLVRLRQQITNLQGSRAQIRGVATHTQALYASTSISTGMKGATKAMVAMNKQMAPAKQVKVIKEFQKQSAQLDMTIEMMSESIDETLDKDEAEEETEELTNQVLDEIGVDIASQLSSAPKGRIASRNTENVAPRPAESQDVEELEKRLASLRRI

SEQ ID NO: 120292 - protein, 102 aa, Glycine max
  Coding DNA Sequence Number=SeqID_3514
  Gene Ontology: Mol. function=nucleotide binding; Biological process =protein transport
  Homolog annotation: Hit_ID=Q6ASS4; Match level="QueryCoverage=70%, HitCoverage=19%, E-value=5e-10, Identity=78%"; Hit description=SNF7 family protein
MEGFVVVTARMIPERWGVVGDHKGRRRLCGQVRGKWLLQPEDFFQDIGISIGWVSLKVCFISLSFTLVGIEREIASLQMEEKKLVAEIKREAKTGNEVCFVI

SEQ ID NO: 120293 - protein, 91 aa, Glycine max
  Coding DNA Sequence Number=SeqID_3515
MSTGGYGNEETASGLIGHGSPGTNGVGSGKRGNGKAARGNGKEGRGNGKPNGNGRMGGMICSGGTHELSCTSWNNNIVDHCNQTEQKHKIK

SEQ ID NO: 120294 - protein, 124 aa, Glycine max
  Coding DNA Sequence Number=SeqID_3516
MTHLIIRKTYNGFAFSPCGIGRVKPKEEDPEGLEGNKGMVDGVIGMNGREGKGGNLGRGGNPGSENAGVIGCGKDGIGGSVGDKGLGTKFGFGNSGANEACFHLKISDLQMKIGCCWGVAQDQG

SEQ ID NO: 120295 - protein, 131 aa, Glycine max
  Coding DNA Sequence Number=SeqID_3517
  Gene Ontology: Mol. function=intracellular transporter activity; Cellular component=endoplasmic reticulum; Biological process=ER to Golgi vesicle-mediated transport
  Homolog annotation: Hit_ID=Q9SPE5; Match level="QueryCoverage=89%, HitCoverage=40%, E-value=3e-47, Identity=77%"; Hit description=Gamma- soluble NSF attachment protein
MESAAALAKDLRHWQEVVDFYRRASELYMECGRPQPASDALAKGARALEDSMSEEAIQLYTDACTILEDDGREQMAFDLYRAATNVYIKLEKYTDAASFMLRLGLAADKCNATNSQCKGLERKRIGYRLAF

SEQ ID NO: 120296 - protein, 147 aa, Glycine max
  Coding DNA Sequence Number=SeqID_3518
MDDEDEKRNGDDIILVDEKRNDDDAITVVVETSKQPSMTKIVANDDDMCDRVDENATVTVNGNKAMVTVGGNTRKESQKKKKTRKESTLGNNYGSLGEEDQPPTFGKESHKCCMKIEENIANIPIFRVWEDQKPIKCYITNMSQVDN

SEQ ID NO: 120297 - protein, 94 aa, Glycine max
  Coding DNA Sequence Number=SeqID_3519
  Subcellular localization annotation: CTP_CleavageSite=59; ConfidenceScore=5.37e-01
MVDPTTTTTTNSTTSSTRAHRHVGLPDVGLDPLLRKCHNRAHRRRPATTASFCCLLLLRSSSAAALRQNWKLDNGVVLSLFCFVLRDHNARLTS

SEQ ID NO: 120298 - protein, 126 aa, Glycine max
  Coding DNA Sequence Number=SeqID_3520
  Gene Ontology: Mol. function=DNA binding; Biological process=DNA integration
MVESIMDCIIVPQYTMLQTPKQNGVAKMHNETLKVYLSEDAYDIGDIVDPKSGHEVVSCPQLEMWKYTMNEEMKSMLVNGVWELVELPENFKAISCKWVFKTNKDLNGNIERFKARLVTKGFTQKG

SEQ ID NO: 120299 - protein, 142 aa, Glycine max
  Coding DNA Sequence Number=SeqID_3521
  Gene Ontology: Mol. function=nucleic acid binding; Biological process= DNA integration
MPNCKPRDILIVKGNIFNKDQCPKKEIERVEMNNKPLGSALGNLIYAQVCTRPDIAFIVGVLCRYQSNLENDHWITAKKVMRRSTFGYIFMMVGGAISWKRLRIVDFIARPLKIFYYNSIAAFYTNNNKTSRGFKFEVEPDC

SEQ ID NO: 120300 - protein, 694 aa, Glycine max
  Coding DNA Sequence Number=SeqID_3522
  Gene Ontology: Mol. function=DNA binding; Cellular component=nucleus; Biological process=regulation of transcription
  Homolog annotation: Hit_ID=UPI00000529F6; Match level="QueryCoverage =86%, HitCoverage=56%, E-value=2e-71, Identity=49%"; Hit description =transcription factor
  Pfam annotation: Domain name=FYRC; Domain location=517-612; Score =81.4; E_value=2.8e-21; Accession=PF05965.4; Description=FY rich C -terminus
  Pfam annotation: Domain name=FYRN; Domain location=462-514; Score =50.8; E_value=4.6e-12; Accession=PF05964.4; Description=FY-rich N -terminus
  Pfam annotation: Domain name=JmjC; Domain location=1-59; Score=31.5; E_value=1.1e-06; Accession=PF02373.13; Description=JmjC domain
  Pfam annotation: Domain name=zf-C5HC2; Domain location=165-218; Score= 89.0; E_value=1.4e-23; Accession=PF02928.6; Description=C5HC2 zinc finger
  Pfam module annotation: Pfam domain module=FYRC::FYRN::JmjC::zf -C5HC2; Domain location=517-612::462-514::1-59::165-218
MVLIFSFEQVTQFSPSILKSEGVPVYRTVQHSGEFVITFPRAYHAGFNCGFNCAEAVNVAPIDWLMHGQSAVELYRLQCRKTSLSHDKLLFGSALESVRALAELALGKETPKNLKWGSVCGKDGDLTKAVRARIKMEEERLDCLPTHLKLLKMNSNFDLYKERECFSCFYDLHLSAVGCECSPDRYSCLKHANLFCSCEMEKRFVLLRYTISELNKLLEALEGDSHAIEVWANKNFGMVSANANEVCIDKPDLEKDMYRTKNCEEMESSTGCVRTKDRSNLNAPSSPNSHITTEIVQFESHPVTCAAYDSIDSRHDNNNDKNLITDSKDKVDQAGSLDLNLDVISGENENHLLHIADNHHNKGVSVEEKVCCSEAKKEEDIMELCGEGNLSNLFSVLKTDFSSCSRGVRNYCTFDGGKIEKDLQVDSDSGKQHSNLFEREVIVTTHTSTSLMDESCLVQMFGTSVKLVSLGSVVYGKLWCSKHTLYPKGFKTQVNFFSIVDPKRICSYISEVIDAGFLGPLFKVTMEECPSEAFTDTSADNCWESVLKRLHHEIMRQKSLGELELPPFELLKSINGHRMFGFKLPSIIQAIEAQDPSHLCVEYWNHKVAPSGSVVDNFPFGSSSSLGNINTKIFGIDLIKQEKDNILEEMKSILQGASPDELRTMHKLIISDAQCCEWRVALIALMDGIRNACQ

SEQ ID NO: 120301 - protein, 178 aa, Glycine max
  Coding DNA Sequence Number=SeqID_3523
MGVWEGDVWVWRWEWRREWFMWERDMVNRWSMMLNGVSLRRYSEDEWVPNVSLANVLSKVRKLKIPPKAAFMIWRLLQNKLPTADNLGKRNVIHYGNGVSYDWVWKWLFNPILAHFLQHDFRDAYGMDRNAWSVVWGGSCVECVWRMRNKCVFQGVGVDLGNTWRESGISGGYEVDAW

SEQ ID NO: 120302 - protein, 161 aa, Glycine max
  Coding DNA Sequence Number=SeqID_3524
  Subcellular localization annotation: CTP_CleavageSite=87; ConfidenceScore=5.87e-01
MASFLFHPSVAPRILTMSSFPVTLKNSTSSLVKNGSTSTWKKAPNIRTPAMSSSLAFPTSIPTTLPPSTPPPLASSLKLNEFRGVLYAMRNMSWLLLMVLLYRLVYCYGDSSDFVLGGCKYKGCMFLGSPFMMSMVRLQQQVTAEIGHIIENTSFGCRRWP

SEQ ID NO: 120303 - protein, 77 aa, Glycine max
  Coding DNA Sequence Number=SeqID_3525
MTYGGDDDDNNDNNDHFDGNGHNDDGESNDDSGHEGGSDGHESAPLLSSQINEVFPLGFVFPPKSEHQSKRLLPQAE

SEQ ID NO: 120304 - protein, 176 aa, Glycine max
  Coding DNA Sequence Number=SeqID_3526
MSSNQLMFLIAYNTPLNSFNFNELARGGGVEGGRVVGIDVGNARLDDMAGVLMFGAFFHVLVEPFFTNEEVSKVEKDCWEQGVDKKLNFRVTGKELMVRMRGATEGWKRKLAMMVEVFEVAVDGAFDGGGTMWSTMMTMALASDGDGAATFMSELGKNVMSIIKLLKPNRINHASP

SEQ ID NO: 120305 - protein, 365 aa, Glycine max
  Coding DNA Sequence Number=SeqID_3527
  Gene Ontology: Mol. function=DNA binding; Cellular component=nucleus; Biological process=regulation of transcription
  Homolog annotation: Hit_ID=UPI00000529F6; Match level="QueryCoverage =99%, HitCoverage=32%, E-value=2e-96, Identity=49%"; Hit description =transcription factor
  Pfam annotation: Domain name=JmjC; Domain location=298-365; Score =56.9; E_value=6.4e-14; Accession=PF02373.13; Description=JmjC domain
  Pfam annotation: Domain name=JmjN; Domain location=57-101; Score =82.9; E_value=1e-21; Accession=PF02375.7; Description=jmjN domain
  Pfam module annotation: Pfam domain module=JmjC::JmjN; Domain location=298-365::57-101
MEQLKLAADSEAKEDKSLGHKPKNNNALESSDSLRNKKISARWDPVEASRPIIEEAPVFYPTIEEFDDTLSYIAKIRPLAEPHGICRIVPPACWAPPCPLKEKDLWENTEFPTRIQQIDLLQNREPMRKKSSGRKRKRRKHSKTGTCRRKPANAASEAKNASESEEKFGFQSGSDFTLKDFQLYADFFKECYFGLRDTNGDRIVSDNNHQKIWEPSEEEIEGEYWRIIEQPTDEVEVYYGADLETGALGSGFPKASSLTKSESDQYAQSGWNLNNFARLPGSVLSYEGSDISGVLVPWLYVGMCFSSFCWHVEDHHLYSLNYLHWGDPKVWYGVPGSHAAALEKVMRKHLPDLFEEQPNLLNDLV

SEQ ID NO: 120306 - protein, 149 aa, Glycine max
  Coding DNA Sequence Number=SeqID_3528
MEACSVVRDLLQQMIDHGRVEVNNEGKGEQHICMQSAYKEGPKKPQPLVIHFTRDTVPQRPRQHSAVSGVRPIPFPYKNSRAVPWRYAPSGGKKEEATNIGSLSAKVTNITWLNSITRSGRVFAPPSLPTQPTNAKGKSKMTEGQTIKV

SEQ ID NO: 120307 - protein, 90 aa, Glycine max
  Coding DNA Sequence Number=SeqID_3529
MSHLISLALNTRPLLCRERVGTINTFCNISSEKYNMPVSSSAQSKISAYKSKEGHCNMSSHKACRPWIFFINGVLCFLKINGSRMEKEER

SEQ ID NO: 120308 - protein, 125 aa, Glycine max
  Coding DNA Sequence Number=SeqID_3530
MGLSAMKIGGDGMIEHAWLHYRASMGSYHGERHRKGRRNVGVWCELRRRHVRTRRRRILAGVLLANEIEFEEHGGVEQVKMEVSSMENGIHGSLGCGEVGLGCGEVGHDGFEAIQVGGGSCGICH

SEQ ID NO: 120309 - protein, 80 aa, Glycine max
  Coding DNA Sequence Number=SeqID_3531
  Gene Ontology: Mol. function=nucleic acid binding; Cellular component= mitochondrion; Biological process=DNA integration
MVLYSTFVDDFSTVGCFLHDHDIGFEPKIDYISSSRLVVRPVPYPTRVTKCLKCCERRFTANEISGHVSERYCRDPTMRL

SEQ ID NO: 120310 - protein, 181 aa, Glycine max
  Coding DNA Sequence Number=SeqID_3532
MARIAKVVRISTQELDRVKQNRNGIVGILRKHLEEKARALVDQGESASFIDVLVLLVFGVVFFPNVDGLVDLAVIDAFLAYHHSKESLFVAVLADAYDTIDRRCEKSGTRIVYCTPAFYKNLEEDDLYRCAEQESNSLTAPLTPPAYFHEGLGYGNLVVGMYVLMQFWSSLVQQEGSEDDA

SEQ ID NO: 120311 - protein, 160 aa, Glycine max
  Coding DNA Sequence Number=SeqID_3533
MVGYTPSSFTDLVFASERIKVGLKRGKFNHPAWTTEKTGANEEGENEGETHAANCLSYMENPPPAQQHHYSADINPSHYPPPSHPQRPSLNQPQSLSTALRMTNTTFSTNQNTNQEMNFAAKNPVEFTPISVSYVDLIPYLLVNSMVAITPAKVPQPPFL

SEQ ID NO: 120312 - protein, 129 aa, Glycine max
  Coding DNA Sequence Number=SeqID_3534
MTNANCPQESLHSVSNGNLRFDTAQTLVSRFLQVSSFFEDEGESPVESDETKVQSWSCVNKQIMSHRKWEYNSGSNTYKRKRLGTATRKGLLLISTTTKMPSQPFISPKDTRELHVVNCDGFGCRLVAS

SEQ ID NO: 120313 - protein, 93 aa, Glycine max
  Coding DNA Sequence Number=SeqID_3535
  Subcellular localization annotation: CTP_CleavageSite=55; ConfidenceScore=5.05e-01
MAQTNRYFRWGRSALRSLSRMLLSSNVIYICVRVVMLVRMIRTRHFAVARVKSCPCMHSSYAIASSSGCARIVGRPPLSGGGPGIDKRKLLAP

SEQ ID NO: 120314 - protein, 227 aa, Glycine max
  Coding DNA Sequence Number=SeqID_3536
  Homolog annotation: Hit_ID=Q1T1Y0; Match level="QueryCoverage=29%, HitCoverage=18%, E-value=5e-10, Identity=47%"; Hit description =Ankyrin
  Pfam annotation: Domain name=DUF1723; Domain location=140-189; Score =30.5; E_value=6e-06; Accession=PF08330.1; Description=Protein of unknown function (DUF1723)
MKKSLHQLLSKNPQLRVLAFDGKEALFTPKKRNQEKLLAYKGVGMSPPPLGISLISLKDENLALCSAICSLKFTLFRPLSSEPLKKGFLISTSRLARFDIDEEAPQRRSPTTSTCRQWAAAVVDHVDYAADELKLASHGRKVEKFGRPALKKWHKKTSSFHLPVGEVTITLDDVASLLHLPIIGVFHTFDALDVDQVVELLVKLIEVATQEAKDESEQCRGAYVRLT

SEQ ID NO: 120315 - protein, 51 aa, Glycine max
  Coding DNA Sequence Number=SeqID_3537
MKSLKDMEPSPNQLLPMYVRYVIITCTDHKCNNARCNGMIWQAIRNTKDGK

SEQ ID NO: 120316 - protein, 114 aa, Glycine max
  Coding DNA Sequence Number=SeqID_3538
MTARPGELSLSYEAMSWPRRADFLILKSFGGPGEPEASLGELGSRKTKEKTLLPSFLGISCLHDRNTKWFLALHCNWCFNTGMKGGSWWPPMVVGDGGGVSKVGDGGGVSKEIF

SEQ ID NO: 120317 - protein, 744 aa, Glycine max
  Coding DNA Sequence Number=SeqID_3539
  Gene Ontology: Cellular component=nucleus; Biological process =regulation of transcription
  Homolog annotation: Hit_ID=Q1T621; Match level="QueryCoverage=51%, HitCoverage=61%, E-value=1e-128, Identity=61%"; Hit description=GRAS transcription factor
  Pfam annotation: Domain name=GRAS; Domain location=362-658; Score =285.6; E_value=9.7e-83; Accession=PF03514.5; Description=GRAS family transcription factor
MKAVPLPFQEFRGNGVLDFASVAAVSDSLLLPQQEQFLQRWNPQRENFCYVGIEPAVSGLDLKRKTSSPPTSSSTLSSSRASSGGCGGWGSADSTTGAATATVAEKENNPPQGGLEVVGQARCGLGMEDWESVLSESPGEDHSILKLIMGDIEDPSVGLTKLLQGGSASQDVELNGLGVGFGLVNQSSVLDPIPSVNFVSSSIDPSGPGNCADFPFNSHSNVSPNVPSVGSGLNPNPTGFPTSASNLSQVSLPQGVFQPQQQQHQPIEPLDEKLQVLNPQFILYQNQSQFMPNPGLVLPLTYAQLQEHHQLLPQPPAKRLNCGPNYQVPKTPFLDSGQELLLRRQQQQLQLLPHHLLQRPSMVVAPKQKMVNSGSEDLATHQLQQAITEQLFKAAELIDAGNLELAHGILARLNHQLSPIGKPFQRAAFYFKEALQLLLHPNANNSSFTFSPTGLLLKIGAYKSFSEISPVLQFANFTCNQALLEAVEGFDRIHIIDFDIGLGGQWSSFMQELALRNGSAPELKITAFVSPSHHDEIELSFSQESLKQYAGELHMSFELEILSLESLNSASWPQPLRDCEAVVVNMPIGSFSNYPSYLPLVLRFVKQLMPKIVVTLDRSCDRTDAPFPQHLIFALQSYSGLLESLDAVNVHPDVLQMIEKYYLQPSMEKLVLGRHGLQERALPWKNLLLSSGFSPLTFSNFTESQAECLVQRTPSKGFHVEKRQSSLVLCWQRKDLISVSTWRC

SEQ ID NO: 120318 - protein, 130 aa, Glycine max
  Coding DNA Sequence Number=SeqID_3540
  Subcellular localization annotation: CTP_CleavageSite=21; ConfidenceScore=5.22e-01
MVVALSSPFGLSTHPSATSVRCALSATEESGSASISRPRAKREISALSAAIVVGCTICGGAHESGCCTPNEDQIAHEVNYMGNQPRGNFNTSEFPGFQNNQQYQQQRQWQNHPSNQFNRDQGGSSTRPQQ

SEQ ID NO: 120319 - protein, 300 aa, Glycine max
  Coding DNA Sequence Number=SeqID_3541
MVKKGVDDHVLSSRAIGLDCLWRAKKDIGLDCLWIAKMVRMTKLDCLCIAKMVRLTMVCLRVPSNLIVSGWKRRLDYLWMAKKVWMTLFCLRVPSDLLTLDSIKGANDHVADDNVLSSQAIGLDCLWIGKWGADSHVWSLRAIGLDCLWKGKKDRKKGANDHVCLLMASDMIVFGLQRGTDDNVLSPRAIGLDCIWIAKRVRMTNFATYPSAGGRRGAHGCIFQGWKARGVATNVYLRKTSEKPKLCGLRTLIVKGSGVIFTHGEGISTPHVRHKGRQPLIKVFPLLLRILNCDEEIRPT

SEQ ID NO: 120320 - protein, 160 aa, Glycine max
  Coding DNA Sequence Number=SeqID_3542
  Subcellular localization annotation: CTP_CleavageSite=59; ConfidenceScore=5.08e-01
MVIRTLFGIQRKSSLMAHKDKTWSSASFLLSRDIKSDGTQRQNMVIRTLFVIQRQSSTVARGDKHGHSHHFSDPETIKFDGMQRQNMVIHAFFAIQRQSSPMARGDNMTIKSDGMQRQNMVIRTLFGIQRQSSLVARGDKTWYPHPFCYPETIKSDDMQR

SEQ ID NO: 120321 - protein, 213 aa, Glycine max
  Coding DNA Sequence Number=SeqID_3543
MACGEKQGRWHAEKKHGHPYLLCHLETIKPDGTRRQIMVNRTLFAIQRKSSPMTRRDKAWSSKPLLLSKDNQVRWHAETKHGHPYPFCYPEIIKADGLRRQNMVIRTFFAIQRQSRSMVRRAKTWSSVPSLPSRDNHVRWRVEKNMVIRTIFAIPRQSSPMQSGPPGPSRRFLQKAVASGGSNPARLGELGGKHLPYFAINRGGSEKEKGSAP

SEQ ID NO: 120322 - protein, 64 aa, Glycine max
  Coding DNA Sequence Number=SeqID_3544
MEPDVTKVRVKACFFLHRVAVAVAIDLRTSFVVAKSRVIATYKYIVHRPLFSQLKKHSLGVHHE

SEQ ID NO: 120323 - protein, 81 aa, Glycine max
  Coding DNA Sequence Number=SeqID_3545
MVMQCYPPRALDRRLQEDWTREAREGPRVLMSLRPEGSIFLLHPIATSYSHTLCMSFMFYMPHDTYVGSSGLRIIKKREMN

SEQ ID NO: 120324 - protein, 224 aa, Glycine max
  Coding DNA Sequence Number=SeqID_3546
EKYKKPYHGNDASFGVGAAKRPRIEGGESELVAGEEAIGAVDSSVRSDEVGGERGPDGGGGGVHGSDRGCAVVATSMVSSEPLREWRINGDRRKARVLTGWHWAGLIGLRPSHILTVVIGPNQIAIAPTTIQNSKFTLTHNIRWNYDSAALEGPRIFFINGFLCFLEDEWQRNGERERERRRHFKEKMSLEEAHHHRRPWIRAWRKKEMNEGRGREEHEILCSK

SEQ ID NO: 120325 - protein, 216 aa, Glycine max
  Coding DNA Sequence Number=SeqID_3547
  Homolog annotation: Hit_ID=Q47522; Match level="QueryCoverage=16%, HitCoverage=44%, E-value=6e-14, Identity=100%"; Hit description=LacZ protein
  Subcellular localization annotation: CTP_CleavageSite=84; ConfidenceScore=5.10e-01
MVKVGTSYVPINVSFSPKVGAGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDGFRCLDPSSRRVYISRNVIFDEEQFPAHSIITGPANCVSSSGKSPGLFFTPPSHIFSSSSDFPPPPATIKLIDTVDLEGGPGTSFCSL

SEQ ID NO: 120326 - protein, 130 aa, Glycine max
  Coding DNA Sequence Number=SeqID_3548
MVRAREDAHSCLEMRKARPSYKCYENCLAERGSVRELCYADLNLSLLKNLMHVSAYVNSDWNATFGIALNSFWQNRNEVGFFGTASSVGSIVTHVKALTFNVLRTPSYRQSPEVGEFKLNCDRAITNGGE

SEQ ID NO: 120327 - protein, 71 aa, Glycine max
  Coding DNA Sequence Number=SeqID_3549
MGKEEGSGGEKKRGGEVGKATWGRVKVLMGKWERQHEKGEGSWGKEEGGKVRKTTWGRVKVVEQSYRGRKV

SEQ ID NO: 120328 - protein, 346 aa, Glycine max
  Coding DNA Sequence Number=SeqID_3550
  Gene Ontology: Mol. function=RNA binding; Biological process =regulation of transcription, DNA-dependent
  Homolog annotation: Hit_ID=UPI00006B21A5; Match level="QueryCoverage =74%, HitCoverage=85%, E-value=3e-47, Identity=39%"; Hit description =putative N utilization substance protein
  Pfam annotation: Domain name=NusB; Domain location=148-267; Score =30.1; E_value=8e-06; Accession=PF01029.9; Description=NusB family
MFSGIEKIYHLYIYQLNFLVGLKALAENQMEIGKKKYLKTDSDINPNQKFINNQVLIKLEENPERLFFTGQHKELKWDLHDDLLVKTFQRITAGKRYQDFMKVEEYSFEEDQKFIGKLFLRYIAENEDFHDYLGDKELTWSDDIHISNSMVQKTIGFLKEDEESRTLIKMIKDEDDKAFAAKLLRDTLNNWENNEKKLSERLENWDLERVSLMDKVILSTAISELDNFPFTPSRVIINEYIEIAKVFATDRSNIFINGILDKYCFGLVSCKKENKEAQTAESVATDSSAAATTPADSAVAPATTEAATPAQSNQPSTSLALSESNFDFGNIKKGDKVEHVYEVTNT

SEQ ID NO: 120329 - protein, 1236 aa, Glycine max
  Coding DNA Sequence Number=SeqID_3551
  Gene Ontology: Mol. function=RNA-directed DNA polymerase activity; Cellular component=membrane; Biological process=RNA-dependent DNA replication
  Pfam annotation: Domain name=AT_hook; Domain location=8-20; Score =14.3; E_value=0.078; Accession=PF02178.9; Description=AT hook motif
  Pfam annotation: Domain name=Exo_endo_phos; Domain location=393-625; Score=8.6; E_value=0.0034; Accession=PF03372.13; Description =EndonucleaseExonucleasephosphatase family
  Pfam module annotation: Pfam domain module=AT_hook::Exo_endo _phos::RVT_1; Domain location=8-20::393-625::887-1155
RGRGRGRGRGRGRPAKIPVPPSTTTQKSPPKLNPEPSNASHEVTVEDYVSSEDDESEETPIPSANLPNCNVPEKPKEETNGNKVPRKLWTDVISGNRKPENGMALEFFASKIVEGKPIAEIEPEDIIGELKYWESALIMYVIGRDLSMNSVKQFMEKNWSFVKLPDLFYNDEGYFIMRFQSSQDKDEILSKGPYTIMNMTMLLRDWSPEFNLKRDMLRTIPIWIKLPQLPLYLWGAKTMGKIGSILGKPIVTDECKAQRLRISYARMLVEIDITQEMPKEVTIADNEGHELIQAVEYEWKPKYCGKCKKFGHVCEKPKVRKEKVWVPKPTLKSNEQEERGPSNKETQMINTTNTEDLVSEWTTVQKAGKKTVTDTGTMQKAGKKIITDTGESAMMISWNIRGLNKVGKTIEISSRLKSLNPTIIVLLETRVRKNKALTVRNKLNLNMKYLDNYDKHENGRIWFIWDDSKVMIKHICSTSQLIHCGVYNPNGDFLHWCTAIYALNHLDDRRKLWKDIEDLRVQQADPWCLLGDFNNVLKAEDRIGGRDVIESEYVDLREMMSRVGLYEMDTCGDFFTWTNKQADNTIYSRIDRFLGNLNWLQMHIDSTLKILAPSVSDHALMFLSCKDQSSRLRGRFKYRNSLARLNGFHDEVKKNWNLGVHGNPMYKLWTKLSRLQSVLKNLSSPLNGLREKIDEARRNLQQAHEDLCRDRFNVDNINRVKDRTSELLQLNELEDSDLRQKAKINWIRQGDGNNNYFHATIKGRYKNNAIRSLIKEDGSCITSHEDIEEEVLKFYSALLGSRESNLAGLNIPAIRNGNTLNQFQRDMLIGPVSNAEIDTAIKGMDVNKTPGIDGYGVGFFKDAWSIVGSDVREAILDFFLRNRLHKGFNSSVVALIPKHKEAKMIKDFRPISCCSTVYKIISKVLTNRLSKVIDTLVGKNQAAFVPGQQLHNHVLLAFELLRGYERKHGTPKCMLQIDIQKAYDTVHWDALEHILRELGFPDQFIKWIMIAVRSVTYVFNINGRFTRRLEARRGIRQGDPISPLLFILVMEYLNRILSQLDKFPNFNYHSKCEKMKITNLCFADDLLLFSRGDIGSVQIMLDKLNTFLRSMGLHVNPSKCNIYCGSVDINVKEQLLLISGFKEGKMPFRYLGIPLSSKKLNIKHYQVLIDKIVGRITHWSAGLLSYAGNSNISSKSPIAWEKVCSPKINGEESLLDYEQHDEVEAPVAAIPVQNAG

SEQ ID NO: 120330 - protein, 60 aa, Glycine max
  Coding DNA Sequence Number=SeqID_3552
MPSFKIANEKLSIHDGESNYQLNSVKGNHSKGQSKIDPRFKLMMWSPHHNWAPTLVMMIN

SEQ ID NO: 120331 - protein, 78 aa, Glycine max
  Coding DNA Sequence Number=SeqID_3553
  Homolog annotation: Hit_ID=Q00M75; Match level="QueryCoverage=51%, HitCoverage=6%, E-value=3e-09, Identity=75%"; Hit description=PPR -repeat containing protein
MAWSAHFPAISATRKCDPYFNIPLLIGSSLCEGMREGCCTQPYPCICKEAVSGFEPMSNKSPRHNFTAAPGFALFFFM

SEQ ID NO: 120332 - protein, 133 aa, Glycine max
  Coding DNA Sequence Number=SeqID_3554
MDEDVVQSVSVVLADSTMELERPGEVKKNRWEAKAVTKSAGLMTWRVVMDGCDCDERVVAAEVVSFSCWRRVCVWHSWLCEEGKKEEESYVLGGGFGGHLGSYDFNGDGTAVEHCSIKIGPTVFDDQLLLSSK

SEQ ID NO: 120333 - protein, 1277 aa, Glycine max
  Coding DNA Sequence Number=SeqID_3555
  Gene Ontology: Mol. function=helicase activity; Biological process =viral genome replication
  Homolog annotation: Hit_ID=Q9ZQR0; Match level="QueryCoverage=90%, HitCoverage=98%, E-value=0.0, Identity=39%"; Hit description =Putative helicase
  Pfam annotation: Domain name=DUF889; Domain location=953-1205; Score =434.8; E_value=1.1e-127; Accession=PF05970.5; Description=Eukaryotic protein of unknown function (DUF889)
MTSQHINSGRYTIFNSKLIEHVSHDTDDELDITQGDIVIDYSFDDIATEDFAHTDYDDNLEAPYDNENTGAGYKDIGDPIWQCKQCKAKMWYDERINKDKQTKNPKFSLCCGDGKIQLPILHDAHKQLLFDSRDSQAKKFQQNIRLYNLMFAFTSPGIKVDTSYNTGRGPPTLRIHGQSHHLIGSLLPMPDNSPKFAQLYIYDTKNEVNNRLSQYPIKNNVGEDIIIGIKNMLDTHNPYAQKFRMARDKLDSSVVCDLKLKLISDRQTDGRLYNLPNASEVAALIVGDEHTTNNRDIIIEKQTGMLQRINELHPAYLPLQYPLLYPHGEDGYRPNILHKHHSHSHATKRNKVTMREYFCYKMQSRDNEAQTILHSRRLFHQWVVDGYCMIESQKLNYVRQHQQELRVDNQRYMEQLYFDGMAICAHVGFPDLFLTLTCNPAWPEIQRQVAKSNLTAHDCPDVVSRVFKIKLNQLMHDLKSGHVFGPILAFVYTIEWQKKGLPHAHILIFLHLSNKYPNPEDIDNIISAEIPNKDTDPKLYQIVSNHMMHGPCGIANKRAPCMANDKCFRYVSAPETCWKIFAFPMHGRAPAVERLYFHLENQQSVYWKDSQEIGTVLAKSTIKESMFTAWMDSNKIYHHGRDLTYAEYVSKFVYDARKRCWKPRKQGNTIGRLIWVPPSSGELFYMRMMLSSAKGSQCYEDIRTVENVVYHTFREACFAKGFLGSDQEFVGAYEKQTLGELHTILRNKEKMHLCLTEIENLLQANRKSLRDFPSMPYPLGYAAKTHQNNLIYNELAYDREILAAEFDKCYQSLTDEQASIFNKIMHVVATQSGGVYFLYGYGGTGKTFVWKTLSSAIRSTSGIVLTVASSGIASILLPGGRTTHSKFAIPVPATKNSTCNIHQGSDLAELFHITKLIIWDEAPMCHRYSIEALDKSLQDIMHNNNPFGGKVNVFCGDFRQILPVVPRGNRSDIVYATLNSSYIWNHCQILKLTKNMRLQSNPTDHSNLDELKQFFEWLLDIGDGKLAEPNDGYGEITIPDEFLIKDFQDPIQEIVEATYSDLLHNYNNGDFLQKRVVLASTKDVVDKINDYVLSLIPGEEKEYCSVDSVDKSDELLSPAFGVLTAEFLNSLKTSGIPNHKLIIKVGTPIILLRNLDQADGLCNGTRLIVTRLGSSVVEAEIIAGPNIGHRTYIPRMNLSPSDSPWPFKLIRRQFPFMVSFAMTINKSQGQSLAHVGLYLPTPVFSHGQKLDPSDVHMAYLTVLISLAWYNTYWTLTP

SEQ ID NO: 120334 - protein, 111 aa, Glycine max
  Coding DNA Sequence Number=SeqID_3556
MAHSDDANARMRNFSDNKGEKGKNIVLKTIFCIQTFNRVCSCMDAVRRTGDIVVRVHVDAVTEDDEMHDPPMQLARSAELFDIARNCGQCNYNYGLIARQCYSTCTPTWLH

SEQ ID NO: 120335 - protein, 334 aa, Glycine max
  Coding DNA Sequence Number=SeqID_3557
  Homolog annotation: Hit_ID=Q1T493; Match level="QueryCoverage=87%, HitCoverage=53%, E-value=2e-19, Identity=26%"; Hit description =Nucleic acid-binding, OB-fold, subgroup
MMLMDHTGTKIGATLWQELFPEFEPKLGCGGAYVIQNVKVVDTHSDYKIPPNVHAITSFADIISGVAKPDTLVDIVGVIAEVIECKTVNPAYKVTVKLRDNSHVEIIMTVWEEYALQLDDAIEKNHFVQKPLVVMLTLAKIKEPKDKYPLSVQNIKHGSKLYVNGDKNEIQQFHDSLRVSFYIGGLDDEGGVSQSQSTQNCQHKFLHNAQIVSFGEIKTLRQDCYCLTVGTVDEVMIDTPWSYDSCPCCTITFDLLKIGAACRSCQNHVTHTIPRYKLVVKMEQNREKANFHFWDVVCVKIFGKTADECRQELIASGDEIKVFPACVYQLLGKT

SEQ ID NO: 120336 - protein, 125 aa, Glycine max
  Coding DNA Sequence Number=SeqID_3558
  Homolog annotation: Hit_ID=Q96255; Match level="QueryCoverage=38%, HitCoverage=11%, E-value=2e-07, Identity=57%"; Hit description =Phosphoserine aminotransferase, chloroplast precursor
MAESNLHTVFQIPQEYSSSSYIGALSATRLPMTHISSYFRKPNVILSEKSKNYTKFPSFDDLEQNPDSGYLCICAMRHFMGLSFRNTMFLRVVFWLLICLQISSPTQWMGQNLGLSLLDWPSDSQ

SEQ ID NO: 120337 - protein, 77 aa, Glycine max
  Coding DNA Sequence Number=SeqID_3559
MATEKTVLGGSEKRWHCDTSALAMPRRHCQGLVCIMIDDLPMGMAKTMLSWRVHVGAATGDGEMHDPPMQLARSAER

SEQ ID NO: 120338 - protein, 481 aa, Glycine max
  Coding DNA Sequence Number=SeqID_3560
  Gene Ontology: Mol. function=zinc ion binding; Biological process =metabolic process
  Homolog annotation: Hit_ID=Q6ZA58; Match level="QueryCoverage=86%, HitCoverage=28%, E-value=1e-101, Identity=44%"; Hit description=PHD finger transcription factor-like
  Pfam annotation: Domain name=C1_3; Domain location=166-192; Score =6.1; E_value=0.098; Accession=PF07649.3; Description=C1-like domain
  Pfam annotation: Domain name=PHD; Domain location=167-210; Score =47.4; E_value=4.7e-11; Accession=PF00628.19; Description=PHD-finger
  Pfam module annotation: Pfam domain module=C1_3::PHD; Domain location= 166-192::167-210
MVSQSEKVVAHDEENDVNVLEKEPRSGARKTRSASRKLNTGKKTVLSWMIETGTIRQREKVHYMDHKNERALLSGEIFGDGILCDCCFQVVSISQFEAHSRRQIISDDTVLENMSEESDPLKNMFEERRGRSLLQCMEEAWNRQDKSSVGKFYNEVRVRGSDYNDVTCSLCGKRGDLICCDTCPSTFHQSCLDIQTLPSGDWNCIYCCCKFCGLYKQMDSFQLSSCRLCEQRYHQSCLEATGANTSHSRHSSLCGNGCKELYERLEKLLRVKHNIEDGFSWSFICRSDVDSNATQIEPRVVECNAKIAVALSVMYEGFRPCIDDGSEINLIHSVMYNCGSNFPRLDCKRFITAILERGDEITSVASIRIHGNQLAEMPFVTTRSVYRHEGMFSRLLNAIESALSFLNVELLVIPSVKELREIWIRSFGFEPLDLRSKKMMKGMNLLVFRGTEMLQKKIPKRNFPDENLKSYSRQTRDWLFI

SEQ ID NO: 120339 - protein, 66 aa, Glycine max
  Coding DNA Sequence Number=SeqID_3561
MSLGCDYGLVRWSGGQINGELKNKYVGVGCFTDNTVESEMGIYVVATGGGEKNLYKRPREKGGGRS

SEQ ID NO: 120340 - protein, 156 aa, Glycine max
  Coding DNA Sequence Number=SeqID_3562
  Homolog annotation: Hit_ID=Q7F1K9; Match level="QueryCoverage=90%, HitCoverage=41%, E-value=3e-32, Identity=50%"; Hit description =Putative glyoxylate induced protein
LFKYAFAQEGFCSAPSESKSKPLYWKVDNPTLSPIHLQDLPGFTRSVYKSNHALISPESHVYGPLPDWINTLGTYLISPEMGSHFVMYLAKLKVCHETEFSGTLMRYPLPLFQKIQNQDYPCLIVMCRFIFVLQGAVTLTNATGVSQLLKVWLMCF

SEQ ID NO: 120341 - protein, 53 aa, Glycine max
  Coding DNA Sequence Number=SeqID_3563
MWESYERLGASPNFKCEGSFVWYCSCSDEESGSALQMFLYNELGLKDADNDYG

SEQ ID NO: 120342 - protein, 193 aa, Glycine max
  Coding DNA Sequence Number=SeqID_3564
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98205; Match level="QueryCoverage=41%, HitCoverage=7%, E-value=3e-32, Identity=86%"; Hit description =Putative phospholipid-transporting ATPase 2
MEILESLYSYNSLRPKLIEPKGQLLSIDGKTEEEVCRSLERVLRTMRITTSEPKDVAFVVDGWALEIALTHYRKAFTELAVLSRTAICCRVTPSQKAQGLLSICLQYLWAAYDNSGESLNTADHAAFDNHTSYMGSINGPKLPLVFEVQQMPHDLTTEGCPKNNFQNSCIFNKKSATVIKVLGRYPPKREVLQ

SEQ ID NO: 120343 - protein, 90 aa, Glycine max
  Coding DNA Sequence Number=SeqID_3565
MKSANTTADGTNNPATPKWIEVKSHVQSGGYECGYYVMHWMWNIVSGGLKNYWSMWFLDGTALDNETITTIRQKWAAYFLKVQSNQCTKS

SEQ ID NO: 120344 - protein, 256 aa, Glycine max
  Coding DNA Sequence Number=SeqID_3566
  Homolog annotation: Hit_ID=Q33VW5; Match level="QueryCoverage=100%, HitCoverage=29%, E-value=4e-98, Identity=69%"; Hit description=Type III restriction enzyme, res subunit
MVGLGRSLEQFWEDADMAVIDDAYRRAARIFSPAIAHSYVDHLASQVAHRNDDPEGFIEAIVEARVTVAGLGLVMEAHAYFDTEAEKLAMNWLSKYNKQIKMLSDDRRESYRQIIEMSIEPQDVELLKPEARYEATKVNESGNVKVLPVWNDHLLCGLDGKYPAELNGWERIVVETESGRSGFCYWYRNPQQPGQSSLGIAYEKAGQYGIVRPDFLFFAEQDGSIAVDLVDPHGLHLSDALAKLQGLAQYAANHMN

SEQ ID NO: 120345 - protein, 66 aa, Glycine max
  Coding DNA Sequence Number=SeqID_3567
MTVPYMTRSKTRRIKKVLQGLIMEINSTQGELEVTPHWSKVDVSGRIMPSGSSLLVLQGFLSLAYK

SEQ ID NO: 120346 - protein, 87 aa, Glycine max
  Coding DNA Sequence Number=SeqID_3568
  Homolog annotation: Hit_ID=Q8S8M1; Match level="QueryCoverage=94%, HitCoverage=7%, E-value=5e-12, Identity=41%"; Hit description =Putative retroelement integrase
KLHERVRNQIENQTKVYATKGNREIKELILNEGDWVSLYLRKERFPTKRKSKLSPRGGADTGEEGPKDLRSNPLQGGEDDAILPRKG

SEQ ID NO: 120347 - protein, 111 aa, Glycine max
  Coding DNA Sequence Number=SeqID_3569
MVAVGDGESAWKFRNGIGRKKEEEMMFFLSYTKAKASSRSFIKRLLAHSRHLLKDSNGQIMDKCLVKLQTKFREDPTVNEGWAAFLPRQLHVAFSRSFIKRLPPEASSWLL

SEQ ID NO: 120348 - protein, 48 aa, Glycine max
  Coding DNA Sequence Number=SeqID_3570
MAWSTSRALKVWKAPVRGKLYMPAKGGTTIMIIKKAQATDGTSEATAV

SEQ ID NO: 120349 - protein, 195 aa, Glycine max
  Coding DNA Sequence Number=SeqID_3571
MADGRGRPRKYARGEMQYRKLWLPENLLMELRVAARVRRYTTNDEIISRLITSMQFSPRRHVIKTDEGQRLVALARMFDEFIQSRLDIIREKCRNNEDKNTDKKTFTPGKSKAFSSSFPENLRRDMEISARFNRRSVNMEIQVRLLDSLNYLTEQQLPENEEVRRLRELAILFDEFILEKVVVAENPIAGKETGS

SEQ ID NO: 120350 - protein, 178 aa, Glycine max
  Coding DNA Sequence Number=SeqID_3572
MVLSSSQDPFEVDVFPSKRFKHTSFHNRCPNAGTVEDLEGQDAQSHSESSLSKGMSILEPIIEENAIEVDWTLVHFSNLENEQNPLAIEEQLGFEALADVSIPISVVETNELIVDQTIVEESPMVDTKNLQRETNPLDPDPFALIDVWSSDSMSLKLLNLVTTSHSHILMKLWLSFED

SEQ ID NO: 120351 - protein, 36 aa, Glycine max
  Coding DNA Sequence Number=SeqID_3573
MDTSKPYIGAMKGTMHKPQANLGADYKFSPNRFPAT

SEQ ID NO: 120352 - protein, 49 aa, Glycine max
  Coding DNA Sequence Number=SeqID_3574
MTPGHASDPLPDGHAPQPRVVPQAPKTDIPHVPEPGASSTSVEELRHAV

SEQ ID NO: 120353 - protein, 126 aa, Glycine max
  Coding DNA Sequence Number=SeqID_3575
GVSSLSSFSIPLPFIFQEAKESIDEEDPRPTSSNGACIMASPLSLPLSIPLPFIFQEAKESIDEEDPRPTSSNGAYIKKGDTKEFWRKKKFKEIHNNGSTEMLEKLLLENQSLAFIDSSSLVKKTS

SEQ ID NO: 120354 - protein, 98 aa, Glycine max
  Coding DNA Sequence Number=SeqID_3576
  Gene Ontology: Mol. function=DNA binding; Cellular component=nucleus; Biological process=regulation of transcription
  Homolog annotation: Hit_ID=Q84QS1; Match level="QueryCoverage=71%, HitCoverage=24%, E-value=1e-25, Identity=75%"; Hit description =Transcription factor GT-3b
MEGTHHLHHHHQGHQQQQQQRVLPQNMNVDVTDRFPQWSIQETKEFLVIREELDQTFMETKRNKQLWEVISNRMKEKGYHRSAEQCKCKWKNLVTRYK

SEQ ID NO: 120355 - protein, 56 aa, Glycine max
  Coding DNA Sequence Number=SeqID_3577
MQLSAITISETSRGRDSMAFRQWDWRNRHGISPLGLAKQAPITSWQQWVLPVVLAK

SEQ ID NO: 120356 - protein, 92 aa, Glycine max
  Coding DNA Sequence Number=SeqID_3578
MRILKTGQIQAKGPSGEGRRPNFYLGSLLNQSQTYQGNPCGIYPDLSSFTGSGVYPDLSSFTGSGVIQISITCIKRSAPSQVHIIWYQSFGS

SEQ ID NO: 120357 - protein, 113 aa, Glycine max
  Coding DNA Sequence Number=SeqID_3579
RIQGTNRLRILCPNTLEGTSFVAQVEGTSAWVFILRTREGTSLVDQFKWRVHPLGCSKRTREGTSLLDLWLVKDFTRLKEISRTVGCLGAGCRHGLLSNQYESCVCLLLLYTL

SEQ ID NO: 120358 - protein, 76 aa, Glycine max
  Coding DNA Sequence Number=SeqID_3580
  Homolog annotation: Hit_ID=Q4GX57; Match level="QueryCoverage=61%, HitCoverage=6%, E-value=4e-09, Identity=68%"; Hit description =Meiotic recombination 11
MEPGTNERRVIGRVNCKGGLAPTWIHSFVVTEVKEVPGMGFEISQLGSSVATSLIDGESKLKHVLLLEIKVVNLSM

SEQ ID NO: 120359 - protein, 106 aa, Glycine max
  Coding DNA Sequence Number=SeqID_3581
  Homolog annotation: Hit_ID=Q10SC2; Match level="QueryCoverage=60%, HitCoverage=7%, E-value=6e-10, Identity=46%"; Hit description=FHA domain containing protein, expressed
MSLLVETMRSKLEDTRQKLVASDNKVRQLETQVHEKKLTIGNEMKKVELERQETRRLRKEIESNKSSTLANFLGYMCGTRPRFLIFIYLLDYSTYHRHMHIYMSTT

SEQ ID NO: 120360 - protein, 87 aa, Glycine max
  Coding DNA Sequence Number=SeqID_3582
MKKKTTKNRGIDGRRMDVSMPMYNVSFIWDGVAMCSCGLDGIELEAQGTITIPQVLNLLGFSLSPNGPNWFLLIKLISIFWQSNGLT

SEQ ID NO: 120361 - protein, 67 aa, Glycine max
  Coding DNA Sequence Number=SeqID_3583
MYIGIEGVSVHNVPLGNNQLKGTEGPMKLVDRPHPHVDSLYLMTLITPQSFPQVVAGVVGCYRVWGV

SEQ ID NO: 120362 - protein, 181 aa, Glycine max
  Coding DNA Sequence Number=SeqID_3584
MSAAWSALTRRILMPRSSNLAQASEEDLILMWAFLTGRPIDWAHLICYCMHKALWSGAPLPYPQLVTLFLRHFEIPLDLEPFLLVKRSFAIGAGAVTSFGYRKDMDGQWLKKDAQPPQDECTPSPPPQRDDSSALMNEVLSELRGLHTYVGERFDSLDGRIDLLMLALKEWIPASLSLKRM

SEQ ID NO: 120363 - protein, 86 aa, Glycine max
  Coding DNA Sequence Number=SeqID_3585
MSLHVLYLYAFSGFPPGISRLLYLSLQSFKEMNGRDRLELPSGVGTKHGQQKPIKERMQVGMGSRPTDRCPFSALDKQRTSLQGSP

SEQ ID NO: 120364 - protein, 86 aa, Glycine max
  Coding DNA Sequence Number=SeqID_3586
  Homolog annotation: Hit_ID=Q1S0W6; Match level="QueryCoverage=64%, HitCoverage=11%, E-value=1e-19, Identity=78%"; Hit description=EGF -like
MNFTVQLKLEKERQHKLEEEEEIKRLRKELIPKAQPMPYFDRPFVPRRSMKHPTIPREPKFHIPQHKKIKCLVSRNDMNPYSSYLN

SEQ ID NO: 120365 - protein, 191 aa, Glycine max
  Coding DNA Sequence Number=SeqID_3587
MAPLPDTCQGQNNESNRRSTGTNEGQYGGTMKEQMTMMVEAMMIMRKMMEDNAARVVVASTVTEMDPIHSAGFNQIQNNHSFPPYGLPPNYTLPIVVYTSGENISNSTPVLIKNQQPQSDHAHVSQPMWVYPRYTTEGQAFSGIPVLNAPGISQCHPLSQPLHFEGGEGPSTVLENERIERMEERLCTIEV

SEQ ID NO: 120366 - protein, 51 aa, Glycine max
  Coding DNA Sequence Number=SeqID_3588
MEGLRRISRWSTEGLLPISLFATKETSGTPADLFALLYAGKTTVRFHLLEA

SEQ ID NO: 120367 - protein, 75 aa, Glycine max
  Coding DNA Sequence Number=SeqID_3589
MNTSEQTANMSSQKTVAQYENDQTCRNMIHLLSSLQDPSKHQKSKEVKNTKILSPTAKIKCGVVRKSHLESEDWT

SEQ ID NO: 120368 - protein, 68 aa, Glycine max
  Coding DNA Sequence Number=SeqID_3590
  Subcellular localization annotation: CTP_CleavageSite=50; ConfidenceScore=5.14e-01
MEALDKVEWSKLFTGCPIRKQNSSRRSKLNNGSSRQIRMCPKISLGCPIRGHNISRRSKLNNGSSRKI

SEQ ID NO: 120369 - protein, 149 aa, Glycine max
  Coding DNA Sequence Number=SeqID_3591
  Gene Ontology: Mol. function=sequence-specific DNA binding; Cellular component=nucleus; Biological process=regulation of transcription, DNA-dependent
  Homolog annotation: Hit_ID=Q6Q4E9; Match level="QueryCoverage=67%, HitCoverage=15%, E-value=2e-33, Identity=58%"; Hit description =PHAVOLUTA-like HD-ZIPIII protein
MVEPCFGLNFEQPSAGTTTNNSCDFAVAEILKDRQSWYHDCRCMDVLSIGPTGNGGTIGLMYMQICERSLTYSIGGPTGPPCTTFVRVEMLRSGFLIRLCECGGSIIHIVGHNDLYLWSVLEVLRPLSLMGTDGVEDVTIAINSSPNKL

SEQ ID NO: 120370 - protein, 111 aa, Glycine max
  Coding DNA Sequence Number=SeqID_3592
  Subcellular localization annotation: CTP_CleavageSite=33; ConfidenceScore=5.07e-01
MSSPQETRLGVPLSHKSFTPSETHKDNPFFVLRCFTTRDSESLSPLLEIKVVVLALVVVEFHVLVVVKELLSLAVMDFEYDMERVLIGGIGDESLTLHVPLFFSNCLICKF

SEQ ID NO: 120371 - protein, 45 aa, Glycine max
  Coding DNA Sequence Number=SeqID_3593
MQNYQHAKRFDSAKARINRKRSGSNFMTAYEDCQSPTNQPVINTE

SEQ ID NO: 120372 - protein, 527 aa, Glycine max
  Coding DNA Sequence Number=SeqID_3594
  Gene Ontology: Mol. function=sequence-specific DNA binding; Cellular component=nucleus; Biological process=regulation of transcription, DNA-dependent
  Homolog annotation: Hit_ID=Q9ZRY1; Match level="QueryCoverage=87%, HitCoverage=73%, E-value=0.0, Identity=100%"; Hit description=NDX1 homeobox protein
MAAISRLKAKILSILLSLCEAESISYLDEVASSVRSLDLAKSVALEVFDLLKKAFGRDPGHLTADRSFPMGFVQLNAMRLADIFSDDSNFRSYMILCFTKVLTAIISLSHGDFLSCWCSSNLSETEEDASIEYDIFAAVGWILDNTSPDVRNATNLEFNLIPNSMPKASYAHHRTSLFVKFFANLHCFVPNICEEQERNLFVLKVMECLQMDLSNLLPGFSFASDAPKAAIASKNLRSLLSHAESLIPNFLNVEDVQLLRVFFGELQSLFTSTGFGENQVQDSKFDESLSWDKLSKFNMNEHYQEAQSAGGCPPSLTGKEHASLNKKGGNFKEGMSENSAFPDMDQHNTRAEETNQGKGLNKQNQVDDKGIPGKTASGGAREMDKDAQNVETSGSDSSSAKGKNVVDNMDNGELSKSNERLKRTAVEENPEDEKIELSQRRKRKRTIMNDKQVMLIERALKDEPDMQRNAASLQSWADKLSGHGSEVTSSQLKNWYASICSLSSYSLSSCCLFLLLYISDDIVEHLV

SEQ ID NO: 120373 - protein, 247 aa, Glycine max
  Coding DNA Sequence Number=SeqID_3595
  Gene Ontology: Mol. function=3'-phosphoadenosine 5'-phosphosulfate transporter activity; Cellular component=integral to membrane; Biological process=positive regulation of I-kappaB kinase/NF-kappaB cascade
  Homolog annotation: Hit_ID=Q9FN90; Match level="QueryCoverage=76%, HitCoverage=55%, E-value=2e-74, Identity=72%"; Hit description=UDP -galactose transporter related protein-like
  Pfam annotation: Domain name=DUF6; Domain location=89-220; Score=7.4; E_value=0.025; Accession=PF00892.11; Description=Integral membrane protein DUF6
  Pfam annotation: Domain name=TPT; Domain location=80-218; Score=-3.5; E_value=0.00088; Accession=PF03151.7; Description=Triose-phosphate Transporter family
  Pfam annotation: Domain name=UAA; Domain location=4-226; Score=109.0; E_value=1.4e-29; Accession=PF08449.2; Description=UAA transporter family
  Pfam module annotation: Pfam domain module=DUF6::TPT::UAA; Domain location=89-220::80-218::4-226
MDPSLSFTRLSRSPNQIISSDTNCWEIRGVWGALIMQKRYQGPDYLLAFLITLGCSVFILYPAGADMSPYSRGRENTVWGVLLMVGYLGFDGFTSTFQDKLFRGYDMEIHNQIFYTTLCSCILSLTGLILQGHLIPAVEFVYNHHDCFFDIALLSTVATVSQFFISYTIRTFGALTFATIMTTRQLVSIMLSCVWFAHPLSWEQWIGAVIVFGSLYGKSFSRKMPQKTTSSITLVQKGDPNNLKDNP

SEQ ID NO: 120374 - protein, 74 aa, Glycine max
  Coding DNA Sequence Number=SeqID_3596
  Homolog annotation: Hit_ID=Q6K9N6; Match level="QueryCoverage=45%, HitCoverage=8%, E-value=7e-07, Identity=76%"; Hit description =Succinyl-CoA ligase [GDP-forming] beta-chain, mitochondrial precursor
MVRGLLNKLVCRSLYVAGKWQHNQLRCLNIHEYQVCLLTYRWRDLNLFSSFFSMRMFIILSLLDLCIMENARIS

SEQ ID NO: 120375 - protein, 126 aa, Glycine max
  Coding DNA Sequence Number=SeqID_3597
  Gene Ontology: Mol. function=3'-phosphoadenosine 5'-phosphosulfate transporter activity; Cellular component=integral to membrane; Biological process=positive regulation of I-kappaB kinase/NF-kappaB cascade
  Homolog annotation: Hit_ID=Q9FN90; Match level="QueryCoverage=71%, HitCoverage=26%, E-value=1e-40, Identity=87%"; Hit description=UDP -galactose transporter related protein-like
  Pfam annotation: Domain name=UAA; Domain location=1-125; Score= -129.6; E_value=0.00062; Accession=PF08449.2; Description=UAA transporter family
EKIMRVPYGAEKEYFKHSLFLVFCNRITTSAVSACSLLASKKAMDPVAPIYKYCLISVSNILTTTCQYEALKYVSFPVQTLAKCAKTIPVMSNNLYLKCKSLPHDSLSLKQKSFSIYENPMVALRA

SEQ ID NO: 120376 - protein, 154 aa, Glycine max
  Coding DNA Sequence Number=SeqID_3598
  Gene Ontology: Mol. function=RNA-directed DNA polymerase activity; Cellular component=mitochondrion; Biological process=DNA integration
  Homolog annotation: Hit_ID=Q1SYY5; Match level="QueryCoverage=85%, HitCoverage=8%, E-value=2e-37, Identity=56%"; Hit description =Integrase, catalytic region; Zinc finger, CCHC-type
MVVVGGEALGDRLVAEMRIFRYLIGTPNLGLCFKRGKGFIFSSFCGADYARDKLERKNTNGSYHFTGGNLVTWICKKQGSTALCTAEEKYISTASCCAQLIWIKKQLEDYKICERSIPIFNYNKATISLSKNPTLHSREKHIEIDAILSRKGIR

SEQ ID NO: 120377 - protein, 265 aa, Glycine max
  Coding DNA Sequence Number=SeqID_3599
  Pfam annotation: Domain name=DUF1635; Domain location=2-231; Score =145.2; E_value=1.8e-40; Accession=PF07795.2; Description=Protein of unknown function (DUF1635)
MQSCDELRQKLLATTLELEIMENVKRELMNLLKMAYQERDEARQELQKLVKKLTPPALFEVPSMMMIHAPTKANSSITESNSTSHVSSSVDSLLDSVSPPEFSNMNNINVDSHNLGGYLKQPSVQNNLCVSQKRTCDVGDEVIEYIAKGKVLPQKGNLLKAVMDAGPLLQTLLVAGPLPTWRNPPPLQNIKIPPLNVQDFASNNNNVNTLNSLKKPMLAPSHYSTQPTTLNVSVVNNSFQMTSNATCKNLAPSRIPQSHQHLLRN

SEQ ID NO: 120378 - protein, 149 aa, Glycine max
  Coding DNA Sequence Number=SeqID_3600
MSRGSGDLGDVRRAPGSQPIKEQSPRSKEACVAAGQLCILGGIWKLASGNRLPFGDRALPVEWILPTPTPYRLVEPVQVIEVSSSKEDLEEDPEELPPEPVVDALDFPEDDEDSFPNVDSPEDVMSASEADSTEESGPGGTTNNDDSSS

SEQ ID NO: 120379 - protein, 100 aa, Glycine max
  Coding DNA Sequence Number=SeqID_3601
MNVEFANKKVIVSKVLGTKVVFSSNSISKAIGCLHEGSTYQEGWEKNYDSHVARALYKENVDKAVYYCKFVENCTEALVCNNMILMLVENNEYEPFSLKV

SEQ ID NO: 120380 - protein, 84 aa, Glycine max
  Coding DNA Sequence Number=SeqID_3602
MGCTHGPEIYPKAHKNPRAFSCISGPIYLEFFYPMPLRSRIASELDIPSSIILRVFVDFVELLRRLSFMDGRSNVARIFLQDGW

SEQ ID NO: 120381 - protein, 188 aa, Glycine max
  Coding DNA Sequence Number=SeqID_3603
  Gene Ontology: Mol. function=transporter activity; Cellular component= integral to membrane; Biological process=transport
  Homolog annotation: Hit_ID=Q39883; Match level="QueryCoverage=80%, HitCoverage=59%, E-value=2e-76, Identity=96%"; Hit description =Nodulin-26
  Pfam annotation: Domain name=MIP; Domain location=5-185; Score=154.2; E_value=3.3e-43; Accession=PF00230.10; Description=Major intrinsic protein
MHFEEKGSVDATRKVYDLTLLTKKEYMKIIKLTNNGSATPSELVAASLSHAFALFVAVSVGANISGGHVNPAITFGAFVGGHITLFRSILYWIAQLLGSVVACLLLKFATGGLETSAFALSPGVEAGNALVFEIVMTFGLVYTVYATAVDPKKGDLGIIPPIAIGFIVGANILAGGTFDGSSCQLDLG

SEQ ID NO: 120382 - protein, 292 aa, Glycine max
  Coding DNA Sequence Number=SeqID_3604
  Gene Ontology: Mol. function=DNA binding; Cellular component=nucleus; Biological process=regulation of transcription
  Homolog annotation: Hit_ID=Q0PJI3; Match level="QueryCoverage=88%, HitCoverage=96%, E-value=1e-110, Identity=78%"; Hit description=MYB transcription factor MYB139
  Pfam annotation: Domain name=Myb_DNA-binding; Domain location=63-111; Score=50.2; E_value=6.7e-12; Accession=PF00249.21; Description=Myb -like DNA-binding domain
  Pfam annotation: Domain name=Myb_DNA-binding; Domain location=8-57; Score=39.9; E_value=8.7e-09; Accession=PF00249.21; Description=Myb -like DNA-binding domain
  Pfam module annotation: Pfam domain module=Myb_DNA-binding::Myb_DNA -binding; Domain location=63-111::8-57
MVQQEVRKGPWTEQEDFKLVSFVGLFGDRRWDFIAKVSGLKVAGESKSCRLRWVNYLHPGLKRGKMTPQEERLVLELHSKWGNRSLRWSRIARKLPGRTDNEIKNYWRTLMRKKAQDKKRGEAASSSSSSVDSSISSNNHAVDPHASKKAGEESFYDTGGHGVTASTQDQGQKGEQGLFSMDDIWKDIDNMSEENNTLQPVYEGNSEEGCNFSCPPQVPSPSSWEYSSDPLWVMDEETTSKSMNSLYTATCDQNQMTCTAYTDQYWMNCDVAWPTQAFLKLDIKGEGHGKNS

SEQ ID NO: 120383 - protein, 103 aa, Glycine max
  Coding DNA Sequence Number=SeqID_3605
  Subcellular localization annotation: CTP_CleavageSite=35; ConfidenceScore=5.37e-01
MSPPPLEPHNHSQTHLKFSRRLLLQARFSIGGFVRACTLSAILNRLALISGFRLSACFSYSADGLKRCASLDDPSLSANAQLILLSDSSSRSAEECCAQRMAC

SEQ ID NO: 120384 - protein, 70 aa, Glycine max
  Coding DNA Sequence Number=SeqID_3606
MAIEIVVLDDTIDCVYGQNGRNVVRLRQIRALPPFYWGLSQPTLWREGNVGLTSASSKGGRRAESPPTFI

SEQ ID NO: 120385 - protein, 120 aa, Glycine max
  Coding DNA Sequence Number=SeqID_3607
  Homolog annotation: Hit_ID=Q9FJD4; Match level="QueryCoverage=50%, HitCoverage=7%, E-value=5e-17, Identity=72%"; Hit description =Importin beta
MARGCHTHFYVFCTLTPNNHKICIVARINLSNGCVPREVKQRNDKHRHQRDLQVQMAMEVTQILLNAQAMDDTLRKQAEESLKQFQEHNLPSFLFSLVGELANDDKPAKSQKLAELNICG

SEQ ID NO: 120386 - protein, 88 aa, Glycine max
  Coding DNA Sequence Number=SeqID_3608
MEVHRFHISLQNHIYCDIREVLYKVLEFQAKFLRKTLTEENFDRPRGRNRLRTSQSKVNECAREGRVVRNLERGQGRMRTKNNCKEVR

SEQ ID NO: 120387 - protein, 43 aa, Glycine max
  Coding DNA Sequence Number=SeqID_3609
MLLIKAHNMFITYVSMLVLCVNEGTSDRHKTINKHVAIKTNRF

SEQ ID NO: 120388 - protein, 70 aa, Glycine max
  Coding DNA Sequence Number=SeqID_3610
KSQLAAFLASSKSKESLAQNLKEVLQLLQQEVEEEPSKKEAESSETNDDQEDDPFYQNEDDCFGISLDDD

SEQ ID NO: 120389 - protein, 270 aa, Glycine max
  Coding DNA Sequence Number=SeqID_3611
  Gene Ontology: Mol. function=nucleotidyltransferase activity; Cellular component=integral to membrane; Biological process=sulfur metabolic process
  Homolog annotation: Hit_ID=Q7WQM9; Match level="QueryCoverage=81%, HitCoverage=83%, E-value=8e-90, Identity=76%"; Hit description =Adenylyltransferase
MAGRFKGAPRQALAHAGQQLEGLGRLHAADDANHRRKHAHGGAVGLFDVVRLGKQAVVARRVRIAQVVDADLAVETDGGARHQRLAVLHTGAVDGVAGGEVVGAVQHQVGLRHGVGQGLALQPLDAGMHAGLGIESRQHVAPGLGLGPAHARSGVEDLALQVAELDDVVVGQRDLADASGGQVERGGRTQPTRPYDKHTRRQQSFLPFDTQLVEQDVAGVAQQLLVVHLSLLGSTPVGVIFMRWALPAPGLASALAWARAEPFCTGLPAS

SEQ ID NO: 120390 - protein, 129 aa, Glycine max
  Coding DNA Sequence Number=SeqID_3612
  Homolog annotation: Hit_ID=Q6ZLF2; Match level="QueryCoverage=40%, HitCoverage=2%, E-value=6e-08, Identity=51%"; Hit description=1 -phosphatidylinositol-3-phosphate 5-kinase-like
EILIDASVFGAYEVLYVHSPGLPPSPPSTPSDASGIDDGPNPGHDNNGMIMKPLGVDVPKKKKEGNNGRMIVIFVLSSSAILLKPDTSRGGGMDHGGYVKVKCIACGHRNERFVLLTAMLLDLFPVLYG

SEQ ID NO: 120391 - protein, 68 aa, Glycine max
  Coding DNA Sequence Number=SeqID_3613
MVLILDKFSQQVVLEFDSPEKCFQNLEIKDEGLDAFGGDKAFQNKMSDVERKMIMDRAYNAIILNLGD

SEQ ID NO: 120392 - protein, 185 aa, Glycine max
  Coding DNA Sequence Number=SeqID_3614
  Gene Ontology: Mol. function=DNA binding; Cellular component =membrane; Biological process=DNA integration
  Homolog annotation: Hit_ID=Q1S3Z1; Match level="QueryCoverage=75%, HitCoverage=14%, E-value=6e-19, Identity=32%"; Hit description =Integrase, catalytic region; Zinc finger, CCHC-type
  Subcellular localization annotation: CTP_CleavageSite=41; ConfidenceScore=5.13e-01
MSHLCTIILPATIKGVGTVLTSATSLKVDIQRRCLSQQRLRMSTFKDDVEVEFLGGVTNSREVPIQNEREPTAKSKSESLTNYMLAKDREKKQAKPTQRYGFAELIAFALNLAKDIEQYEPLTYVGAMKKRILGVEPTRFKVRQVAKGFTHKERVDYTEVFSSVVKHASIRVILSMVAQQELELE

SEQ ID NO: 120393 - protein, 108 aa, Glycine max
  Coding DNA Sequence Number=SeqID_3615
MLIIIDQYKEKVNLAASHGQMLEDEQAKVSTLRVEREAREGVIELLHKEAMKWMDRFALSLNESQELPRLLAKAKAVPDTYSAPDEVHSLFNYCQHMVELMTYIIRNS

SEQ ID NO: 120394 - protein, 103 aa, Glycine max
  Coding DNA Sequence Number=SeqID_3616
  Gene Ontology: Mol. function=helicase activity
  Homolog annotation: Hit_ID=Q1SN45; Match level="QueryCoverage=91%, HitCoverage=5%, E-value=1e-11, Identity=38%"; Hit description=AAA ATPase
MNQSSIRKVFLAEIEEVVKCGDVNPSSIGSRVVFSSLIVGAYPYMLNNSQDAMAICRRLGYPDLFLTVNYLQSKIARDIKIYQQKELNAFDRPDILVGCLTSS

SEQ ID NO: 120395 - protein, 141 aa, Glycine max
  Coding DNA Sequence Number=SeqID_3617
  Gene Ontology: Mol. function=RNA-directed DNA polymerase activity; Biological process=RNA-dependent DNA replication
  Pfam annotation: Domain name=AT_hook; Domain location=66-78; Score =14.9; E_value=0.061; Accession=PF02178.9; Description=AT hook motif
MRMLRWMCGKTRQDKIRNEAIRERVGVAPIVEKMVENRLRWFGHVERRPVDSVVRRVDQMERRQTIRGRGRPKKTIREVIKKDLELNDLDRSMDSKIQASIRKLMMRKYCVLLRKDEIFITIGTSVSTPKDEPWWYHACKC

SEQ ID NO: 120396 - protein, 87 aa, Glycine max
  Coding DNA Sequence Number=SeqID_3618
MGPVRGFKKKRKPEKKHDKNGSAAASGSPEGDGPVDWWDDLSKRMNVHYVCMRNSKEKWYFLLGAGMVVQSVCFHIFKDFQHIHQKQ

SEQ ID NO: 120397 - protein, 56 aa, Glycine max
  Coding DNA Sequence Number=SeqID_3619
MVHKGGLRPKGCGGGRKGSKLFAAALSMATPNTSTSDGAERKLHRYTEKLTKITYI

SEQ ID NO: 120398 - protein, 1104 aa, Glycine max
  Coding DNA Sequence Number=SeqID_3620
  Homolog annotation: Hit_ID=Q9LHB1; Match level="QueryCoverage=97%, HitCoverage=93%, E-value=1e-151, Identity=49%"; Hit description =Transcription factor X1-like protein
  Pfam annotation: Domain name=XH; Domain location=1006-1104; Score =126.0; E_value=1.1e-34; Accession=PF03469.5; Description=XH domain
  Pfam annotation: Domain name=XS; Domain location=619-736; Score =185.1; E_value=1.7e-52; Accession=PF03468.5; Description=XS domain
  Pfam annotation: Domain name=zf-XS; Domain location=160-202; Score =68.6; E_value=2e-17; Accession=PF03470.5; Description=XS zinc finger domain
  Pfam annotation: Domain name=zf-XS; Domain location=246-289; Score =78.9; E_value=1.6e-20; Accession=PF03470.5; Description=XS zinc finger domain
  Pfam annotation: Domain name=zf-XS; Domain location=429-473; Score =73.6; E_value=6.5e-19; Accession=PF03470.5; Description=XS zinc finger domain
  Pfam annotation: Domain name=zf-XS; Domain location=44-86; Score =86.4; E_value=9.1e-23; Accession=PF03470.5; Description=XS zinc finger domain
  Pfam annotation: Domain name=zf-XS; Domain location=549-593; Score =88.7; E_value=1.8e-23; Accession=PF03470.5; Description=XS zinc finger domain
  Pfam module annotation: Pfam domain module=XH::XS::zf-XS::zf-XS::zf -XS::zf-XS::zf-XS; Domain location=1006-1104::619-736::160-202::246 -289::429-473::44-86::549-593
MAHCSNKDNDPSASQLSWWYVDISYQELKKGSYKVMRSDETFICPYCPERKQDYKYRELLNHASGVGRSSSEKRTAKEKANHLALVKYLEKDLVHMDVPSKPVDKGAKLLSPGETIMPHCSNKDTDISASQISWWYVDTSYEELKNRSHNVKTSDVTFICPYCPRRKQDYLYRELLEHAYMVGRSSSEKRSARERANHLALVKYLENDLIIMDGPPEPVDKGTKLSLGQTVEAQCSNKETDQTLSCPYCPRKRKRDYVYRELLEHASGVGQSSSQKRHVREKTTHLALMKYLKNDLKYMNDPSKSVNECNPPVNRGDQSSSQERSVREDATHLPSVKYLKKDLTNVSGPSSKPVNEGDPPVVNEEVFLVIGYAEIGTITVSPGETVIGCCSNKDSNISSSQIVWYAENFYEELKRGIHNVKTSDETFRCPYCPNKKINRDYAYREILEHASGVGQSKSQKRSFIEKANHLALVKYLKRDLMNVGAPCPSKPMDQGTKTISPGETLMGQYSHKDNNIRESQISGWYVHKSYEALKKGSHNVKTSEMTFSCPYCPNKKRKRDYLYREILEHASGVGQSSSEKRSAIEKANHLALIKYLEKDLMIVDGPPKTADEGSPPFNFEKQFVWPWTGVVVNIPTRLTEDGRCVGESGSKLRDEYRSRGFNPRRVRILSNFCVHSGTAVVEFNKNWTGLDNALAFERAYELDHHGKKDWFANTQHKSGIYAWIAQADDYKMNNIIGEQLRKMVDIKTISELMEEEARTQDKLVSNLNNTLQVKKKRLKEMEVKYYETSRRMDIVMGEIDKLTQGHNQEMKKIQSSATQHFQNIFNGHERLKLQLESQKRELELRRIELEKREARNESERKKLEEEIMENALKNSSLDMAVLEQQKAGENVLKLAADQKRQKEQFHAKIILLERQLEVKQKLELEIQQLKGKLNVMAHIEDDGDSEVLNKVDALHKDLREKEQSLRDLDSLNQTLIIKERQSNDELQEARKELINGIKEISCRANVGVKRMGELDIRPFLEAMKIKYNNEDAEDRASELCSLWEEYIRDPDWHPFKITIIEGKHQEIIDDEDEKLKGLKNEMGEGVYKAVVTALTEINTYNPSG

SEQ ID NO: 120399 - protein, 1130 aa, Glycine max
  Coding DNA Sequence Number=SeqID_3621
  Gene Ontology: Mol. function=binding; Cellular component=COPI-coated vesicle; Biological process=protein transport
  Homolog annotation: Hit_ID=Q9M2T1; Match level="QueryCoverage=98%, HitCoverage=99%, E-value=0.0, Identity=58%"; Hit description=Adaptor protein/ adaptin-like
  Pfam annotation: Domain name=Adaptin_N; Domain location=31-639; Score= 300.9; E_value=2.4e-87; Accession=PF01602.10; Description=Adaptin N terminal region
  Pfam annotation: Domain name=HEAT; Domain location=136-172; Score =16.2; E_value=0.12; Accession=PF02985.12; Description=HEAT repeat
  Pfam annotation: Domain name=HEAT; Domain location=174-210; Score =12.1; E_value=1.4; Accession=PF02985.12; Description=HEAT repeat
  Pfam module annotation: Pfam domain module=Adaptin_N::HEAT::HEAT; Domain location=31-639::136-172::174-210
MMFPQFGATAESLNKASTAVFRIGTDAHLYDDPEDVNIAPLLDSKFDSEKCEALKRLLALIAQGFDVSNFFPQVVKNVASQSLEVKKLVYLYLLHYAEKRPNEALLSINYFQKDLGDTNPLVRAWALRAMAGIRLHVIAPLVIVAVQKCARDPSVYVRKCAANALPKLHDLRMEEHASAIEEIVGLLLNDHSPGVVGAAASAFTSVCPDNFSLIGRNYRRLCEILPDVEEWGQIILIGILLRYVIARHGLVKESIMFSLYNKDINNLEEDESYITSKEDAGYSIDKTVSELATMVFQCYIEGPDEYLSRSSSTNRVAPKLDVSQYTSCSNDVVKILLQCTSPLLWSNNSAVVLAAAGVHWIMASKEHITRIVKPLLFVLRSSSASRYVVLCNIQVFAKAIPSLFAPHYQDFFICSSDSYQIKALKLDILSSIATDSSISVIYKEFQDYIGDPDRRFAADTVAAIGLCAQRLPKMATLCLEGLLTLVRQDFFCGEIRSLDGEEGVLIQAIIFIKSIIKLEPSSYEKVIIQLVRSLDKIKVPAARAMIIWILGKYCSLGDIIPRMLSTVLKYLALCFTSEALEAKLQILNTTAKVLLCIKGEDILTVRKIWTYIIELAECDLNYDIRDRSRFLKKLLSSNLESQHGEEENSESQKRDQSHILSECIFGGQTKAVTVPSEPIDYRFYLPGSLSQLVFHAAPGYEPLPKPCSLPYTDLDQYDGASKSDSDEEDNTGTSGSLDEESASDYSSEQSITASGEVTGSDESVSGNEGEDNADPLIQISDTVNVCENQNGGAPSGAAGFRDLMSTKSLESWLDEPARSSKGSEIEQSRVRRSSARITIGNIGGRVKPKCYSLLDPVNGNGLKVNYSFSSETSSISSHLVCLEVLFENCSLEPMFDIVLIEEDYSKSSDSTDQTSSPTENTLKFHVDKPALVSMEEIPSLEPGQTANRTLLVRFHHHLLPLKLALFCNDKKFLVKLKPDIGYFVKPLPLSIEDFKDKESRLPGMFEYVRSCTFNDHILELNKDSNSLTEDKFLVICETLALKMLSNANLSLVSVDMPVAANLDDASGLCLRFSSEILSNSMPCLITVTVEGKCSDPLIVSVKVNCEETVFGLNFLNRVVNFLVEPSVGHL

SEQ ID NO: 120400 - protein, 61 aa, Glycine max
  Coding DNA Sequence Number=SeqID_3622
MEVSITYELNPDRLHELKAFDDSKAGNTEHIIPVIHLSKFGKELSSLQEIVGGRIRKAYEK

SEQ ID NO: 120401 - protein, 174 aa, Glycine max
  Coding DNA Sequence Number=SeqID_3623
  Gene Ontology: Mol. function=hydrolase activity, hydrolyzing O -glycosyl compounds; Biological process=carbohydrate metabolic process
  Homolog annotation: Hit_ID=Q2HU62; Match level="QueryCoverage=66%, HitCoverage=20%, E-value=2e-29, Identity=52%"; Hit description =Glycoside hydrolase, clan GH-D; Ricin B lectin
MVKRNNISTSCKCSATALKKIENTIFLGVIWYEGEKRGGGGKRRKEKRSRTDEWFGKKEEEDMTLWSMAKAPLMYAGDVRKIDPSTYDHWQFPYITSVNSEDQDLGKQMRRSSKEIKTTDTHSLGLTSCTESKASGLASGSLNQYLERICWKRSLGNKHLAPFCVHKRELYFTL

SEQ ID NO: 120402 - protein, 63 aa, Glycine max
  Coding DNA Sequence Number=SeqID_3624
MEFKVFLLVILLLFQAFAEASSITGVANSLEITNEGSQTVALNNEHIHLHKIMELYYMPNAVN

SEQ ID NO: 120403 - protein, 132 aa, Glycine max
  Coding DNA Sequence Number=SeqID_3625
MRINSEAIAGKMKHKAKQSGSPQYSCEYDDFSRQPFNEDSYKDKKNEDIDDNVIPSSTTGCLGVRRDAKKHGKREGTLKLKEKDNIGLGEEGKLLNDEKVSKEMDEYNREKEYENLRRRYKRKAKKAFQKQL

SEQ ID NO: 120404 - protein, 45 aa, Glycine max
  Coding DNA Sequence Number=SeqID_3626
MVRGASILKPYYYEPGTRRKFRSLLSVQRHLAGETGDCVVANSII

SEQ ID NO: 120405 - protein, 48 aa, Glycine max
  Coding DNA Sequence Number=SeqID_3627
MGLPLTVEAFPSYQLGFRSGFGVSAELAGCETQLSFTMEALTSYQPDY

SEQ ID NO: 120406 - protein, 81 aa, Glycine max
  Coding DNA Sequence Number=SeqID_3628
  Subcellular localization annotation: CTP_CleavageSite=44; ConfidenceScore=5.34e-01
MAVLKTDTISRNFRFSLPHIFGFPMAGFSSKGPVPLTLLTLTVTKSYLSKLVDYSSYSSKKLFNYFWFCPVAWIVLLVLAL

SEQ ID NO: 120407 - protein, 209 aa, Glycine max
  Coding DNA Sequence Number=SeqID_3629
MIRGDTLRLSAPLCHPEAAGPMIRGDTLRLSAPLCHPEAAGPMIRGDTLRLSAPFCHPEAAGPMTSRDKIWSFCTLVSSRGGGPDDTRRYLTVIRTLLSSRGGGPDDKQRQNLAAGPMIRGDTLRLSAPFCHPEAAVPMTSRDKIWSFCTLVSSRGAGPDDTRRYLTVIRTLVSSRGGGPDDTRKYPSGYSYKHSFAICKTERLIACRD

SEQ ID NO: 120408 - protein, 156 aa, Glycine max
  Coding DNA Sequence Number=SeqID_3630
  Gene Ontology: Mol. function=catalytic activity; Cellular component =cytosol; Biological process=purine ribonucleotide biosynthetic process
  Homolog annotation: Hit_ID=Q0XEK1; Match level="QueryCoverage=96%, HitCoverage=32%, E-value=1e-65, Identity=80%"; Hit description =Putative 3-carboxy-cis,cis-muconate cycloisomerase
MGARQRKGAVHHLRGLAQVVARVGEALQRRAVEMGRDFGQAGQRIGQRAALGVDAAAGGIDDVVRLLAARVRGQAHHHGLGHDQAVGHVQVAGHAFGIDDEAAEHEARLVQGAGREHEALGQGHPFGVPGAGGALQVLDHGVQHQARMLAHGLGAQ

SEQ ID NO: 120409 - protein, 506 aa, Glycine max
  Coding DNA Sequence Number=SeqID_3631
  Gene Ontology: Mol. function=oxidoreductase activity; Cellular component=membrane; Biological process=electron transport
  Homolog annotation: Hit_ID=Q9S833; Match level="QueryCoverage=91%, HitCoverage=92%, E-value=1e-158, Identity=59%"; Hit description =Putative cytochrome P450
  Pfam annotation: Domain name=p450; Domain location=39-499; Score =133.6; E_value=5.6e-37; Accession=PF00067.12; Description=Cytochrome P450
MGGAFMILLELLPLSLIFLPILFYITLAAFWRGDKISGPASPATYPLIGCLISFYRNKHRLLDWYTELLAQSPTNTIVVQRLGARRTIVTANPQNVEYMLKTNFNNFPKGKPFTEILGDFLGQGIFNVDGEPWLTQRRLASHEFSTKSLREFVMHTLEKEVCERLVPVLEALCGENKVVDLQELLGRFSFNVICRFTLGTNRCCLDPSVPTCPLARAFDVAAEVSAKRGAAPLFMMWRVKRWLGAGSERLLKNAVGEVQTHVMRMIQERKKQKGERNDDDVEDDLLSRLICAGHEEEIIRDMVISFIMAGRDTTSAAVTWFFWVLSHYSHLEEKIVEEAKGVLDYESLKNLSFLKACLCESMRLYPPVAWDSKHATDDDLLPDGTVVKAGDRVTYFPYGMGRMEDLWGKDWFQFRPDRWFVEPRNIEGIIMLNDVSPFSFPIFQAGPRVCLGKEMAFIQMKYVVASILSRFTFRIVGPEKPIFVPLLTAHMAGGLRVLVCKRGKKS

SEQ ID NO: 120410 - protein, 48 aa, Glycine max
  Coding DNA Sequence Number=SeqID_3632
MIGTMHELQENLGADKKSSPDRLKTQKGGLGKRTTAKLAGRVMQTTHA

SEQ ID NO: 120411 - protein, 118 aa, Glycine max
  Coding DNA Sequence Number=SeqID_3633
MKREKHASYSSHDSCKSLSEELSDYYRGRHRPHTKHHSHRREKDKRPQEVNISLPYFHGKDNVEVYLDWEMKVEQLFACHHIGDERTVPLSTISRVVIIKLIDTVDLEGGPGTSFCSL

SEQ ID NO: 120412 - protein, 121 aa, Glycine max
  Coding DNA Sequence Number=SeqID_3634
MGWKKRKKIPPRRLLRRKIILQQKVIAKEHSFLNNPSTFLLSRETSLSTTTIPTFDTLHPKVHKHLHEFGDIFPKEIDAIHPRRGPVTRAMARRLQEDWARYAGEGPRVLMSLTGDFGPMG

SEQ ID NO: 120413 - protein, 257 aa, Glycine max
  Coding DNA Sequence Number=SeqID_3635
  Gene Ontology: Mol. function=electron carrier activity; Cellular component=extracellular region; Biological process=cellulose and pectin-containing cell wall organization and biogenesis
  Homolog annotation: Hit_ID=Q6T5H7; Match level="QueryCoverage=99%, HitCoverage=99%, E-value=1e-136, Identity=86%"; Hit description =Alpha-expansin 1
  Pfam annotation: Domain name=DPBB_1; Domain location=66-153; Score =179.0; E_value=1.2e-50; Accession=PF03330.8; Description=Rare lipoprotein A (RlpA)-like double
  Pfam annotation: Domain name=Pollen_allerg_1; Domain location=164 -241; Score=162.2; E_value=1.3e-45; Accession=PF01357.11; Description= Pollen allergen
  Pfam module annotation: Pfam domain module=DPBB_1::Pollen_allerg_1; Domain location=66-153::164-241
MPSLIAIVTLIAVVLTSTEARIPGAYSGGAWETAHATFYGGSDASGTMGGACGYGNLYSQGYGVNTAALSTALFNNGLSCGACFEIKCANDPSWCHAGSPSIFVTATNFCPPNYALPNDNGGWCNPPRPHFDLAMPMFLKIAQYRAGIVPVSYRRVPCRKQGGMRFTINGFRYFNLVLITNVAGAGDIVKTSVKGSKTGWMSMSRNWGQNWQSNAVLVGQSLSFRVTASDRRTSTSWNLVPANWQFGQTFTGKNFKV

SEQ ID NO: 120414 - protein, 202 aa, Glycine max
  Coding DNA Sequence Number=SeqID_3636
  Gene Ontology: Cellular component=extracellular region; Biological process=cellulose and pectin-containing cell wall organization and biogenesis
  Homolog annotation: Hit_ID=Q6T5H7; Match level="QueryCoverage=75%, HitCoverage=59%, E-value=7e-77, Identity=83%"; Hit description=Alpha- expansin 1
MNLNSGWFRESCNYAAKGARLSKILNRFQMNGSDGDDAGAVLSDFEEHGHGQVEVRPRRVAPSSIVVRKSVVWGAEVCGGYEDGGAASVAPAGVVGALYLEAGTAAQPVVEQRRAQRRRVHAVALAVQVPVPARAAHCPRRVAAAVERGVRGLPRAAAVGARDPRLGGSQNNGYEGHNGDERRHAEEGILNSTESEVCVLRK

SEQ ID NO: 120415 - protein, 112 aa, Glycine max
  Coding DNA Sequence Number=SeqID_3637
  Homolog annotation: Hit_ID=Q9SXH3; Match level="QueryCoverage=64%, HitCoverage=22%, E-value=1e-06, Identity=73%"; Hit description=FtsJ
MSSGSSVLDLGCAPGGWQSLGPLRNGGSKEGQEFARCFFFGVLKVGGHLAIKVLESEDAKGSSLLAYLSASYMIDVLFNSIAFGCVSNVLLFGGRHRGSDLKLQGLRQERII

SEQ ID NO: 120416 - protein, 113 aa, Glycine max
  Coding DNA Sequence Number=SeqID_3638
  Homolog annotation: Hit_ID=Q9LHH0; Match level="QueryCoverage=65%, HitCoverage=5%, E-value=9e-09, Identity=76%"; Hit description=Actin -like protein
  Subcellular localization annotation: CTP_CleavageSite=30; ConfidenceScore=5.07e-01
MARPLHKVAKNNTRFRLSRPPDNNSRKPKRALTEKNQFAEKGTVKIRVGERRIVEYPMRKYEAPLSITRGVLESKRTRERAKWLAEMKRTAWLNRTGLVGSTEKCIGDEEEHE

SEQ ID NO: 120417 - protein, 626 aa, Glycine max
  Coding DNA Sequence Number=SeqID_3639
  Gene Ontology: Mol. function=protein binding; Cellular component =cytosol; Biological process=regulation of transcription, DNA -dependent
  Homolog annotation: Hit_ID=Q9LHH0; Match level="QueryCoverage=99%, HitCoverage=86%, E-value=0.0, Identity=61%"; Hit description=Actin -like protein
  Pfam annotation: Domain name=Actin; Domain location=4-622; Score= -15.1; E_value=1.8e-13; Accession=PF00022.9; Description=Actin
MEYILDFGFDRMGANGTEIDHPVLITECVCNPVQSRSKMAELLFETYGVPSIAFGVDVAFSYKYNQQQGVCAKDCLALCPGFNTTHVIPFVDGEPVYEGCCRTNVGGFHVTDHLKQLLSLKYPYHLARFTWEKVEDLKMEHCYIAPDYVSEVRLFQKGAKEAEEKTRCWQLPWVPPPIEEPPSEEEIARKAAIKEKQGQRLREMAEAKRSSKINELENELHGLEFLFHQLEQVEESKVLSFLAETGYGSRQEIESARNKVMQSLRKAKGEPKNEQDETEKVDPAANEKYSLINIPDDMLTQEQLNEKKKQLSLKSMAEGRQRLKQKRHEEELERERKQQLEEEKRLENPELYLEQLHARYKDLSERLDQQKRLKTNGGHSNGNNLSGGVGRGERLNAAQRERMRLLTTAAFDRGKGEDTFGARDEDWQLYKLMSKDYNDDDEGPDEEEAELACISSRLQDLDPTFIPKLEAGISQPAELPHVRPLTKEDFQIFLGVERFRCPELLFNPNWIAVDQVGLDEMVGVSIRRLPYKDESLEQRLTSSILVTGGSSLFPGIVERLEAGIRMIRPCGTPIKIVRALDPVMDAWRGAASFASDPQFHMQTFSRLDYYEKGEDWLRNYQLQYTL

SEQ ID NO: 120418 - protein, 237 aa, Glycine max
  Coding DNA Sequence Number=SeqID_3640
  Gene Ontology: Mol. function=transcription factor binding; Cellular component=intracellular; Biological process=regulation of transcription, DNA-dependent
  Homolog annotation: Hit_ID=Q40219; Match level="QueryCoverage=93%, HitCoverage=93%, E-value=5e-81, Identity=75%"; Hit description=RAB8E
  Pfam annotation: Domain name=Arf; Domain location=1-199; Score=-85.7; E_value=0.0038; Accession=PF00025.11; Description=ADP-ribosylation factor family
  Pfam annotation: Domain name=MMR_HSR1; Domain location=16-147; Score=- 4.6; E_value=0.0026; Accession=PF01926.13; Description=GTPase of unknown function
  Pfam annotation: Domain name=Miro; Domain location=17-147; Score =72.6; E_value=1.3e-18; Accession=PF08477.3; Description=Miro-like protein
  Pfam annotation: Domain name=Ras; Domain location=17-201; Score =316.6; E_value=4.5e-92; Accession=PF00071.12; Description=Ras family
  Pfam module annotation: Pfam domain module=Arf::MMR_HSR1::Miro::Ras; Domain location=1-199::16-147::17-147::17-201
MAAPPARARADYDYLIKLLLIGDSGVGKSCLLLRFSDGSFTTSFITTIGIDFKIRTIEQDGKRIKLQIWDTAGQERFRTITTAYYRGAMGILLVYDVTDESSFNSKAFSFGIIIQLVPISDIRNWIRNIEQHASDNVNKILVGNKADMDESKRVVPTSKGQALADEYGIKFFETKKFILQSAKTDLNVEEVFFSIARDIKQRLADTDSKAEPAGIKIDNQKDQATAGEVAQKSACCG

SEQ ID NO: 120419 - protein, 68 aa, Glycine max
  Coding DNA Sequence Number=SeqID_3641
MVKDIEEGCRTPKRSACRIPAAMVCPPAPKKKPAIYPARKRVPPKKGYFVPPDLELIFRVAPTREAFA

SEQ ID NO: 120420 - protein, 110 aa, Glycine max
  Coding DNA Sequence Number=SeqID_3642
MRLSSNNELMSFIFAGWSKHVQDIALAMTTFYVWTIWHCRNNKCLNNKAISFDAYSASMNSFIQEFVIRKQLGIIDHPRRADHISLVTWNPFYMDGLSTTLTARLMAFLA

SEQ ID NO: 120421 - protein, 53 aa, Glycine max
  Coding DNA Sequence Number=SeqID_3643
MEDDWMGCKVHWQQDLHWKMSIFFLWIVKLEKLRCCCSLELVVADEKENFACC

SEQ ID NO: 120422 - protein, 225 aa, Glycine max
  Coding DNA Sequence Number=SeqID_3644
  Homolog annotation: Hit_ID=Q2HT93; Match level="QueryCoverage=99%, HitCoverage=30%, E-value=8e-23, Identity=31%"; Hit description=P -type trefoil
MELSQCLATLGESIGSLSLLVAGKTDLEDNQRKLKMQVKELRKFVVEAEVEPNFWFLPFDMVDLMWFGELALKFLQQEFQRCGACEKEDMKMLEGEVGRFKELICSSIKSLAEISSTNFVAKEVEKNNNSCDLEAGKSNGGNNTCMVSGLGEDGIEQTIGSFLQLSRIVVDNLYGDEGEKEMKSQVVLSLSAVGFSLCACIRGTMEIEEAIKELVQWENPSSEIN

SEQ ID NO: 120423 - protein, 122 aa, Glycine max
  Coding DNA Sequence Number=SeqID_3645
  Homolog annotation: Hit_ID=Q2HT93; Match level="QueryCoverage=34%, HitCoverage=5%, E-value=4e-07, Identity=50%"; Hit description=P-type trefoil
  Subcellular localization annotation: CTP_CleavageSite=60; ConfidenceScore=5.04e-01
MNQGSRDKNLMGKNLSNTKQPKTPYTDPNTVPWALTFAALNVAWVLLGLEHKLEVRSMISCGGVWPKIRRRKWVNLGELLEWYEGIGERGLWFCIGFGNSNMLLEAVKNMFKVLVEKIAHWE

SEQ ID NO: 120424 - protein, 102 aa, Glycine max
  Coding DNA Sequence Number=SeqID_3646
MNSRRRLADVCGSHKKCCDLQLGFSSSFCELKDIQLNVWIGSPVTVDPSRLPFVLEKQIVLLLYLYMAVLPSAALLWLLKRDDNKATTSNSHSVLISSDKYP

SEQ ID NO: 120425 - protein, 222 aa, Glycine max
  Coding DNA Sequence Number=SeqID_3647
  Homolog annotation: Hit_ID=Q5CSU9; Match level="QueryCoverage=65%, HitCoverage=32%, E-value=7e-08, Identity=25%"; Hit description=Sec14 domain containing protein
  Pfam annotation: Domain name=CRAL_TRIO; Domain location=1-174; Score =12.0; E_value=1.1e-06; Accession=PF00650.10; Description=CRALTRIO domain
MVFWHGSDVGHRPCLIVRLGLACSTLTSGDRPRFAQAVISQVEYGVLHLVDAGNPQITVLVDCEGLPPVRIPMQIIRSCSSLLQDHFPNCLGCMFVIRLPANVLVISQTFIQTLEPATRNKLKIEGEMYQKVLSDYLPKLPSYLGGCCTCMKCSNIDHGNMLQTYATGTSRRDGLEDTTDRDNDNEDSPTLHPSNELEGNLYANYDQLLRTAIVVFDPSNLH

SEQ ID NO: 120426 - protein, 251 aa, Glycine max
  Coding DNA Sequence Number=SeqID_3648
  Homolog annotation: Hit_ID=Q2HT93; Match level="QueryCoverage=19%, HitCoverage=5%, E-value=6e-09, Identity=52%"; Hit description=P-type trefoil
  Subcellular localization annotation: CTP_CleavageSite=85; ConfidenceScore=5.38e-01
SSGRSVLPEDVWLLPEEHFFRKLSGKRSSGTSGRTPNGSSGSLRRQPLFPIFSGVLSSRFLPSSPLVFYPKVTILRGVRETNLVRGEEEDDVRACLAGEEEAVRGEEEAVRGRNEQQKRQNCPFIKVAGCTSNIAGKLAKMNQGSRDKNLMGKNLSNTKQPKTPYTDPNTVPWALTFAALNVAWVLLGLEHKLEVRSIISCGGVWRKIRRRKWVNLGELLEWYEGIGESNMLLEAVKNMFKVLVENIAHWE

SEQ ID NO: 120427 - protein, 152 aa, Glycine max
  Coding DNA Sequence Number=SeqID_3649
  Gene Ontology: Mol. function=small conjugating protein ligase activity; Cellular component=endoplasmic reticulum; Biological process=protein modification process
  Homolog annotation: Hit_ID=O24560; Match level="QueryCoverage=74%, HitCoverage=49%, E-value=2e-23, Identity=52%"; Hit description =Ubiquitin carrier protein
  Pfam annotation: Domain name=UQ_con; Domain location=1-136; Score =65.2; E_value=2.1e-16; Accession=PF00179.16; Description=Ubiquitin -conjugating enzyme
MSFPPNYPNSPPSVKFTSELWHPNVYPDGRVCISILHPPGDDPNGYELASERWTPVHTHCINDSSHSHSRIELSIPCTVNEKGNISLLVESIVLSIISMLSSPNDESPANVEAASYLMATYLHPREEKMTKLGNWARMGRVLLNPTLPHPLR

SEQ ID NO: 120428 - protein, 126 aa, Glycine max
  Coding DNA Sequence Number=SeqID_3650
  Subcellular localization annotation: CTP_CleavageSite=2; ConfidenceScore=5.04e-01
MGCSIESKLEHTSPGPGRTIFSSSFVSLSIIISTLQNPFTYTIPYYKYNSTLFAFSLFSSLLSLLLRNLRTEHNRALQLSLSLMASQASLLLQKQLKGAPYPAPSLTRSTPFLSFRLSVDFPHPFD

SEQ ID NO: 120429 - protein, 57 aa, Glycine max
  Coding DNA Sequence Number=SeqID_3651
LRMPTLVKETSKVKAWQSHPNTQGYFDLLTKDRIRQCGTGQNRATGQGKCRPCGLWV

SEQ ID NO: 120430 - protein, 261 aa, Glycine max
  Coding DNA Sequence Number=SeqID_3652
  Gene Ontology: Mol. function=transcription regulator activity; Cellular component=nucleus; Biological process=regulation of transcription
  Homolog annotation: Hit_ID=Q67UR9; Match level="QueryCoverage=95%, HitCoverage=41%, E-value=1e-115, Identity=80%"; Hit description =Putative TAF5
  Pfam annotation: Domain name=WD40; Domain location=102-140; Score =51.7; E_value=2.4e-12; Accession=PF00400.22; Description=WD domain, G-beta repeat
  Pfam annotation: Domain name=WD40; Domain location=144-182; Score =48.2; E_value=2.8e-11; Accession=PF00400.22; Description=WD domain, G-beta repeat
  Pfam annotation: Domain name=WD40; Domain location=18-56; Score=43.1; E_value=9.5e-10; Accession=PF00400.22; Description=WD domain, G-beta repeat
  Pfam annotation: Domain name=WD40; Domain location=186-224; Score =54.7; E_value=3.1e-13; Accession=PF00400.22; Description=WD domain, G-beta repeat
  Pfam annotation: Domain name=WD40; Domain location=60-98; Score=41.4; E_value=3.1e-09; Accession=PF00400.22; Description=WD domain, G-beta repeat
  Pfam module annotation: Pfam domain module=WD40::WD40::WD40::WD40::WD4 0; Domain location=102-140::144-182::18-56::186-224::60-98
GENDTSQNEQIFGQGGGKRQYTLFQGHSGPVYAASFSPVGDFILSSSADSTIRLWSTKLNANLVCYKGHNYPVWDVQFSPVGHYFASSSHDRTARIWSMDRIQPLRIMAGHLSDVDCVQWHANCNYIATGSSDKTVRLWDVQSGECVRVFVGHRVMILSLAMSPDGRYMASGDEDGTIMMWDLSSGRCLTPLIGHTSCVWSLAFSSEGSIIASGSADCTVKLWDVNASTKVSRAEENFLEGIFFLRLALYQKVVNIFEYVY

SEQ ID NO: 120431 - protein, 329 aa, Glycine max
  Coding DNA Sequence Number=SeqID_3653
  Homolog annotation: Hit_ID=Q62DN9; Match level="QueryCoverage=57%, HitCoverage=42%, E-value=2e-29, Identity=42%"; Hit description=FHA domain protein
MDVIGFDDLPCTLSWREVADRFDPQQHISYWWSNRSDGFAHATHKHSGPLTAQLFSLLFNPAAGAQPGRTGAPVARRRVPPDQPGQRHFSGAERRGAAARLAGAAAPRRYAADWRIWPGSAAADPLGMQQDESVPEPEVLPQSDSPRHERRPDARLAIDPQSDAPVMPAVLAGADQDKLIAALLEGMGLNNGHQTPITEEQMRVTGRMLSLFSQGTVALLSSRSILKRGVKADMTMILNEANNPFKILPSGKTVLMQMYQSQMPGFMPPEAAVRDALVDLQAHQLGMIAGIRAIIAAMLQSFNPQRLEEEARKDGVLPKMPFSGGRKAA

SEQ ID NO: 120432 - protein, 168 aa, Glycine max
  Coding DNA Sequence Number=SeqID_3654
  Homolog annotation: Hit_ID=UPI000019713A; Match level="QueryCoverage =46%, HitCoverage=8%, E-value=9e-28, Identity=70%"; Hit description =nucleic acid binding / zinc ion binding
  Pfam annotation: Domain name=DUF537; Domain location=96-168; Score =61.4; E_value=2.9e-15; Accession=PF04396.4; Description=Protein of unknown function, DUF537
MEENRERPCSYDENFIKKNKTIHFNVLLSFESNCNNVFQLPANKNKQEEFDDFAHPHPPNPAACLFVYIGEIRVLKRSLMDGDGATTIAEAQYATAKTSVWWDIENCHVPKGSDPHAIAQNISSALVRMNYCGPVSISSYGDTTRIPASVQHALSSTGISLNHVPAGR

SEQ ID NO: 120433 - protein, 538 aa, Glycine max
  Coding DNA Sequence Number=SeqID_3655
  Homolog annotation: Hit_ID=Q10B16; Match level="QueryCoverage=16%, HitCoverage=15%, E-value=2e-27, Identity=63%"; Hit description =Expressed protein
  Pfam annotation: Domain name=X8; Domain location=400-484; Score =164.9; E_value=2e-46; Accession=PF07983.3; Description=X8 domain
  Subcellular localization annotation: CTP_CleavageSite=80; ConfidenceScore=5.79e-01
MAKEPSLCLLFLSFLIFCSSGTSVSSSSSSVGTTFFQKSKISKSEIRFSVSDCKILSTLTNTNLSVDFFLNESLVENFVSSKSKSSLVSWLETHLMNIIPQVDIRSIVVRCGSECLGQYEMPSLIPILKSIHSFLSNLQLRREIKVSVAFPLSFLENLNALYGNDLLRIVMFLKKIDSFIMIEDIIGGELSTVQSVIERATLAASILPCKDVPVVLTIKSHDIPNSMELSQFSEAVSKYLEAISHFTNRIVALIAQVYTLNDFLLLKREEGEEICPLSLRENPSKVHIRRTLQDTTNTPTTVFPTNPTPPSPVITPPDTPTIITVPSTNPVTVSPTNPASTPVTVPSTTPVVPLPPTNPANPVTNPVASYPPPSSGSVPVTSALPPPPSTNAQAMPAGQSWCVAKTGVPQASLQSALDYACGMSGVDCSQIQQGASCYNPNSLQNHASFAFNSYYQKNPAPTSCDFGGTANIVNTNPSSGSCIYPSSSGAGASGSGTGSPVLGSQSPPDLNTSYSAGLRPLIGCMVLAISLVTVRLTT

SEQ ID NO: 120434 - protein, 161 aa, Glycine max
  Coding DNA Sequence Number=SeqID_3656
  Gene Ontology: Mol. function=protein serine/threonine kinase activity; Cellular component=nucleus; Biological process=protein amino acid phosphorylation
  Homolog annotation: Hit_ID=Q8H5R5; Match level="QueryCoverage=95%, HitCoverage=35%, E-value=3e-47, Identity=60%"; Hit description =Haploid germ cell-specific nuclear protein kinase-like protein
MQQRHFDNHSKGNILVGRSDSETLQFTLNGKNMLIKTHGLIISIIDFTLSTINTGDSILYLDLSSDPDLFKGPKGDKQSETYRRMKEVTEDCWEGSCPKTNVLWLIYLVDILLMKKSFERTTKHERDLRSLKKRLDKYDSAKEAVLDPFFTDLFIESDPKA

SEQ ID NO: 120435 - protein, 36 aa, Glycine max
  Coding DNA Sequence Number=SeqID_3657
MTGLPMILPSESVLAYQCVIVRWMVLKNLVLEDTET

SEQ ID NO: 120436 - protein, 460 aa, Glycine max
  Coding DNA Sequence Number=SeqID_3658
  Gene Ontology: Mol. function=enzyme inhibitor activity; Cellular component=cell wall; Biological process=cell wall modification
  Homolog annotation: Hit_ID=Q43111; Match level="QueryCoverage=88%, HitCoverage=69%, E-value=5e-45, Identity=33%"; Hit description =Pectinesterase-3 precursor
  Pfam annotation: Domain name=Pectinesterase; Domain location=165-442; Score=174.5; E_value=2.7e-49; Accession=PF01095.10; Description =Pectinesterase
MDDDSKEKERLTFNIAIMVASMIAIAMVTVSVVAHTDGPKQDAGKNVKTLLSVCSKTEDPESCFRMLKHVGEKATVLKAAINATLTELLLVIRPKPRLDGASRFCSKILLTRIALSIVHNFSERPNRREARLMLEEFPRWFPATERKMIESNQGDNGGGEQWPINVVVAQYGRRHLSTIADSVLNACPKNKTIACVIYVKRGKYEKRVVIPKGVNQVFMYGDGPAHTIVTDSNTRDPKTLTTSFRAATFVVMGKGFICKDMGFTAPADIGGAPTLLVLSDHSAFFNCKIDGNEGTLLAVAQRQFYRDCEILGRVTQNSHIIVKPRNSSDLVLRRNVVSAQSRLDKHQTTGLVIQNYTITAHGQNMNTLNATTYLRSPYSEYSRTIIMESFIGDVIHPKGWCKWSDNAIETRTDKRVKWNGYSTIFERDQMVSYTVGRFVQTDQWLLNRGIPYEIGFLVQN

SEQ ID NO: 120437 - protein, 227 aa, Glycine max
  Coding DNA Sequence Number=SeqID_3659
  Gene Ontology: Mol. function=aspartic-type endopeptidase activity; Cellular component=lysosome; Biological process=sphingolipid metabolic process
  Homolog annotation: Hit_ID=Q948P0; Match level="QueryCoverage=91%, HitCoverage=41%, E-value=1e-114, Identity=94%"; Hit description =Aspartic proteinase 2
  Pfam annotation: Domain name=Asp; Domain location=84-227; Score= -33.5; E_value=1.2e-11; Accession=PF00026.14; Description=Eukaryotic aspartyl protease
MGQKHLVTVLCLWALTCSLLPSFSFGILRIGLKKRPLDIDSINAARKAREGLRSGRSMMGAHDQYIGKSKGEDLVPLKNYMDAQYFGEIGIGTPPQPFTVVFDTGSSNLWVPSSKCYFTLACYTHNWYTAKKSKTHAKNGTSCKISYGTGSISGFFSQDNVKVGSAVVKHQDFIEATHEGSLTFLSAKFDGILGLGFQEISVENSVPVWCVPSALLLFHLYLFSMLE

SEQ ID NO: 120438 - protein, 77 aa, Glycine max
  Coding DNA Sequence Number=SeqID_3660
MGGKNRQRKSSFFSVFNIFKSNNKQRGGSNYNTFYDEGPKVSGTKIWPSDEDKGRWGVADPVIDMRATAYIAQYKKR

SEQ ID NO: 120439 - protein, 58 aa, Glycine max
  Coding DNA Sequence Number=SeqID_3661
MSNKKAKGGRSDHGRGCEIVRDWPSDYDKGSWGVASPNIDKKARIFIDKQKNRVHHQP

SEQ ID NO: 120440 - protein, 67 aa, Glycine max
  Coding DNA Sequence Number=SeqID_3662
MDHFESLTLPSSTGGIFGVLFSFFVLILYHNVRCFFILRVRLAGSDMDDELLTTWPLTQRSYCIVHA

SEQ ID NO: 120441 - protein, 48 aa, Glycine max
  Coding DNA Sequence Number=SeqID_3663
MEMGGDLHDHINKFNQLLWWSLSEREIIQGDMMGQEKDQNRNCIRNEI

SEQ ID NO: 120442 - protein, 71 aa, Glycine max
  Coding DNA Sequence Number=SeqID_3664
  Gene Ontology: Mol. function=RNA-directed DNA polymerase activity; Biological process=RNA-dependent DNA replication
MPGLNPDIVQHRLPLNLGCSPVKQKLWRMKPEMSLEIKEEVKKQFNASFLVVARYPEWVANIVLVPKKDGK

SEQ ID NO: 120443 - protein, 52 aa, Glycine max
  Coding DNA Sequence Number=SeqID_3665
MARDSQTSKMAAQRALQMERWCKYRRWSEWLYSWMIKTFARGRDYHVEETHT

SEQ ID NO: 120444 - protein, 206 aa, Glycine max
  Coding DNA Sequence Number=SeqID_3666
  Gene Ontology: Mol. function=pepsin A activity; Cellular component =endoplasmic reticulum; Biological process=proteolysis
  Homolog annotation: Hit_ID=O22282; Match level="QueryCoverage=100%, HitCoverage=48%, E-value=3e-77, Identity=66%"; Hit description =Expressed protein
MSLPKFSYCISGEDALGVLLLGDGTDAPSPLQYTPLVTATTSSPYFNRVAYTVQLEGIKVSEKLLQLPKSVFVPDHTGAGQTMVDSGTQFTFLLGSVYSSLKDEFLEQTKGVLTRIEDPNFVFEGAMDLCYHAPASFAAVPAVTLVFSGAEMRVSGERLLYRVSKGSDWVYCFTFGNSDLLGIEAYVIGHHHQQNVWMEFDLLKSR

SEQ ID NO: 120445 - protein, 370 aa, Glycine max
  Coding DNA Sequence Number=SeqID_3667
  Gene Ontology: Mol. function=zinc ion binding; Biological process =cell redox homeostasis
  Homolog annotation: Hit_ID=Q1SYU4; Match level="QueryCoverage=99%, HitCoverage=94%, E-value=7e-88, Identity=49%"; Hit description=Zinc finger, RING-type; Thioredoxin-related; RINGv
  Pfam annotation: Domain name=DUF1117; Domain location=236-366; Score =49.6; E_value=1e-11; Accession=PF06547.3; Description=Protein of unknown function (DUF1117)
  Pfam annotation: Domain name=zf-C3HC4; Domain location=168-208; Score= 33.7; E_value=6.4e-07; Accession=PF00097.15; Description=Zinc finger, C3HC4 type (RING finger)
  Pfam module annotation: Pfam domain module=DUF1117::zf-C3HC4; Domain location=236-366::168-208
MPVCPDCDSGFVEEIQPSNRSVHHVETRRRRFPTGTAMYMIGHSSNNSDYNPRSSRRHHCRYVTSHRSPLNPVIMLQSEGTSRDRGSGFDLFFDDGAGSGLRPLPPRMSEFLLGTGFDRVMDQLSQVESNSGMGSNDQHNHAPASKSAVELLPSIEIDETHTATESHCAVCKEPFELSTMAKEMPCKHIYHAECILPWLAIKNSCPVCRHELPCENVARARLERVEEEEEEENNNNVGLTILRLPGGGFAVGRLGRREGEREVNVPLVYTEVDGGFNFNNVVVGEPRRVSWSVSESRGSRRGGAFRRMFNGLFSCLRGGGVGPNRSSNTSRTTVMRSNSFRASSRPNNVGPSPPSSRRTWSMDVNEGTRP

SEQ ID NO: 120446 - protein, 472 aa, Glycine max
  Coding DNA Sequence Number=SeqID_3668
  Gene Ontology: Mol. function=acyltransferase activity; Cellular component=integral to membrane; Biological process=metabolic process
  Homolog annotation: Hit_ID=Q1SYU3; Match level="QueryCoverage=98%, HitCoverage=92%, E-value=0.0, Identity=77%"; Hit description =Phospholipid/glycerol acyltransferase
  Pfam annotation: Domain name=Acyltransferase; Domain location=248 -365; Score=32.6; E_value=1.3e-06; Accession=PF01553.11; Description =Acyltransferase
MESVVCELEGTLVKDKDAFSYFMLVAFEASGWVRFALLLTLLPVIRFLDMVGMNDASLKLMIFVAVAGVPKSEIESVARAVLPKFYMDDLDMDTWRVFSNYDKRVVVTKTPKIMVERFVKEHLRAGEVIGTELSFNRFGFATGFVLGHSNNTISERVANFFDNEAPTLVMDQLNPPNSANQNFNHQLLRPLPVIFHDGRLVKRPTPSTSLLILLWIPVGIVLAIIRIAMGSILPFWAIPHISRLFGGKVIVKGKPPLPPSGGNSGVLYVCTHRTLMDPVVLSSVLRRKIPAVTYSISRLSEILSPIPTVRLTRSRDIDAEKIKLELSKGDLVVCPEGTTCREPFLLRFSGLFAELTDRIVPVAMNYRVGFFHATTARGWKGLDPIFFFMNPRPVYEVTFLNQLPVEATCSSGKSPHDVANYVQRILAATLGFECTNFTRKDKYRVLAGNDGTVSPTYSFFDQMVKVVRTFIR

SEQ ID NO: 120447 - protein, 81 aa, Glycine max
  Coding DNA Sequence Number=SeqID_3669
MSLYPDLNCNFDLRLAMPYSRICERTSPTAMDGEITSKVIELVIFWFEVRIRKQPLCICKGKAAYNIPPPYLRIAKSLWTM

SEQ ID NO: 120448 - protein, 338 aa, Glycine max
  Coding DNA Sequence Number=SeqID_3670
  Gene Ontology: Mol. function=transcription regulator activity; Cellular component=nucleus; Biological process=regulation of transcription
  Homolog annotation: Hit_ID=Q6S7B0; Match level="QueryCoverage=100%, HitCoverage=47%, E-value=1e-93, Identity=56%"; Hit description=TAF5
  Pfam annotation: Domain name=TFIID_90kDa; Domain location=71-215; Score=150.0; E_value=6.4e-42; Accession=PF04494.6; Description=WD40 associated region in TFIID subunit
MEDDKIVGYVTAFLKKKGFTQTEKIFQEEFQHNKSNTSNSLLEPDIANHLLAFSQYFSTFSPLLTCHFFTTLINPIMLLCRLETGPARFHDGYSRLRTWTYSSLDLYKHELLRVLYPVFIHCFMDLVAKGHVQEARNFFNTFREDHEMMHLRDLQKLEGVLSPNHLEEMEFAHSLRKSKFNIKICEYSYELLLQHLHSTQSTTILGIINEHINFQVTPGQPSLISDDPEAVTLTGSSQEAANLINQKEIHWGLLEDSLEERLEKAGALLLDSEKGEGEAKEGENDETKKRSIEGGKQGGASVKKVKKDKGGSATGKSAKPEASTVPAAPRVKPELPLP

SEQ ID NO: 120449 - protein, 64 aa, Glycine max
  Coding DNA Sequence Number=SeqID_3671
MVILRYLKIGISAPKTYLRITIFRRNFWHALYRAWHPTGHITGNGYTQVNSEQDSQDAQSHIPF

SEQ ID NO: 120450 - protein, 242 aa, Glycine max
  Coding DNA Sequence Number=SeqID_3672
  Gene Ontology: Mol. function=hydrolase activity, acting on ester bonds; Cellular component=nucleus; Biological process=regulation of transcription, DNA-dependent
  Homolog annotation: Hit_ID=Q9ZPV5; Match level="QueryCoverage=97%, HitCoverage=30%, E-value=4e-64, Identity=54%"; Hit description =Nucleolar complex protein 2 homolog
MSGTASGAREHMEQLQKLQEKDPEFYEFLKEHDNELLQFSDDDVDEDVGTNTEDGNLQLDEEVSEDEIEEKEQKSSKEVITTSMVDLWGKSIQESGSLSAVRSLMRAFRTACHYGDDGGNESMAKLSVIMSSTVFNKIMLTVLTEMDGILRNLLKLPASGGKKETITDLMATKHWKSYGHLVKSYLGNALHVLNQMTDTEMISYTLRRLKYSLLFLAAFPSLLRKYIKVVLHFWGTGGGALP

SEQ ID NO: 120451 - protein, 56 aa, Glycine max
  Coding DNA Sequence Number=SeqID_3673
LNKFRSEIRQLVDSWVGDGEDDSIAKKIAVKVLKLLEVNVPIAVSSASPILFNNSK

SEQ ID NO: 120452 - protein, 300 aa, Glycine max
  Coding DNA Sequence Number=SeqID_3674
  Homolog annotation: Hit_ID=Q9LTJ3; Match level="QueryCoverage=99%, HitCoverage=99%, E-value=6e-36, Identity=38%"; Hit description =Arabidopsis thaliana genomic DNA, chromosome 5, BAC clone:F2O15
MSFGGLSIALSLVFGCLLLALCAQLYYFLWWKKRRTQMDIEMDAKGAFYWGCWKTPCAMHVANNTGRGGVNRDIERTTTSREPEMELDLLHKPFGEEGTVESELMRLHNLAGPPRFLFPIKEETKEDLESEDRSRKGSRTRSLSDLMLTIDTPFLTPVASSPLKCCSLPLDPLHSYKHQGFNPLFESSVELEYNRFRSSPPPKFKFMRDAEEKLHRKLMEEARRKAVDNNNVQECGVKDCSNETLATDFRDGSFLKFIQTTEHKQPQQYLPQFPSGSSQILPLASSPTTLRPLEKASIVH

SEQ ID NO: 120453 - protein, 72 aa, Glycine max
  Coding DNA Sequence Number=SeqID_3675
  Homolog annotation: Hit_ID=Q1S6A6; Match level="QueryCoverage=80%, HitCoverage=14%, E-value=8e-08, Identity=37%"; Hit description=FAR1
LASSPSSLTMNHVHLFPAYRGLMDVDKAQADSLCREDLYNYFDSLIHAQIKDGDIVASLSYLDEMSDTDPML

SEQ ID NO: 120454 - protein, 248 aa, Glycine max
  Coding DNA Sequence Number=SeqID_3676
  Homolog annotation: Hit_ID=Q1S6A5; Match level="QueryCoverage=26%, HitCoverage=33%, E-value=3e-07, Identity=40%"; Hit description=Zinc finger, CCHC-type
  Pfam annotation: Domain name=zf-CCHC; Domain location=51-68; Score =16.6; E_value=0.0018; Accession=PF00098.13; Description=Zinc knuckle
MEDILKLTIKYEKLGEHAFTQNSSSKCFCDPTMIKTKGAPKKRDSCKKRSRHCSNCNSTKHNARMCPQCDVIGFSPHFYRKVKVKRKLVTEKFNRKHKKAKKMTQNSDHVHKGKKKVSDKEKVNQKQKIAKKITQNSDNAYVNQCLEMVMSLMSQVQTMFPPTQPMISPTQPMVQPKVPPMQIPTYVNSNQGPFSLPNYGGVPVFPHNTQVLILSQDYHGQSVGNNYTSYFGLLQEVVKNGGQTNKIY

SEQ ID NO: 120455 - protein, 33 aa, Glycine max
  Coding DNA Sequence Number=SeqID_3677
MEVLTWSGTLWKLVALTMVMMQQRFFAMLMAMW

SEQ ID NO: 120456 - protein, 352 aa, Glycine max
  Coding DNA Sequence Number=SeqID_3678
  Gene Ontology: Mol. function=DNA binding
  Homolog annotation: Hit_ID=Q1SYZ1; Match level="QueryCoverage=91%, HitCoverage=94%, E-value=9e-51, Identity=79%"; Hit description=Myb, DNA-binding; Calcium-binding EF-hand
SAPMKRKKWSELEEQTLLSKYSELLRSGTLAKLKTREKKFKPVAEHVNAVHHLRNPASFPFKWSWRDVSIKVQNMRHQYLGVKQKIRLSPHHFNWKDGNNHWENFLKYKEVFGDVQLLESPKPITTAKLGFDVDSDDDENEEEEEEDDDEEDCDEEEDVLKVRRLGSVVELREAVVKREERRREREFRREKVEAERERKRRESEFRRERRRELLEDREMELEERQLRWARRGLEKRLRLERELDAERRWRKRVEEKMEEEEMEWRQRMVAMQVEHEKQMMQMHVEACQNQMQVLGIMARLLCQFFGSGTDGLSNGLGALPPQVLHHGGGLGNAKLWGGKEGETVEHACLTCF

SEQ ID NO: 120457 - protein, 65 aa, Glycine max
  Coding DNA Sequence Number=SeqID_3679
MASALLEPSADCVPNNAYAVQLRQLYLVGCSVPVAPKWKLVKGLMPNGPYPCYLWFSSAPEVEYT

SEQ ID NO: 120458 - protein, 203 aa, Glycine max
  Coding DNA Sequence Number=SeqID_3680
  Gene Ontology: Mol. function=metal ion binding; Biological process =defense response to bacterium
  Homolog annotation: Hit_ID=Q94B55; Match level="QueryCoverage=73%, HitCoverage=35%, E-value=7e-54, Identity=65%"; Hit description =Putative RING zinc finger ankyrin protein
RIPYMVALKHKHGACASLLNPTSAEPLVWPSPLKFISELNPEAKALLEQALMDANREREKNILKGSSYSLPSPSHSDGVADNMSEVCTIEVQNCGHQMCAQCTLALCCHNKPNPATACLTPPVCPFCRSTITRLVVVKTECHDETDQDSADINCSKLSKSSRKLRHLNDSGSSSFKGLSSVSSFGKLGSRSSGRIAAEWLDKQ

SEQ ID NO: 120459 - protein, 165 aa, Glycine max
  Coding DNA Sequence Number=SeqID_3681
  Subcellular localization annotation: CTP_CleavageSite=28; ConfidenceScore=5.60e-01
MSTGSFFPDQSTTLGSLMGVSSIVELSRRSLRGTKTELLKSKKKMFNFSSWLFCLGSRSKITEAESQKYNPPSLGQFLAVERRAASENRRKQSLSIYDPHDELALAERNSLFMNGTIAPPHSISPRQSIGTERENMELRQHSRGFGLLAELFSCMCGQDGLLANF

SEQ ID NO: 120460 - protein, 52 aa, Glycine max
  Coding DNA Sequence Number=SeqID_3682
  Homolog annotation: Hit_ID=Q0KIN0; Match level="QueryCoverage=62%, HitCoverage=1%, E-value=1e-08, Identity=75%"; Hit description =Integrase core domain containing protein
MELEGLARGKKDSPWRARRKEYWILTLGNVQFQGDDDSSSLLCHFVVVYEDM

SEQ ID NO: 120461 - protein, 72 aa, Glycine max
  Coding DNA Sequence Number=SeqID_3683
MAERRSKGLCYFCDEPFTPEHGLTHKRLHIHVLEIEDEEEGPGPQQLDANVGTEPDSEPLISVNALKGVANF

SEQ ID NO: 120462 - protein, 63 aa, Glycine max
  Coding DNA Sequence Number=SeqID_3684
MLQPYEISIGLKEHSNPVTPKAYTPKSPSGPLPPDSEDTAHELYNTHNLYSCFKHVQHNCATI

SEQ ID NO: 120463 - protein, 58 aa, Glycine max
  Coding DNA Sequence Number=SeqID_3685
MSSNIGDHRPHDLAYLEVLLETQLPAVHTPGYYLFGWMQNLPTSASGHQAQVLNTDVS

SEQ ID NO: 120464 - protein, 126 aa, Glycine max
  Coding DNA Sequence Number=SeqID_3686
YGHCTTPGDGQQEEKPTMCRTKLDLNKNFKEVTKAIEVAQVQISLMAGDHKILLSKYGSGSFSTTTQVNPKKHCNLITTRWGTVVGLKDNDEKKNKQGVEKENKKHDEVVTSEKVVSEEEKKKSNE

SEQ ID NO: 120465 - protein, 213 aa, Glycine max
  Coding DNA Sequence Number=SeqID_3687
  Gene Ontology: Mol. function=hydrogen ion transporting ATP synthase activity, rotational mechanism; Cellular component=integral to membrane; Biological process=ATP synthesis coupled proton transport
  Homolog annotation: Hit_ID=Q6D3D2; Match level="QueryCoverage=83%, HitCoverage=76%, E-value=6e-76, Identity=78%"; Hit description =Putative membrane protein
MAGKGLPREVLPGIKLESPKITRNLTTAWFAQRVDGRYQQSGVDRAANLYGAGVWLDDLRLTADGVCVVVCRAHAWRHGTGVCQSHHLLRPDYRAAGAGVRAFRHGAAHERRRGDRAVYALFRADRADNGEYFPCLYLLVDRQYLLRYRGHVWCHELLRLHHQTRPEPLRQPAVYGADRHSAGVAGEFLAEKPGADVGDYLYRRGGVCGPDGL

SEQ ID NO: 120466 - protein, 415 aa, Glycine max
  Coding DNA Sequence Number=SeqID_3688
  Gene Ontology: Biological process=Mo-molybdopterin cofactor biosynthetic process
  Homolog annotation: Hit_ID=Q8ZQQ1; Match level="QueryCoverage=37%, HitCoverage=96%, E-value=3e-65, Identity=81%"; Hit description =Molybdenum cofactor biosynthesis protein C
  Pfam annotation: Domain name=MoCF_biosynth; Domain location=56-198; Score=108.0; E_value=2.8e-29; Accession=PF00994.14; Description =Probable molybdopterin binding domain
  Pfam annotation: Domain name=MoaC; Domain location=201-336; Score =303.3; E_value=4.6e-88; Accession=PF01967.11; Description=MoaC family
  Pfam annotation: Domain name=ThiS; Domain location=341-415; Score =71.9; E_value=2e-18; Accession=PF02597.10; Description=ThiS family
  Pfam module annotation: Pfam domain module=MoCF_biosynth::MoaC::ThiS; Domain location=56-198::201-336::341-415
RAAGAHRPQPRAEKADAFPASGQYRHHAEPLLHWWLNTGVTAMGKPSGDFVALNAAVMTVSDSRDASSDSSGDYLREALTEAGHQVVDHAIVPDNRYRIRATVSRWIASEDVQVVLINGGTGFNSKNSTPEALLPLLDREIDGFGELFRMISYEEIGSATLQSRAVAGLANQTLLFAVPGSTEVISMSSLTHINAAGEAHMVDVSGKTDTVREAQAEALVLMQPATLQMILDGSHDKGDVFATARIAGIQAAKRTWELIPLCHPLMLSKVEVTLVAEPEHSRVRITSRCRLSGKTGVEMEALTAASVAALTIYDMCKAVQKDIVIDQLRLLSKSGGKSGDFQAVRELTGTAALDLAAEYADVATLRAALAQKSDRWALALESGKLLAAVNQTLVPMNHPLRAGDEVAFFPPVTGG

SEQ ID NO: 120467 - protein, 228 aa, Glycine max
  Coding DNA Sequence Number=SeqID_3689
  Homolog annotation: Hit_ID=Q1SPY9; Match level="QueryCoverage=100%, HitCoverage=26%, E-value=1e-49, Identity=51%"; Hit description =Ankyrin
MKANLGKMEDPKSDKMNYPKNYATLYDLFGGLLSVAALIGVLDSQKSIYFLSIFLWAGKMPSENNQHDTENPSTNKYTFGFGTSQVGFLPPNYATFQQFVRSAYVHTLGLSGAELKEIKKTKKRHQWSSQLLKALLKRPYAAFTGSGGKPTDLEVEADMYNVYSQYKQGETTGLGGLEEEKKTEADDKKNSSPSETIRKETDERADEKNIDKKETAFLVAARNGIVEM

SEQ ID NO: 120468 - protein, 355 aa, Glycine max
  Coding DNA Sequence Number=SeqID_3690
  Gene Ontology: Mol. function=protein serine/threonine kinase activity; Cellular component=cell surface; Biological process =protein amino acid phosphorylation
  Homolog annotation: Hit_ID=Q6UY58; Match level="QueryCoverage=89%, HitCoverage=56%, E-value=7e-98, Identity=51%"; Hit description =Lectin-like receptor kinase 7;3
  Pfam annotation: Domain name=Pkinase; Domain location=95-311; Score =57.7; E_value=3.8e-14; Accession=PF00069.15; Description=Protein kinase domain
  Pfam annotation: Domain name=Pkinase_Tyr; Domain location=95-311; Score=19.9; E_value=1.1e-13; Accession=PF07714.7; Description =Protein tyrosine kinase
  Pfam module annotation: Pfam domain module=Pkinase::Pkinase_Tyr; Domain location=95-311::95-311
MYAGFSASTGLLLSSHYILGWSFKMNEEAKSLHLETLPSLPTSKNRKMVMILGVAVSFAILTIITAIGFVIYVVRRMKNGDAVEPWELEVATNGFKEKQLIGFGGFGRVYKGVLAESNTIIAVKRIKQDSEEGLQQFMSEIETIGRLRHKNIVQLRGWCRKRCDLLIVYDFMPNGSLDKYLFDEPGRVLSWEQRFKIIKDVARDEWEGLLMDHGENPNTTRVVGTLGYLAPELTLTGKPTASSDVFAFGALLLEVGCGRRPFEPKALPEELILVDWVKDRWGAGRVLEVVDSKLNWAFDPRPSMRQVVMYLERDMQLPDVEEPTTSFYDRVSMWSCTTEDVDASSLSLSGDTEGR

SEQ ID NO: 120469 - protein, 276 aa, Glycine max
  Coding DNA Sequence Number=SeqID_3691
  Gene Ontology: Mol. function=molecular_function; Cellular component =cellular_component; Biological process=regulation of progression through cell cycle
  Homolog annotation: Hit_ID=Q9LZL8; Match level="QueryCoverage=79%, HitCoverage=74%, E-value=2e-77, Identity=61%"; Hit description =Thaumatin-like protein
  Pfam annotation: Domain name=Thaumatin; Domain location=29-235; Score= 197.4; E_value=3.4e-56; Accession=PF00314.8; Description=Thaumatin family
MPTSMYPFIFLSILISIPLTGGTQLILVNNCQESVWPGILGSGGHPTPKDGGFHLCSGDEVVLEVPEGWSGRIWGRQGCCFDTKTGKGTCETGDCGGLLKCGGMGGVPPATLVEMTLGTPQSALHFYDVSLVDGFNLPVSMKPVGGGIGCGVAACEANLNVCCPFALVMKRQGKVVGCKSACLAAKSDRYCCTGEFATPKSCKPSAFSRLFKTICPKAYSYAYDDSTGLKICKAHRWLSESLISCIYCGLLNGAHWPTDCFHMIIVYNVLKAKVVY

SEQ ID NO: 120470 - protein, 220 aa, Glycine max
  Coding DNA Sequence Number=SeqID_3692
  Homolog annotation: Hit_ID=Q9LHS8; Match level="QueryCoverage=96%, HitCoverage=97%, E-value=3e-41, Identity=45%"; Hit description=LOB domain-containing protein 33
  Pfam annotation: Domain name=DUF260; Domain location=7-108; Score =207.9; E_value=2.3e-59; Accession=PF03195.5; Description=Protein of unknown function DUF260
MTGFGSSCGACKFLRRKCTSDCVFAPYFSYDQASTHFAAVHKIYGASNVSKLLSHLPIQNRSDAAVTISYEALARMQDPIYGCVAHIYALQHQVASLQEEIDALGNLVANSSVSVVNCGSVQATINSNNGTQFNILQHDATRTQYCQNNLANFLSQEGSATVFQSLINSQMDIELPNCTQVEHPSFGDFNSNPLEQFLSGIDQEMFVNHPWFKHNADIKN

SEQ ID NO: 120471 - protein, 88 aa, Glycine max
  Coding DNA Sequence Number=SeqID_3693
  Homolog annotation: Hit_ID=Q1SPY9; Match level="QueryCoverage=91%, HitCoverage=10%, E-value=4e-15, Identity=50%"; Hit description =Ankyrin
MSRRKNQIDTENPPINEQFGFGLLPPNYETFQQLVRSAFVHILGLSGVDINEVKKTKERHQWGCQLLKELKMEAPPFQDYIGNGDLRI

SEQ ID NO: 120472 - protein, 221 aa, Glycine max
  Coding DNA Sequence Number=SeqID_3694
  Gene Ontology: Mol. function=DNA binding; Cellular component =chromatin; Biological process=chromosome organization and biogenesis (sensu Eukaryota)
  Homolog annotation: Hit_ID=Q1SZ33; Match level="QueryCoverage=63%, HitCoverage=43%, E-value=3e-34, Identity=55%"; Hit description=HMG-I and HMG-Y, DNA-binding
  Pfam annotation: Domain name=DUF296; Domain location=85-202; Score =191.9; E_value=1.5e-54; Accession=PF03479.5; Description=Domain of unknown function (DUF296)
MANRWWAGNVPVRPNEQDDGDNNPTPTNSGNSNTNVNAVTEDDANTNDGEDQNLSAGRRPRGRPPGSRNKPKPPVVVTKESPNALHSHILEISGGSDVAECIATFATRRHRGVSVLSGSGVVTNVTLRQPAAPGGVITLQGRFEILSLSGAFLPAPSPPEATGLTVYLAGGEGQVVGGSVVGPLVASGPVMVVAATFANATYERLPLEDEQGEEDMPDVNE

SEQ ID NO: 120473 - protein, 79 aa, Glycine max
  Coding DNA Sequence Number=SeqID_3695
  Gene Ontology: Mol. function=transferase activity; Cellular component= cytosol; Biological process=glutamine metabolic process
  Homolog annotation: Hit_ID=Q1SPM3; Match level="QueryCoverage=88%, HitCoverage=35%, E-value=6e-16, Identity=52%"; Hit description=SNO glutamine amidotransferase; CobB/CobQ-like glutamine amidotransferase
MNNIISGQKTGGQYLVSGFDCTVHRNFFGSQIQSFDAELSVLELVSKEGELEVQVLADYPIPSSRLLSSDSSIKDQMVS

SEQ ID NO: 120474 - protein, 58 aa, Glycine max
  Coding DNA Sequence Number=SeqID_3696
MSQQDEGWPLGLLQPANARIELVRNSDNAGSISFNTLLTRSPSSSTDSSSDFDTERPH

SEQ ID NO: 120475 - protein, 182 aa, Glycine max
  Coding DNA Sequence Number=SeqID_3697
MGVSSNSKVFLSDKDLKGVINNTDHHEVGLLVHKEGCQSLIQEDHQIIRLKQLSVQQRDQEEGDNKDDHHQEEQKQRRNNMIVTAKPVCPPINLKLEIPYSRVGSENDDDGLKTPTSSDHKIPVILECPGAPKKTKSKPDTKRKECRPRIVLDLSKDLESLFPMPHAVDVLGGGLKNKRVKQ

SEQ ID NO: 120476 - protein, 71 aa, Glycine max
  Coding DNA Sequence Number=SeqID_3698
MKRASEKSGQAVAAEDNVKNTEFLGHAGCPSEDVGYDAKLLLMDDGWSHGRRCYLWSEEVKGISKKTTEES

SEQ ID NO: 120477 - protein, 71 aa, Glycine max
  Coding DNA Sequence Number=SeqID_3699
MTGRGVLILGWPMAAEQFYNYKLFEGEDAKRTSYEHIVAKIELFMNVTEKGIMMRKKVGNIRYMIRGCCKR

SEQ ID NO: 120478 - protein, 144 aa, Glycine max
  Coding DNA Sequence Number=SeqID_3700
  Gene Ontology: Mol. function=protein binding
  Homolog annotation: Hit_ID=Q1SYZ9; Match level="QueryCoverage=82%, HitCoverage=30%, E-value=3e-53, Identity=88%"; Hit description=AAR2
  Pfam annotation: Domain name=AAR2; Domain location=1-143; Score= -116.1; E_value=6e-05; Accession=PF05282.2; Description=AAR2 protein
MPMEEALDKQLKVGNSATSVGKSRRKGCYYTSIPHVVKCKGISGQELTSLNLDKTHLLETLLTKDYGDSEDLLLGELQFAFIAFLMGQSLEAFLQWKSLVSLLFGCTEAPFRTRTHLFTKVQNIDINTWNAVNFIPDCSSSSDF

SEQ ID NO: 120479 - protein, 72 aa, Glycine max
  Coding DNA Sequence Number=SeqID_3701
MKWVLLPAISHVADNWVGKGNRLDVFGLDLGFPNFTTNHTGEEREKDTISISVKEIDKWNMQKRGRTQLGFA

SEQ ID NO: 120480 - protein, 410 aa, Glycine max
  Coding DNA Sequence Number=SeqID_3702
  Gene Ontology: Mol. function=protein serine/threonine kinase activity; Cellular component=chloroplast; Biological process=protein amino acid phosphorylation
  Homolog annotation: Hit_ID=Q06548; Match level="QueryCoverage=88%, HitCoverage=88%, E-value=1e-148, Identity=69%"; Hit description =Protein kinase APK1A, chloroplast precursor
  Pfam annotation: Domain name=Pkinase; Domain location=89-371; Score =153.2; E_value=6.9e-43; Accession=PF00069.15; Description=Protein kinase domain
  Pfam annotation: Domain name=Pkinase_Tyr; Domain location=89-371; Score=139.6; E_value=8.7e-39; Accession=PF07714.7; Description =Protein tyrosine kinase
  Pfam module annotation: Pfam domain module=Pkinase::Pkinase_Tyr; Domain location=89-371::89-371
MLSTHQTEKVLGVKGCIEKNSSLTSVKDKDKLEYISLSSKDGNKEEDGLSSKASTPSVPPTPRTEGEILKSSNMKSFNFSELKTATRNFRPDSVVGEGGFGCVFKGWIDEQTLAPVRPGTGMVIAVKRLNQEGLQGHSEWLTEINYLGQLRHPNLVKLIGYCLEDDHRLLVYEFLTKGSLDNHLFRRASYFQPLSWNIRMKVALDAAKGLAYLHSDEAKVIYRDFKASNILLDSNYNAKLSDFGLAKDGPAGDKSHVSTRVMGTYGYAAPEYMATGHLTKKSDVYSFGVVLLEIMSGKRALDSNRPSGEHNLIEWAKPYLSSKRRIFQVMDARIEGQYMLREAMKVATLAIQCLSVEPRFRPKMDEVVRALEELQDSDDRVGGVGSSRDQTTRRSGPRQHRGRQHETTRK

SEQ ID NO: 120481 - protein, 36 aa, Glycine max
  Coding DNA Sequence Number=SeqID_3703
MAIGFMEVQLVKAKGLQETDIFASDLSHLTSQLSIP

SEQ ID NO: 120482 - protein, 367 aa, Glycine max
  Coding DNA Sequence Number=SeqID_3704
  Gene Ontology: Mol. function=4 iron, 4 sulfur cluster binding; Cellular component=integral to membrane; Biological process =regulation of transcription, DNA-dependent
  Homolog annotation: Hit_ID=Q5JM88; Match level="QueryCoverage=82%, HitCoverage=76%, E-value=1e-137, Identity=79%"; Hit description =Radical SAM domain-containing protein-like
  Pfam annotation: Domain name=Radical_SAM; Domain location=63-229; Score=66.7; E_value=7.5e-17; Accession=PF04055.11; Description =Radical SAM superfamily
PQGFRNTLEEAGWKVGRSPIFETVTAADGTVKLLLKLEDNRLIETVGIPVMVDKGLTRLTACVSSQVGCPLRCSFCATGKGGFSRNLQRHEIVEQVLAIEEVFKNRVTNVVFMGMGEPMLNLKAVLEAHHCLNKDVQIGQRMITISTVGVPNTIKKLASHKLQSTLAVSLHAPNQKLRETIVPSAKSYPLDALMSDCREYFQQTSRRVSFEYALLAGVNDSVNHALELAELLHRSGSGYHVNLIPFNPIEGSEYQRPSKRAVLAFSGALESSKITVSVRQTRGLDANAACGQLRNKFQKTPVVTDPFDLAVTDTSMPYNNKFALWSDKGVYCCCISCNINLPSEKLWTDTYLLVVNFAGPCRPESLQ

SEQ ID NO: 120483 - protein, 326 aa, Glycine max
  Coding DNA Sequence Number=SeqID_3705
  Gene Ontology: Mol. function=nucleic acid binding
  Homolog annotation: Hit_ID=Q9M2T3; Match level="QueryCoverage=92%, HitCoverage=87%, E-value=8e-42, Identity=40%"; Hit description =Putative RNA binding protein
  Pfam annotation: Domain name=RRM_1; Domain location=49-140; Score =39.6; E_value=1.1e-08; Accession=PF00076.12; Description=RNA recognition motif. (a.k.a. RRM, R
MRRNSPAYYSPPRRGYGGGGRGGGGGGGGGGSGRRGFGGGRRRDSNGSLLVRNIPLDCRPEELRVPFERFGPVRDVYIPKDYYSGLREEVFLVCGCESFVLKCFLEPRGFAFVQFVDPYDASEAQYHMNRQIFAGREISVVVAEETRKRPEEMRHRTSRLRLSLLEFWIPSMIVMMGIQTVLTCQGVDGRQPIFHNASFLVALGVLDLAQLPDHAHHLITLVLGIDIAQGMSYSPAPRRQSDYSVSPRRQAEHPRSPRGPPRERDGEQKRRSYSPAYGNGIEQNQSNGYAEKSMYKSDADRGQWKSSRSPPGSRSRSAELSPRRGR

SEQ ID NO: 120484 - protein, 817 aa, Glycine max
  Coding DNA Sequence Number=SeqID_3706
  Gene Ontology: Mol. function=protein serine/threonine kinase activity; Cellular component=ubiquitin ligase complex; Biological process=protein amino acid phosphorylation
  Homolog annotation: Hit_ID=Q33BK6; Match level="QueryCoverage=94%, HitCoverage=93%, E-value=1e-154, Identity=40%"; Hit description=U -box domain containing protein, expressed
  Pfam annotation: Domain name=Pkinase; Domain location=473-765; Score =62.6; E_value=1.3e-15; Accession=PF00069.15; Description=Protein kinase domain
  Pfam annotation: Domain name=Pkinase_Tyr; Domain location=473-736; Score=18.0; E_value=1.4e-13; Accession=PF07714.7; Description =Protein tyrosine kinase
  Pfam annotation: Domain name=U-box; Domain location=746-817; Score =57.1; E_value=5.7e-14; Accession=PF04564.6; Description=U-box domain
  Pfam module annotation: Pfam domain module=Pkinase::Pkinase_Tyr::U -box; Domain location=473-765::473-736::746-817
  Subcellular localization annotation: CTP_CleavageSite=43; ConfidenceScore=5.33e-01
MELLKPLHPHHAPILRIPFHAVPSSSSSSSQSKVPLPMISKVHVAVGKSLDKAVPLLRWTLNHFRNAEIVIVHAYQPSLTIPTLLGKLPASQASPAVVSAFRKAEREQTVKLLDKYLSICRAARVRASVIVTEADQVQKGIVDLVIKHNIEKLVIGAIPENCMKVKRNSGKANYTAKNAPPFCEVWFIYKGKHIWTREASETPCYSSSCTQPEIATRESLRCRSFQYGNELFDSEYLQPNSARTTTGSGSRSWVQGEIIETEAIFSSSCSSHCSPQNSSRAYLDTYLEAMEERINKQLIETKREAEAVTDEAFAELLKCEKLEVEAMEAIRKVNLFESAHVREVKLRKEAEDALTDTVQEQQKLLNASEEIAGELQMTMRNIALLDSRAQEAHRRCDEAADELSLIQESISTLWQERQQIRRQKMEALRWLERWRSRGKVGAAHCNGVIGFAEELPELAEFSLSDLQNATCNFSNSFIIEQGGYVCIYKGEMLGRTVAIKKFHQHNMQGPLEFRQEVQVLGSLQHPHLITLLGVCPEAWSIVYEYLPNGTLQDYLFRKSNNSPLTWNTRARMIAEIASALCFLHSFRPESIIHGDLKPETVLLDSSLGCKMCGFGFCRLVSEESLLRPSFRLSTEPKGAFTYTDPEFQRTGILTTKSDIYSFGLIILQLLTGRTPVGLAVLVRNAISCGKLSSILDSSAGEWPSAVAMRLVELGLQCCQQYRRDRPELTPTLVRELEQLHASEERPVPSFFSCQILLEIMHDPQVAADGFTYEGDAIREWLENGHDTSPMTNLKLSHLFLTPNHALRLAIQDWLCKP

SEQ ID NO: 120485 - protein, 255 aa, Glycine max
  Coding DNA Sequence Number=SeqID_3707
  Gene Ontology: Mol. function=protein binding; Cellular component =clathrin vesicle coat; Biological process=Golgi to endosome transport
  Homolog annotation: Hit_ID=Q9LW61; Match level="QueryCoverage=42%, HitCoverage=41%, E-value=4e-12, Identity=34%"; Hit description =Arabidopsis thaliana genomic DNA, chromosome 3, P1 clone: MLM24
  Pfam annotation: Domain name=ENTH; Domain location=1-78; Score=29.8; E_value=5.5e-08; Accession=PF01417.11; Description=ENTH domain
LLKFDNKNWRASYNSLIVLEHLLTHGPESVAEEFQSDKDVIGQMKCFQHIDDSGFNWGLAVRKKSEQILKLLEEGTLLKEERNRARRLSRGIQGFGSFSPRSTQAQGVLQEKSSPTTFDRRTADFNDNENQENQSFGSNLCLDTAAVKSASPSSQGRILKSLDDSVETESYLDDQGNIQMHQKSETSSGENMTPSKEEFHLWNLKGESNPLLDGSQEDHSRLGMFIAQDDHPFNSTEMHATSSLLSRHEVCYALK

SEQ ID NO: 120486 - protein, 507 aa, Glycine max
  Coding DNA Sequence Number=SeqID_3708
  Gene Ontology: Mol. function=DNA binding; Cellular component =mitochondrion; Biological process=embryonic development ending in seed dormancy
  Homolog annotation: Hit_ID=Q7F7G0; Match level="QueryCoverage=88%, HitCoverage=74%, E-value=4e-52, Identity=28%"; Hit description =Putative DNA-binding protein
  Pfam annotation: Domain name=PPR; Domain location=140-174; Score =13.7; E_value=0.18; Accession=PF01535.11; Description=PPR repeat
  Pfam annotation: Domain name=PPR; Domain location=210-244; Score =20.3; E_value=0.007; Accession=PF01535.11; Description=PPR repeat
  Pfam annotation: Domain name=PPR; Domain location=314-348; Score =12.0; E_value=0.28; Accession=PF01535.11; Description=PPR repeat
  Pfam annotation: Domain name=PPR; Domain location=349-383; Score =38.6; E_value=2.2e-08; Accession=PF01535.11; Description=PPR repeat
  Pfam annotation: Domain name=PPR; Domain location=384-418; Score=2.5; E_value=3.7; Accession=PF01535.11; Description=PPR repeat
  Pfam annotation: Domain name=PPR; Domain location=426-460; Score=0.2; E_value=7.1; Accession=PF01535.11; Description=PPR repeat
  Pfam module annotation: Pfam domain module=PPR::PPR::PPR::PPR::PPR::PP R; Domain location=140-174::210-244::314-348::349-383::384-418::426 -460
MRSVIGIFAQQRLVQLIHRTPCGIVCLKLFCTQATQNHDSLSRRIEKLPKGESVGSAFRSWMRDGLPVHGGDIFHAINRLRKLNMNKRALQVMEWVIRERPYRPRELDYSYLVEFTTKLHGISHGEKLFSRIPVEFQSELLYNNLVIACLDKGVIKLSLEYMKKMRELGFPISHLVFNRLIILHSSPGRRKMIPKLLTQMKADKVTPHVSTYNILMKIEANEHNLENLVKVFGRMKVAQVEPNEISYCILAIAHAVARLYTATEAYVEAVEKSITGNNWSTLDVLLMLYGYLGNQKELERVWATIQELPSIRSKSYMLAIEAFGRIGQLNRAEEIWLEMKSTKGLKSVEQFNSMMSVYCKHGFIDRAAKLYKNMKASGCKPNAITYRQLALGCLKSGMAEQALKTLDLGLRLTISKRVRNSTPWLETTLSIVEIFAEKGDVGNVERLFEEFHKAKYCRYTFVYNTLIKAYVKAKIYNPNLLKRMILGGARPDAETYSLLKIAEQFQT

SEQ ID NO: 120487 - protein, 186 aa, Glycine max
  Coding DNA Sequence Number=SeqID_3709
  Gene Ontology: Mol. function=protein transporter activity; Cellular component=mitochondrial inner membrane; Biological process=protein transport
  Homolog annotation: Hit_ID=Q41050; Match level="QueryCoverage=95%, HitCoverage=92%, E-value=5e-36, Identity=51%"; Hit description=Core protein
  Pfam annotation: Domain name=Tim17; Domain location=15-186; Score =88.2; E_value=2.6e-23; Accession=PF02466.9; Description =Tim17Tim22Tim23 family
MPWVRLSESPRLDVAIDMGNPFLNLTVDGFLKIGAVAATRSAAEDTYHIIQKGLCQTNSTCLFQGISQVVISRKLIVMRGLVLAENDDDWGDPPKDTSESYSMDISWCMLFFVPCSRGTIAGVYVGMEYGVERIRGTRDWKNAMIGGAVTGALVSAASNNKKDKIAIDAITGAAIATAAEFINYLT

SEQ ID NO: 120488 - protein, 787 aa, Glycine max
  Coding DNA Sequence Number=SeqID_3710
  Gene Ontology: Mol. function=GTP binding; Cellular component =intracellular
  Homolog annotation: Hit_ID=UPI0000162CAC; Match level="QueryCoverage =79%, HitCoverage=44%, E-value=3e-16, Identity=24%"; Hit description =GTP binding
MGKDLVSSDQTTVQIQDNNPGCMWGMLQILDYHRWRVKKVFPHKRRRHATYKRKPILYNQHEDQQHGVTEAEPLLVGQPSKKLHAAGKSSPKNRKKEPRTEKEFNNENSKGNSSMDYSKKNQASREYALHLEKDGKTTEAALNHKPMETNKHNRDISNKFEKHTDVFELLRVEKDLLLKFLRDIDFGGKKVQQASHINARLKKSGSFPLASTSQMRNISSRSLKHKQNEIWAFPKGEKLHAGTQESNMLVSSSVKDTSYEKSMPLASDLGVDSAMKQKAIISSGPSQGSNHKGWNQVVLHQFKVIKQKIKYVLVEFRKSGYQTTSAEAIHRRASPEYSIIKNEEEISQSLEDGVVQQFKRSKSSNETRASDYDSNKHDARLMRRTSSLNESLDRYTQLFEKSFSKDTKWQSSKSKSLKLTNEDKNHKNGHAPRFSRSNLSMPNLETLGFILQDALFDTNDIGTTVEAYNRVHRKSVSLPLKIDKSLDHFKEAEIVETVEGSNRDVNPSLLSDMIMEKIEEIDEEVTCDQKEEMHEPAVGDGSFPQEKEEMNNMTTNLSKEVMATLGTSFEDNKTGNAEGTELNSLGSTLDELETDLSYKGNVYHSLPDSSSDRNASVTAEDTDNTSNFKYVKNVLEFSGFLGNEHTQKRYTVDQPLKPSIFQDLDATLCHEIEPSEETISHQLLFNLVNEVLLEIYGRSPTYFPRPFSFNPRFHPMPKGNYLLDEVWNSVNSYLTLRPELDQTLEDVIGRDLAKGKGWMILQEEEEYVALELEEMIMDDLLDEFIFS

SEQ ID NO: 120489 - protein, 143 aa, Glycine max
  Coding DNA Sequence Number=SeqID_3711
  Subcellular localization annotation: CTP_CleavageSite=48; ConfidenceScore=5.28e-01
MPLPAPLSAGPSDFSFTPQMLHSMMQSLHRGQSIIMKSLQGLGLPSIMSMEEFEAQVAWPGDRSSSSGGGGASAAQEPVIKEPPAPAPGTTKDEDELTPLEPSYFDVGSHMVQEEETTPNQTPQPSPALALIPKDVVPVAKPE

SEQ ID NO: 120490 - protein, 143 aa, Glycine max
  Coding DNA Sequence Number=SeqID_3712
  Subcellular localization annotation: CTP_CleavageSite=48; ConfidenceScore=5.28e-01
MPLPAPLSAGPSDFSFTPQMLHSMMQSLHRGQSIIMKSLQGLGLPSIMSMEEFEAQVAWPGDRSSSSGGGGASAAQEPVIKEPPAPAPGTTKDEDELTPLEPSYFDVALHMVQEEETTPNQTPQPSPALTLIPKDVVPVAKPE

SEQ ID NO: 120491 - protein, 80 aa, Glycine max
  Coding DNA Sequence Number=SeqID_3713
  Subcellular localization annotation: CTP_CleavageSite=46; ConfidenceScore=5.09e-01
MVTLHSTSRWSEPSIGIFIDPKSSRNRLSRSRKELPTKGFDRWRVLTNEKLSEVSPCEVLYCESRREIDNQGCYNLNERD

SEQ ID NO: 120492 - protein, 53 aa, Glycine max
  Coding DNA Sequence Number=SeqID_3714
MTNGVRLEQVLGGALKGVLLSEITYLELSDKGESLNKSVLCVEPMVEEGECEG

SEQ ID NO: 120493 - protein, 1229 aa, Glycine max
  Coding DNA Sequence Number=SeqID_3715
  Gene Ontology: Mol. function=DNA binding; Cellular component=beta -galactosidase complex; Biological process=DNA integration
  Homolog annotation: Hit_ID=Q1SS72; Match level="QueryCoverage=97%, HitCoverage=79%, E-value=0.0, Identity=60%"; Hit description =Integrase, catalytic region
  Pfam annotation: Domain name=rve; Domain location=321-481; Score =161.3; E_value=2.4e-45; Accession=PF00665.16; Description=Integrase core domain
  Pfam annotation: Domain name=zf-CCHC; Domain location=31-48; Score =16.6; E_value=0.0018; Accession=PF00098.13; Description=Zinc knuckle
  Pfam module annotation: Pfam domain module=RVT_2::rve::zf-CCHC; Domain location=735-990::321-481::31-48
MAMQVNSNQSNFNGKGGYYNKGKGSSKGGNRVCTHCGKTNHIVDNCFEKIGYPPGYKTNKSKNSSSSSQANNTSNASALESTQQGSSAQSSFQFTQEMYQGILEALQQSKVGSQPKANSVTTSPFALHSPSSNPNGKNPSLWILDTGATDHITFDLSSLTTYQNIVPVPVSLPNGSQVLASISGSVVISPLITIHHVLYIPCFHVNLMSVTKLASTNNCHLSFTTDLCKILQNHSLETIGTAKLQRGLYVIDTADMIRSCNSISSHSFELWHSRLGHVSNSGMQAISKQFPFIPCKNNMSPYDSCHFSKQKRLPFPNSITTSLSPFELLHADVWGPYSTISLLGHKYFLTLVDDYSRFTWVIFLKNKSETKNHIINFVAYLENQFNTSLKCLRSDNGTEFALNDFFLSKGIIHQKSCVETPQQNGVVERKHQHILNVARSFFFHSNVPLTMWNFCVQHAVHVINRIPSPLLKSKSPYELLFKLPPTLLHLKVFGCLSYATTIQAHRTKFDSRARKCVFIGYKDGTKGYMLYDLHSHNIFLSRNVIFYEHCLPFKTVPGPTPSNTPSNFPLYDDPLDISPHPCVDSSPLSTGLIDSTSTSPASIPPIDHTLDSSSLPTPAVTAHPTHPTSDLDQNSIDQTSSHITNVPVTLEPPLPLSTRVSTRPKRPPGYLQDYHCNVISSCTNQFSSNVAYPLSSVLSYNNCSPDYKIFCCSISSTIEPKTYNQASKFDCWKKAMDAEITALEVNKTWTVVDLPCGKVPVGCKWVYKIKYHANGTIERYKARLVAKGYTQMEGVDYFDTFSPVAKMTTVRVLLAVAAVRGWHLEQLDVNNAFLHGDLNEEVYMSLPPGYDASSPSKVCKLNKSLYGLKQASRQWYSKLSTALTSLGYQVSQADHSLYVRSDGTSFTALLVYVDDIVLAGTSMEEIKSVKLFLDQQFKIKDLDQLRFFLGLEIARSSSGIFLNQRKYTLELLEDTGFLGSKPASVPLDPHTKLSATDGVPFDDPSGYRRLIGRLLYLTHTRPDISFSVQHLSQYVSNPLVPHYQAATRILRYLKSCPAKGILFSSHSPLQLHGFADSDWACCPNTRRSITGYCVLLGSSLISWKSKKQNTVSRSSTEAEYRALASLTCELQWLQYLFQDLNITFPQSASVYCDNKSAIYLAHNPTFHERSKHIELDCHIIREKLQSKLIHLLPVPSQSQLADVFTKPLHSPSFSSMMSKLGLCSIHHPT

SEQ ID NO: 120494 - protein, 70 aa, Glycine max
  Coding DNA Sequence Number=SeqID_3716
  Gene Ontology: Mol. function=drug transporter activity; Cellular component=integral to membrane; Biological process=response to nematode
  Homolog annotation: Hit_ID=Q9FHB6; Match level="QueryCoverage=81%, HitCoverage=11%, E-value=2e-09, Identity=51%"; Hit description =Genomic DNA, chromosome 5, TAC clone:K24M7
MALWKEEAKKQLWLAGPMVFVSVFQYSLQVISLMFVGHLDELLLASASLATSFVNATGFNVLFSHFQNVR

SEQ ID NO: 120495 - protein, 156 aa, Glycine max
  Coding DNA Sequence Number=SeqID_3717
  Gene Ontology: Mol. function=calcium-dependent phospholipid binding; Cellular component=membrane; Biological process=transport
  Homolog annotation: Hit_ID=Q9M2T2; Match level="QueryCoverage=96%, HitCoverage=98%, E-value=1e-34, Identity=47%"; Hit description =Elicitor responsive/phloem-like protein
  Pfam annotation: Domain name=C2; Domain location=6-90; Score=89.0; E _value=1.4e-23; Accession=PF00168.20; Description=C2 domain
MAIGFMKVQLVKAKGLRGTDIFGKMDPYVLIQYKNQEKRSTVANGQGKNPVWNEKFIFKVEYPGSINQHKLILKIMDKDLYTDDFVGEAIIHVGDLLAQGVENGGAELPTLKYRVVRANKSYCGEIDIGVTFTRKVEDKFVEGDIGGWKESDHYLL

SEQ ID NO: 120496 - protein, 395 aa, Glycine max
  Coding DNA Sequence Number=SeqID_3718
  Gene Ontology: Mol. function=metal ion binding
  Homolog annotation: Hit_ID=Q2HUT4; Match level="QueryCoverage=56%, HitCoverage=43%, E-value=5e-88, Identity=75%"; Hit description =Putative RING zinc finger protein-related
MDFVPYAQIDTPSGEREILHTDANYNDTKHLQWTQISYGAFWDGQGWCGGHHRTNDGFMVVWLWLHSGHRWVRRFGSHTYGVVEISKKTKKVKEVVRGRTAATSAPVRGSAAECGVSVPLFSDSETCRRQMRTRTGCVGGSGGFVSGGIVRSVSVFGFGGNEVLGFRDLGGHDIVASFIVNKSASLLEDNKFQLTNEIFDEIDAPSSKVGIWSLDPLPGPNKTRVVFTVDPEDKHTEMSSAVISLIRASFTTLVIRPSILHLTSSSLFGDPYSFEVLKFKGGITIIPQQTAFPLQKEQAKFSFKLNFPIYQIQSNFKELTSQLKSGLYLTSFENLYISLSNSEGSTVDAPTVVQSTVLLAVGITPSKERLKQLAQTIMGPHNLGLNHTEFGKVKQ

SEQ ID NO: 120497 - protein, 79 aa, Glycine max
  Coding DNA Sequence Number=SeqID_3719
MYNSYKKNHKLEVQHNANMEVSVKGDMDEDSNNGEEDTNNDAFEIEEVEDLKAYLLIPKKDNIFMSRDIKLSIKLLMIN

SEQ ID NO: 120498 - protein, 163 aa, Glycine max
  Coding DNA Sequence Number=SeqID_3720
  Homolog annotation: Hit_ID=Q1SQE1; Match level="QueryCoverage=46%, HitCoverage=21%, E-value=2e-19, Identity=66%"; Hit description=Seed maturation-like protein, putative
MTGEEEAVEGVFGDSVDDRKVVGGEQSKHGGNGLLRGVSGGGGHTFRDGGVVEGLDAVEDGDDHGEATVEVARGDSVVGEAGRDEAATAAREGEEDGGWRRRRKRGGCFEVAAQKTDPEPAPLRPVRPLQPRHETAPLQRCPSRMGAAPLHSAAIAAAIDYIG

SEQ ID NO: 120499 - protein, 71 aa, Glycine max
  Coding DNA Sequence Number=SeqID_3721
MAPVFMENDAPYKEKLLTMHEEEKYEWDGYHEEELSIEKWEKNIMEKTQVEESIKTNYHFFSEKHTHPNRL

SEQ ID NO: 120500 - protein, 45 aa, Glycine max
  Coding DNA Sequence Number=SeqID_3722
MSRVSRERKDQVPESFERLCCVKICKDQSLKQELVCELEMSLYLM

SEQ ID NO: 120501 - protein, 35 aa, Glycine max
  Coding DNA Sequence Number=SeqID_3723
MDRASDKRNPHGLSARKTLEEDELYMFSKRIASSY

SEQ ID NO: 120502 - protein, 75 aa, Glycine max
  Coding DNA Sequence Number=SeqID_3724
MDVFFMFKACCLLYKPWMRTSSIDCIKTTSSELNNYFIDQEIRLSYGDSEFGRKNEVRSVLESGKELGLLVMEKE

SEQ ID NO: 120503 - protein, 74 aa, Glycine max
  Coding DNA Sequence Number=SeqID_3725
MVPYILLDANTSHNVLLNRPTLNKLEAIISTPHLAMKFPSSIGEIVTIKADQADAHECYVKSCKVELYNMAIAI

SEQ ID NO: 120504 - protein, 99 aa, Glycine max
  Coding DNA Sequence Number=SeqID_3726
MDILGRFPVAEGQVKFLLMAIDYFTKWIKADHFSEDETPFRLTYGNSAMVPVEVSESSVRRTQFEEALNDKNLALELDRINEVRNHAEIQEEARKRRAT

SEQ ID NO: 120505 - protein, 79 aa, Glycine max
  Coding DNA Sequence Number=SeqID_3727
MVPNALLTRKGWKERALWCLYRTHAKARVMSEIEEVQEQMKANMEAVKEQMTTMMEAMMSMRKNDGGQHDYSHCCKYRH

SEQ ID NO: 120506 - protein, 126 aa, Glycine max
  Coding DNA Sequence Number=SeqID_3728
MRRHIFAFHLALPSKEHSSRPLPGDPEYARFISVADDHEHGGLLGTVGLGPESSLPFWGEAAEDTPEAGEAEDTPEEEAGAKDAPVEAVEVGVSGATEADIDIDYVADVIAAQGTWDPWPTPDQDD

SEQ ID NO: 120507 - protein, 73 aa, Glycine max
  Coding DNA Sequence Number=SeqID_3729
  Subcellular localization annotation: CTP_CleavageSite=35; ConfidenceScore=5.00e-01
MLLNSNVIYICVRVVMLVRMTRTHLFAVARVKSCPGMHSSCVIASLSGCARTVGRPSISGGGPGTNKRELLAP

SEQ ID NO: 120508 - protein, 453 aa, Glycine max
  Coding DNA Sequence Number=SeqID_3730
  Gene Ontology: Mol. function=receptor activity; Cellular component =integral to membrane; Biological process=xylan catabolic process
  Homolog annotation: Hit_ID=Q6JN46; Match level="QueryCoverage=96%, HitCoverage=89%, E-value=2e-97, Identity=32%"; Hit description=EIX receptor 2
  Pfam annotation: Domain name=LRR_1; Domain location=109-131; Score =9.7; E_value=4.4; Accession=PF00560.23; Description=Leucine Rich Repeat
  Pfam annotation: Domain name=LRR_1; Domain location=133-156; Score =9.6; E_value=4.5; Accession=PF00560.23; Description=Leucine Rich Repeat
  Pfam annotation: Domain name=LRR_1; Domain location=158-180; Score =9.0; E_value=5.9; Accession=PF00560.23; Description=Leucine Rich Repeat
  Pfam annotation: Domain name=LRR_1; Domain location=182-204; Score =8.5; E_value=7.4; Accession=PF00560.23; Description=Leucine Rich Repeat
  Pfam annotation: Domain name=LRR_1; Domain location=256-278; Score =13.9; E_value=0.58; Accession=PF00560.23; Description=Leucine Rich Repeat
  Pfam annotation: Domain name=LRR_1; Domain location=280-302; Score =16.4; E_value=0.1; Accession=PF00560.23; Description=Leucine Rich Repeat
  Pfam annotation: Domain name=LRR_1; Domain location=304-326; Score =16.7; E_value=0.085; Accession=PF00560.23; Description=Leucine Rich Repeat
  Pfam annotation: Domain name=LRR_1; Domain location=328-349; Score =7.8; E_value=9.9; Accession=PF00560.23; Description=Leucine Rich Repeat
  Pfam annotation: Domain name=LRR_1; Domain location=61-83; Score =11.6; E_value=1.9; Accession=PF00560.23; Description=Leucine Rich Repeat
  Pfam annotation: Domain name=LRR_1; Domain location=85-107; Score =17.2; E_value=0.058; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=109 -131::133-156::158-180::182-204::256-278::280-302::304-326::328 -349::61-83::85-107
MRSCKLGPEFPKWLQTQNQFGNIDISNAGIADMVPKWFWANLAFREWISMNISYNNLHVETLYQLDLSNNHFSGKIPDCWSRFKSLSYLDLSHNNFSGRIPTSMGSLLDLQALLLRNNNLTYEIPFSLRSCTNLIMLDVAENRLSGLIPVWIGSKLQELQFLSLGRNNFHGTLPLQICYLSGIQLLDLSINNMSGKIPKCIKNFTSMTQKTSSGDYQGHSYYVTSSYSSGDQTYDLNAFLMWKGSEKMFKNNGLLLLKSIDLSSNHFSGEIPLEIENLFGLVSLNLSRNNLTGKIPSKIGKLASLESLDLSRNQLVGSIPLSLTQIYWLSVLDLSHNHLTGKIPTSTQLQSFNASSYEDNLDLCGPPLEKFCIDGRPTQKPNVEVQEGEYSLFSREFYISMTFGFVISFWVVFGSILLKRSWRHAYFKFLNNLSDNIYVKVAVFANKISKVHG

SEQ ID NO: 120509 - protein, 65 aa, Glycine max
  Coding DNA Sequence Number=SeqID_3731
MCAVKKVIWTFQLPEKKDETNIQCMRDDMMQMRKSETEGWTTSDNISSKRKTLDEVSLSSSKSES

SEQ ID NO: 120510 - protein, 351 aa, Glycine max
  Coding DNA Sequence Number=SeqID_3732
  Gene Ontology: Mol. function=drug transporter activity; Cellular component=integral to membrane; Biological process=response to nematode
  Homolog annotation: Hit_ID=Q9FHB6; Match level="QueryCoverage=52%, HitCoverage=34%, E-value=9e-40, Identity=48%"; Hit description =Genomic DNA, chromosome 5, TAC clone:K24M7
  Pfam annotation: Domain name=MatE; Domain location=128-305; Score =56.8; E_value=7e-14; Accession=PF01554.9; Description=MatE
MKRPLPPSVSSDNVEDRKMKKKVKALDTTTMWSAWRASMFDDNLLFEVLKHIDTSDVGMHKQAVTQGVEIIKGKKTPEKKVELKKLKEKKTKEKPKKTREVIDGGAYGVELVEELVGDWWGGLGGWRVEESLEASTFEIIVLLTGALPNSKLQTSVLSICLNTTGVFWMVPFGVSVAGSIRISNELGDGSAKAAYLAVKVTMFLGSAVGILEFAVLMLVRKVWGRAFTNIHEVATYVTAIIPIVASSAFIDSIQTAFQVYIELNQFINTLLVQLHRVARGCDRQKLGALINLGSYYLLGVPFAIVTACVLHTKGQQYNVFIVQANKAATRLGGSIVQVEALQGNQNVNTTA

SEQ ID NO: 120511 - protein, 187 aa, Glycine max
  Coding DNA Sequence Number=SeqID_3733
MHIMDILQSLKIVSDTLWLCIGDYNIISSQEGVKYFIQTRGSERGHYPDAPNKSPSFWRLNQTNFRSWLEDIMSEMEEDSRAMVFTVARNIWYGRNQYVLQNRRLDFRQILAKANQNLPLCLMRDVPNAHSQRVPVGWKPPPEGTFKVKLNAAIRNNQGTCMGFIDRDHEGNVLAASSRSISSTGFC

SEQ ID NO: 120512 - protein, 133 aa, Glycine max
  Coding DNA Sequence Number=SeqID_3734
MPHRRSWHSSPPLLSPPLLIILFPIVILTLLFLAVPPLLSAATRLLRPASSDVKTSWDSLNILLVVFAILCGVFARRNNDEEQTQNNNHVHQHDDDAVSDRNAAFRRVPSEGQSQWFGFSEERKVYGNDTPLN

SEQ ID NO: 120513 - protein, 382 aa, Glycine max
  Coding DNA Sequence Number=SeqID_3735
  Gene Ontology: Mol. function=GPI anchor binding; Cellular component =anchored to membrane
  Homolog annotation: Hit_ID=Q9SUC9; Match level="QueryCoverage=79%, HitCoverage=78%, E-value=8e-42, Identity=35%"; Hit description =Uncharacterized GPI-anchored protein At4g28100 precursor
MSLTLFLKTLFLFFPCYLCLPDSETTTTLNPILLTPSKPATTIPAFPEQSEVSGCPLTLSDELFDGIKSACGGAKSGADMELHHSRCCPVLAAWLYSAYSATALGSMAGHSHSHSNNGHGHDGHATSAYDMIMPLLPDDSETCVNELGKALELRGVELTKPNETCDVVYCFCGIRLHHLTCPDSFSVGQSGELVGDASVTRLEKNCLSSTTDANGLPEDQDGLGFIFIFLTSSLMLGTCFCTIPHAPLELVWFTNMDRTEPIVDWISDLVLNKKTSNSSKAEDRTTKIHNKDCELMGLTWLLAKNRTAYMHTVSAVLRALMLNTDGSYPQSCSLNSDGMPLAVDSSEISDHSSSTNLLPPISLSLLLLCLLLLPMHFTMLSS

SEQ ID NO: 120514 - protein, 91 aa, Glycine max
  Coding DNA Sequence Number=SeqID_3736
  Gene Ontology: Mol. function=enzyme inhibitor activity; Cellular component=cell wall; Biological process=cell wall modification
  Homolog annotation: Hit_ID=Q69Y54; Match level="QueryCoverage=97%, HitCoverage=17%, E-value=5e-20, Identity=51%"; Hit description =Putative pectin methylesterase
  Pfam annotation: Domain name=Pectinesterase; Domain location=1-91; Score=-140.0; E_value=4.8e-11; Accession=PF01095.10; Description =Pectinesterase
TEAIDFAPNNSRDRTVIRVKEGIYKENVVIQSYKINIVMLGDGSDVTVITGNRSVPGEGSLARDIAFNNSAGLEKQRAVALRVHADLTAFY

SEQ ID NO: 120515 - protein, 107 aa, Glycine max
  Coding DNA Sequence Number=SeqID_3737
MEYTDLCMSPDDFEEKVSENLSKKRKFQNICSDKVKATDELVSGVTEVEKSDILCMAVESPESINSDQTKKIADLKGRSESNKKSKRSNSKKTGSNNRTLLNFFSRV

SEQ ID NO: 120516 - protein, 624 aa, Glycine max
  Coding DNA Sequence Number=SeqID_3738
  Gene Ontology: Mol. function=DNA binding; Cellular component=nucleus; Biological process=regulation of transcription, DNA-dependent
  Homolog annotation: Hit_ID=Q6R029; Match level="QueryCoverage=80%, HitCoverage=59%, E-value=1e-120, Identity=42%"; Hit description=MYB transcription factor
  Pfam annotation: Domain name=Myb_DNA-binding; Domain location=332 -425; Score=6.2; E_value=1.3; Accession=PF00249.21; Description=Myb -like DNA-binding domain
  Pfam annotation: Domain name=Myb_DNA-binding; Domain location=431 -478; Score=23.9; E_value=0.00056; Accession=PF00249.21; Description =Myb-like DNA-binding domain
  Pfam annotation: Domain name=Myb_DNA-binding; Domain location=484 -530; Score=36.5; E_value=8.9e-08; Accession=PF00249.21; Description =Myb-like DNA-binding domain
  Pfam annotation: Domain name=Myb_DNA-binding; Domain location=535 -580; Score=43.7; E_value=6.3e-10; Accession=PF00249.21; Description =Myb-like DNA-binding domain
  Pfam annotation: Domain name=Myb_DNA-binding; Domain location=586 -624; Score=17.0; E_value=0.067; Accession=PF00249.21; Description =Myb-like DNA-binding domain
  Pfam module annotation: Pfam domain module=Myb_DNA-binding::Myb_DNA -binding::Myb_DNA-binding::Myb_DNA-binding::Myb_DNA-binding; Domain location=332-425::431-478::484-530::535-580::586-624
MTPRVDDFEKDDLSASDDDDDDDDDGLKEDMAALARACTIAVPCPDDNSTAEDDVPAEDPLLHAGDSIVPAATDSDDDQDDLECLKRVQSLYQPLSVLPPLTPPAAVSDDDDDGVDDLETVRAIMKRFSTYGEGGMQMLVEGDQTSSPGYEGDIANGSIHYESDAGELCPVSQDPNEAATEELIENVEMKLSDFVESSEPDAYESSKLPQKRLSCPPVVRCFVDAINKNRDLQRFIRSKLIELEAKIEENKKIRNKIKILKDFQASCTRRTGNALSMKKDPRVQLISSKKPFAPKNSKKHKKASAMCYGPEENSHVANYRMVLERFPLSLDRKKWSSVERESLLKGIKQQFQEMVLQLSLSVDSSEGLLGDANDMDNVIASVKDLEITPERIRQFLPKVNWDLIASMYVGGRNGAECESRWLNCEDPLINQGAWTNEEDKSLLLIVQDMGIRNWFDIAASLGTSRTPFQCLARFQRSLNPAMLNSEWTEEEDSQLCSAVACFGARDWQSVASVLERRTGTQCSNRWKKSICPEKKGSFTQEEDIRLTVAVMLFGRKWNQIANYVPGRIQSQCRDRYLNSLDPSLKWGGWTEEEDLRLEAAIVKHGYCWSKIAEEVPPRTDSQCR

SEQ ID NO: 120517 - protein, 92 aa, Glycine max
  Coding DNA Sequence Number=SeqID_3739
  Gene Ontology: Mol. function=protein binding; Cellular component =integral to membrane; Biological process=ethanol metabolic process
  Homolog annotation: Hit_ID=Q2RB03; Match level="QueryCoverage=93%, HitCoverage=36%, E-value=1e-30, Identity=65%"; Hit description =Mpv17/PMP22 family protein, expressed
  Pfam annotation: Domain name=Mpv17_PMP22; Domain location=24-90; Score=45.4; E_value=1.9e-10; Accession=PF04117.3; Description=Mpv17 PMP22 family
MKYFHRFLFSPIFIGVFSSTLVTLEGNPSRAVPKLKQEWFSAVLANWKLWIPFQFLNFRFVPQQFQVLAANVIALVWNVILSFMAHKEVLPK

SEQ ID NO: 120518 - protein, 402 aa, Glycine max
  Coding DNA Sequence Number=SeqID_3740
  Gene Ontology: Mol. function=protein kinase activity; Biological process=protein amino acid phosphorylation
  Homolog annotation: Hit_ID=Q9FK64; Match level="QueryCoverage=90%, HitCoverage=93%, E-value=1e-126, Identity=62%"; Hit description =Tyrosine-specific protein phosphatase-like protein
  Pfam annotation: Domain name=DUF860; Domain location=53-359; Score =298.9; E_value=9.4e-87; Accession=PF05898.4; Description=Plant specific of unknown function (DUF860)
MNPRFTTAQLQSHEPLVHPQTQDLPSTPFPLHPLHPTAMEETHRLRPNPLRGQSPRPPLGQTHVPPQKTRPCSQNPPPHVRAQARSLRLPHPPLPLAKHPRTPHPRGALPPQIPPRVPRQQETEAVKRVKKLLMMSLNGTLRLHALRLFKRELGLPEDFRDSILGKYSADFRLVDLEVVALVDWDAELAVARVEEWREKEYSEKWLSEFETKFAFPVSFPTGFKFERGFKERLKNWQRLPYAKPYERKEVVRVRTCGGIERYEKRAVAVLHELLSLTVEKMVEVDQLAHFRRDFGVEVNVRELLLRHPGIFYLSTKGKTLTVFLREAYRKGGLVEPNPVYETRRNMLDLVLLGCRKTKLLLDCDESNKEESNVVACEVNEEGERQGDWVIPFLEKCEENRSP

SEQ ID NO: 120519 - protein, 378 aa, Glycine max
  Coding DNA Sequence Number=SeqID_3741
  Gene Ontology: Mol. function=molecular_function; Cellular component =nuclear pore; Biological process=regulation of nucleocytoplasmic transport
  Homolog annotation: Hit_ID=Q2HUV6; Match level="QueryCoverage=75%, HitCoverage=92%, E-value=2e-97, Identity=64%"; Hit description =Cytochrome cd1-nitrite reductase-like, C-terminal haem d1
  Pfam annotation: Domain name=WD40; Domain location=136-175; Score =4.3; E_value=12; Accession=PF00400.22; Description=WD domain, G-beta repeat
  Pfam annotation: Domain name=WD40; Domain location=286-323; Score =13.6; E_value=0.71; Accession=PF00400.22; Description=WD domain, G -beta repeat
  Pfam module annotation: Pfam domain module=WD40::WD40; Domain location=136-175::286-323
MASFPPPGSLTLCEVNRDLITVDALSDDRANQTYGKILGLVFSPVPFHNLENDASDQEGPTATETAAGESVQRKCPVALLQGLVNNYLGRLFYPNDVHLLPEVDLQGVSWHPNKHIIAFISAPTQVLVRDYQESEGKDPSILTNESQRDARVLEWRPNGGKMLAVGCKGGICMWAASYPGNAASVRSGAASFLGGLSRSSGNRYILVDFLRSPYDEHVSALSWSPDGRYPYLCQKVLLIFGFCYVFPKYDMVVLLLSFVIEAAVLGKVTSASYESSSFTVWDFAQGVGTPIRRGLGGISMLKWSPTGDYFFASKFDGTFYLWETNTWTSEQWSSTSGFVKMNLFPRKKVHGGRMEYPPPQKKPWRRSWINKVLGAELT

SEQ ID NO: 120520 - protein, 211 aa, Glycine max
  Coding DNA Sequence Number=SeqID_3742
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=93%, HitCoverage=60%, E-value=1e-66, Identity=59%"; Hit description=Ser -thr protein kinase
  Pfam annotation: Domain name=Pkinase_Tyr; Domain location=2-180; Score=-134.1; E_value=0.0003; Accession=PF07714.7; Description =Protein tyrosine kinase
FFNFDFILAYAAVREGEELNWTMRMRIAMGIAYCLEYMHELKPPIAHRNLQSSFIYLTEDYAAKISDLSLWNDMCDTKNGSATTQFLETSSADTKDNVYSFGIVLFELITGRIPLAGNNELLADWAAEYVRWGKSLRDVVDPRLKSLQEEEIEEWSEVIRNCVQPDPEKRPTMKEVTSRLKEITAMGPDGANPKASPLWWAEMAITSTDSS

SEQ ID NO: 120521 - protein, 894 aa, Glycine max
  Coding DNA Sequence Number=SeqID_3743
  Gene Ontology: Mol. function=protein binding; Cellular component =thylakoid; Biological process=ethylene mediated signaling pathway
  Homolog annotation: Hit_ID=Q1SC84; Match level="QueryCoverage=96%, HitCoverage=97%, E-value=0.0, Identity=49%"; Hit description=TPR Domain, putative
  Pfam annotation: Domain name=TPR_1; Domain location=431-464; Score =2.5; E_value=2.7; Accession=PF00515.18; Description=Tetratricopeptide repeat
  Pfam annotation: Domain name=TPR_1; Domain location=560-593; Score =17.2; E_value=0.048; Accession=PF00515.18; Description =Tetratricopeptide repeat
  Pfam annotation: Domain name=TPR_1; Domain location=760-793; Score =29.3; E_value=1.4e-05; Accession=PF00515.18; Description =Tetratricopeptide repeat
  Pfam annotation: Domain name=TPR_2; Domain location=431-464; Score =9.6; E_value=2.6; Accession=PF07719.7; Description=Tetratricopeptide repeat
  Pfam annotation: Domain name=TPR_2; Domain location=560-593; Score =23.7; E_value=0.00065; Accession=PF07719.7; Description =Tetratricopeptide repeat
  Pfam annotation: Domain name=TPR_2; Domain location=686-719; Score =11.0; E_value=1.7; Accession=PF07719.7; Description=Tetratricopeptide repeat
  Pfam annotation: Domain name=TPR_2; Domain location=760-791; Score =13.3; E_value=0.86; Accession=PF07719.7; Description=Tetratricopeptid e repeat
  Pfam annotation: Domain name=TPR_2; Domain location=792-825; Score =15.0; E_value=0.28; Accession=PF07719.7; Description=Tetratricopeptid e repeat
  Pfam module annotation: Pfam domain module=TPR_1::TPR_1::TPR_1::TPR _2::TPR_2::TPR_2::TPR_2::TPR_2; Domain location=431-464::560-593::760- 793::431-464::560-593::686-719::760-791::792-825
  Subcellular localization annotation: CTP_CleavageSite=63; ConfidenceScore=5.55e-01
MRDLKLVERFKSTQVHALNSEATSRRNKATVGARARAITIRSLVSKSKSNTTTTSTTTTTSAVANLVVPLQLPSADTLEPSIEPHLKPINLVEALSELYQRLECCCLQSEKKTSLCVEQFTLLRSLGDQKLLRRCLRTARQNAEDVLSKVVLSAWLRFERREDELEGVPSMDCGGGGGSCVLECPKVNLVKGFSSPCSINDRCQCPQGTKEEATSNEESVFLCLPDEEKKDVSFCIGIEEIDCVRWRIAALSDPGKNMLYGGFAESKMRKIDFSKNGICSKGMRAVEFYSRAKRLDFFCAMTVLELLSFANRFCCEEMKAACDAHLASTVGSADDALTLIDYGLEERAPLLVASCLQVLLRELPNSLHNSKVMNVFCSSEGRKRLAMVGYDSFLLYYFLSQVAMEEIMVSKTTVMLLERLGECAAERWQKALAFHQLGCVLVERKEYKEAQHSFEVAAEAGHVYSVAGVARTKYKQGQPYSAYKLISSLIFEHKPAGWMYQERALYNMGREKSFDLDVATELDPSLSFPYKYRALAKVEEKQIKDGILELDKIIGFKLSPDCLELRARMFIALKDYDSAIRDIRALLTLEPNYVTSNEKISGKYLVHLLSHVVQQKSQAECWMQLYEQWSSVDDVGSLAIIHQMLENEPGKSLLEFRQSLLLLRLNCQKAAMRSLRMARNHSSSMQERLIYEGWILYDTGYRDEALARADRSITIQRSFEAYFLKAYVLADTSMDPESASYVIELLEEALKCPSDGLRKGQALNNLGSIYVDCGKLDLAKACYENALAIRHTRAHQGLARVYHQKNQRKAAYDEMTKLIEKAESNASAYEKRSEYCDREMAKVDLNVATQLDPLRTYPYRYRAAVFCKPISYVTDNKTLVAYCISGHGQASRNM

SEQ ID NO: 120522 - protein, 132 aa, Glycine max
  Coding DNA Sequence Number=SeqID_3744
  Homolog annotation: Hit_ID=Q1SJS5; Match level="QueryCoverage=31%, HitCoverage=14%, E-value=6e-16, Identity=88%"; Hit description=Zinc finger, RING-type; RINGv
MACGWEHCEEARAYEHSGIICLVGVWISLDCCGWPSTFGRFSTSLLDEKDCTRDRGRGRGRGNGGRNLINERSKGVEGSDRIGEREEYNNKDWWQGIWQSWGKGTHIVYMSGTEKRGNIIEFGIGCGSLSGL

SEQ ID NO: 120523 - protein, 464 aa, Glycine max
  Coding DNA Sequence Number=SeqID_3745
  Gene Ontology: Mol. function=protein-tyrosine kinase activity; Cellular component=integral to membrane; Biological process=protein amino acid phosphorylation
  Homolog annotation: Hit_ID=Q84U00; Match level="QueryCoverage=27%, HitCoverage=39%, E-value=3e-51, Identity=74%"; Hit description=Ser -thr protein kinase
  Pfam annotation: Domain name=LRRNT_2; Domain location=29-72; Score =54.8; E_value=2.9e-13; Accession=PF08263.3; Description=Leucine rich repeat N-terminal domain
  Pfam annotation: Domain name=LRR_1; Domain location=123-146; Score =11.0; E_value=2.4; Accession=PF00560.23; Description=Leucine Rich Repeat
  Pfam annotation: Domain name=LRR_1; Domain location=147-169; Score =9.2; E_value=5.5; Accession=PF00560.23; Description=Leucine Rich Repeat
  Pfam annotation: Domain name=LRR_1; Domain location=75-97; Score=4.1; E_value=49; Accession=PF00560.23; Description=Leucine Rich Repeat
  Pfam annotation: Domain name=LRR_1; Domain location=99-121; Score =10.6; E_value=2.9; Accession=PF00560.23; Description=Leucine Rich Repeat
  Pfam module annotation: Pfam domain module=LRRNT_2::LRR_1::LRR_1::LRR_ 1::LRR_1; Domain location=29-72::123-146::147-169::75-97::99-121
MAPFTPSKLLLLTLVFTLSQKQSLCSTLKSEEGLALLALRERVVSDPQGALSSWSGEDGDIDPCSWFGVECFHGYVVTLNLKDLCLEGTLAPEIGKLTHIKSIILRNNSFFGEIPKEILHLEKLEVLDLGYNNFSGLLPFDHGSMPSLTTLLLDNNYYLTNLTPELYKLKMNSEFHANEEQLTGATTRELFVCRCHLRHIGQHGDRSYRRQLLKVANDANTPRIQGNVNRGTLKQSASHFAFSLPPDFEPFSSSPSESPSYSPGAVPLSYSPSPLPSPSSIFFTPSPVVLPTPGISSPANTLPPEFNWAPSPSPFSNQGNTDSSNQIHHSVIIWKVVAVKPWSTGLSGQLQKAFVKGVPSLKRGEIEAASEYFSNIIGSLPDGTVYKGTLSSGVEIAVASSAVTTAKNWSKSMEAQFRKKIATLSRVNHKNFVNLIGYCEENKPFSRMMVLEYAPNGTLFEHLH

SEQ ID NO: 120524 - protein, 167 aa, Glycine max
  Coding DNA Sequence Number=SeqID_3746
  Gene Ontology: Mol. function=O-methyltransferase activity
  Homolog annotation: Hit_ID=Q0M6D6; Match level="QueryCoverage=50%, HitCoverage=38%, E-value=3e-22, Identity=63%"; Hit description=O -methyltransferase, family 3
MLAVSDLIEIRVGDALDTLSQDLPASVDMLVLDGAKAIYPEILQLVQPWLRPGALIVADDADFSPEYLEMVHGSRLYTSLPFADGVEVAAMKVTVPLLVIAFASAKAGAFQAKIDPLKLALKPANALASTDQAQPLAIAEAHARLAAAVSGCQCPFCTQMRLVNSGL

SEQ ID NO: 120525 - protein, 231 aa, Glycine max
  Coding DNA Sequence Number=SeqID_3747
MVEVHGRVALSGGYSFPDHAGTTYIVPISLEAKNERYKVYGGRSKHLQEELGITMHIVPLSLGHGDEGYRVYGGRSKYLQEELGRTMHTIPLSLGARNEGYQVYGGKSNCFQEEIDITRAHRSSYPFTLRDTLLKSSTSTNVGYPRKDHVRSMDIVHSSLGARNEGYFSNVYGGSSNNWQEELDRTTAQRASYSFDGVRSDFERYTTKVLGRFVQSRMNILMKERRVFVES

SEQ ID NO: 120526 - protein, 70 aa, Glycine max
  Coding DNA Sequence Number=SeqID_3748
  Gene Ontology: Mol. function=transporter activity; Cellular component= intracellular; Biological process=transport
  Homolog annotation: Hit_ID=Q1S959; Match level="QueryCoverage=71%, HitCoverage=14%, E-value=1e-18, Identity=88%"; Hit description =Cellular retinaldehyde binding/alpha-tocopherol transport; Cellular ...
  Homolog annotation: Hit description=retinaldehyde-binding/triple function, N-terminal
MLQCSMFAWCLLPIFLGCEASFARKNKEKNPGATRLWEGGITEGNGLCIPPTLLKKRRFQVIQTSCIMKH

SEQ ID NO: 120527 - protein, 145 aa, Glycine max
  Coding DNA Sequence Number=SeqID_3749
MSEETHQENKNAIEFLDEYTFYYDEEHEKCIPCYKEDSTKVVLNSVDFDFNNHNKDLDKFLKNLATRDSSPQLEVLALAPSTYEVPVILAPTTSPIVDAPTKVLALAIDEVVAPTLGSYPSKGLHPVPTPQRVHAHIVAATPPTP

SEQ ID NO: 120528 - protein, 229 aa, Glycine max
  Coding DNA Sequence Number=SeqID_3750
  Gene Ontology: Mol. function=sequence-specific DNA binding; Cellular component=nucleus; Biological process=regulation of transcription
  Homolog annotation: Hit_ID=O81639; Match level="QueryCoverage=73%, HitCoverage=57%, E-value=9e-46, Identity=53%"; Hit description=Zinc finger protein
  Pfam annotation: Domain name=WRKY; Domain location=67-126; Score =136.1; E_value=9.5e-38; Accession=PF03106.6; Description=WRKY DNA -binding domain
MNQKNLPHKNSAKNNNPNHQNKNRQLNCKQSSLIEDENDGHSYSSTGSRTVKEPRVVVQTTSEIDILDDGYRWRKYGQKLVKGNPNPRSYYTCVALGCPVRKHVERVAHDMKAVITTYEGKHIHDVPLGRGNSSYSMNRTSLNNNTNTNIVIDPAPIRPSAVTNYSNSASFTNSLHDTKPPTSASQEPFPMDLVLSPESIGFLANDPFLQSFCQRTFKFGSRRTLERYT

SEQ ID NO: 120529 - protein, 274 aa, Glycine max
  Coding DNA Sequence Number=SeqID_3751
NVPKETSKKCIKRTRLRTKEVQDTEVYSDDGIKTCGEVVSACRNVSKKMRSKRHTKNTQNCPKEVVDISCSDKVKTCIESSESQSTFIASSGNQDSDNITIVCFLRDKSKEMLSRFTKDLCQASFSARITDVSRQVESQDPFDDQIISLSQSCDTVGTKNLFVQQKAASDTLVGTPEDANTLTGNDDDMTLACFLGNKPKKGSQAANRRSACSSTIIIPDGSGLSRSKHVEEETVLHGGVAEPMDIVVEKKDDELLTSLQNRPTRQRKRPSRFL

SEQ ID NO: 120530 - protein, 142 aa, Glycine max
  Coding DNA Sequence Number=SeqID_3752
MTTTPNVGSCSSSCTLPLLLFLGLLFVPEGVALVLEFRFGVQFDGFWRVFVAALMGCLSGILFIPASRSARCFWLGNDQIRCNLSMITCGWFTRAILYANQMLIVALRPNLQMYLNEALLSWYQRLHASKVPDLNYRKAKVI

SEQ ID NO: 120531 - protein, 105 aa, Glycine max
  Coding DNA Sequence Number=SeqID_3753
MRGYRMVTRTFRQQGENEPVDAKRLTSSSTPFAIQGQRVRWQAKIPYGHPHLSSIEGNKFDGFTLVVRKHSSPTTHEILFYWAGTIECNGVGKCCGCPTLSLSRR

SEQ ID NO: 120532 - protein, 95 aa, Glycine max
  Coding DNA Sequence Number=SeqID_3754
  Subcellular localization annotation: CTP_CleavageSite=61; ConfidenceScore=5.08e-01
MKVQCFVDLSLRQRPMTSVVNVMVSGCLPFKLIAYSVPSKSSSPFLVFACVGEVNDDADFAAGVGSEGGGGSVVSVATRGPPEREGVSRKDDRQQ

SEQ ID NO: 120533 - protein, 79 aa, Glycine max
  Coding DNA Sequence Number=SeqID_3755
MDLGVGSWNGRGIGSYGNYLWSDKCCGKVSQEGEQNTRDNHKVGPHEGDEQGGTTLSTSPLEKVEAFRVASPIKEQKFT

SEQ ID NO: 120534 - protein, 137 aa, Glycine max
  Coding DNA Sequence Number=SeqID_3756
  Homolog annotation: Hit_ID=Q1RV98; Match level="QueryCoverage=65%, HitCoverage=6%, E-value=2e-23, Identity=65%"; Hit description =Phospholipase, patatin family, putative
  Subcellular localization annotation: CTP_CleavageSite=41; ConfidenceScore=5.36e-01
MVVEGYHTFSGSFFLSLFSFLQQLSRKPPHLFSCRRWFLVTASERKKKKKLMVALSMLQDTVVVELKPRDDDESVVDLGMKVVKRREPLKAVTMAKAVASGQQSDDTGILIRLLRSDLPSSTPLNVGDVAVAGSGHQ

SEQ ID NO: 120535 - protein, 59 aa, Glycine max
  Coding DNA Sequence Number=SeqID_3757
MAASPYKLHASNNGGTHGRDISMCDCEGENLKSRDKNPYSGCAERERERVDSILDKEKG

SEQ ID NO: 120536 - protein, 306 aa, Glycine max
  Coding DNA Sequence Number=SeqID_3758
  Gene Ontology: Mol. function=sequence-specific DNA binding; Cellular component=nucleus; Biological process=regulation of transcription, DNA-dependent
  Homolog annotation: Hit_ID=Q1SSB6; Match level="QueryCoverage=96%, HitCoverage=75%, E-value=2e-76, Identity=56%"; Hit description =Homeodomain-related
  Pfam annotation: Domain name=Homeobox; Domain location=16-77; Score =63.4; E_value=7.2e-16; Accession=PF00046.19; Description=Homeobox domain
AEKNKREFNGATPVVVSSRWNPSPEQLRALEELYRRGTRTPSAEQIQHITAQLRRFGNIEGKNVFYWFQNHKARERQKRRRQMESDAEPPEKKDLAASRTVFEVERTKNWTPSTNCSTMAEESVSTQRTAKAVAAAESRTDGWLLLDEGELQQRRNLFERNATWHHVMQLPCPSPSAPVTHLINTTPNASAASSSMTTTTTTVTTTRRRKMDPNLIIKTHDLSFFISPLQRENSVIYLSSSSSTSEDDNCVDESQTLQLFPLRSTGDGSSDNMMKDNETEISTSAMNNANNLTTPGQFFEFLPMKE

SEQ ID NO: 120537 - protein, 132 aa, Glycine max
  Coding DNA Sequence Number=SeqID_3759
  Gene Ontology: Mol. function=nucleotide binding; Cellular component =membrane; Biological process=small GTPase mediated signal transduction
  Homolog annotation: Hit_ID=Q40196; Match level="QueryCoverage=95%, HitCoverage=75%, E-value=2e-47, Identity=64%"; Hit description=RAB11F
  Pfam annotation: Domain name=Miro; Domain location=2-92; Score=1.5; E_ value=0.0039; Accession=PF08477.3; Description=Miro-like protein
  Pfam annotation: Domain name=Ras; Domain location=3-132; Score=119.4; E_value=1e-32; Accession=PF00071.12; Description=Ras family
  Pfam module annotation: Pfam domain module=Miro::Ras; Domain location= 2-92::3-132
MAVADAFDEHCDYLFKVVLGSQEDKLIKAQIWDTAGQERAITSSYYRGALGAMLVYDITKRATFVNVGKWLHELREFGGEDMVVVLVRNKSDLDQSRQVEREKGKGFAETEGLCFMETSALQNLNVDEAFWK

SEQ ID NO: 120538 - protein, 371 aa, Glycine max
  Coding DNA Sequence Number=SeqID_3760
  Gene Ontology: Mol. function=DNA binding; Cellular component =membrane; Biological process=DNA integration
  Homolog annotation: Hit_ID=Q1SS72; Match level="QueryCoverage=95%, HitCoverage=24%, E-value=3e-69, Identity=37%"; Hit description =Integrase, catalytic region
  Pfam annotation: Domain name=zf-CCHC; Domain location=247-264; Score =10.9; E_value=0.016; Accession=PF00098.13; Description=Zinc knuckle
  Pfam annotation: Domain name=zf-CCHC; Domain location=285-302; Score =16.9; E_value=0.0016; Accession=PF00098.13; Description=Zinc knuckle
  Pfam module annotation: Pfam domain module=Retrotrans_gag::zf -CCHC::zf-CCHC; Domain location=76-191::247-264::285-302
MNELLLNSESYLYLHPSENPAVTLVSPALDSSNYHSWSRSMITTLSAKNKVEFVNGNAPEPLKTDRTYGAWNRCNNMVVSWLVHSVSTSIRQSILWMDKAEETWNDLKSRYAQGDLLRVSDLQQEAASIKQGSLSVTEYFTKLRVIWDEVEIFRPDPVCSCTVKCTCSVLNIMAQRKREDRAMQFLRGLNEQYNNIRSHVLLMDPIPTIPKIFSLVAQQERQLAGNNALPNLNIEVKEGPSINAVKSTCEFCGRVGHSENVCYKKHGIPSNYDGKSKGFGMRNGKTCAYCGKPGHTIDICYKKHRYPLGFKFTNSRTMANNIVAVEGKATNDQAQHQEHQELVRFSPEQYKALLALIQQPCEKNSASANSQ

SEQ ID NO: 120539 - protein, 482 aa, Glycine max
  Coding DNA Sequence Number=SeqID_3761
  Gene Ontology: Mol. function=DNA binding; Cellular component =intracellular; Biological process=DNA integration
  Homolog annotation: Hit_ID=Q1S7S0; Match level="QueryCoverage=81%, HitCoverage=30%, E-value=1e-116, Identity=52%"; Hit description =Integrase, catalytic region; Peptidase aspartic, catalytic
  Pfam annotation: Domain name=rve; Domain location=33-176; Score=67.5; E_value=4.2e-17; Accession=PF00665.16; Description=Integrase core domain
  Pfam module annotation: Pfam domain module=RVT_2::rve; Domain location=373-482::33-176
DANTKVKIGTAEVSRGLYQLIPEAIKSHTMCTTIIHPQCKVTPINLWHFRMGHPSLERLRAMQSYYPFLSSSKDFAETQFDSHVKTIRSDNGAEFLMHEFYSRKGIIHQTTCIETPEQNGIAERKHQHLLNVTRALLFQTQLPLTFWCFALVHATYLINCIPTPFLKDQSPYEKLYAKSYDISNLRIFGCLCYVSTLQNHRQKLDPHAHPCIFLGFKPHTKGYLVYDLHTHTIITSRNVIFYEDHFPSPTQSPDNTTTDTRVSSSPFSNTTATLDTPILLPIPRPTTPSSHSQNPTLRRSTRTRHAPNYLHDFHHALTSPADSISTKVRYPFHSVLSYSRLSTTHKHFTLSISTITEPNSYVEASKHDCWIKAMHAELQALQQNHTWVLTQLPPHKKAIGCRWVYKVKHNADGTIERYKARLVAKGYTQMEGLDFLDTFSPVAKLTTVRLLLALASLHNWHLRQLDVNNAFLHGDLHEEMSN

SEQ ID NO: 120540 - protein, 115 aa, Glycine max
  Coding DNA Sequence Number=SeqID_3762
MYFSPVVIRRKQPPRRGKVRRKRRRGDEQQNPIKMKYKRDRSGRVWGSRRRENRVKVCHAEEGVGLQWKDVGMRVWFTERADGSDGVHKGEERVCGALKGEGWVVELERKLKVEE

SEQ ID NO: 120541 - protein, 53 aa, Glycine max
  Coding DNA Sequence Number=SeqID_3763
MEQGWFLDSQRRNCGRLIGWYRTSETEREREGAALSVTKFHINKSPVLEKSIN

SEQ ID NO: 120542 - protein, 90 aa, Glycine max
  Coding DNA Sequence Number=SeqID_3764
  Gene Ontology: Mol. function=zinc ion binding
  Homolog annotation: Hit_ID=Q08ET6; Match level="QueryCoverage=83%, HitCoverage=15%, E-value=3e-32, Identity=86%"; Hit description=RING -finger protein
  Pfam annotation: Domain name=Copine; Domain location=44-90; Score= -63.0; E_value=0.092; Accession=PF07002.6; Description=Copine
MSSTNKKVSEALALAGLESSNLIVGVDFTKSNEWTGKNSFNRRSLHHIGRGLNPYEQAISIIGKSLAAFDEDNLIPCFGFGDGISLNNLT

SEQ ID NO: 120543 - protein, 93 aa, Glycine max
  Coding DNA Sequence Number=SeqID_3765
MEKNEETTMEERVKLKINGGLRSTYLKFLCFEPSYKINGGLKSTYLKFIRNHLMEAYFRSFYEGSVLDKKLKEEASIEQENEREKGGVGIEGD

SEQ ID NO: 120544 - protein, 139 aa, Glycine max
  Coding DNA Sequence Number=SeqID_3766
  Homolog annotation: Hit_ID=Q1T6D1; Match level="QueryCoverage=70%, HitCoverage=10%, E-value=2e-20, Identity=53%"; Hit description =Quinoprotein amine dehydrogenase, beta chain-like
MSAFLQFLMLVSNVAVQELQEQPGGDSKSLNVVRCTSLKQDGIIKDECSFSPLQNLLLYYPGFPSFWHLNLVSQELEEGCVSTDESNNRLFFSDCNHHRILVSGGNGEILDCVPFPNSNTPPSGLELVECTKLGTNILD

SEQ ID NO: 120545 - protein, 154 aa, Glycine max
  Coding DNA Sequence Number=SeqID_3767
MAKIPRLKDEMVKVKLKMQEYKYVGKGQVKDTLAKAKLKMLWLWHRQIYSSHGQVKVILDKLGDGSCTQDRFLPRSCTRDVARISTGVEGKLHGEANLKSMKQKEGGGKGLDAVGDRVEGRGRGRFVWEEVKGKKEFEWEIWGEIFKGMLVWEI

SEQ ID NO: 120546 - protein, 287 aa, Glycine max
  Coding DNA Sequence Number=SeqID_3768
  Gene Ontology: Mol. function=RNA-directed DNA polymerase activity; Cellular component=chromatin; Biological process=chromatin assembly or disassembly
MELGLEWLATLGEVKANFGDLTTKLKVQGETTVLKVQGETTVLKADPKMIKASASIKLIQGALQDQGLGFILECNQVEHSEEQITIPQYVQEVLEAYTSVFQTPQGLPHMRRQDHVIITKPAAQIPNLRPYKYPHYQKEEIEKLVRELLSSGFIQPSTNLYASPIILVKKKLERWRFCVDYRSLNKLAVPDKFPIPVIELLDFKDALIQRFQPASMVNSFESLLTLKQDQAVHEFMTQFEKYARSVKGLDEQYLMGIFINGLKEEISAELWLYEPKTLSEAMNKAGN

SEQ ID NO: 120547 - protein, 662 aa, Glycine max
  Coding DNA Sequence Number=SeqID_3769
  Gene Ontology: Mol. function=nucleic acid binding; Biological process= DNA integration
MASANYGSIPINTGEIPINSGTIPNKFGTIPVNSIPMNQDQIKPAITALGLNCFVANPQIPPRYLSDANHDLDHVNPLFLMWQKQDKFMLVWLQFTLSSSILARVLRSTHLYQVWDKIHAYFHHQTRTKARQLRSVLHHTTLDNRHVSEFLSRIKVLIDKLASIGDAATYRLILAQELRLRKYNKLDSSSNTFAPSVNLTQASSGGHNGRGEGSFNRHGGRGGGRSSVQCQVCFKYSHMALTCYNRFNPQYQASNSGNYGFNGNSGNCSNWSQNQNQNWNQNSNQNWNNSNWNSPKSKSCILSVANSDSAASSSSWQTQEHPFIIAIPQSPIHDTVTSHDPQQSFINDKAASTATGNANSGLLRNKAWTMVPLPPNRNAIGHKWVFGVKENSDGSVNKYKARLVAKEASSTIICILVHVDDIIVTGNSSLVQKLIQQLNATFSPKQLGSLDYFLGIGVHSLSSGAPLMTQYKYIRDLLTRTNMLEAKPISSPMTSSCKLSKDGSDLLQDASFYRSVVGALQYVTITHPELSSAVNKDLFCILPHLINLFSFEVSVNLTGLQTLMIGTLNLKVVSKSSTEAQYRSLSAVTADILWIQTILKELAVPHITPLVLCDNSILTRQLIVQHIPGIDQWADLLTMRLPPTRFAYPSSKLNVAELPLVS

SEQ ID NO: 120548 - protein, 263 aa, Glycine max
  Coding DNA Sequence Number=SeqID_3770
  Gene Ontology: Mol. function=zinc ion binding
  Homolog annotation: Hit_ID=Q08ET6; Match level="QueryCoverage=84%, HitCoverage=43%, E-value=2e-55, Identity=51%"; Hit description=RING -finger protein
VTKNVDTKHGRLSPQEQKTVDTIVAVSKFPLSIILVGVGDGLWDMMKEFDDNIPARAFDNFQFVNFTEIMSKSIPPSRKEAAFALAALMEIPSQYMAAIELNLLGSRQANAPQRHALPPPTYSSRAARFEPSIPPQHGNSHPFATAPSAPSSTYDNQRDIHGTSCLKNLLSNEASMLVDVSDKTECVNLECHLLHNFGVSSVRHKLCPICLSNAKDMAFGCGHQQQSGDSDYVSDDHDSSEGMVLAMMGDSIVQAKCKPGWLS

SEQ ID NO: 120549 - protein, 328 aa, Glycine max
  Coding DNA Sequence Number=SeqID_3771
  Homolog annotation: Hit_ID=Q1T6D1; Match level="QueryCoverage=90%, HitCoverage=42%, E-value=4e-90, Identity=56%"; Hit description =Quinoprotein amine dehydrogenase, beta chain-like
MGARTVETLYPTSAPNKGGIQIWNWIMSKLGLESSGKTSVQERSEVFDSKLYFPWHLLKSPDDTFYIMDRRFQTLWVMDINSGKIDEVFEGSPRILKICGQLIMKSLSIIDQIPSDWFQQQTKNGFLLGGLQHSDLLSSLATLHNHIFICDPVHVKMYDIGVMYRELQYSTALSVKANGLSGTPIDHLQHFDLLPGRIDINLRVDLPMDIELVVPLQESCIWYQARGAATETSGMDEVSLNKSGLAQQWYDELDDLAAPKPESEINVQDDNLDKKSVVEDEKVPFSVGVFTSPGTSELLKLTRVNHSYTLTPSCKLNGAMKPKEAQQH

SEQ ID NO: 120550 - protein, 149 aa, Glycine max
  Coding DNA Sequence Number=SeqID_3772
  Homolog annotation: Hit_ID=Q1T6D1; Match level="QueryCoverage=94%, HitCoverage=18%, E-value=2e-23, Identity=47%"; Hit description =Quinoprotein amine dehydrogenase, beta chain-like
  Subcellular localization annotation: CTP_CleavageSite=26; ConfidenceScore=5.19e-01
MALRHRRLTKQLSKFLTPVLNAGNCCQQSSKALNLVALSIMHMPSAQSPIANWTQVRGFREYRISTKSDELCEPATEIDLLSFIKASLDEFEGTHHYWLNRSDNNDQLFGADGIFLVLSARVFDCGIKLEKLKTIQKRHTEVKFFLLTL

SEQ ID NO: 120551 - protein, 180 aa, Glycine max
  Coding DNA Sequence Number=SeqID_3773
  Gene Ontology: Mol. function=histone-lysine N-methyltransferase activity; Cellular component=nucleus; Biological process=chromatin modification
  Homolog annotation: Hit_ID=Q1SJT8; Match level="QueryCoverage=57%, HitCoverage=14%, E-value=2e-46, Identity=82%"; Hit description=SRA -YDG; SET-related region; Pre-SET; Histone H3-K9 methyltransferase
  Pfam annotation: Domain name=SET; Domain location=3-103; Score=43.2; E_value=8.6e-10; Accession=PF00856.18; Description=SET domain
MEELVGDNEDDYIFDSTRIYQQLEVFPGDTEAPKIPSPLYISAKNEGNVARFMNHCCSPNVLWRPVIRENKNESDLHIAFYAIRHIPPMMELTYDYGAVLPLKVGGGLRMNILKDKLYKSDSRMELCRKMLAETNFSFLANLVNWHMKEQVVYFAIEAKNGVHFGNQKGGAGSSLEVQKQ

SEQ ID NO: 120552 - protein, 114 aa, Glycine max
  Coding DNA Sequence Number=SeqID_3774
  Gene Ontology: Mol. function=RNA polymerase II transcription factor activity; Cellular component=nucleus; Biological process=regulation of transcription factor activity
  Homolog annotation: Hit_ID=Q6S7A2; Match level="QueryCoverage=51%, HitCoverage=16%, E-value=4e-10, Identity=43%"; Hit description=TATA binding protein associated factor 6b isoform 1
  Pfam annotation: Domain name=DUF1546; Domain location=24-99; Score= -18.6; E_value=0.066; Accession=PF07571.4; Description=Protein of unknown function (DUF1546)
MALCFMAIEGVQLTIPENAPVEGIFPDLSAIKLNFLSSSAEFLPISFFPRVTKTFLHSFLDPTKALPQHYDSIKGIEALGSRQASRLLEMKRHEAWQVYGALLIILKNDIVILL

SEQ ID NO: 120553 - protein, 102 aa, Glycine max
  Coding DNA Sequence Number=SeqID_3775
  Gene Ontology: Mol. function=nucleic acid binding; Biological process= DNA integration
  Homolog annotation: Hit_ID=Q1SZY4; Match level="QueryCoverage=54%, HitCoverage=15%, E-value=2e-11, Identity=50%"; Hit description =Peptidase S8 and S53, subtilisin, kexin, sedolisin; Zinc finger, CCHC- type; Peptidase aspartic, catalytic
  Pfam annotation: Domain name=zf-CCHC; Domain location=67-84; Score =13.9; E_value=0.0051; Accession=PF00098.13; Description=Zinc knuckle
MRQKELVQGAFRMKAQNSRDGKDKKNNKWKNKKSEHSNKHQDETFPPCSHFKMTNHPQARCWWRPNVKCKKCGNIGHVERICKFKPEEAKVTTKEQEDEEFK

SEQ ID NO: 120554 - protein, 151 aa, Glycine max
  Coding DNA Sequence Number=SeqID_3776
  Gene Ontology: Mol. function=zinc ion binding
  Homolog annotation: Hit_ID=Q1SJT9; Match level="QueryCoverage=78%, HitCoverage=37%, E-value=3e-45, Identity=72%"; Hit description=Zinc finger, DHHC-type
MKLEMKFLYENFLLYMTTYENFRYRYDKKENPFTKGILANFKELSCAKIPSKLVNFREWVTIENNIQDESYTSDLEKGFITSKHKFDMEMGTMYGKDGMRVPSILKELDYNDIDDHLKKKAGEKEVEYDIFVPADQLKSKTEGANAHEEKQ

SEQ ID NO: 120555 - protein, 70 aa, Glycine max
  Coding DNA Sequence Number=SeqID_3777
  Gene Ontology: Mol. function=nucleic acid binding
MVIHLSQGKWTMAIDNLIGLKYISDALYVPSIDQNLLNVAQLVEKGYKVIFEDNWCLIKDTKGKDTFRVT

SEQ ID NO: 120556 - protein, 90 aa, Glycine max
  Coding DNA Sequence Number=SeqID_3778
MAEIGFLKPFGRVIHMFWKEKLELIEIVAKQEAARSIEELTARGGQMETNHNYDQKALVPSSVEKCDDRFAAQIIHEYQARLHCGRSQLI

SEQ ID NO: 120557 - protein, 272 aa, Glycine max
  Coding DNA Sequence Number=SeqID_3779
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q9XGM1; Match level="QueryCoverage=87%, HitCoverage=100%, E-value=3e-92, Identity=77%"; Hit description =Vacuolar ATP synthase subunit D
  Pfam annotation: Domain name=ATP-synt_D; Domain location=59-227; Score=136.7; E_value=6.3e-38; Accession=PF01813.8; Description=ATP synthase subunit D
  Pfam annotation: Domain name=DUF1657; Domain location=147-197; Score =12.2; E_value=0.025; Accession=PF07870.2; Description=Protein of unknown function (DUF1657)
  Pfam module annotation: Pfam domain module=ATP-synt_D::DUF1657; Domain location=59-227::147-197
TLSLDHSLSVLSICTATSLSDRSRVPEKGKGKKDVGANAASERGPHRDDAGSGQGASSRRHARSRAPEEEERRAHGAVPPDPEEDRAKYVAGDNIKHVVLENVKEASLRVRSRQENVAGVKLPKFDYTADADATKNDLTGLARGGQQVQQCRAAYIKAIEVLVELASLQTSFLTLDEAIKTTNRRVNALENVVKPRLENTISYIKGELDELEREDFFRLKKIQGYKKREIERQMLLQNNSNVETNLPLRKGVSYNSAHNLLSVGDKDEDIIF

SEQ ID NO: 120558 - protein, 247 aa, Glycine max
  Coding DNA Sequence Number=SeqID_3780
  Gene Ontology: Mol. function=zinc ion binding; Cellular component =integral to membrane; Biological process=protein amino acid palmitoylation
  Homolog annotation: Hit_ID=Q1SJU0; Match level="QueryCoverage=84%, HitCoverage=42%, E-value=3e-80, Identity=68%"; Hit description=Zinc finger, DHHC-type
  Pfam annotation: Domain name=zf-DHHC; Domain location=162-229; Score =66.9; E_value=6.4e-17; Accession=PF01529.11; Description=DHHC zinc finger domain
MGGSPSGNSVHKQRRLYQVWRGGNNFTCTDDCLLERVNGKLAFLKFFCGGRLVFGPDVASLFLTTFLIAGPAIAFCVKIYLKIKKTDGLIHDYWFPVLIVGSILTVLDLIFLLLTSGRDPGIVPRNSRPPEFDETCDIPTPSMEWINGTTPHLKLPRTKDVVVNGHIVKVKFCDTCLLYRPPRTSHCSICNNCVQRFDHHCPWVGQCIGIAEILPYKHTIAPIHKLSVAAGKKSTTPFCPGSTLAAI

SEQ ID NO: 120559 - protein, 156 aa, Glycine max
  Coding DNA Sequence Number=SeqID_3781
MGLCQSFGVPVTPSKVIRPPITRAFIEKYYTPRQAQGDAHQVADAPPPPHQVDPTGSLGMECYLQHLVRQQAANHRGQVQIHECLYRFSLSQQRQGFASFACPTPKQFGAEVAWPRDWPEAQAGEEPAGSPGEAEEARMDEEMTDLLGFLGGSGAM

SEQ ID NO: 120560 - protein, 113 aa, Glycine max
  Coding DNA Sequence Number=SeqID_3782
MVKLKRVTFDCDDNSDRHITPTIFECRQCVEAQVAIKQLELGEPEDMSPMSSYADHEFGELKLVSHMRKLQSSRVFGREKNETELGRRRTKGKVEPRHYRVVTVDHFLRHFSC

SEQ ID NO: 120561 - protein, 99 aa, Glycine max
  Coding DNA Sequence Number=SeqID_3783
MGLEIYPEVHETLGPSSAALTQSSWSLLLMALVTGPFLGRIALGGLTPTINSYQTGRVTSCFGIAIGSREEMEEYQELLRQLEQASKEERDDPSKAHLS

SEQ ID NO: 120562 - protein, 349 aa, Glycine max
  Coding DNA Sequence Number=SeqID_3784
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=93%, HitCoverage=32%, E-value=2e-62, Identity=43%"; Hit description=CTR1 -like kinase kinase kinase
MRPLNEFKSPYNVEKITGQEAPGRPNHPHVHARSPSWTEGISSPAVRRMKVKDVSLYMIDAAKENPHLAQKLHDVLLESGVVAPPNLFSEIYDEELSSSTEANLLTEEKDEHEQGSGRQEAEIDGNVSPAQFFPPRALPKASSSSQLEHLKPVEGLGINLPLHTGEAAGQQIPTQVKYGQNVPVAAAAAAAAAVVASSMVVAVAKSSIDSNIELPVAEAATATAAAVVTAAVSRQYEQGSRSDGDTDSAGYDLKGSGDGEHIALGANSEGDRRSDRSVVSNDSTKSDSALDDHEVAEVDIPWEEITLGSYGEVYRGEWHGTEIAVKRFLDQDISGESLEEFKTELPPLM

SEQ ID NO: 120563 - protein, 256 aa, Glycine max
  Coding DNA Sequence Number=SeqID_3785
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=96%, HitCoverage=22%, E-value=1e-75, Identity=61%"; Hit description=CTR1 -like kinase kinase kinase
MSSHLNYNALGYDDKTLDGFYDLYGSLTESTPARMPSLVDLQLQGTPIAGSGTWEAVLVNRAADSNLLKLVQKVQELTGKSSPDFVVIDSNLVRKLAIFVADYMGGPVGDPESMTRAWRSLSYSLKATLGSMILPLGSLTIGLARHRALLFKRVLKVLLEKDILCIFLSERNFGRFAMVLADSLGIPCRLVKGLQYTGSNDVAINFVKIDDGREYIVDLMADPGTLIPSDATGSQIDYDESLYVASPSSRDLDSSH

SEQ ID NO: 120564 - protein, 85 aa, Glycine max
  Coding DNA Sequence Number=SeqID_3786
MEQFPLHPRRQQKDTVYTTPHIIIVVIYFRKQKEVKTRITEQPQIEKEGSFLSGAQRQREKQQVEGVVGAHLSRGAEGFQGPRKR

SEQ ID NO: 120565 - protein, 156 aa, Glycine max
  Coding DNA Sequence Number=SeqID_3787
  Gene Ontology: Mol. function=protein serine/threonine kinase activity; Cellular component=membrane; Biological process=protein amino acid phosphorylation
  Homolog annotation: Hit_ID=Q7X8K7; Match level="QueryCoverage=70%, HitCoverage=10%, E-value=7e-26, Identity=60%"; Hit description=CTR1 -like kinase kinase kinase
  Subcellular localization annotation: CTP_CleavageSite=46; ConfidenceScore=5.73e-01
MKNLLKKLHIMSNQSENEQGSSSSSSKGGNKSNLGSSSSSKKKVVRSTSPQSSEQKPFSGLSSWLNSLRGERMEPSDAVSSGGGLDAVFSDSARLDSGSSGSRDPEVEEEYQIQLALELSAKEDPEAVQIEAVKQISLGSCDPGYTPAEVVAYRYW

SEQ ID NO: 120566 - protein, 183 aa, Glycine max
  Coding DNA Sequence Number=SeqID_3788
  Homolog annotation: Hit_ID=Q93YH8; Match level="QueryCoverage=30%, HitCoverage=13%, E-value=7e-20, Identity=85%"; Hit description=HMG I/Y like protein
MFLFAFSIASILVGQGSTSASTSQNAANEDLRRKLEHFQSKVKESLAVLKPHFNHESPVTAIAAIQELEVLGTMDLNVPLRDETLPHQVELPPPQPPVQQQQQPPQQQLQQPPQQPPQQHLAPQQLPPQPPIFQQTYPPFHLPQFHHHQPSLQFQQQQQQPPQPPPQLFQHQAQPPSHQQFHP

SEQ ID NO: 120567 - protein, 132 aa, Glycine max
  Coding DNA Sequence Number=SeqID_3789
MKMLTNDGADARCTQHFYWCTQHLLGKDLNIPAIFLKKFVHPTVSFSVRAVSFSLLLPFATTTSSSVRSLAVSVLVEPVLLLCVVVQHCWWRVGGALHLDCARSSSVHAAPSTSSVVCRDVVDLHRDLGHLQ

SEQ ID NO: 120568 - protein, 97 aa, Glycine max
  Coding DNA Sequence Number=SeqID_3790
  Gene Ontology: Mol. function=transporter activity; Cellular component= integral to membrane; Biological process=transport
  Homolog annotation: Hit_ID=Q1SJU4; Match level="QueryCoverage=83%, HitCoverage=34%, E-value=3e-28, Identity=70%"; Hit description=Major intrinsic protein
MVEMCNKQEATTGNSDVMSAVEEVVKIPGDSIGQNGEGVVGAATCNLDEEGEEEHVGDGEGSFDNLTEGAMSEAKVVEDDDPKENTGPYPHERQNEV

SEQ ID NO: 120569 - protein, 488 aa, Glycine max
  Coding DNA Sequence Number=SeqID_3791
  Gene Ontology: Mol. function=kinase activity
  Homolog annotation: Hit_ID=Q2HUI1; Match level="QueryCoverage=98%, HitCoverage=95%, E-value=3e-88, Identity=45%"; Hit description =Phytochrome kinase substrate 1-like protein, putative
MMKTVRDRDASFSSYLRPGNKATTITAAPLEDATTELSIFDARKYFNDDDDNDNNNNIQKVSISRVSPMERIPERGDVTITEATRYSSASSSVDSYAHIRNYRGRSFHVVTPTASSEASWNSQTGLLSHPPGAIPVSMQNPQNPKNLQNPKLSKSIWLLRRKCPCTGKKSVRVKESTQESKTQISQQERDTEHHNNNNVRNHITPNNWILNQTPALAPAPATATIIAAKSQRFHNSNSHRVVSSVRVPFTDGFTFPVLNPNNPITKLKLANVNGIVEEDPPRESLEVFHPPDEPSPNPSPKQLNYPLPAKARVVVEDDAASDASSDLFEIESFSTATQSTYPAAYRRNSRDSFDEAAAAAAASSTATATGFFYGRRSMEEGSTTQTITEWYEPSEASIEWSVTTAEGHDEAISNGVAVEEKWKRKGGNGLLVSCRCEKAVSVGPQPVKCGSEGQRNATSASDVNVIGSINKPPRGHRNAPRVSLALAT

SEQ ID NO: 120570 - protein, 410 aa, Glycine max
  Coding DNA Sequence Number=SeqID_3792
MEQKLATVDALSDMVKERQHRTCHQDHFQDLMNLPQQGSLAEFIDVISCKLRLSEDYLVDASLVGLQEEYADPVLLFKPRTMGEARCLARLLQIKLQQHDEKKIAIKNMRYLAPERALNNDPFTPKNLSRMLKALTAEELIELDEEEVTVVEEAECDNENNPNISLHAIEGVEGTTSMRIKGHVGWRTLQILIDNGSTHDFLDYDLAKRLCWKENGLNYLQSTLKDCSMGFEVETDACGDGIERIDGCGLSSGALASISREVELAGYDYEIQYKKGNDNYVADALPRLPRQQIMHMVLDTSSSEFLQKIEKIWEQDADLHALMSHLTWKGGNLGHYTWDGQLLRKKGNMLILGGREKVETFTKVGQLEKASDAEQSIQVDGSNRGTGLSSPIPLPARPQRISTGRELFYQ

SEQ ID NO: 120571 - protein, 137 aa, Glycine max
  Coding DNA Sequence Number=SeqID_3793
  Gene Ontology: Mol. function=delta3,5-delta2,4-dienoyl-CoA isomerase activity; Cellular component=peroxisome; Biological process=fatty acid catabolic process
  Homolog annotation: Hit_ID=Q9FHR8; Match level="QueryCoverage=67%, HitCoverage=37%, E-value=2e-23, Identity=60%"; Hit description=Enoyl CoA hydratase-like protein
MFVVAVREGGEMEEKYSNLEISEESPNSGSSACTGSQPGGEGDRLVERRGPLLLRHRHLPPGINRREFGFLRREILAMQDAVTALERCRKPVTASIQGACIGGGIDIVTACDIRMCTEAFFSMGKSHAHTIREILIK

SEQ ID NO: 120572 - protein, 454 aa, Glycine max
  Coding DNA Sequence Number=SeqID_3794
  Gene Ontology: Mol. function=DNA-3-methyladenine glycosylase I activity; Cellular component=cytoplasm; Biological process=base -excision repair
  Homolog annotation: Hit_ID=Q1SSR7; Match level="QueryCoverage=99%, HitCoverage=99%, E-value=9e-38, Identity=45%"; Hit description =Protein prenyltransferase, alpha subunit
  Pfam annotation: Domain name=Adenine_glyco; Domain location=172-411; Score=256.4; E_value=5.8e-74; Accession=PF03352.4; Description =Methyladenine glycosylase
MSGPPRVRSMNMAVTDADARPVLVPAGNKVLPAIDRRKPVMKSSPETEKKPVAHSPQCVSVTPPAISRRQEHHQAVLKSLSSMNASCSSDASSTDSSTHSSGASSSGKVARRVSVALRKKQVGPKTEKVSSDNVAGSDDADLSDSLEGKKRCAWVTPNTATLPDESLVKEAWTLKKPCYIVFHDKEWGVPVHNDRKLFELLSFSGALAELTWPTILSKRQLFREVFLDFDPSAVSRMNEKKIAAPGSPANSLLSELRLRSIIENGRQMCKKGLAEVNQPIHLPFQTFLLPTFENIKKNEINLLPDPHTDEYYKKKTWEKERQILNSTCLRGGIEEFGSFDTFIWNFVNHKTIVSQFRYPRQVPVKSPKAEFISKDLVRRGFRSVGPTVIYTFMQVAGLTNDHIISCFRFKECTSNAEAMGKESSLNSKVKEKANEEPTEVDLLLAANKLSFISK

SEQ ID NO: 120573 - protein, 135 aa, Glycine max
  Coding DNA Sequence Number=SeqID_3795
MKSCYGKAKERRSSLYMTLINEHAIIENYQGIEGYEVRASPGAAKQPLCICKGKAAYNIPPPYLRIAKSLRAMGYEMYKGFSDERLQKGEDHNLGVVTRSKLRELQGDINRKMILFVEKDDGSELKIIILSQLLD

SEQ ID NO: 120574 - protein, 141 aa, Glycine max
  Coding DNA Sequence Number=SeqID_3796
  Gene Ontology: Mol. function=kinase activity
  Homolog annotation: Hit_ID=P42856; Match level="QueryCoverage=57%, HitCoverage=59%, E-value=4e-23, Identity=70%"; Hit description=14 kDa zinc-binding protein
  Pfam annotation: Domain name=HIT; Domain location=25-91; Score=39.3; E_value=1.3e-08; Accession=PF01230.13; Description=HIT domain
MASETEAALAATPSDGPTVFDKIINKEIPSTVVYEDDKVLAFRDIDPQAPTHILIIPKVRDGLTGLSKAYYVVSDVHLKIIYIHVLRKFTIVIDFLQYQHTGSRKGLIFLMKKIVQLVHSSNNTALKLLFEDSMAWEKLLN

SEQ ID NO: 120575 - protein, 189 aa, Glycine max
  Coding DNA Sequence Number=SeqID_3797
MGINTDALCLQNRYYDMVLSTKLAGLGHAAFLFMTTARDRVSYIYPNVNAAGAGLLLSETFVPDSQNLSDGGYNMYHQMVDWLGKPFREVPRQPVPPLRVSISKKLKEVVEAKYEKAGAKKGKYVVIHGIKSDSKASMQSRGDPDSLLPIEVWAEIADVIRYAMLLNESRIELKSILNVTKSLPRGTIF

SEQ ID NO: 120576 - protein, 306 aa, Glycine max
  Coding DNA Sequence Number=SeqID_3798
  Gene Ontology: Mol. function=protein dimerization activity; Cellular component=nucleus; Biological process=regulation of transcription, DNA-dependent
  Homolog annotation: Hit_ID=Q2HUH2; Match level="QueryCoverage=91%, HitCoverage=87%, E-value=7e-91, Identity=66%"; Hit description=CAMP response element binding (CREB) protein
  Pfam annotation: Domain name=bZIP_1; Domain location=246-300; Score =43.4; E_value=7.5e-10; Accession=PF00170.11; Description=bZIP transcription factor
  Pfam annotation: Domain name=bZIP_2; Domain location=246-300; Score =52.1; E_value=1.9e-12; Accession=PF07716.5; Description=Basic region leucine zipper
  Pfam module annotation: Pfam domain module=bZIP_1::bZIP_2; Domain location=246-300::246-300
MGSQGGTTQDQEPKTGSLTRQGSLYNLTLDEVQNQLGNLGKPLGSMNLDELLKSVWTAESGTDAYMQHGGQVASAGSSLNPQGSLTLSGNLSKKTIDEVWRDMQQNKSVGKERQPTLGEMTLEDFLVKAGVATEPFPNEDGAMAMSGVDSQHNTSQHAHWMQYQLTSVQQQPQQQQHQHQNQQNSVMLGFSGFMTGHAVQQPIPIVVNTVLDAGYSEALPSSLMGALSDSQTAGRKRDASGNVVEKIVERRQKRMIKNRESAARSRARKQAYTQELEIKVSQLEEENERLRRQNIASCHLGRAMNG

SEQ ID NO: 120577 - protein, 221 aa, Glycine max
  Coding DNA Sequence Number=SeqID_3799
  Gene Ontology: Mol. function=peptidase activity; Biological process =regulation of transcription
  Homolog annotation: Hit_ID=Q2HUG9; Match level="QueryCoverage=97%, HitCoverage=73%, E-value=1e-67, Identity=66%"; Hit description =Peptidase M22, glycoprotease; Homeodomain-related
MAGATPKGVLRVMGVPGLTIYHVKSHLQKYRLAKYLPESPADGKDPKDEKRMSGDSISGADSSSGMPINDALRMQMEVQKRLHEQLEVRISDNDKSLASFSMTFQVQKQLQMRIEAQGKYLQKIIEEQQKLGSTLTTSETLPLSHDKQNHPQSEASGSSDALASTVSPLKKQRIDDGSKEGFTASQVRKNDNVGQLDPNLYDDAGFGFDLETKKDEDNESG

SEQ ID NO: 120578 - protein, 32 aa, Glycine max
  Coding DNA Sequence Number=SeqID_3800
VRLYGEVEREYACTGCTQMKGLLRWRRGATLH

SEQ ID NO: 120579 - protein, 85 aa, Glycine max
  Coding DNA Sequence Number=SeqID_3801
MAIRIPEMEKHYILIRKSYHIIDYQIHPNTSFALLKDEFSGAHGAVMPALGLRVQRKETETPLALKVHSLDHPSTVRTRSWCWLP

SEQ ID NO: 120580 - protein, 248 aa, Glycine max
  Coding DNA Sequence Number=SeqID_3802
  Gene Ontology: Mol. function=protein translocase activity; Cellular component=chloroplast outer membrane; Biological process =intracellular protein transport
  Homolog annotation: Hit_ID=Q41009; Match level="QueryCoverage=73%, HitCoverage=64%, E-value=1e-88, Identity=86%"; Hit description =Translocase of chloroplast 34
  Pfam annotation: Domain name=AIG1; Domain location=37-214; Score =124.2; E_value=3.6e-34; Accession=PF04548.7; Description=AIG1 family
  Pfam annotation: Domain name=MMR_HSR1; Domain location=37-132; Score =26.5; E_value=3.8e-06; Accession=PF01926.13; Description=GTPase of unknown function
  Pfam module annotation: Pfam domain module=AIG1::MMR_HSR1; Domain location=37-214::37-132
MASQIREWSGINTFAPATQTKLLELLGNLKQENVNSLTILVMGKGGVGKSSTVNSIIGERVVSISPFQSEGPRPVMVSRSRAGFTLNIIDTPGLIEGGFLLNKTIDVLLYVDRLDVYRVDNLDKLVAKAITDSFGKGIWNKAIVTLTHAQFSPPDGLPYDEFFSQRSESLLKVLRSGARIKKEAFQGPAAMQHYIVKVLLLITLTGNSVKQPEAANLDSIGEFCVAGVSAANSIHSQNLWSLLPLLLT

SEQ ID NO: 120581 - protein, 71 aa, Glycine max
  Coding DNA Sequence Number=SeqID_3803
MEIIIFSGKVRDWGLVVLEMIGFERERDVMNPNVELNRRRRFKGTLSLTEVLGTHALVTCHCSSLGVVVSL

SEQ ID NO: 120582 - protein, 136 aa, Glycine max
  Coding DNA Sequence Number=SeqID_3804
  Gene Ontology: Mol. function=histone-lysine N-methyltransferase activity; Cellular component=nucleus; Biological process=chromatin modification
  Homolog annotation: Hit_ID=Q9SRV3; Match level="QueryCoverage=70%, HitCoverage=35%, E-value=1e-39, Identity=79%"; Hit description=LOB domain-containing protein 20
  Pfam annotation: Domain name=DUF260; Domain location=45-132; Score =184.0; E_value=3.7e-52; Accession=PF03195.5; Description=Protein of unknown function DUF260
MAEPQGGIGGDSGASGSKRRSTVSKRGMVAQTQDEAIVGSSPATPCGACKFLRRKCIGGCIFAPYFCTDQGAAKFAAVHKVFGASNVSKLLSNIPANRRHEAATSISYEAQARLSDPVYGCVSTILALQQQLFIYP

SEQ ID NO: 120583 - protein, 418 aa, Glycine max
  Coding DNA Sequence Number=SeqID_3805
  Subcellular localization annotation: CTP_CleavageSite=33; ConfidenceScore=5.57e-01
MATKAKETSVAGKEKKAQSSNSPMTSTKKIPTKASTTSSTNKATSSPSEKQVPNYLKPTISSLLDSHSSFKLPRNDAPTKPTLNRRRSLDPSSSSRLQKHAHTPSLSRQNKALVSPGPRERTLQLRSSSVPIKTTNNPSKPIPERLSKTPKEGRIQPLSAKKSNNNASTSTSKKVISNDASANSTNFSKSSGTTAEAEEAINEEKFGEVKNVENHEEEPSQVVGSEHEHDREQHGRKLDESDQPHVQDDDEKDIPTVPEEKKDENTNQDECNINEIHPEIDHSTTEEVEAKEEEQEQEREESGVVVQEDHKSEPNNEEEVVEERERVEEVTSEEVKELREGQNEDEQVESEFKEEKVESPKPKQVEEGGGVQEKKEAQSPVSNDVIEEDARKQLEARRNKVRALAGAFQNVIDHQKTK

SEQ ID NO: 120584 - protein, 85 aa, Glycine max
  Coding DNA Sequence Number=SeqID_3806
MMAHQNPPYLAFCTPGQNETKNKIQGYQRETNKNIHIFLNEHQGMHMRIKRYFKVVMGPRTSYGKIWNKWLNPKGIEEQWGISAY

SEQ ID NO: 120585 - protein, 95 aa, Glycine max
  Coding DNA Sequence Number=SeqID_3807
MTCDHSLVLVRCLAPIIRQFVKFQDMPKNQKDIDAQSQRGVYLVKMGVQIAPRPTWALRNIPPEGGCFWRKQPCSPGRAELAWASWAATTSPILL

SEQ ID NO: 120586 - protein, 82 aa, Glycine max
  Coding DNA Sequence Number=SeqID_3808
  Homolog annotation: Hit_ID=Q9LRX3; Match level="QueryCoverage=83%, HitCoverage=3%, E-value=2e-17, Identity=65%"; Hit description =Arabidopsis thaliana genomic DNA, chromosome 3, TAC clone:K7P8
MSNMSSPSKFIRIISGGRDRGRKAKALKVSVGQPGSGSPWSLFEEQALVVLVHDMGPNWELVSDAINSTREGFRSYDLTRMT

SEQ ID NO: 120587 - protein, 136 aa, Glycine max
  Coding DNA Sequence Number=SeqID_3809
  Homolog annotation: Hit_ID=Q9LRX3; Match level="QueryCoverage=30%, HitCoverage=2%, E-value=7e-09, Identity=71%"; Hit description =Arabidopsis thaliana genomic DNA, chromosome 3, TAC clone:K7P8
MVCVGTKRGCFEALGLKGKGSARQLFQRLQGPMEEDTLKSHFDKIIKIGPNSTPTKSACKVRIVQAPPLGLQLRQPPKKLQLRQGKHNCDGVVLHKPQKKAIVAALLLSAVMRVADLAKGRSFSVHNRGGSFKLGL

SEQ ID NO: 120588 - protein, 106 aa, Glycine max
  Coding DNA Sequence Number=SeqID_3810
MSHHSSSVNGEGTSHKDPLYRILDELSSLKLWKEKLERKEKGKERDNVTTYLDWKIRVKQQLKRKSTLKSYGSHSYPKKDQGLGILGAPPSKPKDDKGKTIEKQPP

SEQ ID NO: 120589 - protein, 45 aa, Glycine max
  Coding DNA Sequence Number=SeqID_3811
MGKPPCSSTLEGGATTFTMKLNEQEGDKGKGQLSNPVVPVIHSFV

SEQ ID NO: 120590 - protein, 114 aa, Glycine max
  Coding DNA Sequence Number=SeqID_3812
  Subcellular localization annotation: CTP_CleavageSite=93; ConfidenceScore=5.03e-01
MDKRVYVVSLQAELAMLQTQLMNSKFFYTSALQTTQLHQPNMNAAALHPAYSNNSCGSTNLLNLSNFNNTPSFDLAMDTTPSSHSLEPLQLTRLSQYEEEEEEESKTQQTFDHH

SEQ ID NO: 120591 - protein, 37 aa, Glycine max
  Coding DNA Sequence Number=SeqID_3813
GMCVGWAFKRKDWRSNHLDSLQPSNYLKGMDTCPVVE

SEQ ID NO: 120592 - protein, 419 aa, Glycine max
  Coding DNA Sequence Number=SeqID_3814
  Gene Ontology: Cellular component=nucleus
  Homolog annotation: Hit_ID=Q2QN39; Match level="QueryCoverage=98%, HitCoverage=98%, E-value=3e-31, Identity=29%"; Hit description =Expressed protein
MQPQQSSRIDLGELRAQIVKKLGADKSKRYFYYLNRFLSQKLSKSEFDKLCFRVLGRENLPLHNHFIKSILKNACQAKTPPPIHPPGPLKSGEHASDISPGREDGHEHSVASFQNQNQKAPIWSNGFLPASPKVRSGVRERKLRDRPSPLGPNGKVDSVSHQSMGSEDSGSKVDMENGIRTPCDYQRPIQHLQAVAELPENERGDAVRRPTEKPRIRGKGPAEMSIVEDGEEVDQLSRLGFSRSPLIAPLGIPYCSASVGGARKTLPVSSAGDFDNCCDSGRLSDTNTLQRRMEQIAAVQGLGAVSMECANMLNSMLDVYLKRLIRSCVELVGARSTNELRMPPAPKQQMQGKVINGMWPNNHLHVQCADGSAEGVPEHRPPCSVFLHDFKVAMELNPRQLGEDWPLLMEKISMQSFEE

SEQ ID NO: 120593 - protein, 128 aa, Glycine max
  Coding DNA Sequence Number=SeqID_3815
MDESSTGKLGYDYECSEETKKKKLFNHDLAISGFLLFVTTRNRSNLHNTELQVVMPVTIIIHSKYQKVQLRLDEDTANELRVCIQGYSSWNRGILGCWVILGDGSTMYDDLVGSDCWGVVVGFNMGRF

SEQ ID NO: 120594 - protein, 223 aa, Glycine max
  Coding DNA Sequence Number=SeqID_3816
  Homolog annotation: Hit_ID=Q2HUG7; Match level="QueryCoverage=73%, HitCoverage=54%, E-value=8e-42, Identity=58%"; Hit description=Cupin, RmlC-type
DESGKREEQQHSDAGGGGGGGGEENRVHKRANGVVAAASDPWLLSGDVVPAEAPLHPLGPRRLPLPRVALTPPPARGLRAPSLLPNGHQGQPRQVAKDNRGWIFDPIALARASGISGGAVSCASLHVGEIRPGKIRANHRHHDSNETFLIWGAATKFRNNDEDDGYAEVILGRDEIAVAASPVHKAHALVNIDSIRSIFFIGCQDNVVSYNASSTDFNVWKDL

SEQ ID NO: 120595 - protein, 299 aa, Glycine max
  Coding DNA Sequence Number=SeqID_3817
MENKNNVNSSAIENIGASLGERVHNSTNLVDASANLARGLGSQVSPDLDSKLDEFQPESVLSNPVNINFEQNQGSVAVQQTRVLFHCLSVEVLQFYLAYENPCHIGTQDGGEITTSGLRDGSSDDMHRDGGLVKVNGISDTNGPGHQLDSVEETREAINSRLQDSNHLVIKEKVRAEDALANGFPSSEPSFNPGQVIEQSTKTLDNKPNTTDSSQERTAQGLEQEECQTLRESAEVPDVIGDDSVAGGVVSGSQNSSSVYEVQPGVESGLSTTPTSIAKQKGRRIATRYNRRGRGKGVK

SEQ ID NO: 120596 - protein, 495 aa, Glycine max
  Coding DNA Sequence Number=SeqID_3818
  Gene Ontology: Mol. function=alpha-N-arabinofuranosidase activity; Cellular component=nucleus; Biological process=L-arabinose metabolic process
  Homolog annotation: Hit_ID=Q1SJT6; Match level="QueryCoverage=97%, HitCoverage=70%, E-value=0.0, Identity=63%"; Hit description =Galactose-binding like; Alpha-L-arabinofuranosidase, C-terminal
MSLPIKICLLYLTCLTVSCFAEQTSTLIVDAKGSVRKIPDTFFGAFFEEINHAGAGGLWAELVRNRDMQMLNEILTSLSLLKISRSGFEAGGPNVPSNIFPWSIIGDDSTILVSTDRTSCFERNKVALRMNILCNESNPCPAGGVGISNPGFWGMNIEKGQKYKVVFYVKARGRLDLDVSFVGSVSGAKLASQNFRAPGQNISMWTRMETILEANDTNRNASLQITTSNRGVVWLDQVSAMPLDTFKGHGYRKDLFQMVADLKPNFFRFPGNYLRNAFRWKDTVGPWEERPGHFNDVWNYWTDDGFGFFEGLQFAEDVGALPTWVFNNGLSLNDEVNTSAIAPFIQEALDGIEFARGSPKSQWGSLRASMGHPEPFDLRIVAIGNEECGMPKYQANYLKFHAAIKQAYPDIQIITNCDGSKKPLDHPADLYDFHIYTNATDMFSKSTKFDDAPRSGPKAFVSEYAVWKDDAGNGTLLAAVAEAAFLIGLERNRLD

SEQ ID NO: 120597 - protein, 325 aa, Glycine max
  Coding DNA Sequence Number=SeqID_3819
  Subcellular localization annotation: CTP_CleavageSite=3; ConfidenceScore=5.09e-01
MKRQSSAVSPSSSRRETPPEKIHAKTIGCMSGILHFISSSNSRRSRRFLTFGKRQINKNPASTPADAGNLPPENAAADDWRLSSDVPRSPTLPAEIRRSSAKAPPPERRREAPALVARLMGLEAAPAEPTDTVAEKRQKLLGALQRCDEDLKALKKIIETVRLTDPPPPSTPSPSPALACIGFEDKFRTVPEVKCSVVNGEQQQPSPVSVLDEFTPRIQHQKQQLLKKPGEEDISSTYIYERMAYESVNRKVNDEDHLVMWSSKAMIKSVDEVCRDVAWGEKRELGRIGLALQDYICRDLIEEIVRELGCFYTLPFEACKRRLCF

SEQ ID NO: 120598 - protein, 1290 aa, Glycine max
  Coding DNA Sequence Number=SeqID_3820
  Gene Ontology: Mol. function=RNA-directed DNA polymerase activity; Cellular component=chromatin; Biological process=chromatin assembly or disassembly
  Pfam annotation: Domain name=Chromo; Domain location=1195-1246; Score= 24.6; E_value=0.00036; Accession=PF00385.14; Description='chromo' (CHRromatin Organisation MOdifier
  Pfam annotation: Domain name=RVP_2; Domain location=281-404; Score= -45.8; E_value=0.0037; Accession=PF08284.2; Description=Retroviral aspartyl protease
  Pfam annotation: Domain name=rve; Domain location=890-1046; Score =82.9; E_value=1e-21; Accession=PF00665.16; Description=Integrase core domain
  Pfam annotation: Domain name=zf-H2C2; Domain location=831-872; Score =11.1; E_value=0.012; Accession=PF09337.1; Description=His(2)-Cys(2) zinc finger
  Pfam module annotation: Pfam domain module=Chromo::RVP_2::RVT _1::rve::zf-H2C2; Domain location=1195-1246::281-404::425-580::890 -1046::831-872
MADGTRSKASSECLGDAIAKLTASQLAMNSKIDDLLQRMSQLEANQPQLQSPPSSSARHTPQTQTSFHRMKLDVSRFDGSDPTSWTFKITQFFEFHSTPDHERLTIASFYMEGPALAWIVGLPAPFVLSCFISGLNQPIRREVQVLQPISLAQAVSYARLQEEKLLDAHRPSPYRPLVSTGPSSTRSSSSNSTQPLLPTPVRTSSSIPFKRFTPEELASRREKGLCFHCAEKFSRGHKCASSLFLLVMDDEDTTIEGESSRYYTPTQELLPEFPLAQLSLHALSGHLAPETLRLKGYINDRPINILIDGGSTHNFLHNRVVLSLRLKTTETAPLRVTMGNGEELHCNQLFTAIQINIQQHSFTIDFHVLPLCGVDVVLGVQWLKTLGPVLTNYGALTMKFITGKKEIEEQVAIMLERGFIQPNSSPFSSPVLLVRKKDGSWRFCIDYRALNAKTVRDRFPIPTVDELLDELGGARWFSKLDLMQGYHQILMNTANICKTAFRTHQVVMPFGLCNTPSSFQATMNQLFQPYLRKYIIVFFDDILIYSRTMHDHLLHLEIAFQVLVEGKFSLKLSKCTGVTPVAEKVQAVSRWPTPRTPRALRGFLGLTGFYRRFIKGYAALASPLTKILCHSQFAWSHEAEIAFQNLKKALTEAPVLALPDFTTPFVVETDASGSGMGAVLTQKGHPLAYYSKQLCPKLINASTYVRELAAITTAMIQTPKQHRYLARLLGFDYSIQYRAGKTNVVADALSRSQEDHAASLFFLSMPRFVFLDDLRKELASLETFQDLRRRIQENPASYPDYALTEGLIMYKKRIWLPSNSSSIKQLLEEFHQSPTGGHMGIQKTLQRLHDNFTWASIKEDTRKFVTACATCQHTKYDNRKPAGLLCPLSVPTLPWEDLSMDFITGLPSYRGNTCIFVMVDRFSKGLHLGILLTQHTTHTVALLFIEMVGRLHGMPKSIISNRDSLFISKFWREIFTLSGTKLRLSSSYHPPSDGQTEVANRIIEQYLRAFVHEKPATWGRYLPSAKWSYNTSSHSTTGMTPFEITFGRKPPTYPHYITGTSPVEAVDAILSQREEVFAMLRRKLLKAQSRMKTNADRHRRDQEFQVGDWVLVKLRPQRQVSVTGTTCSKLSKRYYGPFQIVERMGTVAYRLQLPEHSRIHPVFHVSLLKSYTANPTTTTTVMDLPPLASNNHPVITPLAIVASKVIPSETGPRHMVLVQWQGLPPEETSWEDWASLKRTHHLEDKVLLDGQGSVTGEVREGVSLAREPCRMEEHVKLLEGIASTIKAWMA

SEQ ID NO: 120599 - protein, 155 aa, Glycine max
  Coding DNA Sequence Number=SeqID_3821
  Gene Ontology: Mol. function=alpha-N-arabinofuranosidase activity; Biological process=L-arabinose metabolic process
  Homolog annotation: Hit_ID=Q6RX11; Match level="QueryCoverage=63%, HitCoverage=40%, E-value=2e-16, Identity=40%"; Hit description=A -arabinofuranosidase 1
ALSMKVLCSESFPCPSGGVGISNPGSWGMNIEKGQKYQIVFYAKADGAINLDVSFVGSEKELMDIMLQIGQGWRLYMVEANATNHNASLQITTSKGGVVCVLEMCCIINTDSRGNMEELVGVCFIVGWSFSHRVLALGGFNEAPRFSPEYTLYFG

SEQ ID NO: 120600 - protein, 137 aa, Glycine max
  Coding DNA Sequence Number=SeqID_3822
  Gene Ontology: Mol. function=hydrolase activity, acting on glycosyl bonds; Biological process=L-arabinose metabolic process
  Homolog annotation: Hit_ID=Q7X9G7; Match level="QueryCoverage=98%, HitCoverage=28%, E-value=7e-31, Identity=63%"; Hit description=Alpha- L-arabinofuranosidase
MHLGGKTLLDPGKRDQDTLEIYEIIGPMTDLVSLRAFNLLEVRPNQDGGALRASMGHPKPFDLRIVTIGNEDCGKFNYKDIQIISNCDGSEKSLDHPTDLYDFHIYTKAMDMFSKSTKFDNVSRYGPKGFVSEYAVW

SEQ ID NO: 120601 - protein, 93 aa, Glycine max
  Coding DNA Sequence Number=SeqID_3823
GGAEIGEGARIGVGEEGAGPVREAFGGEDVFDKGEAVDGGDGGGEVAGVAVVDPGIGGESMEAHADAIWEGVVADWMAEDRSWDLERESKEEE

SEQ ID NO: 120602 - protein, 38 aa, Glycine max
  Coding DNA Sequence Number=SeqID_3824
MTTKRNKTLLVSLDLDDSGGVGDAKIRSEISWKRGLGR

SEQ ID NO: 120603 - protein, 61 aa, Glycine max
  Coding DNA Sequence Number=SeqID_3825
MSIEFNDEICAISAHQWAKHTSTAKCSFNALSAIEEPGKASIPRPRAKREISALSTTVVFN

SEQ ID NO: 120604 - protein, 218 aa, Glycine max
  Coding DNA Sequence Number=SeqID_3826
  Homolog annotation: Hit_ID=Q1SKD7; Match level="QueryCoverage=91%, HitCoverage=51%, E-value=2e-08, Identity=25%"; Hit description =Ankyrin
MASRKRKALASASQARYDRSRFTSQEAWDRYSDIVIGRKILPERNVMIYHTEFDEFKTELERRNWHKELTNFLDRSIDVAIVKDFYANLYDPEDKSPKQVRVRGHLIKFDKNALNTFPKTPMIIEERESLSAYSRFCRLRPDPQELATRLFIPGRGFELNTNGLPLKILQKNLTILAQTWSILSFSNLAPTSHISDITLDRARLIYGIIQKMDINVGS

SEQ ID NO: 120605 - protein, 88 aa, Glycine max
  Coding DNA Sequence Number=SeqID_3827
MENWRTALRNNFAGLQTRSGERRIGGQRYAITSRGYRLEGGGHMKSARKLHSWVSEKSREWRIGEQRYAITSRGSRLEGGGCMNSARQ

SEQ ID NO: 120606 - protein, 102 aa, Glycine max
  Coding DNA Sequence Number=SeqID_3828
MNRQAEQEWSGCIQTAARPSLVGNTQQQAPSAGDRNIMKSNESPGPLKGQSKNEFKIESRTLQDSRGKLISRIKIQEIKIQDSRIKRRLNQDKYEKVFSKTE

SEQ ID NO: 120607 - protein, 134 aa, Glycine max
  Coding DNA Sequence Number=SeqID_3829
  Homolog annotation: Hit_ID=Q1SKD7; Match level="QueryCoverage=95%, HitCoverage=33%, E-value=6e-14, Identity=31%"; Hit description =Ankyrin
MAPKKLSAKRSRRDAAVEGTSAAPEFDSHRFWSAEHQQHFEAIKGWSFYRERRVQLREDEYTDFEEEIARRHWTSLVTPMAKFDPEVVLEFYANAWPTEDGVRDMHSWVRDQWIPFDADALSQFLGDPLVLEEG

SEQ ID NO: 120608 - protein, 143 aa, Glycine max
  Coding DNA Sequence Number=SeqID_3830
  Homolog annotation: Hit_ID=Q9A7M1; Match level="QueryCoverage=77%, HitCoverage=54%, E-value=2e-08, Identity=29%"; Hit description=DedA family protein
  Pfam annotation: Domain name=SNARE_assoc; Domain location=14-139; Score=37.4; E_value=5e-08; Accession=PF09335.1; Description=SNARE associated Golgi protein
  Subcellular localization annotation: CTP_CleavageSite=43; ConfidenceScore=5.21e-01
MALSKSTVLISSVLPPASVMLLTGITVSQASMHPALAWLAVVMGATVGSVLNFHIGQLMGHTRWITRLTAKHAGKFLRVQHQLQKNGVLVLFSARFLAVLRYIVPLAAGMLRLNVVKVYAVSLLSAAVWAALYVGIVTGISAF

SEQ ID NO: 120609 - protein, 320 aa, Glycine max
  Coding DNA Sequence Number=SeqID_3831
  Gene Ontology: Mol. function=oxidoreductase activity; Cellular component=membrane; Biological process=fatty acid biosynthetic process
  Homolog annotation: Hit_ID=Q6D972; Match level="QueryCoverage=77%, HitCoverage=99%, E-value=1e-67, Identity=56%"; Hit description =Putative short chain dehydrogenase
  Pfam annotation: Domain name=Epimerase; Domain location=80-314; Score= -29.4; E_value=0.0003; Accession=PF01370.11; Description=NAD dependent epimerasedehydratase family
  Pfam annotation: Domain name=KR; Domain location=81-257; Score=-4.7; E_value=4.5e-07; Accession=PF08659.1; Description=KR domain
  Pfam annotation: Domain name=adh_short; Domain location=78-240; Score= 123.6; E_value=5.6e-34; Accession=PF00106.15; Description=short chain dehydrogenase
  Pfam module annotation: Pfam domain module=Epimerase::KR::adh_short; Domain location=80-314::81-257::78-240
VDRTRHQPALLEQAKLLRQLFLRNRGSRPQQIAKANGRIEHNQAIENGDRPFTGNQVDKLRHRAETFQEKNMGRLTDKYTLITGGTSGIGLATAQAFIAEGAHVAVTGRNPDTLAEAERILGENAWVIPTDAGDIASQKALAETLAARWPRLDAVFLNAGDVTHAPLEAWQEEAWDRLMGINLKGPFFLIQALLPLLNNPSSVILCGSVSARIGLPTSSVYAASKAALLSLARTLSAELLPRGIRVNGLSPGPVETPAFNKTGLSEEALNAMMAEIIKLVPLGRMGSTTELAKAALYLASDESSYTVGTELLVDGGMGSL

SEQ ID NO: 120610 - protein, 36 aa, Glycine max
  Coding DNA Sequence Number=SeqID_3832
MELASSYDQLNFSSAFVVEFEATRYIISLNRTSESK

SEQ ID NO: 120611 - protein, 102 aa, Glycine max
  Coding DNA Sequence Number=SeqID_3833
MSSKKRKSISARPTAQYDTRRFHYFEAWTRYTDNVLGRYILAKRKVQIYHMELDEFKAELERHNFHKRLTNFADSSIDLALVKEFYANLYSPQGPSSKQVRI

SEQ ID NO: 120612 - protein, 124 aa, Glycine max
  Coding DNA Sequence Number=SeqID_3834
MAEPSKKRKGSSSRSQRHSETQETPIPSSIPSASLFSSEEQRIRKGVPFEGTLIDDWKFDFSVHVARRLVCTNQADMIGRLLVGSLAFESRILHYLIVRILLPRSSNLAQVSEEDLIVMLAFHK

SEQ ID NO: 120613 - protein, 194 aa, Glycine max
  Coding DNA Sequence Number=SeqID_3835
MADAKFAGLAWFSHCLSFSMCPVVGFGPWLGLGKPLVEILPPGQLRGFCPLLAWLGSAVLGYGPVLSFGLVGPLLPPVISFVARILPTLACAPLAKSVPRWWIIMQNEREPTNGSLFWPNIVEEERDTGLIGEGRIKATRAESQWIVAARPLCHLQYPVAYLSRLQRILPRLLDGNCASRRLVGLIRLTRVTNG

SEQ ID NO: 120614 - protein, 192 aa, Glycine max
  Coding DNA Sequence Number=SeqID_3836
MPISPCKSISWSVSSRHGDRTHKDTQWTRKSPTGPWGFQLWLQASISPTGCPYPPGKGSHLQDTQWTRRSPTGSWSCQALITGLCQFYRVPVTSSKGIRPPTNRAFIKKYCAPQAGAGRNTTAALGWPVAGNRYTATTSRVHLSSSVKRLERCLRHMADQQATKSKAKGKQSTRSVTYKPSCVQLKTLKKRY

SEQ ID NO: 120615 - protein, 50 aa, Glycine max
  Coding DNA Sequence Number=SeqID_3837
MVRLQRDREAGTIPISRPHAKREISVLSAGVVISQAQCMTSAMLKSTYSR

SEQ ID NO: 120616 - protein, 139 aa, Glycine max
  Coding DNA Sequence Number=SeqID_3838
MAPNQLVRPKDTKGKAKVDTEESDKASPVLDKEIPAERFAKGEEDFSRKKLSTIEANEFLWIIQQSEFKVIKQLNKTPARVSLLELLINLEPHRTLLVKILNGAHVALDISVEGFGGFINNITSNNYLTFTDEEIPIKG

SEQ ID NO: 120617 - protein, 51 aa, Glycine max
  Coding DNA Sequence Number=SeqID_3839
MSAFIYSCTSSSSPIVLDLDLETADLLGGGVGVCHSFGLCQHSGKLLTPVQ

SEQ ID NO: 120618 - protein, 238 aa, Glycine max
  Coding DNA Sequence Number=SeqID_3840
  Gene Ontology: Mol. function=hydrolase activity
  Homolog annotation: Hit_ID=Q3CEC4; Match level="QueryCoverage=99%, HitCoverage=94%, E-value=3e-64, Identity=50%"; Hit description =Acetylxylan esterase related enzyme
  Pfam annotation: Domain name=DUF303; Domain location=42-136; Score =99.5; E_value=1e-26; Accession=PF03629.8; Description=Domain of unknown function (DUF303)
MAGRGFLKDVPPILDEKIKMLRNGRWQMMAEPINFDRPTSGISLATTFASSWRLFHNQEDDIGLIPCADGGTSLDDWSVEGALFQNAIFQAKAAQKISTLSGILWHQGESDSHGQKYRSYTEKLSYIINTLREELNTPEIPLIVGGLGSFLTEGMYGQYFSEYSKINEALVQYAKDNEHAYFVSAEGLTGILSDEEQIMNKIHNRPLTKNEKYELLQYDFAMGLVSADEFQVQFAQLK

SEQ ID NO: 120619 - protein, 82 aa, Glycine max
  Coding DNA Sequence Number=SeqID_3841
MNVSQPTLRREGDARAHGCVFHGRKMHGVATNIYSRKTSEKPKRCGLQTLSVKGSGVVFTHREGCFPCSYIFLNCDKEIRPM

SEQ ID NO: 120620 - protein, 118 aa, Glycine max
  Coding DNA Sequence Number=SeqID_3842
  Homolog annotation: Hit_ID=Q9ZVC6; Match level="QueryCoverage=49%, HitCoverage=26%, E-value=2e-08, Identity=49%"; Hit description =Expressed protein
MYRGNDLKGKKPDTKSISNCTIFQKAGIDFKRDQLKVQVTSKLTLRLMGERLITENRWHRFNLELPLLFYYDTDSVTAKFKGAKLSIKFGELSQTKLGDLNHFIFATMSGVTCFDCSY

SEQ ID NO: 120621 - protein, 178 aa, Glycine max
  Coding DNA Sequence Number=SeqID_3843
  Gene Ontology: Mol. function=transition metal ion binding; Cellular component=chromatin; Biological process=proteolysis
MLSETLRKLVDGPKRNVITWQGYNINKYSFYTKAQDEKSTMQNSGVTLRVESQHFASVHDDNPCVASIPYFGNTSVRTNDVGFTFVNLKKVAYQNDPFIMVEQFKQVFYVQDPCDERWSVVLHGKTIGVNVEDDDSYINTYVSPLSTQMSPNIVGEEELDDVLANRNGHDEGELINIV

SEQ ID NO: 120622 - protein, 125 aa, Glycine max
  Coding DNA Sequence Number=SeqID_3844
MDFEICQIVQQKAIKFVQQNFPNVQKNVCALLVMGKVVHIGFWTFLANPNEFSASALFSWFRVVHDVWILWKLRGVDGDPMPRGMRIRATWGYVSLVEGGQLGMVGSCLICGCGRVDLHHRPIST

SEQ ID NO: 120623 - protein, 80 aa, Glycine max
  Coding DNA Sequence Number=SeqID_3845
GAAVSSAGVSRGAVASSLEFVAQLALVRPVLGLKFAGVGHLALWRLTEELGWMMMKGCRRFKTSFSMTSANNGTKQLNRI

SEQ ID NO: 120624 - protein, 173 aa, Glycine max
  Coding DNA Sequence Number=SeqID_3846
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=58%, HitCoverage=14%, E-value=8e-28, Identity=56%"; Hit description =Putative endo-1,4-beta-xylanase
MPHRVIFYLEGPTPGVDLLIRSVEINCSTPNNSVSQRGCKSHDSMNDGKIVPKSGKFFASATERTQSRKGIQQEIIGRVQCKLAYEVTTLVRIFGNNVSTADHATKTPPSTPLDVKIRKRGVILKFSGLDSGSYANTLVIVKIPFGNDMMKVFTLVWVLATRKWLLLTRSRVF

SEQ ID NO: 120625 - protein, 600 aa, Glycine max
  Coding DNA Sequence Number=SeqID_3847
  Homolog annotation: Hit_ID=O48878; Match level="QueryCoverage=77%, HitCoverage=49%, E-value=3e-75, Identity=36%"; Hit description=Gene X-like protein
  Pfam annotation: Domain name=XS; Domain location=249-365; Score =227.6; E_value=2.7e-65; Accession=PF03468.5; Description=XS domain
  Pfam annotation: Domain name=zf-XS; Domain location=133-173; Score =21.3; E_value=0.00041; Accession=PF03470.5; Description=XS zinc finger domain
  Pfam module annotation: Pfam domain module=XS::zf-XS; Domain location= 249-365::133-173
MWDLWKEVGGETDGGMVCSGGSMKIQVAVHGYSDIKTEAAIEPCTTRLPFVLCNGSYMETPYSITVSVSKCFLHVFWLIKLCGMFCREPFVTGMSGGRERVRESDFEYYEREYYKDLKSDYYKLKISKSSYKCPFCQDKREYSLNELLKHAVRFERDSRSMKTKDLAKHSALQLYIKKYLDENDRPGSVVHDKAGSVVLDRPGKVVHDRSGKVVIDGSGNVYNDRFGKVVNDRPGNVVIVNDRSEKVGKDQLFVWPWMGIVANIATEFKDGRRTGDSGSKLRDEFTLKGFHPLKVQPLWNRYGHSGFAIVEFSKDWEGFTNAMNFGRSFEAEHCGKRDYNKLRDRGDRLYGWVARDDDYHSKSIIGDQLRKTGDLQSVSGKQAEEKRKTSLLVLDLAKTLKVRNETLEQVCSKYDDISVSLNRVMDEKEAMIESYNNGTLKGREKARLELHAQRKELEGREKDLQRSQVKNENERRKLYLERKNNEMAIMEQNKADEREEKEKMHKKILELQNELDAKQKLELGIQQLKGNLQVRKQIGEDDEEEKNKLDAIKTELEDKEEELEGLEALQQALVVKERKTNDELQDARKELIRVCVYSQA

SEQ ID NO: 120626 - protein, 58 aa, Glycine max
  Coding DNA Sequence Number=SeqID_3848
  Gene Ontology: Cellular component=integral to membrane
  Homolog annotation: Hit_ID=Q5ZDM9; Match level="QueryCoverage=79%, HitCoverage=14%, E-value=1e-10, Identity=59%"; Hit description =Putative membrane protein
MSTTGNAGTVKGMLRTIVYIHRDDEDDDVGHHEGGDQPWEPALEEAEVTIAHGGGARR

SEQ ID NO: 120627 - protein, 76 aa, Glycine max
  Coding DNA Sequence Number=SeqID_3849
  Gene Ontology: Mol. function=ferric iron binding; Biological process =aromatic compound metabolic process
  Homolog annotation: Hit_ID=Q9LHB1; Match level="QueryCoverage=98%, HitCoverage=11%, E-value=1e-19, Identity=57%"; Hit description =Transcription factor X1-like protein
  Pfam annotation: Domain name=XH; Domain location=1-76; Score=74.4; E _value=3.5e-19; Accession=PF03469.5; Description=XH domain
MEVLDEEDEKLRTLKDEFGDDVFQAVVTALKELNEFNPSGRYPLRELWHSKEGRKASLKEGCSYIIKQWKTLKRKK

SEQ ID NO: 120628 - protein, 217 aa, Glycine max
  Coding DNA Sequence Number=SeqID_3850
  Gene Ontology: Mol. function=serine-type endopeptidase activity; Cellular component=integral to membrane
  Homolog annotation: Hit_ID=Q3C2H8; Match level="QueryCoverage=89%, HitCoverage=63%, E-value=1e-53, Identity=51%"; Hit description =Rhomboid family protein AtRBL1
  Pfam annotation: Domain name=Rhomboid; Domain location=9-153; Score =198.0; E_value=2.2e-56; Accession=PF01694.12; Description=Rhomboid family
MGALEVGKVIHRHQVWRLFSCIWLHGGVVHLLANMLSLVFIGIRLEQEFGFVRIGFLYVISGFGGSLLSALFIQEGISVGASGALFGLLGGMLSELLINWTIYANKFAALLTLIVIVVINLAVGILPHVDNFAHIGGFVSGFLLGFIFLIRPQFKWVSSRHRNSHSSAAAPSVKYKHKPYQYALWVISFILLIAGDLIALFSTIGYLHKIGTLMLVS

SEQ ID NO: 120629 - protein, 199 aa, Glycine max
  Coding DNA Sequence Number=SeqID_3851
  Homolog annotation: Hit_ID=Q1SP02; Match level="QueryCoverage=71%, HitCoverage=30%, E-value=8e-17, Identity=36%"; Hit description=IMP dehydrogenase/GMP reductase
MWSTLTLSGTSLIVVVTLGELPRWTTTRQLAGYLTLLQCWIYEHFPSVHQCVTDDTYQETSPRASPWLTSKAHMKGITGAPYRARCDGLTVTDVSWLLYTEHRGVRAFQEISSFQGQLRWGPMIVTVRLERVVRQFGYIQSIPPPPVSARLSHDQINDWWMEFADHLLPAGQLCLVPGRMITTDIRRLHRGWSVCSTLG

SEQ ID NO: 120630 - protein, 472 aa, Glycine max
  Coding DNA Sequence Number=SeqID_3852
  Gene Ontology: Mol. function=phospholipid binding; Cellular component= cytoplasm; Biological process=steroid metabolic process
  Homolog annotation: Hit_ID=Q93Y40; Match level="QueryCoverage=89%, HitCoverage=92%, E-value=0.0, Identity=83%"; Hit description =Oxysterol-binding protein
  Pfam annotation: Domain name=Oxysterol_BP; Domain location=40-444; Score=148.4; E_value=1.9e-41; Accession=PF01237.9; Description =Oxysterol-binding protein
  Subcellular localization annotation: CTP_CleavageSite=26; ConfidenceScore=5.14e-01
MKKAYGNFIPSFLVLGHHSMTPPSILVSSVRNVVILWNASLHMFSFDSRLLGYEGVEVINPDGGKEDAEEEAQRGRWKPEERDGYWKMMHKYIGSDVTSMVTLPVIIFEPMTMLQKMAELMEYSYLLDQADECEDPYMRLVYASSWAISVYFAYQRTWKPFNPILGETYEMANHGGITFLAEQVSHHPPMSAGHAENEHFTYDVTSKLKTKFLGNSVDVYPVGRTRVTLKRDGVVIDLVPPPTKVNNLIFGRTWIDSPGEMIMTNLTTGDKVVLYFQPCGWFGAGRYEVDGYVYNSAEEPKILMTGKWNESMSYQPCDSEGEPLPGTELKEVWHVADVPKNDKFQYTYFAHKINSFDTAPKKLLASDSRLRPDRYALEMGDLSKSGAEKSSLEDKQRTEKKIREAKEHKFTPRWFDLTEEVTSTPWGDLEIYQYNGKYTEHRAAIDNSGSIDHVDNKEIEFNPWQYGNLSTE

SEQ ID NO: 120631 - protein, 192 aa, Glycine max
  Coding DNA Sequence Number=SeqID_3853
MRLKCSSASFFFSLGLFTCILSGVDVGQEDLSMAIALAGLWSLFLALGCSACVWPIYYTVSTAYQKAFDSGLSYDSPASVLGLLFVVNSIIFMTLGLAIGYPVASASVKVLQGLWRNDLAALKGSCPNCGEEVFAFVRTDKANNSSHRADCHVCECLLEFRTKVEQSALRLGRQWVYGRIYLVRRSRRQGDP

SEQ ID NO: 120632 - protein, 249 aa, Glycine max
  Coding DNA Sequence Number=SeqID_3854
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=Q4VZ81; Match level="QueryCoverage=66%, HitCoverage=47%, E-value=3e-27, Identity=41%"; Hit description=Beta1, 3-glucuronosyltransferase
  Subcellular localization annotation: CTP_CleavageSite=61; ConfidenceScore=5.72e-01
MASVRRTLSPVPRAGTVANGEVCSVASPLSKSSSSPQNFSPSVGLDYRALVFGVFSPRSFRALERSKPRGQLWRKMLFHFFICFMVGVSIGLIPLASTHMSANLMPKQQAFSFEVISAVANFQPFENVNLNVTPSINEAVNFNATLYSTVKEQELIDGVAYNVSNSQISENPYLESQKLLIIVTPTHNHIFQAYYLHRLSQTLKLVPPPLLWIVVEMTSQSEETADILWSSGIMYRHLICKTKSNQPKP

SEQ ID NO: 120633 - protein, 550 aa, Glycine max
  Coding DNA Sequence Number=SeqID_3855
  Gene Ontology: Mol. function=lithium ion binding; Cellular component =integral to membrane; Biological process=calcium ion transport
  Homolog annotation: Hit_ID=Q9LJI2; Match level="QueryCoverage=97%, HitCoverage=82%, E-value=1e-166, Identity=57%"; Hit description =Na/Ca,K-exchanger-like protein
  Pfam annotation: Domain name=Na_Ca_ex; Domain location=154-288; Score= 122.1; E_value=1.6e-33; Accession=PF01699.14; Description =Sodiumcalcium exchanger protein
MKAPNALFGAKRRKFHGVFNALCAMVVFFFFYNREDIIHNPILRQSSYFPNHGLPQNAIFRDGSSVIHRRMVEISANTSGVAGDNGLGVSSSGLCNGLVQHEGYASPCEFLKVNPQCSSDGYLDYLKFFYCTCQGFSVFGYLVLGVWLAALFYLLGNTAADYFCPSLEHLSRLLKLPPTVAGVVLLPLGNGAPDVFASIAAFVGAESGDVGLNSVLGGALFVTTIVAGTVSLCVADKEIGIDRRCFIRDVSFFLVTLVSLLLILFVGKVGVGVAIGFVLIYVVYAFIVAASEILRKHAWRLKLDAVTPLLPVRGSVFSLGLEEDTSIYSSLLEDTESDPPRLPPSLPQWMWSSNVAIYSNHASKINFLDDERPPWGWSDGSMENTKTSFTVSKLFLMMEIPLAIPRRLTIPMVHEEVWSKPYAVASASLAPILLAILCSTQDNVSNQGVILSYCVGVSLGCTFGILAYKYTVSDRPPPQFLLPWVLGGFIMSIVWFYIIANELVALLVAFGVIFGINPSILGSYVQHTYWLGDLVAAWGLVKETLFVCGA

SEQ ID NO: 120634 - protein, 482 aa, Glycine max
  Coding DNA Sequence Number=SeqID_3856
  Gene Ontology: Mol. function=serine-type endopeptidase inhibitor activity; Cellular component=integral to membrane; Biological process=hyaluronan metabolic process
  Homolog annotation: Hit_ID=Q1RTL8; Match level="QueryCoverage=95%, HitCoverage=62%, E-value=1e-115, Identity=45%"; Hit description=IMP dehydrogenase/GMP reductase
  Pfam annotation: Domain name=VWA; Domain location=217-377; Score =33.9; E_value=5.5e-07; Accession=PF00092.18; Description=von Willebrand factor type A domain
MILHSALQLILVIWSSEAERKGSLLGLEVDGSGRSYHTELISLKDEKDKNKVAKAKDGYFLKSHIYTVKIPQFRGGSVFSIKIRWSQKILFHDGQLSLCVPFSFPSYVNPAGRNISKKEKIFLKVNSGATTEVLCKTTSHPFKELLRQAGKLNLSYEAEVLTWSSTDLSFSYSVSSNDIFGAVLLQSPFLRDFDEREIFCLYLYPGNSPDRKVFKKDVVFVVDISASMKGTPLDNTKNSLLTSLSQLNAQDTFNIIAFNGAVYLFSSSMERATEEAILNATTWVDTNFIANGDTNIMLPLTQAMKLLEKSTDSVPLIFLVTDGAVEDERDICNFVKSYVSSLYCNHYFLQMLAQIGRGHYDSAHDLDSIDFRMQRLFSSASSVMVADITIKSLEGLDSLELFPTHIQDISFESPLILSGRYSGTFPELVKVTGTLADMTNFVVDLKVKREKDMQLSNVLSKRHIDQVTAQAWLLKSKELEEK

SEQ ID NO: 120635 - protein, 86 aa, Glycine max
  Coding DNA Sequence Number=SeqID_3857
  Gene Ontology: Mol. function=nucleoside diphosphate kinase activity; Cellular component=flagellum; Biological process=pyrimidine ribonucleoside triphosphate biosynthetic process
  Homolog annotation: Hit_ID=Q6Z7E5; Match level="QueryCoverage=90%, HitCoverage=39%, E-value=7e-20, Identity=62%"; Hit description =Putative outer arm dynein intermediate chain 1
  Pfam annotation: Domain name=NDK; Domain location=2-82; Score=-21.7; E_value=7.6e-06; Accession=PF00334.9; Description=Nucleoside diphosphate kinase
MIISGPVLVMVLEKDNAIADWRALMGPTDASKAKITHPHSELVTILCSIRAKSGLDVEKNCVHGSDSPKSAQREIPFFFKELSAGQ

SEQ ID NO: 120636 - protein, 281 aa, Glycine max
  Coding DNA Sequence Number=SeqID_3858
MKARGSIWSKMETRIGKEVMFLSWMQNKLGGKQDNRKPNTHTTNTTTYLAKQEPREEFSDWPHGLLAIGTFGNKSEIKEDLDDQNTQEDPSSSEEIADFTPEEIGNLQKELTKLLRRKPNVEKEISELPLDRFLNCPSSLEVDRRISNALCSESEDKEEDIEKTLSVIIDKCKDICADKRKKAIGKKSISFLLKKIFVCRSGFAPTPSLRDTLQESRMEKLLRTMLHKKIYTQNSSRSPLVKKGIEDKKMTRKRNEDESDERNGDGCKWVKTDSEYIVLEI

SEQ ID NO: 120637 - protein, 329 aa, Glycine max
  Coding DNA Sequence Number=SeqID_3859
  Gene Ontology: Mol. function=DNA binding; Cellular component=beta -galactosidase complex; Biological process=DNA integration
MMNNNTYGSESSLVVLLVYVYDIILVGPSSTCVAKVQQKLQSMFKLKVLGSLKYFLGLEIAKSSKGISLCQRKYALSLLDDTGYLGCKPASLPMDPNLTLLDGEPIPDPSLYRHLIGRLMYLTISRPGITFVVHKLSQYMKNPMTTYLNVVHHLLQYLKSAPGQGLFFPTTNSLHLSAYADADRGGCLDTRKSTTVSWKFVKQGTVSKSSAESEYRALSSVASEIERLKRLLTHFGILIDSAMLFCDNKSTIHLASNPSLHERSKHIDIDCHFIQELVQFRVFSLIHVKTQHQIAHVFTKALPASVLSASWVSLTFTLQLEGNITHSYF

SEQ ID NO: 120638 - protein, 103 aa, Glycine max
  Coding DNA Sequence Number=SeqID_3860
  Gene Ontology: Mol. function=RNA splicing factor activity, transesterification mechanism; Cellular component=ribonucleoprotein complex; Biological process=mRNA metabolic process
  Homolog annotation: Hit_ID=Q1RTK2; Match level="QueryCoverage=97%, HitCoverage=84%, E-value=6e-42, Identity=80%"; Hit description=Like -Sm ribonucleoprotein-related, core
  Pfam annotation: Domain name=LSM; Domain location=1-61; Score=33.3; E_ value=8.6e-07; Accession=PF01423.12; Description=LSM domain
MYEKLLVLLRDGRKLMGTLRSFDQFANAVLEGACERVIVGDLYCDIPLGLYVIRGENDLEREELPEHMTRVSTAEIKRAQKAEREASDLKGTMRKRMEFLDFD

SEQ ID NO: 120639 - protein, 405 aa, Glycine max
  Coding DNA Sequence Number=SeqID_3861
  Gene Ontology: Mol. function=oxidoreductase activity; Biological process=electron transport
  Homolog annotation: Hit_ID=Q9FLE1; Match level="QueryCoverage=92%, HitCoverage=79%, E-value=1e-124, Identity=58%"; Hit description =Arabidopsis thaliana genomic DNA, chromosome 5, P1 clone:MYH19
  Pfam annotation: Domain name=DAO; Domain location=14-301; Score= -52.8; E_value=0.019; Accession=PF01266.14; Description=FAD dependent oxidoreductase
  Pfam annotation: Domain name=HI0933_like; Domain location=13-405; Score=362.9; E_value=5e-106; Accession=PF03486.5; Description=HI0933- like protein
  Pfam module annotation: Pfam domain module=DAO::HI0933_like; Domain location=14-301::13-405
SKVVFFVVKSKEELLVVVGGGAAGVYGAIHAKTVAPHLSVVVIEKGKPLSKVKVSGGGRCNVTNGHCVDNMILAENYPRGHKELRGSFFNTHGPVDTMSWFVSQGVELKVEDDGRVFPVSNSSSSIIDCLMSEVKERGAVSILSSGKFLLEVQQHTSVHAEHVEADYLLIASGSSRQGYTLASQLGHSVVDPVPSLFTFKIEDLRLRELSGTGFRELVAYLVEHDHFANVLFTALVKVTFPKVKVRLKLDSVQRNIPQLTQVGPMLVTHWGLSGPVVLRLSAWGARFLFSSGYKGKLFVDFIPDLHVESLKSVLSHHKLQYAGLSGDILWASISNSSLMSIGSLLKDCVFEVTGKGQFKDEFVTAGGVPLSEIMLNTMESKICSRLFFAGEILNVDGVTGGFNFQ

SEQ ID NO: 120640 - protein, 91 aa, Glycine max
  Coding DNA Sequence Number=SeqID_3862
  Subcellular localization annotation: CTP_CleavageSite=80; ConfidenceScore=5.10e-01
MASIAGVFQTLQYVMVRQCISGFGQPNHSVLCLGFSSLLPTIHYKHMNLFFTPRARRCTTLAISPATKSITKYKSYDLGLAEGVSTRNIVN

SEQ ID NO: 120641 - protein, 88 aa, Glycine max
  Coding DNA Sequence Number=SeqID_3863
MSNLISALLKDGLIVPNNNSFSSLVLSVKKKNDTWRVCVGYKGLNVVTIKDSFPIPAIDKLLDELDGSDYHQIHVLVNSLASVPNRHK

SEQ ID NO: 120642 - protein, 63 aa, Glycine max
  Coding DNA Sequence Number=SeqID_3864
  Homolog annotation: Hit_ID=UPI000034F2F4; Match level="QueryCoverage =82%, HitCoverage=7%, E-value=9e-17, Identity=83%"; Hit description =protein binding
MGVSQAMDALRKRAVFVKESLHKSQTITDNMVSILGSFDHPLSALETAMRPTQDNYVNISDLN

SEQ ID NO: 120643 - protein, 125 aa, Glycine max
  Coding DNA Sequence Number=SeqID_3865
MPNKTNKDLEEAILALVVEMENLQAHHENRHEQLQSTMDARNDALHGVLASIMDKLAIISSAPAQVFSPAIFATTSPTFHMAFDGTIHITTSPFGGHILSSSTLLHQHNFSPHHTPNFSTNPFIQ

SEQ ID NO: 120644 - protein, 111 aa, Glycine max
  Coding DNA Sequence Number=SeqID_3866
  Gene Ontology: Mol. function=nucleic acid binding; Biological process= DNA integration
  Homolog annotation: Hit_ID=Q1S3Z1; Match level="QueryCoverage=92%, HitCoverage=8%, E-value=2e-20, Identity=46%"; Hit description =Integrase, catalytic region; Zinc finger, CCHC-type
QIANLNKILDDLENLEVKMEDEDKALMLLNGLPSSYKHFKDAMLFGRDQTITFEEVQSSIRTKEMQRIHESNTNNNAKELNVMRGTLQEGLPLKGEAKIQRNLKNQRCGQK

SEQ ID NO: 120645 - protein, 330 aa, Glycine max
  Coding DNA Sequence Number=SeqID_3867
  Homolog annotation: Hit_ID=Q1SWU2; Match level="QueryCoverage=90%, HitCoverage=90%, E-value=2e-77, Identity=50%"; Hit description =Cytosolic fatty-acid binding; Actin-crosslinking proteins
  Pfam annotation: Domain name=DUF569; Domain location=1-141; Score =325.3; E_value=1e-94; Accession=PF04601.4; Description=Protein of unknown function (DUF569)
MEFFQKAKVVRLRSHHDKYMLADGDQENVFQDRNGCYMNAKWIVDVVENSNFIRLKSCYGKYLTASNMPFILRGTGKKVLQTLPTRLNSSIEWEPIREGVQVRLRTRYGQYLRGNGGLPPWRNTITHDVPHRTATANWILWDVDIVELRPQTQAPKPRPRPTPITPPNHSMNATPTNLSPCPSPSSSPLISEMDSLVKIDLRSPTTSESEDEIECLSPLKEGRIIFYDVGNDNGDIDDAKKESFFTFKGSCASELKDKLKEETGLDDIIVCCRNPLTTKLYPLHLQLPPNSIDMHVVVVPSSFKREFFSTYLFYDAICLFNNPSFIRNVL

SEQ ID NO: 120646 - protein, 166 aa, Glycine max
  Coding DNA Sequence Number=SeqID_3868
  Gene Ontology: Mol. function=protein binding; Cellular component =intracellular; Biological process=defense response
  Homolog annotation: Hit_ID=Q1S334; Match level="QueryCoverage=100%, HitCoverage=20%, E-value=3e-67, Identity=69%"; Hit description =Disease resistance protein; AAA ATPase
  Pfam annotation: Domain name=LRR_1; Domain location=111-132; Score =6.3; E_value=19; Accession=PF00560.23; Description=Leucine Rich Repeat
  Pfam annotation: Domain name=LRR_1; Domain location=39-61; Score =13.1; E_value=1; Accession=PF00560.23; Description=Leucine Rich Repeat
  Pfam annotation: Domain name=LRR_1; Domain location=63-85; Score =11.0; E_value=2.5; Accession=PF00560.23; Description=Leucine Rich Repeat
  Pfam annotation: Domain name=LRR_1; Domain location=87-109; Score =15.6; E_value=0.18; Accession=PF00560.23; Description=Leucine Rich Repeat
  Pfam module annotation: Pfam domain module=LRR_1::LRR_1::LRR_1::LRR _1; Domain location=111-132::39-61::63-85::87-109
AFENGNMLISDALPILEDLNIDYCNDMVELPTGLCEITSLKMLSITNCHKLSALPQEIGNLENLKLIRLSSCTDLEGIPNSIGRLSNLRHMDISNCISLPNLPEDFGNLCNLRNLYMTSCARCELPPSIINLEHLKEVVCDEETAASWDAFKPMLPNLKIDIPQLD

SEQ ID NO: 120647 - protein, 321 aa, Glycine max
  Coding DNA Sequence Number=SeqID_3869
  Gene Ontology: Mol. function=protein binding; Cellular component =intracellular; Biological process=defense response
  Homolog annotation: Hit_ID=Q1S351; Match level="QueryCoverage=97%, HitCoverage=40%, E-value=1e-110, Identity=64%"; Hit description =Disease resistance protein; AAA ATPase
  Pfam annotation: Domain name=NB-ARC; Domain location=4-296; Score =77.6; E_value=4e-20; Accession=PF00931.13; Description=NB-ARC domain
MAQQVKRPFGVPEEPEFTVGLDAPLRELKMELLKEGVSIIVLTGLGGSGKTTLATKLCWDEQVIGSFKENILFVTFSKTPKLKIIVERLFEYCGYQVPQFQSDEDVVNQSGLLLRKIDASPMLLVLDDVWPGSEPLVEKFKVQMPDYKILVTSRVAFPRFGSPYILKPLVHEDAMALFCHHTLLGKNSSNIPEEVVQKIVRHCKGLPLAIKVIGRSLSNQPYELWQKMVEKLSQGHSILDSNTKLVASLKKISDVLEDNSIIKECFIDLALFPENQKIPVAALVDMWVELYGLDNDGIVMANVNKLASMNLANVLETRYSR

SEQ ID NO: 120648 - protein, 175 aa, Glycine max
  Coding DNA Sequence Number=SeqID_3870
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=Q7XHJ8; Match level="QueryCoverage=96%, HitCoverage=65%, E-value=1e-62, Identity=63%"; Hit description=Beta3- glucuronyltransferase
  Pfam annotation: Domain name=Glyco_transf_43; Domain location=1-154; Score=72.8; E_value=1.1e-18; Accession=PF03360.6; Description =Glycosyltransferase family 43
MAHIETHRLEGIVYFADDDNIYSVELFQQMREIRRFGTWTVARLLGDKSSIVLQGPICNGSQVIGWHTDESNGKSKRFHAEMPGFAFNSTILWDPKRWHRPTLEPIRQLDSVKESLWVSTLIEQVVEDESQMEGLMDNCSRVMVWHIDLESSYSFYPQKWIVKNNLDAIVHLPLV

SEQ ID NO: 120649 - protein, 665 aa, Glycine max
  Coding DNA Sequence Number=SeqID_3871
  Gene Ontology: Mol. function=protein-methionine-S-oxide reductase activity; Cellular component=nucleus; Biological process=regulation of transcription
  Homolog annotation: Hit_ID=O81074; Match level="QueryCoverage=97%, HitCoverage=96%, E-value=1e-148, Identity=44%"; Hit description =Putative SCARECROW gene regulator
  Pfam annotation: Domain name=GRAS; Domain location=264-571; Score =405.1; E_value=9.8e-119; Accession=PF03514.5; Description=GRAS family transcription factor
MDRRAVSSINTDQECPLDDTDSSSALFSYIKQMLMEDDTQESYSIFHDSLALQHTERSFYQVITHNYPPSSSSPHHQSPEQSLSVSSSDSSSSCSTNSTSSSADSPFRSLPPLLPHSTFPIPHNFFFHSNSTQSSINTTLGFFDNPLAEISDSAFLQQFERGVDQGTRFLPLHTTPFNINVDPNNTAFSSSFTKTKTPPPQMLIKTEAEGEPFLAGRKQRQREEYEADGRSRKQSAPYMDDSELSELFDKVLLGTGLGKGVPPDTTHETILTNMFGGDASKSDEEVVDLGTLLMLCAQAVASGSSPSFAKQLVMQIKQHSSPIGDETQRLAHYFGNALEARLDGTGYQFYSVLLSSKRTSAKDMVKAYRVYLSICPFEKLAVIFANNSICNLSEDAKTIHIIDFGIRYGFKWPALISRLSRRPGGPPKLRITGIDVPQPGLRPQERVLETGRRLANYCKRFNLPFEFHAIAQRWDTIRVEDLKIETDEFVAVNCLFQFEHLLDETVVLNNPRDAVLKLIKKANPDIFVHGIVNGSYDVPFFVSRFREALYHYSALFNMLDTNVGREDPIRLMYEKELFGREIMNIIACEGCERVERPQTYKQWQLRNMRNGFRPLPLDQRIIDKLKGRLRDDAYNNNFLLEVDGNWVLQGWKGRILYASSCWVPA

SEQ ID NO: 120650 - protein, 296 aa, Glycine max
  Coding DNA Sequence Number=SeqID_3872
  Gene Ontology: Mol. function=RNA methyltransferase activity; Cellular component=chloroplast; Biological process=RNA processing
  Homolog annotation: Hit_ID=Q94FY7; Match level="QueryCoverage=83%, HitCoverage=55%, E-value=6e-79, Identity=54%"; Hit description =Tocopherol cyclase, chloroplast precursor
  Subcellular localization annotation: CTP_CleavageSite=53; ConfidenceScore=5.33e-01
MEAKLWEARLFSPTLPLLPPTPRLPSLNLHFPSSSTSTLHLARNSVSDTVPIQNEEKEQTLSSVKPTYSPTLPNRDLRTPHSGYHFDGTTRKFFEGWYFKVSIPERRQSFCFMYSVESPSFRKPLTPLELAQYGPRWAYRVIVIEPPIDVQSSKLPVKRCVQLSVGNLMIECWKVFKSPPFGIKVLFAMMEGGETVKTARWEYSTRPVYGWGDVGSTQKSTAGWLAAFPVFEPHWQICMAGGLSTGWIEWDGERIEFDNAPSYSEKNWGGGFPRKWFWNNQLSIYLTSTRCKNSSP

SEQ ID NO: 120651 - protein, 67 aa, Glycine max
  Coding DNA Sequence Number=SeqID_3873
MDPNFIISGNDFDESKQWDLNGHYTNLLNDPLSDVGPLGFSHNSILNSEPFVSSSASAAAASSSTAT

SEQ ID NO: 120652 - protein, 253 aa, Glycine max
  Coding DNA Sequence Number=SeqID_3874
  Homolog annotation: Hit_ID=Q1RCT6; Match level="QueryCoverage=100%, HitCoverage=62%, E-value=3e-60, Identity=50%"; Hit description =Hypothetical protein ycgF
  Pfam annotation: Domain name=BLUF; Domain location=1-72; Score=79.0; E_value=1.5e-20; Accession=PF04940.3; Description=Sensors of blue -light using FAD
MVAKASLLNAEHHVTGILLFNGTHFFQILEGPEQGVLAIYARICADRRHHNVVELMRDYSPSRRFGNAGMELFDLRNHHSGSVLQAVLDRGTSKYQLTYDDRGLQFLRTFVEAREKENYFEVPPADCWEFIPAEGQSPAPASGVTFRPVVDPLGREVTAIEAIPHAQPAGLKEHERYIHDLNVVTDALHKAGQACPDGMTLYISILPMTLVYLPDAVSQLVSAIAQAELVPQQIILGVSETEVISRLEDFSTA

SEQ ID NO: 120653 - protein, 108 aa, Glycine max
  Coding DNA Sequence Number=SeqID_3875
MAGQQMGHHHACMNIIGWLANNYQRKTLLHHVFGDIGYKDVSRGCQNRPWMTLAKGRSNGIHLEGGIFVTTKKPQDDTVVNSVSSSKLFEAIRKKVSAIDVPLFSPIS

SEQ ID NO: 120654 - protein, 57 aa, Glycine max
  Coding DNA Sequence Number=SeqID_3876
MNGNKNNYGERISIIREIKMKRNYYEILGVHLDNNKALGPEEMLRWCQMRIGVLVMK

SEQ ID NO: 120655 - protein, 144 aa, Glycine max
  Coding DNA Sequence Number=SeqID_3877
CYKKIDVYPEPFVCPCGKHNDRAVLRYRVEVMVNYKDENTKFLLWNCECTELIGQSADEVNTLKIEDGDLDLNASPKALDKLLGHLFTFKVKIQPQYKNSTVLKCSSDLTLINDVLDMLPDVETCSKIEATTSFDSNDPVHDEC

SEQ ID NO: 120656 - protein, 275 aa, Glycine max
  Coding DNA Sequence Number=SeqID_3878
  Gene Ontology: Mol. function=sequence-specific DNA binding; Cellular component=nucleus; Biological process=regulation of transcription, DNA-dependent
  Homolog annotation: Hit_ID=Q9ZRY4; Match level="QueryCoverage=86%, HitCoverage=24%, E-value=2e-95, Identity=73%"; Hit description=NDX1 homeobox protein
MALPGVVDMNWQLLFQNAISLISALKELQGVTALDLNKLLRDSENFTIHYLTEKGSLLKIDMEKLAGSLPLHLTTLLMSGVRDEALFRYLLRGIRLLHSLCELASRNSKFEQILLDDVKMMEQLTDLVFYMLIVLGGYRQEYRAFSYMHLMHSTLVACNLHLLTAFVSTQWQDIVHVLLAHPKVDIFMDAAFGSVRMIVSFLENALVAYHEDISVESNLTAEQMVYYLCQQCEASLQFLQSLCQQKMFKERLLKNKVPKPILHSYFINLERELCP

SEQ ID NO: 120657 - protein, 259 aa, Glycine max
  Coding DNA Sequence Number=SeqID_3879
  Homolog annotation: Hit_ID=Q9AXP7; Match level="QueryCoverage=89%, HitCoverage=87%, E-value=5e-17, Identity=33%"; Hit description=PnFL-2
  Pfam annotation: Domain name=Zim; Domain location=123-158; Score =69.4; E_value=1.2e-17; Accession=PF06200.4; Description=ZIM motif
MSSFPNTVAEGRRSGKAPEKSTFSQTCSLLSQFLKEKRASADSTLGIGGKMEPKGISRKFVKLLVTRIADGGVVCLDLEIPANTKALLGSLQNSDGALKLSASAMEFLPQLVENPCIKKSRSPGPESPQLTIFYAGKMLVFDAFPPEKATEVMEMATKLASNNSGTEESPPSLPVTTEKLAVSKMPQTNTSSETPKPGNQGVGSDMRYPRRASLLKFLEKRKERVNARGPYQMNNLKPEGSSSGGEPEDQCSKQFDLNF

SEQ ID NO: 120658 - protein, 96 aa, Glycine max
  Coding DNA Sequence Number=SeqID_3880
  Subcellular localization annotation: CTP_CleavageSite=59; ConfidenceScore=5.07e-01
MALSEKGALSAIPTLEIINTLFSVKNTIFTLSSSPNATQTITPPSLPPMTTGGHHEPLLLAAEPPHQEEHFNRSGILLKDSMEKFSPILHFKASLR

SEQ ID NO: 120659 - protein, 60 aa, Glycine max
  Coding DNA Sequence Number=SeqID_3881
MVVLGTMHDGSRSKVECEGETTKEEVLVEDWKTYSHRQNSAKQVLESGGRKQIFVVVVYN

SEQ ID NO: 120660 - protein, 43 aa, Glycine max
  Coding DNA Sequence Number=SeqID_3882
MGDYRGSTNNKGAEGRRDQEQEEGDEANIPEGLPLRAILEERN

SEQ ID NO: 120661 - protein, 89 aa, Glycine max
  Coding DNA Sequence Number=SeqID_3883
MARAGDGGGDYHQLDESQCLLLDGVKLNVPTFKGRSDPDAYLDWEMKIEHGDAKEEYYKEMEMTLVRANIEEETKDTMAHFLSGLNPDI

SEQ ID NO: 120662 - protein, 140 aa, Glycine max
  Coding DNA Sequence Number=SeqID_3884
MCSWHLRSRGLTPTTNNFQDTRMSLYMCHTLVHMVLVDRLDATPITINHVQYCYIHWGFMSRWQLKWFEDISFYLGMEVPHNAQEFVVTPVRFDARDNILSWRFELVHLVWVTGEHGDHINMTLKEEKEYGASTRLRAFI

SEQ ID NO: 120663 - protein, 432 aa, Glycine max
  Coding DNA Sequence Number=SeqID_3885
  Gene Ontology: Mol. function=nucleic acid binding; Cellular component= lysosome; Biological process=regulation of transcription from RNA polymerase II promoter
  Homolog annotation: Hit_ID=Q2XPV3; Match level="QueryCoverage=83%, HitCoverage=91%, E-value=1e-154, Identity=73%"; Hit description =Oligouridylate binding protein-like protein
  Pfam annotation: Domain name=RRM_1; Domain location=180-251; Score =86.0; E_value=1.2e-22; Accession=PF00076.12; Description=RNA recognition motif. (a.k.a. RRM, R
  Pfam annotation: Domain name=RRM_1; Domain location=97-162; Score =25.3; E_value=0.00022; Accession=PF00076.12; Description=RNA recognition motif. (a.k.a. RRM, R
  Pfam module annotation: Pfam domain module=RRM_1::RRM_1; Domain location=180-251::97-162
MALKIMFKRHFVGVTVKLKPSLGVMTYDPCALSLRLSLGEKWHYSNLGKNIENCPFPPFLLPFRLYVREMRCIEPYPSGNLPPGFDPKIFAVLKSNSGVPKLPVTEPLLQEVFSGTGPVEGCKLIRKDKSSYGFIHYFDRRSAALAILSLNGRHLFGQPIKVNWAYASGQREDTSGHYNIFVGDLSPEVTDATLFACFSVYPSCSDARVMWDQKTGRSRGFGFVSFRNQQDAQSSINDLTGKWLGSRQIRCNWATKGAGGNEEKQNSDAKSVVELTNGSSEDGKETSNSDAPENNPQYTTVYVGNLAPEVTQLDLHRHFHALGAGVMEEVRVQRDKRVWFCECSWGSKPTPPGTASNPLPPPAAASLPGLSATDLLAYERQLAISKMGGVHALMHPQGQHHLKQAAAIGASQAIYDGGFQNVAAAQQMMYYQ

SEQ ID NO: 120664 - protein, 116 aa, Glycine max
  Coding DNA Sequence Number=SeqID_3886
LCNNQIAFLLLAPTSNNTDSPTIITIPNSLTTTTHIQKQQQQQNGLMTRWGWVQVDPRQGGIDDGGKVIDAIRIDNNGAWNSKGWVCMLSGGVVWGKWWHKSSAFGMPGWRRRLWI

SEQ ID NO: 120665 - protein, 192 aa, Glycine max
  Coding DNA Sequence Number=SeqID_3887
MAEQAKQVFYIQDPCDKRWSVVIHGKTIGLNIEDDDSTLDTCLTPFSTQMPSTWLHQPAYLLLLLLSQQHLFHCLRRRRPDEVEGPVVDVYPVTGKADGPHRKKLRTYLGIVARDKVDVTYDNWKQVHVAQKDMIWEDIQEGKDDKVYEKYGISKEKWAQFCKKWYRPFMGGCSKEGANHSETKHCSSRVVS

SEQ ID NO: 120666 - protein, 110 aa, Glycine max
  Coding DNA Sequence Number=SeqID_3888
MARTKKTSQMTSKAVKEITNRINVLTVAIGLSEHPDRVCAAEVGVNQMQSLIQSQGLTLPSKVEVSPFVARVNTKKSCMDPFGQHPETGVTTIHNVPLGNDQVKVGVEEV

SEQ ID NO: 120667 - protein, 68 aa, Glycine max
  Coding DNA Sequence Number=SeqID_3889
MQVVRVIGRLGSRNCHKVNLFAILVWLQISIIKECSWVIKRVNPPPLPKARWDELTHHESRLQKTLPV

SEQ ID NO: 120668 - protein, 486 aa, Glycine max
  Coding DNA Sequence Number=SeqID_3890
  Gene Ontology: Mol. function=cysteine protease inhibitor activity; Cellular component=intracellular; Biological process=defense response
  Homolog annotation: Hit_ID=Q1S339; Match level="QueryCoverage=95%, HitCoverage=49%, E-value=1e-133, Identity=52%"; Hit description =Proteinase inhibitor I25, cystatin; Disease resistance protein; AAA ATPase
  Pfam annotation: Domain name=NACHT; Domain location=201-348; Score= -26.3; E_value=0.0065; Accession=PF05729.3; Description=NACHT domain
  Pfam annotation: Domain name=NB-ARC; Domain location=163-460; Score =39.5; E_value=8.3e-13; Accession=PF00931.13; Description=NB-ARC domain
  Pfam module annotation: Pfam domain module=NACHT::NB-ARC; Domain location=201-348::163-460
MSHYLKEKGGPRLVIMGETKQLVTLLTQFQEAMRMVKDIVEKSRSSKTSKRLLRKTLKNMTPLLQEINQYNEHLDPPREEIDTLIKEKDAVEEIVCCYSCSRSIWWTKLFSWLPLYGDKFWNNKNYSLAADDNQVKYIKNTLYKVKEVLERLDIENFQLKLKGVGSPIKCPFGVPENPEFTVALDLPLSKLKMEVIRDGMSTLLLTGLGGSGKTTLATKLCRDEEVKGKFKENILFLTFSQTPKLKSIVERLFDHCGYHVPEFISDEDAIKRLGILLRKIEGSPLLLVLDDVWPGSEALIEKFQFQMSDYKIVVTSRVAFPKFGTPYVLKPLAHEDAMTLFRHHALLEKSSSSIPDEELVQKVVRYCKGLPLAIKVIGRSLSHRPIEMWQKMVEEFSQGHSILDSNIELLTCFQKLLHVLEDNPNIKECFMDLGLFPEDQRIPLPVLIDIWAVLYGYDDDGIEATDMINKLDSMNLVNVLVARYSD

SEQ ID NO: 120669 - protein, 214 aa, Glycine max
  Coding DNA Sequence Number=SeqID_3891
  Gene Ontology: Cellular component=nuclear pore; Biological process =transport
  Homolog annotation: Hit_ID=Q9LJH6; Match level="QueryCoverage=84%, HitCoverage=15%, E-value=6e-46, Identity=56%"; Hit description =Arabidopsis thaliana genomic DNA, chromosome 3, P1 clone: MAG2
MAMGTSPSYFDPHNLSSRQQFRRYGKRHSSSGASIQYDNSASKLSETGLLYDGQSIHSPTNAALVLENIKQEVESLDADYLEEKTPYSTRRKLSAVIDGVPGVDAGFDSGRYSLKACKTEGDSLGDGAETIFTLFASLLDSSLQGLMPIADLILRVENACRNVSESIRYGLNIRHRVVEDKLMRQKAQLLLDEAATWSLLWFLYGKGNISLTIY

SEQ ID NO: 120670 - protein, 204 aa, Glycine max
  Coding DNA Sequence Number=SeqID_3892
  Gene Ontology: Mol. function=porin activity; Cellular component =nuclear pore; Biological process=transport
  Homolog annotation: Hit_ID=Q2R0I9; Match level="QueryCoverage=87%, HitCoverage=16%, E-value=8e-77, Identity=75%"; Hit description =Nuclear pore protein 84/107 containing protein, expressed
MCDATLCDIPGMGLLKSIYLSQVSGTSHVVACEFVVEDHTAQLCLRIVQWLEGLASKALDLEAKVRGSHVGSYLPSCGVWHHTQRYLKKGNLDMNVVHHLDFDAPTRENANLLPDDKKQDESLLEDVWILLRAGRLEEACGLCRSAGQPWRASSLCPFGGLNTFPSVEALVKNGKNRTLQAVEFESGIGHQWHLWKWASFCASE

SEQ ID NO: 120671 - protein, 145 aa, Glycine max
  Coding DNA Sequence Number=SeqID_3893
MSALKEQMTSMMEAMLGMRQLMEKNVAIAAAVKWCDCNRHLLLAACTIETKGPIFTAMFTPLALIITAIFSALLWKETLYLGRFKFYSKSQNKHKIVGGTVLLVVGLYSVLWGKSKESVKEGVKGENLEVEQTKEETRLECIVKH

SEQ ID NO: 120672 - protein, 86 aa, Glycine max
  Coding DNA Sequence Number=SeqID_3894
MEVARGLSSSLTMEERMGVVVVTTVLVGACDRNRRGKCGNNNSMQQQQETTSQLQAVVSPPQVGSSSMGVSPSNQQTQPQASQKIF

SEQ ID NO: 120673 - protein, 1326 aa, Glycine max
  Coding DNA Sequence Number=SeqID_3895
  Homolog annotation: Hit_ID=Q7XEZ9; Match level="QueryCoverage=99%, HitCoverage=99%, E-value=1e-135, Identity=32%"; Hit description =Expressed protein
MGVSFKVSKTGTRFRPKCIPQLQDGASDNSKPQSDLVEAGENIAQIPRSSVSSETLSLADREASFTLNLFPDGYSIGKPSENEAANQSKYQDFPKLLHPYDRSSESLFLAIESGHLPGDILDDIPAKYVDGALICEVHDYRRCSSEKGGSVSAESSPTVSKVCLKMSLENIVKDIPSITDKSWTYGDLMEVESKILKALQPKLHLDPTPKLDRLCESPLPTKLNLPRKRLKNMPEFAVTSTNKIHGKKVCIDRVQESSINRLGDVGNTASNAIVQQTHENPAMQNLSPNVAMALRSKNFIPDSSIPNFPMMSHQSRYSMAVGTQRSLQEQGPTPSINSLGASPATQDVMISYAENANSGASLLGKRDNQDGQASPLSNIAKRMRPASTVLDAMQHQQIGSHVEALQGSDMNWQNTLQQQAMARIQYASGGIQKFPQQAFEGGANQETGAIPFASSQQQGMRLVAKEEQFEMEKLDGAEINRNKSEMEMEMNNLDPQQLRIQQRLSQHAFMRSNFPQAAWNSLGQPMEKETKKEDQLQKRKSVQSPRLSTGALPHSPLSSKSGEFSNGAVGPSFGQSAMAAVPGTSQKDKTAMVSVPATVGTPSNDSTQRQHAQLAAKRRSNSLPKTPAMNGVGSPASVGTTSVPLNANSPSVVTSGLVDQNLQNMLERFSKIEMVTMRHQLNFKKNKVDDYPIKKQNPYAQNNLAALLANATNNEGLPEESISLSKSLIGGSMNACKMRILTFCVPERVVQGSVVTIIPRMRTRMIIFEKSDGTVAMHCGEIEEVDYVAAEDHLLTLPNTFDYVAAQDHLLTLPNTHSADLLVQQFCSLMVREGFVKEDDRIQLKPNRVNLPLGNQSTTPNNAVVEMQQYGEAIPGQSSNEVAKPTSGSNAPVNLSQNLVTNPRMLPPGNPQALQMSQGLLSGVSMASRPQQMDSQQAIQQQQQQQQQQQQQQQLQQNQHTLIQQQNPQFQRSPMMLGTNQLSHLNPVGQNSNMPLGNHMLNRPSALQLQMFQQQQQQQQQQQQQPQMQRKMMMGLGQAVGMGNLRNNLVGLAPMGNPMGMGGVRGIGGSGISAPMTSIAGMGNMGQNPMNLSQTSNITNSISQQFRSGSINAAASADLLSKLRLVHQNRQGMLGSSQSNIASISGARQIHPGGTPSLSMLGRANTMQRPIGPMGPPKIMAGMNLYMSQQQQQQHQQPQPQQQQQQHQQQLQLQQHMQQQLQQQQQQETTSQLQAVVSPPQVGSPSMGIPPMNQQAQQQASPQQMSQRTPMSPQMSSGAIHAMNAGNPEACPASPQLSSQTLGSVSSITNSPMDMQGVNKSNSNAQ

SEQ ID NO: 120674 - protein, 497 aa, Glycine max
  Coding DNA Sequence Number=SeqID_3896
  Gene Ontology: Mol. function=nucleic acid binding
  Homolog annotation: Hit_ID=Q1RWN3; Match level="QueryCoverage=60%, HitCoverage=95%, E-value=4e-59, Identity=40%"; Hit description=Zinc finger, CCCH-type; DNA-binding SAP
  Pfam annotation: Domain name=SAP; Domain location=103-137; Score =33.9; E_value=5.6e-07; Accession=PF02037.17; Description=SAP domain
  Pfam annotation: Domain name=zf-CCCH; Domain location=375-400; Score =29.0; E_value=1.7e-05; Accession=PF00642.15; Description=Zinc finger C-x8-C-x5-C-x3-H type (and similar)
  Pfam module annotation: Pfam domain module=SAP::zf-CCCH; Domain location=103-137::375-400
REFHSSRTTKYLPPELHEITTESDSDSDWDDSEEDPDFHLLEETHSKFSNLSLKHKAKAGLISWQFGVCIVFEDKDLGEEVNASAHDGDTFEEVQKLIQLGRLEKLKVDECKLYPRKNGLRLTGNKDTLIQRIKKHLEILNGGVKKYPPSSFVLNCKELDFPASGPPCGKRIGAGHIVQESYGATKQQHTFPIWEDESQRQKILMEKHSRGSLAREDREARIQEKEKRKKTKENRYLISDLKSLLTLFICQHKGKKHSSIVNKPAAVTGRHGDSKTLGRASFTVHNMHNQQAWNRTGDCRNISDIGHMRRGADLSVCYNYADPHFRDKPTIIQKYHPFMDETSGFTVGTHLHHRMPLANANHSQPVMPNRESYNKQKQVCRHYARGKCYFGDNCKFLHDLRDKRECVNLKILLWHVFIHVVELKRLGVFGLPDIQDFVMFPSLSPFSVTPNGLCRTYNLAIILIFYPDLLTYELKGILATSLYSAKKNLYLSLCMFL

SEQ ID NO: 120675 - protein, 616 aa, Glycine max
  Coding DNA Sequence Number=SeqID_3897
  Gene Ontology: Cellular component=nuclear pore; Biological process =transport
  Homolog annotation: Hit_ID=Q9LJH6; Match level="QueryCoverage=99%, HitCoverage=58%, E-value=0.0, Identity=61%"; Hit description =Arabidopsis thaliana genomic DNA, chromosome 3, P1 clone: MAG2
  Pfam annotation: Domain name=Nup84_Nup100; Domain location=1-578; Score=305.2; E_value=1.2e-88; Accession=PF04121.4; Description =Nuclear pore protein 84  107
KIADQGGKCEAAVYAAQCSNLKRMLPLCNDWESACWAMAKSWLDVQVDLEITRSLPGGVDQLRTFGDVIDGSPGNADGSFEPSNGPENWPIQVLNQQPRQLSSLLQKLHSGEMIHEAVTRQCKEQQRQIQKTFQFVGIISPKFFVLSHRPSGDPQMIRFGAHLVLVLRYLLAEEMKDTFKDKILSEHEELVGIYASQLARHRCIDLFVHMMELRLHNSVHVKYKIFLSAMEYLPFSSMDDSKGNFEDIIQRSREIKVGKYDNLSDVAEQHRLQSLQKAKVIQWLCFTPPSTITNVKDVSKKLLLRALIHRVPAMPIGAHTVLGFLAEPLKQLAETLETSEDYNVFEDLREFQDWREYYSCDATYRNWLKTEVENAEVPISELSLEEKERAISAAKETLSASLSLLKRKETPWLASTDCMYESAEPVFLELHATAMLCLPSGECLCPDATVCTTLTSALYSSAGDEVVLNRQLMVNVSISSRDSYCIDVVLRCLAIAGDGLEPHDLNDGGILGTIMAAGFKGELPRFQAGVTMEISCLDAWYSDKDGTLECPATYIVKGLCRRCCLPEVILRCMQVSVSLMGSGVLPDCHDTLIELVGSPETDFLHLFSQQQLQARL

SEQ ID NO: 120676 - protein, 73 aa, Glycine max
  Coding DNA Sequence Number=SeqID_3898
MYQTYMQMLSIGYLQPEEQESFSLFCNFRQVAIGNCEKEVANKSSAMKHGCDARLQDRLLRSSWEGKHRRSEN

SEQ ID NO: 120677 - protein, 117 aa, Glycine max
  Coding DNA Sequence Number=SeqID_3899
  Gene Ontology: Mol. function=nucleic acid binding
MKTKFYAINPKKMMRKKLSMVAYILVSKQWEIRKLYETHTCSNPSISQDHPKLQYLLTSKSIHTLIENDPSTSVLALISLSKSTKGYTTMYRKAWLEKKKVIENIYDNWERSFHDLP

SEQ ID NO: 120678 - protein, 100 aa, Glycine max
  Coding DNA Sequence Number=SeqID_3900
MKDSILGPIVEVGAFGGFFFSRIQVHGLAFFERTSALCSPSTLKLSVLHLSIISSKLEHGFRLTQASSQLSTSSPSPPYLEVHPVGHWIVDRAGAIRLRS

SEQ ID NO: 120679 - protein, 268 aa, Glycine max
  Coding DNA Sequence Number=SeqID_3901
MGTSIGLPKVNTSLSEKEENHSLEEFEKEEESVFPPSGESLVEFLSKKQKAEKRNMLKTSWRKHQRMKRDAILEMQQKNGVRPLVFNGITKGPPLGFKKKILSKEREDKEVIIDCFESGFEDSLEAICGVISILPAKYAKDYQNRHNFVVFDPPTNDMRGHMKLLHLTSTVEDQIINKILVYGGTAFNILPRSMLRRFGRNVEDLIPHNIVMKRDKALATTTPFKIDDSFYVNNKLGEDKNKFFCWDLTKGFLLINMAIEKMAKVEEL

SEQ ID NO: 120680 - protein, 121 aa, Glycine max
  Coding DNA Sequence Number=SeqID_3902
MRIKRSFKVVMGPRTRYGKIWNKWLNPKGIEEQWGITFEKQHHIQHVQHLTNMQLSFKTRKGKQGSKGLSKELIQGKSIWLEAYKNKIASIISKYACELGSINKNQAKAIVQTINGAKHTK

SEQ ID NO: 120681 - protein, 154 aa, Glycine max
  Coding DNA Sequence Number=SeqID_3903
MKADMEAMKEQMTSMMEVMMSMRRMMEVNLVTVVAASTATELDPSHPPGFNQVNHLASDMVGQGGKALGSTGGPHFVQVQSTHSFPPYGLPPNYTPFNVAHIPDENVDNSAPIPIESQHPQFGHAQVSQLMGETHEAPRDHNLVDFGPHVGYAA

SEQ ID NO: 120682 - protein, 110 aa, Glycine max
  Coding DNA Sequence Number=SeqID_3904
MSLSLNNLSLILVLLISMSTFATNGALSKTNNTLSDLKAQAEALILSANDIDGLLTCFLCPSNVFGPDDYSNPASAPDRASSIKWKEPSIELSGNLCYLVKLYSVNRRLV

SEQ ID NO: 120683 - protein, 46 aa, Glycine max
  Coding DNA Sequence Number=SeqID_3905
MAVVGTTAHALHHSLTVIGVFYATPPYVGPCGLNNLKRDRLRMQKK

SEQ ID NO: 120684 - protein, 174 aa, Glycine max
  Coding DNA Sequence Number=SeqID_3906
MANSNLFFPLLIFLNLVIANATISKSLDLKILHHQGFSIQERGEVKTHANTNMFNNIASKVLPILPKGHVPHPIPLHGRGSPISHGSPACLSDGCNIGVRSYANKYVVNNIKTKEFHVPHFIPLRGQGSLIFDGSPTCLSDGCNIDAKAPAHKYVANNIKIKKLHFPHLVPLHG

SEQ ID NO: 120685 - protein, 50 aa, Glycine max
  Coding DNA Sequence Number=SeqID_3907
MEQYRPMTNTFPIIQSLSVHVVKDRGSNNMSNMKQPKAKAWSLRKSLNEL

SEQ ID NO: 120686 - protein, 60 aa, Glycine max
  Coding DNA Sequence Number=SeqID_3908
MESPPMFIQGKRWKNQKVKVEGLRILKRRVQESFTHREGLTRVFPSLLRILGCDEEFRST

SEQ ID NO: 120687 - protein, 105 aa, Glycine max
  Coding DNA Sequence Number=SeqID_3909
  Subcellular localization annotation: CTP_CleavageSite=54; ConfidenceScore=5.14e-01
MTENFSLHNWLSVIGTRLAPNTYISNNGLASNTSLALCMPQRIALSWARRGLARGSQQKYLSKRTRQLLSHDVHNEDEHSTTWLNSLSACMLAKRVHLEMYMFKA

SEQ ID NO: 120688 - protein, 535 aa, Glycine max
  Coding DNA Sequence Number=SeqID_3910
  Homolog annotation: Hit_ID=Q2QYH0; Match level="QueryCoverage=22%, HitCoverage=17%, E-value=4e-22, Identity=46%"; Hit description =Expressed protein
  Pfam annotation: Domain name=DUF936; Domain location=1-533; Score =517.1; E_value=2e-152; Accession=PF06075.3; Description=Plant protein of unknown function (DUF936)
MASLIPGVLLKLLQSMDSDVKVNGEYRSVLLQVISIVPAITGSELWPNQGFFLKVSDSSHSTYVSLSKEDNELILNNKLQLGQFFYVDRIEAGTPVPILVDVRPVPGRHPFIGNPKDLMQLLEPSEGPVQSDHNHRVNRSKSMNSTKSKESKSPRQKIVIKEEKAAVASRYMRGVRSPTSNVNVQDANEERKGNDFENGVDSKKVASAKVKLKKLQTLSVNTTRSLQLEIPSPRQRVAQSNIQENVMSPKRISAKRNSTKQETTNLNVLSSSEDKSYSTEAIPWSSLPASLLRPGKELLRRKHLASQVAVEAQREVTATAVLVKFLSMFANICASAASENPHGTLNKFFSFQELMDQSNFTSTTPHKDKSLQLYKFSSPTETDKTDKKSDLVPGKSSSKSPKYSPELSEAEKQEWVTGNGLKEINELREALLIETRSWFLKYLEKTLDVWFSTSSRDKRGKMSKDSAGRQMEHANNIALTLSHLKQANEWLEKLRSTSNLENDELVETVDRLKQKVYSCLLLHVDSAAFALENRA

SEQ ID NO: 120689 - protein, 572 aa, Glycine max
  Coding DNA Sequence Number=SeqID_3911
  Gene Ontology: Mol. function=ATPase activity, coupled to transmembrane movement of substances; Cellular component=integral to membrane; Biological process=transport
  Homolog annotation: Hit_ID=Q1RWN5; Match level="QueryCoverage=99%, HitCoverage=73%, E-value=1e-139, Identity=57%"; Hit description=ABC transporter, transmembrane region, type 1
  Pfam annotation: Domain name=ABC_tran; Domain location=379-538; Score= 147.7; E_value=3.2e-41; Accession=PF00005.17; Description=ABC transporter
MAHFIHHIFTFICGYAVGFKRSWKVSLVVFSVTPLTMFCGMAYKALYGGLTAKEEASYTKAGSIAEQGIGSIRTVFSFVAERQLTGKYAELLQKSAPIGDRVGFAKGIGMGVIYLIMYSTWALAFWYGSILIASNELDGGSAIACFFGVNVGGRGLALTLSYFAQFAQGTVAASRVFYIIERIPEIDSYSPEGRKLSGVRGRIELKSVSFAYPSRPDSLIFDSLNLVLPSSKTLAVVGASGGGKSTIFALIERLYDPIEGIITLDGHDLRTLQVKWLSALCHIYSGLRVDNYSYAKASNMLLEQIVKSFERTLSEPRRKSLSSQLQGLMFGLFQDLSKFSVEQLAGLAPDTSMAATAIPAVQDIIKRRPLIGNDRTEGGSTVALVGPSGSGKSTVIWLTQRFYDPDHGKVMMSGIDLREIDVKWLRRQIALVGQEPALFAGSIRENIAFGDPNASWTEIEEAAKEAYIHKFISGLPQGYETQVGESGVQLSGGQKQRIAIARAILKKSRVTKEATTIIVAHRLSTIREADKIAVMRDGEVVEYGSHDKLMASGQNGLYASLVRAETEANAFS

SEQ ID NO: 120690 - protein, 780 aa, Glycine max
  Coding DNA Sequence Number=SeqID_3912
  Gene Ontology: Mol. function=potassium ion transporter activity; Cellular component=membrane; Biological process=potassium ion transport
  Homolog annotation: Hit_ID=Q1RWL9; Match level="QueryCoverage=99%, HitCoverage=100%, E-value=0.0, Identity=58%"; Hit description =Immunoglobulin/major histocompatibility complex; K+ potassium transporter
  Pfam annotation: Domain name=K_trans; Domain location=57-780; Score =1185.4; E_value=0; Accession=PF02705.7; Description=K+ potassium transporter
MSVEADSLGMEGDNDTWKETPKNHLMKERTDSLNLEAGRVSMTSTHFSKLDWRTTLSLAFQSIGIVYGDIGTSPLYVFSGIFTNGIHHNEDILGVLSLIIYTIVIIPMIKYVFIVLHANDHGNGGAFALYSLICRHAKVSLIPNQQPEDKKLSHYRLETPSHNLNRAQKLKQKLENSYFARVVLVLVTMLGTSMVIGDGIFTPSISVLSAVSGISTSLGQEVVVGISIAILIALFSLQRFGTDKVGSSFAPILLVWFSFIAGIGIYNLFKHDIGVLRAFNPKYIFDFFKRNGKQGWLSFGGVLLCITGSEAMFADLGHFSVRAIQISFSFVVFPSILIAYIGQAAYLRKFPEKVSNTFYASIPDHLYWPTFVVAVAAAIIASQAMISGAFSVISQAQSLGCFPRVKVVHTSTKHRGQVYIPEVNFMFMIACIVVTAAFKTSEKMTHAYEKYMGGALFLPVGCIELLYLSSQLTKFTKGGFVPLLLAFFLTIFMGIWHYVQKERYMFELKNKVSSEYVRQLANNANINRIPGIGLLYSELVQGIPPIFPHFIASIPSIHSIVVFVSIKAIPIATVALEERFLFRQEWPREYRIFRCVVRHGYRDVLGDHVVFESQLVQQLKEFIRQESFMVESEGTTTGEQEPIPANEDEMADMQQGFSSTINVTSAQEGKARTSSSSASARVIPDQGAIVVSRASSDSVQPLGVTKGVEEEIKFIEKAMESGVVYMLGEAEVVADPKSSIFNKIVVNYAYSFLRKNFREGDKSMAIPRNKLLKVGMTYEI

SEQ ID NO: 120691 - protein, 125 aa, Glycine max
  Coding DNA Sequence Number=SeqID_3913
  Gene Ontology: Mol. function=protein binding; Cellular component =integral to membrane; Biological process=vesicle-mediated transport
  Homolog annotation: Hit_ID=Q1RWM9; Match level="QueryCoverage=93%, HitCoverage=56%, E-value=2e-52, Identity=88%"; Hit description =Synaptobrevin
  Pfam annotation: Domain name=Synaptobrevin; Domain location=58-125; Score=24.8; E_value=0.00027; Accession=PF00957.11; Description =Synaptobrevin
MCDRAYPKKLAFQYLEELRNEFERVNGSQIETAARPYAFIKFDTFMQKTKKLYQDTHTQRNIAKLNDELYEVHQIMTRNVQEVLGVGEQLDQVSQMSSRLSSESRIYADKARDLNRQAQTAYPCR

SEQ ID NO: 120692 - protein, 693 aa, Glycine max
  Coding DNA Sequence Number=SeqID_3914
  Homolog annotation: Hit_ID=Q8GRM2; Match level="QueryCoverage=96%, HitCoverage=48%, E-value=1e-101, Identity=38%"; Hit description=COP1- interacting protein 7 (CIP7)-like
MKQVLETQDNARATSTPPLEQQHQRVRQSKGNQGMHDELKMKADELEKLFAEHKLRVPGDQSGSVRRVEPADVHVEQSQYRRGGVGESTPQLPSRSNVIEVAASSSNLTSFDAKLVTKMVDSQNYGDALRQNFSDLNLSEDSRGKFYEKYMKKRNAKLQEDWSMNRAEKEARMKAMQDSLERSRAEMKVKFSGSANRQDSASGAYRAEKLRYFKSNIKKEQHPIDSLQNEDDEDLSEFSEEKTYGASRQSRKFFPNRHISSGTPRTIAVSVSRSSGGRRRDDPLAQSVPNFSDLRKENTKPSSAVSKTTRTQVRTYSRSKSTTEEIQGVKEEKSRQTLSLRKSSANPAEFKDLSHLNSDGIVLSPLKFDMGESHLGPYDQSPRSFLKKGNNIGSGSVGNAIRMKASMVSDTQKNKEFDDLEFDEEDSLRMATEEQDDIETMAIKDVAYNNNGKVSLSQESGKSGNSGSEIGDSTRSLAQVDPISGGEMATGFPSTFNGVRSLQDSPVGSPVSWNSRVPHPFSYPHESSDIDASIDSPIGSPASWNSHSLNQGDNDAARMRKKWGSAQKPFLVANSSQNQPRKDVTKGFKRLLKFGRKTRGSESLADWISATTSEGDDDTEDGRDLANRSSEDLRKSRMGFSHGHPSDDSFNENELFNEQVQSLQSSIPAPPAHFKLRDDHISGSSLKGDPWVT

SEQ ID NO: 120693 - protein, 513 aa, Glycine max
  Coding DNA Sequence Number=SeqID_3915
  Homolog annotation: Hit_ID=Q8GRM2; Match level="QueryCoverage=69%, HitCoverage=28%, E-value=4e-75, Identity=46%"; Hit description=COP1 -interacting protein 7 (CIP7)-like
MKSDTLLDYAVFQLSPRHSRCELLVSSDGHTEKLASGLVKPFLTHLKVAEEQVALAASSIKLEIDRHKNAETWFTKGTFERFVRYVSTPEVLEMVNTFDAEMSQLEAARRIYAQGAGDQRSDPQGGNGAGAITVADATTKELLRAIDVRLSAVRQDLTTACARASASGFNPHTVSHLKHFADRFGAHRFNEACTKYMSLYKRRPDLISHWPGGDDRELRSSVSSDMSIDNDDGPNQAQDQAQPIDPPKPKPISNFASLRRSNTSVSSKDETSDTPTKEETESPAPAPTTAPSGRRLSVQDRINLFENKQKENSGGRAPELRRLSSDVLRRWSGASDMSIDGSGEKKDFDSPLPPPASSVSETKSVVVSEDKVRIDKSEKFVITDQGSSQETGKVSVFDEDKNGGFKDQVGGGVSEATLKKGSSEVVIVGPMLSSGDDDAKFYGGMKNHVVAPSLIRGSRSHSRSLSAQFEGGNGLKFRDVSVRVDQSSPNEVEDSSSSSSFPNKEEDSQIPKM

SEQ ID NO: 120694 - protein, 389 aa, Glycine max
  Coding DNA Sequence Number=SeqID_3916
  Gene Ontology: Mol. function=DNA binding; Cellular component=nucleus; Biological process=regulation of transcription
  Homolog annotation: Hit_ID=Q9LJG8; Match level="QueryCoverage=69%, HitCoverage=74%, E-value=7e-36, Identity=57%"; Hit description =Similarity to DNA-binding protein
MKRVNWAYRWRPRKQIGGEEDMDDDDEIQSHPSPASGSPPSSPRANGRITVTVAAPAPPPPPNSLALALPIQQPAKGNGGGGGGGGGREDCWSEGATAVLIDAWGERYLELSRGNLKQKHWKEVADIVSVREDYTKAPKTDIQCKNRIDTVKKKYKSEKAKIAAGATSKWPFYDRLEQLIGPSAKIPGVGGASGTSAAGNSNLQPQKVPLGIPVGVRGGANQFNHPHKQPQPVPLKNQKIQFRRRGPPVESDSEERDASSPASSDSFPPESFERKRPRLMSSNTTKGSGERRKAKGWGSAVRELTQAILKFGEAYEQAESSKLQQVVEMEKQRMKFAKDLELQRMQFFMKTQVEISQLKLGRKGGNPSNNHHGTTNNNNSNHNNNSGSE

SEQ ID NO: 120695 - protein, 137 aa, Glycine max
  Coding DNA Sequence Number=SeqID_3917
MSVGNPGHGGLLGRNVNNDESYQIKLDKARHNIVSAFVKYYENGEESFEELQQLFEDMFQADIGLDGGPSLASSDSSTSSAYMTYSESSSSNKRNSSEMNFGKAENSSVFDASYQNFCFGLYAKKVLNWLREKIGKR

SEQ ID NO: 120696 - protein, 189 aa, Glycine max
  Coding DNA Sequence Number=SeqID_3918
  Gene Ontology: Mol. function=phosphopantetheine binding; Cellular component=chloroplast; Biological process=fatty acid biosynthetic process
  Homolog annotation: Hit_ID=P52412; Match level="QueryCoverage=56%, HitCoverage=78%, E-value=2e-16, Identity=46%"; Hit description=Acyl carrier protein 2, chloroplast precursor
  Pfam annotation: Domain name=PP-binding; Domain location=45-111; Score=63.1; E_value=9.4e-16; Accession=PF00550.15; Description =Phosphopantetheine attachment site
GSSMFGELKLVNKVQLKRATKTSFALSGGINTIISCSTAELETLQIVQSTIAKQLSIDEATVTPQTKFSDLGADSLDTVEIMMALEEKFDISIGEGGAENISTVQDAADLIEKGVRGVVGAEGAEVVVVVPKPDWERTMVMLRLIGTCSATVDRTELPPENELYFRSFPTRVSVLDPPTFRPIVCEENP

SEQ ID NO: 120697 - protein, 169 aa, Glycine max
  Coding DNA Sequence Number=SeqID_3919
  Gene Ontology: Mol. function=protein kinase activity; Biological process=protein amino acid phosphorylation
  Homolog annotation: Hit_ID=Q2QZ78; Match level="QueryCoverage=70%, HitCoverage=21%, E-value=3e-24, Identity=50%"; Hit description=AT hook motif-containing protein, putative
MLLSNNINNPKNVWAETWEWLLDGILFEQRRALHIPASSGITSLLLLGGRTAHSRFKIPIPTLDNSIYNIHQGSELAALLKMTRLIIWDEAPMAHKFYFKALDKSLRDIMKTNSNEPKFFGEKFVVFGGDFRQILSIIPRGSRSDIVHATANASYQWDSCDVLTLTKNM

SEQ ID NO: 120698 - protein, 175 aa, Glycine max
  Coding DNA Sequence Number=SeqID_3920
  Gene Ontology: Cellular component=mitochondrion; Biological process =protein folding
  Homolog annotation: Hit_ID=Q5JM48; Match level="QueryCoverage=90%, HitCoverage=72%, E-value=5e-62, Identity=69%"; Hit description=Auxin- induced-related / indole-3-acetic acid induced-related-like
  Pfam annotation: Domain name=CIA30; Domain location=52-175; Score =43.6; E_value=6.8e-10; Accession=PF08547.2; Description=Complex I intermediate-associated pro
MVEAVATVGGGGDREREMSRLRRLIQASVDATKKVISGNLDDLMPPPERPIFSFNSKQELSKWHLYSDSEFGGGITESENGATSGIFSGNLSLDVSEGSKWNITRSGFCGMRSKKFDGFIDLDSYDTIAMKLKGDGRCYISTIYTENWVNSPGQMEDNSWQAFVYVPEGNWYITK

SEQ ID NO: 120699 - protein, 120 aa, Glycine max
  Coding DNA Sequence Number=SeqID_3921
  Homolog annotation: Hit_ID=Q652J3; Match level="QueryCoverage=69%, HitCoverage=36%, E-value=7e-07, Identity=36%"; Hit description=Auxin responsive protein-like
  Pfam annotation: Domain name=Auxin_inducible; Domain location=1-98; Score=17.8; E_value=4.8e-07; Accession=PF02519.5; Description=Auxin responsive protein
MGARESKLRKWVMSSGSAYYYKRLEGTLLVPKGYVPICVGKTEDTCKWFMVHTRALGDAYFQELLVRSVEGYGFRNEGVLRIQFEAQDFEEWLIKRSKSNEKITYKRTKYRLNMEMSITR

SEQ ID NO: 120700 - protein, 533 aa, Glycine max
  Coding DNA Sequence Number=SeqID_3922
  Gene Ontology: Mol. function=oxidoreductase activity; Cellular component=membrane; Biological process=electron transport
  Homolog annotation: Hit_ID=Q9C788; Match level="QueryCoverage=95%, HitCoverage=99%, E-value=0.0, Identity=75%"; Hit description =Cytochrome P450, putative
  Pfam annotation: Domain name=p450; Domain location=44-529; Score =162.7; E_value=9.7e-46; Accession=PF00067.12; Description=Cytochrome P450
MKDKPNLTLVAPFRDLCKMGGLMILICMVVSWMFIHRWSQRNKKGPKTWPFFGAAIEQLMNYDRMHDWLVNYLSKSKTIVVPMPFTTYTYIADPANVEHVLKTNFNNYPKGEVYHSYMEVLLGDGIFNVDGESWKKQRKTASLEFASRNLRDFSTKVFKEYALKLSTILSQVSFLNQEIDMQELLMRMTLDSICKVGFGVEIGTLAPNLPENSFAHAFDTANIIVTLRFIDPLWKIKKMLSIGSEAQLGKSIKVIDDFTYSVIRRRKAEIEDIKKSGQQNQMKQDILSRFIELGERNATDKSLRDVVLNFVIAGRDTTATTLSWAIYMVMTHAHVADKLYLELKKFEENRAKEENISFPQCDKEDPESFNRRVEQFSRLLNKDSLEKLHYLHAVITETLRLYPAVPQDPKGILEDDELPDGTKIKAGGMVTYVPYSMGRMEYNWGPDAASFVPERWYRDGVLKTESPFKFTAFQAGPRICLGKDSAYLQMRMVLAILFRFYKFNLVPGHMVKYRMMTILSMAYGLKLTIERRS

SEQ ID NO: 120701 - protein, 113 aa, Glycine max
  Coding DNA Sequence Number=SeqID_3923
  Gene Ontology: Mol. function=nucleic acid binding
MQGSIHPLPALISLSKSTEGYTTMYRKAWLEKKKVIENIYDNWERSFHDLPRLLQAIYQFFHGMVMEKKTLPMPPQGGQTVEGFVKFHRLFWSFRLCINGFQYCKPMIQVDGT

SEQ ID NO: 120702 - protein, 525 aa, Glycine max
  Coding DNA Sequence Number=SeqID_3924
  Homolog annotation: Hit_ID=Q9C660; Match level="QueryCoverage=36%, HitCoverage=25%, E-value=1e-70, Identity=68%"; Hit description=Pto kinase interactor, putative
  Pfam annotation: Domain name=Pkinase_Tyr; Domain location=398-524; Score=-108.1; E_value=7.7e-06; Accession=PF07714.7; Description =Protein tyrosine kinase
  Subcellular localization annotation: CTP_CleavageSite=22; ConfidenceScore=5.78e-01
MSAASPSPATSTAAPPLQTPPSSNNTSPSPSTATTPPLQQTPPSTSPPQQPASPPPSTPSPANPPPSSPPSSPPPPMSGTPPPLVPPPSPPPSPPPSTPAAQPAVPPSSPPPPPSPSPSVPSSPPPSNPRNNTSPPPSPPPQPPAPPPQPPAPPANNTSPPPQRNSPPPPAATPPRTSPPQTSPSPPAAPPPRNSTRLPPPVNSPPPPVDAPPPRSSSPPAPAPSTPPSRTSPPPTPSSQPAPPSNSTPRSSPPSPPSITNLAPSPPSRILSSPPPPPAQNGTENSSPDGGGDGIGIGGVVAISVVAGFLLLGFIGVLIWCMRRKKRKVLVSGDYVMPSTLASSPESDSSFFKTHSSAPLVQSGSGSDVVYTPSEPGGLGHSRSWFSYEELIKATNGFSTQNLLGEGGFGCVYKGCLPDGREIAVKQLKIGGGQGEREFKAEVEIISRIHHRHLVSLVGYCIEDNKRLLVYDYVPNNTLYFHLHGEGQPVLEWANRVKIAAGAARGLTYLHEDCNYQSLLFYSWS

SEQ ID NO: 120703 - protein, 54 aa, Glycine max
  Coding DNA Sequence Number=SeqID_3925
MGGSRLSKPKSGSASGSTNCFMLYARALSITWGDTPEYWIWVQQKETRKLGIGG

SEQ ID NO: 120704 - protein, 66 aa, Glycine max
  Coding DNA Sequence Number=SeqID_3926
GFCGFQRGQCGFFGSVGGSVASTDDNVGVEGAVFGRFQAGGERGAISGRRMTKRRGRARFSSTCGL

SEQ ID NO: 120705 - protein, 102 aa, Glycine max
  Coding DNA Sequence Number=SeqID_3927
LNLGGLSKLSLVQQEGSEDDAWIDSVQLGIEDLEAAITPEEEPQSSEASSSFPMAEYEACALGVQAVIDFNVKLIKVYGDSALVIHQLRGEWETIDHKLIPY

SEQ ID NO: 120706 - protein, 110 aa, Glycine max
  Coding DNA Sequence Number=SeqID_3928
  Gene Ontology: Cellular component=integral to membrane; Biological process=photosynthesis
  Homolog annotation: Hit_ID=P49179; Match level="QueryCoverage=99%, HitCoverage=62%, E-value=1e-54, Identity=87%"; Hit description =Photosystem I assembly protein ycf4
  Pfam annotation: Domain name=Ycf4; Domain location=1-110; Score=97.2; E_value=5.1e-26; Accession=PF02392.7; Description=Ycf4
MAFYGIAGGGFDIFNKKGKKVRFVRWGFPGKNRRIILEIPMNELHSIRIITEVKEEGIFTRTSTFESIVYLETIEQGFIPLTRIEDNLNGTQIAHKAGELSVFLGVPLFY

SEQ ID NO: 120707 - protein, 288 aa, Glycine max
  Coding DNA Sequence Number=SeqID_3929
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=31%, E-value=1e-157, Identity=86%"; Hit description=DNA -directed RNA polymerase beta chain
  Pfam annotation: Domain name=RNA_pol_Rpb2_6; Domain location=35-288; Score=276.3; E_value=5.9e-80; Accession=PF00562.18; Description=RNA polymerase Rpb2, domain 6
MSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAG

SEQ ID NO: 120708 - protein, 142 aa, Glycine max
  Coding DNA Sequence Number=SeqID_3930
  Gene Ontology: Mol. function=nucleic acid binding
MAEDHPQRMTLEDYSSLATPQYFTSIARPDVQATNISYPHSLIQLIQGNLFHGLPSEDPYIRTPGHIHRDLQHGEDSKSEAKRWLHSFKGNSLRTWEEMVEKFLKKYFPKSKTAEWKVEISFNHVEENRNNNSSTLNKSVHK

SEQ ID NO: 120709 - protein, 314 aa, Glycine max
  Coding DNA Sequence Number=SeqID_3931
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=5e-34, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Extensin_2; Domain location=23-314; Score=-131.8; E_value=0.037; Accession=PF04554.4; Description =Extensin-like region
AFRGLHAVTFRGQHVLPLRGLHAVAFKGLHVLIFRGLHVLALEDYTSPPSEGYTLSPSLGYMFSPSEGCTTSPLEDNTSSPSEGYMPSPSEDYKSLPSEDYTSSPQEGYTPSPLEGYMPSPSEDYTSSPSVGYTPSPSKDYTSSPSEDYTSSASEVCTPSPSEGYTISPAEEGQHVLPLKGLHAVTFKGLHVLIFRGLHVLALEDYTSPPSERYTPSPSLGYMSSPSKGCTTSPLEDNTSSPSEGYTPSPSEDYKSLPSEDYTSSPPKGYMPSPLEGYMPSPLEDYASSPSKDYMSSPSVGYRPSPSKDYTSSP

SEQ ID NO: 120710 - protein, 296 aa, Glycine max
  Coding DNA Sequence Number=SeqID_3932
  Gene Ontology: Mol. function=DNA binding
  Homolog annotation: Hit_ID=Q1SFS3; Match level="QueryCoverage=51%, HitCoverage=29%, E-value=7e-18, Identity=33%"; Hit description =Lambda repressor-like, DNA-binding
MAEVSIEAIASLTQYYDQPLRCFTFGDFQLTPTVEEFEEILECPLGGRKPYPFSGFYPSLSRISKIVKISTQELDRGKQVENGVVRVPRKCLEAKARVLASQGECALFMDILALLIFGVVLFPNVDGLVDRAVIDAFLAFYDRKESPIVAILADLYDTFHRRCEKNNQTKKKRLSIGSPYTQDLDWLPSLRTTKGVEVEAPEEDEEVQALKIELEKAQTVKEKFKSAAVRIRKENTELRDVNIATTKALEQETKRALREEHDRNKFQGALWGSNSELKLQREERDQSRINGLILKG

SEQ ID NO: 120711 - protein, 74 aa, Glycine max
  Coding DNA Sequence Number=SeqID_3933
MVSIQIKTLNEKAWLKLKVVSATASTGLISGNRMELLDHWLVCEMYMNSASAEALVIHDSDMCWTTNSTHTYGP

SEQ ID NO: 120712 - protein, 104 aa, Glycine max
  Coding DNA Sequence Number=SeqID_3934
MMYEEVDMNVENEKDKVVEEEEAPRRRWNKKQEAEEEGRKLNKRGRKSIYGGIMTHTDEPLFDYIAKDEGHYSPFIWHEVHSKAVTNFSLMIREYMMVTDGMTN

SEQ ID NO: 120713 - protein, 693 aa, Glycine max
  Coding DNA Sequence Number=SeqID_3935
  Gene Ontology: Mol. function=DNA binding; Cellular component=nucleus; Biological process=transcription from RNA polymerase II promoter
  Homolog annotation: Hit_ID=Q6YU01; Match level="QueryCoverage=76%, HitCoverage=61%, E-value=3e-79, Identity=67%"; Hit description=CCAAT- box-binding transcription factor-like protein
  Pfam annotation: Domain name=CBF; Domain location=195-427; Score =131.3; E_value=2.7e-36; Accession=PF03914.7; Description=CBFMak21 family
MVTSKVGKRHALTGFEALQELFIASLLPDRKLKTLIQRPLNHVPETKDGYSLLLFWYWEECLKQRYERFVVALEEASRDMLPALKNKALKAIYVLLSRKSEQERRLLSALVNKLGDPDNKAASNADFHLSNLLSDHPNMKAVVINEVDSFLFRPHLGPRSQYHAVNFLSQIRLTNKGDGPKVAKRLIDVYFALFKGVNRAFPFVSSNEADDIVDIQTPAEMFIALLLRAMKRDVNLRRVAAFSKRLLQIALQQPPQYACACLFLLSELLKARPPLWNLVLQNESVDEELEHFEDVIETDNEPNSLSNNQNNDIGVVQNGEDANSDTSSSESEDDLPASSEDDDSDDDASEDADFLLAKNEKEHEKQKKSKSVSDKGQQSQLSPKSSLPGGYDPRHREPLYCNADRVSWWELMVLASHAHPSVATMAKTLLSGANIVYNGNPLNDLSMTAFLDKFMEKKAKQSTWHGGSQIEPAKQMDVNNQLIGAEILSLAEEDVPPEDLVFHKFYTNKMSLSSKPKKKKKKSADEEAAEELFDVDNGEVDGGDESDNEEIENLLDSTDPTLGPDSDYDYDDLDEVADEEDEDLIGDVSDAEINSEMDIDIPSDIDEEETDDAPIDDDDDDNIDIQVGDVDDASDADEEEVGKRKRKHKRGGKSGVSPFASYEEFEHLMEDDDHTEKKPSSKKNKSKSKKRKT

SEQ ID NO: 120714 - protein, 322 aa, Glycine max
  Coding DNA Sequence Number=SeqID_3936
MEEATGTIFANQTAKLRWGDEVKMRSTVTFQFDGESLLIGKVEGGFEGFDSKDKGDGEKDEVDGKELEEEIGAGFSYWEEAKRVGRAWRKTGHEVLMLKSGMVLKKLGDLEDPTQGDEGVTGCVWFMKLVNKFIKLEGHIMKCFTKRYLVCSELGDGLLESVRVGLGPSGFCHLDMTTRAPNCLNSRKVKKRTWLRGWMKWRKASGVLCDAKVPIKLKGKFYRTAVRPTILYGTECWAVKSQHENKVGVAEMRMLRWMCEKTGRLCSEESRPDGEKTNNSRQRKTQKDYKRAFLIHNLTRIAMMLEDPKNTTHCIHKVAEKY

SEQ ID NO: 120715 - protein, 149 aa, Glycine max
  Coding DNA Sequence Number=SeqID_3937
  Gene Ontology: Mol. function=chromatin binding; Cellular component =chromatin; Biological process=chromatin assembly or disassembly
  Homolog annotation: Hit_ID=Q1SAV4; Match level="QueryCoverage=96%, HitCoverage=40%, E-value=4e-27, Identity=41%"; Hit description =Integrase, catalytic region
MLTNREAIFAEIRKKLLKAQVIMKQIADTKRRDVNFNEGDWVMLNKRYYGPYKVVERTGKATYKLELLEGARIHPVFHCSMLKPFHHFTDDSNTPLPLPAIVLNNQPIIAPLVILGTHQDPVCVDSKLQVLVQWEGLSPNNTTWRIGIN

SEQ ID NO: 120716 - protein, 116 aa, Glycine max
  Coding DNA Sequence Number=SeqID_3938
  Gene Ontology: Mol. function=RNA-directed DNA polymerase activity; Cellular component=chromatin; Biological process=RNA-dependent DNA replication
MTHEPFKWSSTAQTTFDTLKAALTMTLVLLLPDFTLPFTLETDASGVRMGTVLSKNGHPIAFFGKKFSPKLLRASTYVQELFAITITIKKWRHYLLGHHFTIIIDHRSLKELLTQQ

SEQ ID NO: 120717 - protein, 112 aa, Glycine max
  Coding DNA Sequence Number=SeqID_3939
MVVNLDTSPVICREEEDKHKIYTGSATNRAYIQSPSNLRFLRFLSTLCTLYLYHKGCTLQCVRTKNSQAISPLNICKEKQKISQAGQERHKRIQAVSPSVLLAKGEENEKDE

SEQ ID NO: 120718 - protein, 158 aa, Glycine max
  Coding DNA Sequence Number=SeqID_3940
  Gene Ontology: Mol. function=nucleic acid binding
  Homolog annotation: Hit_ID=Q1SKJ3; Match level="QueryCoverage=79%, HitCoverage=14%, E-value=3e-30, Identity=51%"; Hit description=Zinc finger, CCHC-type; Endonuclease/exonuclease/phosphatase
MAWQGEKAEVDGMFRLGERKKTVIPVDSNVHSSHHKFAKVYFLTNPSKYPSICLKSVSIYVDRFSNYRIQTKEKNFIIVDRVKAGKMNSGQVIVYGVTFCNEIYSPNFGNPVVVKKHPWAATHGLLPIFKRIKFHHKIVVPNITKIKPLSKQKIIFFS

SEQ ID NO: 120719 - protein, 95 aa, Glycine max
  Coding DNA Sequence Number=SeqID_3941
  Subcellular localization annotation: CTP_CleavageSite=44; ConfidenceScore=5.01e-01
FSLPRFVFFIGLLPSSLLAGRHKLWFSILVPSLRLLHWLSVSISAAIEVSVLTPLALVICLNRVNGLRIEDIVVVWCWRLKTKFFCEKKLLPPVC

SEQ ID NO: 120720 - protein, 72 aa, Glycine max
  Coding DNA Sequence Number=SeqID_3942
MASAFSELLTFVIRRMRRPLLVLLCLTALYPALTTACPFLSYSPQYSSSVVNIYGNFDEKGAKEMRPKRKKM

SEQ ID NO: 120721 - protein, 155 aa, Glycine max
  Coding DNA Sequence Number=SeqID_3943
  Gene Ontology: Mol. function=sugar binding; Cellular component =integral to membrane
  Homolog annotation: Hit_ID=O81865; Match level="QueryCoverage=75%, HitCoverage=48%, E-value=8e-30, Identity=50%"; Hit description =Lectin like protein
MANIPKKRLTYPENDYACDGLKNIINRKIKSKIGTIVELAKLKRVCWLEVHGKFDTRKLSLGILYQVSFLIMLEESSQGWEVPINVRFVLPGGKRQQHKVNLNEKLRESWMEILVGEFVASEKDAGEMEISMYEYEGGMWKTGLVIQGVVIKPKN

SEQ ID NO: 120722 - protein, 113 aa, Glycine max
  Coding DNA Sequence Number=SeqID_3944
  Gene Ontology: Mol. function=ribonuclease H activity
  Homolog annotation: Hit_ID=Q1SLA3; Match level="QueryCoverage=94%, HitCoverage=8%, E-value=8e-10, Identity=30%"; Hit description=RNA -directed DNA polymerase
MVKGKPNHNTNLLKDMELPQPLKRSNGGIRNLKIYKGEPFISRSRSVTSIARVAPNSSVNETLSQSRFHFQDEVNEIVGQGGSDIPKIPMIIPDNVLHAHGINIVHIGDFFGK

SEQ ID NO: 120723 - protein, 142 aa, Glycine max
  Coding DNA Sequence Number=SeqID_3945
  Gene Ontology: Mol. function=RNA-directed DNA polymerase activity; Biological process=RNA-dependent DNA replication
  Homolog annotation: Hit_ID=Q2HRG4; Match level="QueryCoverage=53%, HitCoverage=5%, E-value=3e-11, Identity=47%"; Hit description =Ribonuclease H
  Subcellular localization annotation: CTP_CleavageSite=53; ConfidenceScore=5.07e-01
MKTSFTTSGIAPMQEKSGLGWASFQGQSFSAPILESPPSGSLKLNVDGSCLLESSSIGAGGVICDHTYNWIVGVYSFDGLGDSAKAEIMALRHGLILAWDKGFRNILCEMDNKNMVDIFNNNCCPDFHPHIAVVLIVLELIN

SEQ ID NO: 120724 - protein, 43 aa, Glycine max
  Coding DNA Sequence Number=SeqID_3946
MTSTKVVIRASSNFSQIKTSPRNYGYKFLWVLHLKILILALRW

SEQ ID NO: 120725 - protein, 195 aa, Glycine max
  Coding DNA Sequence Number=SeqID_3947
  Gene Ontology: Mol. function=transferase activity; Cellular component= cytoplasm; Biological process=autophagic vacuole formation
  Homolog annotation: Hit_ID=Q2MGR6; Match level="QueryCoverage=96%, HitCoverage=57%, E-value=5e-84, Identity=74%"; Hit description =Glutathione S-transferase, C-terminal-like
MARFSLDEISDTGAFVRSASTFRNWISRDLNSQFPPESGRCLAYLNIKGLNKAISFSAVKPIFERTNESDDYKGWVFPESETEVPGAEPDMLNGAKTIRELYEIASANYTGKYTVPVLWDKKLKTIVNNESSEIIRMFNTEFNSIAENPTLDLYPTDLKPQIDDTNEWIYTSINNGVYKCGFAKKQEPYNEGIYC

SEQ ID NO: 120726 - protein, 62 aa, Glycine max
  Coding DNA Sequence Number=SeqID_3948
MVAIDDSKQKQKLFVGVLFLEFSAGDLVGKPELSEARDLNCEDGFKFNKGEAAEQCCCCRWS

SEQ ID NO: 120727 - protein, 96 aa, Glycine max
  Coding DNA Sequence Number=SeqID_3949
MDYKTLYHFLQIANDKDQQDSPQQNAPFSYSDSDSDYSYNEAEDEAFHCAFGQHDDGDNSSSMENPNRDDPEVNFRAFSEALESPAMKEFHNGVFA

SEQ ID NO: 120728 - protein, 487 aa, Glycine max
  Coding DNA Sequence Number=SeqID_3950
  Gene Ontology: Mol. function=RNA-directed DNA polymerase activity; Cellular component=chromatin; Biological process=chromatin assembly or disassembly
  Pfam annotation: Domain name=rve; Domain location=290-446; Score =123.8; E_value=4.9e-34; Accession=PF00665.16; Description=Integrase core domain
  Pfam annotation: Domain name=zf-H2C2; Domain location=235-272; Score =10.2; E_value=0.016; Accession=PF09337.1; Description=His(2)-Cys(2) zinc finger
  Pfam module annotation: Pfam domain module=rve::zf-H2C2; Domain location=290-446::235-272
MDKSLKVGEDEWRERERKGTEFMPQMSQSFSDHLKHLRTALQTLADNNFVLKLSKCSFATQQVEYLGHLVSEKGVEPVPAKVAAVQQWPTPQSTRALQGFLGLSGFYRRFIKGKPLCSKLLRASTYVRELAAITATVKKWRQYLLGHRFMILTDHRSLKELMAQTVQTPEQQELKTELASNQEFLNRRQQIKDEPHNLQDWVIRDDLILHQGRIWLPPRLRLILTILAEFHSTPTGDHMGVMKTLARVRENFVWTSMKQDIHHFVTSCAICQQTKTDHRRSPGLLCPLHILARPWEDLSLDFIVGLRPYHGNSVILVIVDRFSKGLHLGTLPQHHTATRVARFFMEISDKLHEMPKSLVSDRDPLFVSHFWQELFKLSGTKLRMSSVYHPQSDGQIEVMNRIIEQYLRAFVHQQPATWGRFFMWAEWSYNTSIHSATGMSPYEITFGKKPPCLPQYLEGTSKVEAVDEWFNQRDRIITSLVKKLSKA

SEQ ID NO: 120729 - protein, 308 aa, Glycine max
  Coding DNA Sequence Number=SeqID_3951
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=75%, HitCoverage=15%, E-value=2e-49, Identity=43%"; Hit description=Chromo
MNLLLQNASQPPGSSPNNGSPMISINASLPVKEILLGFPHFDGTTPVMEWIFKAEKFFTYHNTPDTSRVDIVAMHFDKDVMAWFQMSQKLSLVSTWSELTHALESQFSPSPFDCPMAELFKLQQTGLVSDYYLKFMSLANRSLGLSNEALLNCFISGLNPDIRRDVVAMCPPTLLRAVVLAKIFEEKYGHVYKPFQNSYSHKYSQISSTPISINAQPKTQIKSSLLSLLPTPSGPPIRSSNVKKITPAEMQLRREKGLCYFCMRNSLLIINVLIDNFCCCKWKMIMRITIVPQGTHVGPDCLGLANRK

SEQ ID NO: 120730 - protein, 330 aa, Glycine max
  Coding DNA Sequence Number=SeqID_3952
  Gene Ontology: Mol. function=chromatin binding; Cellular component =chromatin; Biological process=chromatin assembly or disassembly
  Homolog annotation: Hit_ID=Q1SAV4; Match level="QueryCoverage=58%, HitCoverage=90%, E-value=1e-30, Identity=51%"; Hit description =Integrase, catalytic region
  Pfam annotation: Domain name=Chromo; Domain location=245-295; Score =19.4; E_value=0.005; Accession=PF00385.14; Description='chromo' (CHRromatin Organisation MOdifier
MAPLPSRSPIYNPHRPSKPEGSHVQGKIWLSTDNPFTTLLMDEFHKTPLGGHMGVAKTLHHLQANFVWPQMRKAVHQYVAQCTICQQTKYEPKKPTSLLQPLPIPSSLWKDLTLDLSLAYPPLMDSRKVPTSMRYHLTTQPTESPSSSSTWCANYMDFPKVWFWIATPFSSMHFVKAVYTKLSKRYYGLFLVEERIGPVAYRLQLPTNSKIHPVFYVSLLKLHQGPFPDIPDSLPPLSSDNHPIVKPLQILDSKWDSSTNPPSKLVLVQWTGLAPEDTSWEQWDNLCVTYNLGDKVSFEDGGDDSNNNSLVTTNRPRRTTRRPTHLSDYP

SEQ ID NO: 120731 - protein, 89 aa, Glycine max
  Coding DNA Sequence Number=SeqID_3953
  Gene Ontology: Mol. function=transferase activity; Cellular component= cytoplasm; Biological process=autophagic vacuole formation
  Homolog annotation: Hit_ID=Q2MGR6; Match level="QueryCoverage=83%, HitCoverage=21%, E-value=9e-38, Identity=92%"; Hit description =Glutathione S-transferase, C-terminal-like
MVPQHCDGVGGIEYTIHFKCNKKLLREYPNLFNYTKDIFQIPGISSTVNMEHIKLHYYGSHPSINPFGIVPVGPNIDYSAPHDRERFSA

SEQ ID NO: 120732 - protein, 99 aa, Glycine max
  Coding DNA Sequence Number=SeqID_3954
MTKDYNHMLNHINSRDNLIIINKIMDIIRSSLVLAERLYEQPLLSTVLPLMTSSKKSNLLLLMNNFNNKNMDEYVDNQQEAGNLPDVELVDTDDINCPF

SEQ ID NO: 120733 - protein, 560 aa, Glycine max
  Coding DNA Sequence Number=SeqID_3955
  Gene Ontology: Mol. function=RNA-directed DNA polymerase activity; Cellular component=chromatin; Biological process=chromatin assembly or disassembly
  Pfam annotation: Domain name=RVP_2; Domain location=172-299; Score= -56.7; E_value=0.026; Accession=PF08284.2; Description=Retroviral aspartyl protease
MDVYERVSQFLASYALSLGILQKGTVNDYLTKFKRLVNRIVGLASPFILSCFIFGLTLELRCEVQALQPLSLPQAMALAKLQKDKSHNRCHSFRPHSFSLLLPAPLGPVPTAAPRFPIKRLSMEELTIRHDKGLCYHCDEKWILGDPPDGDISRKDYPASPTASDDPPEVPRFSQISLNVLSGMPAPKTFKFFGTIAHHYVIILIDSGSMHNFVQSQAAKFLNLPSTLCVMVGNGSTLDFDTSCPQIPIDIQGHTFTIDLFSLPLSGADIVFKVQWLKLLGPITTDYVTLTMTFSYLGQPISLQADVPFKPTIASAQQVKRLAHTHNISALFHITHIPDQAHFYSLRTPDPDTSTPPTIDLLFCHFDDIFQEPSQLPPHRNIAHNIHLVPNSTLAGLIQPSYNPFSSPVLLVKKKDSSWRCCVDYRALNAITTNDHFPMPTIDELLDELGRVMPFGLCNAPSTFQATMNDLLQPFFAEIHGGKFSLCRTKCLFAVQKLNYLAHIVSPQGFYQKFVRGYATVAAPLIVLLREDQFLWNPTSQVTFDKLKSLMAEAQPWELF

SEQ ID NO: 120734 - protein, 190 aa, Glycine max
  Coding DNA Sequence Number=SeqID_3956
  Gene Ontology: Mol. function=hydrolase activity; Biological process =protein folding
  Homolog annotation: Hit_ID=Q7CJR2; Match level="QueryCoverage=74%, HitCoverage=56%, E-value=3e-43, Identity=63%"; Hit description =Putative carboxylase
  Pfam annotation: Domain name=AHS2; Domain location=57-190; Score= -69.8; E_value=1.8e-06; Accession=PF02626.6; Description=Allophanate hydrolase subunit 2
QTGIYPLAAPGGWQLIGHTSLSLFDPQQQPPTLLRPGDSVRFVPQREGDRGRHGWRQYGISLSGALDEPSMRTANMLVGNAENSAVLEIVLGQFKAEFRRDGWFALTGASCSAELDGQPVWTGWRLPVKKGQVLSLSMPTRGWRSAAAGQADAPLQPSGWRTAAAVGQPHPRTAGAGVQRIYPRRAGRIL

SEQ ID NO: 120735 - protein, 72 aa, Glycine max
  Coding DNA Sequence Number=SeqID_3957
MRYLHRRSICGTRCLDSPPGRLSIQGIPKAEIHHRHLTRLSRSPSLLLSIKNPLMKVTRRVEAMRGVSTSRA

SEQ ID NO: 120736 - protein, 197 aa, Glycine max
  Coding DNA Sequence Number=SeqID_3958
  Gene Ontology: Mol. function=RNA-directed DNA polymerase activity; Biological process=RNA-dependent DNA replication
MGEIVIVKAYQKQARKCYIESLKIAPYPPTREPAKPYPAAAEGLKPIKELVMLQLKPKLEQCTQLSKDLTSHEHRGIIDVLHKNMDLFAWPPSDMSGITLVLPATSLPFVPRQNRACPKDAYPLPNIDRLVDGASEFQVLSFLDAYFENNQIKMHTPNEEKMIFITEDVNFSYRVMPFNLKNASATYQRLMDRIFKQ

SEQ ID NO: 120737 - protein, 400 aa, Glycine max
  Coding DNA Sequence Number=SeqID_3959
MVDVDKVDFWTSYVGLRVTFVRRTRGRACKTKDSDAQGSKELDTYRSGMELRVLVCRGRYSPWPDVRASVLGLAWRVDTCLGVPYCLMSSAMALASRRVTSLSSPQAWTSVVQAKSNVLGERDELVKVVADLEAWLKELESRLEEFEHRAAKEREASKELAMYKKKAVEQHEKDFQKAVRQDVKDGVLLDLGHHDESEIFDGIGSKTLWGGGKTLVGGASFLLWGAFPLIDTWLKVLSTDLLIGCLGLWTFSTDGYEEYVWLAPGWRSCQLVWGVALRLTKDGLGFCEPGLTKGELWFNELGTHGVACTGVVAACSCTHVTHGVARTGVVAACSCIRVTRGVLHTGGMVACSCIRVTHGMGSPWVVLGFEEPWSYDYGCTCLDKKVMKGKGCRISFNVFD

SEQ ID NO: 120738 - protein, 108 aa, Glycine max
  Coding DNA Sequence Number=SeqID_3960
  Gene Ontology: Mol. function=RNA-directed DNA polymerase activity; Cellular component=membrane; Biological process=RNA-dependent DNA replication
MADLEEIFRELHKYDMGLNLKKCTFRVGEGNFLGFMITHIGIEVNPNKCTAILEMCNPTNVHEVQKLNRRLASLSRFLPKLAEKAKSLYKLLKKTESFLWDETCEQAF

SEQ ID NO: 120739 - protein, 166 aa, Glycine max
  Coding DNA Sequence Number=SeqID_3961
MESHLPMFKEKNHQLEVATELIRGQHPHLKGFYIVIDDSPMQCCMGLNIGLYKANKKIKLNVAKMRLLKWMSTYKTRWDDECYKEKVGVTPIVKKMLESLLREQKPASNMHEEYGSRRLTRLRNALGRKVVKLRTRHVTKHPSVQAHPSFVALVIYNLIKLIIPEA

SEQ ID NO: 120740 - protein, 80 aa, Glycine max
  Coding DNA Sequence Number=SeqID_3962
MVLGYNDLVHDGVWMMPHLFRSLCLALIWCGRNLRGLKVRTFLDSLEDGTEDDPNLFKRLVVGGDDIVENTTDIIQDKDC

SEQ ID NO: 120741 - protein, 78 aa, Glycine max
  Coding DNA Sequence Number=SeqID_3963
  Homolog annotation: Hit_ID=Q657G7; Match level="QueryCoverage=51%, HitCoverage=6%, E-value=7e-07, Identity=60%"; Hit description =Putative CRS2-associated factor 2
MVWVWMWMPSTASTRRRDVGTLQRCLPSPQSWHCRQHKGRERRLMDGDQLHLRHLRVAELELEQHFNIVEEKKAPQPW

SEQ ID NO: 120742 - protein, 59 aa, Glycine max
  Coding DNA Sequence Number=SeqID_3964
MSEGENEEKLGCTRTSEGVLVELHRHIRGGLHDNGGSNTERVRRRIGSERSGKRVWNAL

SEQ ID NO: 120743 - protein, 64 aa, Glycine max
  Coding DNA Sequence Number=SeqID_3965
  Homolog annotation: Hit_ID=Q948I2; Match level="QueryCoverage=61%, HitCoverage=3%, E-value=3e-07, Identity=62%"; Hit description =Putative transposable element
  Pfam annotation: Domain name=DUF1723; Domain location=16-59; Score =31.7; E_value=2.7e-06; Accession=PF08330.1; Description=Protein of unknown function (DUF1723)
MEATTLLWKQDCHKASKIQNMRWRPETHTFHLPVRECTITLEDVAPKLGIRVDSRLVIGATHYE

SEQ ID NO: 120744 - protein, 96 aa, Glycine max
  Coding DNA Sequence Number=SeqID_3966
MAAIRDENGSDCLVGIFGLTCLSIEPVPAPFLCLAVARGSTGNSNFCSNGCKPQRELTKLKRCYCCMDLDGRTPLSTKRKPTLAMVVVEAVASMVV

SEQ ID NO: 120745 - protein, 622 aa, Glycine max
  Coding DNA Sequence Number=SeqID_3967
  Homolog annotation: Hit_ID=Q8S8Q2; Match level="QueryCoverage=94%, HitCoverage=97%, E-value=0.0, Identity=69%"; Hit description =Expressed protein
MNQNRLDLRAHHSGSTQSEESALDLERSYYGHPNPSCPSPLQPFAGGAQHSESNAAYFSWPTLSRWNDAAEDRANYFGNLQKGVLPETLGRLPTGQQATTLLELMTIRAFHSKILRRFSLGTAIGFRIRGGVLTDIPAILVFVARKVRRQWLNHVQCLPAALEGPGGVWCDVDVVEFSYYGAPAQTPKEQLYTELADGLRGSDSCVGSGSQVALQATPKEAATKVASQETYGTLGAIVRSRTGNREVGFLTNRHVAVDLDYPNQKMFHPLPPSLGPGVYLGAVERATSFITDDLWYGIFAGTNPETFVRADGAFIPFAEDFNMNNVITTVKGVGEISDVNIIDLQSPINSLIGRQVVKVGRSSGLTTGTIMAYALEYNDEKGICFLTDFLVVGENQQTFDLEGDSGSLILLTGQNGEKPRPVGIIWGGTANRGRLKLKVGQPPENWTSGVDLGRLLDLLELDLITTNEALQAAVLEQRNGSAAGIDSTVGESSPTVPIKEKLEESFEPFCLNIPLAQVEDEPSQRVNPSIRPCDFHIKSEIETAPNVEHQFIPSYAGKSPACQSYLKEDMELKSLAELRNGPDEDNFVSLHLGEPEMKRRKISNSSFCIKELKNARPLACGA

SEQ ID NO: 120746 - protein, 114 aa, Glycine max
  Coding DNA Sequence Number=SeqID_3968
MVLSLLLLFSLWGFWPPRWEAHPTWSTHPKAPAVTMGLVFEGDNGVGKWAKTEEKLLKETILELTLGSGGGQIHCRHEHGGFVCWMGGGVRCGCAQLPCWVCLGAVTMWGAFVI

SEQ ID NO: 120747 - protein, 312 aa, Glycine max
  Coding DNA Sequence Number=SeqID_3969
  Gene Ontology: Mol. function=hydrolase activity, acting on ester bonds; Cellular component=cellular_component; Biological process =lipid metabolic process
  Homolog annotation: Hit_ID=Q9FLN0; Match level="QueryCoverage=97%, HitCoverage=80%, E-value=1e-74, Identity=50%"; Hit description=GDSL -motif lipase/hydrolase-like protein
  Pfam annotation: Domain name=Lipase_GDSL; Domain location=33-306; Score=107.0; E_value=5.6e-29; Accession=PF00657.12; Description=GDSL- like LipaseAcylhydrolase
MSILAFYLSYFILISNYSLSQSSICLPKNHTALFIFGDSLFDVGNNNYINSSTFLQANFPPYGETFFNYPTGRFSDGRVIPDFIAEYATLPLIQAYLSPAGFQDHYIYGVNFASAGAGALVETNQGLVIDLKAQVKYFTEVSKQFRQKLGDEEAKKLLSRAIYIFSIGGNDYGTPFLTNLTSGAVLPCPQQKFVDYVIGNITAVIKEIYNEGGRKFGFVNVGPLNCFPLLRMAINSTSLSACLEEEASAIARLHNNALPKMLHGLEKQLKGFKYSVTDFYGALIELMKYPSKYGFEEGNACSLLWRWSLQRR

SEQ ID NO: 120748 - protein, 88 aa, Glycine max
  Coding DNA Sequence Number=SeqID_3970
MKIREMFFLSVQNLVRKGEDMQLAGAIGEFGDKVTAGTGLASGVSAFRVGCRKRCRKGGSFKQLKTPVLLAICAAVGVASSTGELSFK

SEQ ID NO: 120749 - protein, 95 aa, Glycine max
  Coding DNA Sequence Number=SeqID_3971
MDVVGALKRQVRVLYGCSGRRGGGKMVDKEFPWYRTRLASGSGYSQNQSQGIELDVHREKVCVETKGMSLAEVVVSGRLCGEDAMERGGLAGGVD

SEQ ID NO: 120750 - protein, 432 aa, Glycine max
  Coding DNA Sequence Number=SeqID_3972
  Gene Ontology: Mol. function=nucleic acid binding; Biological process= DNA integration
PKIYPKAHENLRAFSCISGPIFLESSIQYPWGMNDKPFGSALGNLMYAQRAAKKVIRYLLKTKEYMLVYRRVDNLEFVGYTNSNLSGCPNDRRSTSGYIFMMDGGVISWNSKKQFLVASFTMQAEFITCFSTVTHVNNKTSKGSKHLELKHLTVRDLVKDVSIVVEHVDIDFMLANPLTKELRPVVFKRHVENMGIVSSFDMLVFEEITNAKDFLDKLEKCFAKSDKAETSTLLQHLISMKYNKKGNIREYIMEVSHIVSKLKGIKLELSEDLLVNLVLISLPVQYSQFKPSLKHFHIWGCMVEAQPYRSKEKKLVCKTISSYFIGHSEHSRGYKFWDPTLKTIFEDVEFRRNKAIIPIVVQEVNAEPKQDNVEQIPIEQPQQQVPLQQSIRERKNTIPDDYIVFLQEHDGDNGMMTDDPINFHQAMKSTNS

SEQ ID NO: 120751 - protein, 330 aa, Glycine max
  Coding DNA Sequence Number=SeqID_3973
  Gene Ontology: Mol. function=nucleic acid binding; Biological process= DNA integration
  Homolog annotation: Hit_ID=Q1SDG1; Match level="QueryCoverage=45%, HitCoverage=17%, E-value=2e-32, Identity=40%"; Hit description =Integrase, catalytic region; Zinc finger, CCHC-type
VHLLGDCYTENKREYISCGSVLVEGTSTWFFKENKGGYIPCGSLACKGFYKVERNLKNRLVAWGLDVGTGCGRTRRYYVHDEDTVVYYLCSKVWHRASKCKDQPRKDVLDNNKQTPIMVPRQWLLTADDSIKVYVQKGKIIRMDKIDNLGKSDSKSDNGTFFEYSETSKAFMVYNFITLVVEEAIHVKFNDTRSDKDLSQIDKPFIDMRLDNDIKDKVSSMEPKHINEAMQDENWLKATQEELDQFQKNEVWKLVELPKDRKVVGANWVFHNKLDENGKVVRNKVRLVAKGYSQQEGNILDSQVIVMLTMLEISLKGRAQVEVVTSLVAT

SEQ ID NO: 120752 - protein, 114 aa, Glycine max
  Coding DNA Sequence Number=SeqID_3974
MTPTHDALLYYNGRWNMPRQNEFVGYSFIGKNPKKFDIPSRCTIDELKDLIKRISPHGIPPYGIHESQTLCTEWVTALLENDNVYSTLHSNATGGKGQWSRNNTCYITTVVIER

SEQ ID NO: 120753 - protein, 431 aa, Glycine max
  Coding DNA Sequence Number=SeqID_3975
MEITTIQSDDKPTIHVEHFIDFIELEKVGVKLNETLLFCAIVSKVLGVKVNLSSDSIAKAAGCLCEGNTYHEGILQDSETLKRVAWGLDVGTRDDDDDDDDDNVQLALRKRKENAQKQAFLAPKKARAANKEWTLPSPPSSSSNETTREASISPWRMCPSSTEQHPPPSPINPEISAMRAYSKSNQAIAYPPGLHISKATEIKIVADRVFPRLPIWHAAKKKCFKLYYYVEMPSRQMKDVDSYDFITKLKNLPIIFHETTYDLTKMDERDLKDHAEVVTKVVDDNIVNEVIIYLTNSGVMDEGPDVSKETQADEVISQQKELASKKSETSHEATSREKDVLDAVIVYSTSSSPTLINYAPPNVVIRDQVQDIIIVAPLIVVLTIATPPDRPPLSLQQPPTLEQQLTTSVPFVDVEPTPPPEQPPLPSQVQE

SEQ ID NO: 120754 - protein, 156 aa, Glycine max
  Coding DNA Sequence Number=SeqID_3976
MAKIQEQCKNGVKLFFLASASNNPPPPPPVTTEVAVHNETPVELVIKVHRLHYLLTNPQIPPRYASLADRNTGNVSSEFLLWEQQAQLLSWLQSTISGEVLPHLIVYFVPATEHVDNILDGLPDEFESLVTLISCRFESLTIDEVETLLARETRIE

SEQ ID NO: 120755 - protein, 262 aa, Glycine max
  Coding DNA Sequence Number=SeqID_3977
  Gene Ontology: Mol. function=hydrolase activity
  Homolog annotation: Hit_ID=Q5FAL6; Match level="QueryCoverage=82%, HitCoverage=61%, E-value=9e-64, Identity=55%"; Hit description =Putative Expressed protein
  Pfam annotation: Domain name=DUF1637; Domain location=18-262; Score =221.0; E_value=2.6e-63; Accession=PF07847.3; Description=Protein of unknown function (DUF1637)
MIAKLKGCFEELICGNLACCWILMSLILSNYSMNIEKYDSGQLLSDTIQPADVGLKEEIADDDRGHGFFGANALSRLARWAQPITYVDIHECDSFTVSFTIYYTPVTPLLPLHCCKLHVYARVCLLKYVSFLSSEYWYQMCIFCFPTSSVIPLHDHPGMTVFSKLLYGSLHVKAYDWVEPPCIIESKEPGYAQVRLAKLAVDKVLNAPCDTSVLYPKHGGNLHCFTAVTPCAMLDILTPPYREEEGRRCTYYHDYPYSAFCK

SEQ ID NO: 120756 - protein, 136 aa, Glycine max
  Coding DNA Sequence Number=SeqID_3978
MKICEGFMYGESLVIDLEFDLELKIWSLKDIPLKEGVEIFTLDDEIFYKIPHNFCPGIDPTTIRHDHGSPQHSTSTVTPFGKNTLSSLMLRTGRVGCRGRVGLRGKRKGGIGKVGRQRERERGKRVGGAEGKGKEI

SEQ ID NO: 120757 - protein, 46 aa, Glycine max
  Coding DNA Sequence Number=SeqID_3979
EKAAKLNVENNKRDIPRIEESFCKAWDEGGGDPEGDKMVLQCSYKA

SEQ ID NO: 120758 - protein, 120 aa, Glycine max
  Coding DNA Sequence Number=SeqID_3980
  Subcellular localization annotation: CTP_CleavageSite=38; ConfidenceScore=5.75e-01
MAESSKKCKGSSASASASRVHRSGATSTSTTPISPSISSSTLFSSEEQQKPYSNLFSSRSIIDPKFIDMEFFYAETFDCIQAFQNLGLIPFMSLQLPVYPELVKAFYCNLEIQDNTLISE

SEQ ID NO: 120759 - protein, 67 aa, Glycine max
  Coding DNA Sequence Number=SeqID_3981
MEERRKGGRSCAGDSENVIFIEQDAWRRQPTGNRLHEYRNRLQAICSSVIDYSIHVIDYQNKKIAFS

SEQ ID NO: 120760 - protein, 117 aa, Glycine max
  Coding DNA Sequence Number=SeqID_3982
GQTSPLTRKDLRRLLDLLSSQGNKPDDMRGVNEPIDAQRLTSSLAPFVNQGQTSPLTRRDLCHLLHLLLSRGGKPDDTRGYRMVIRIFRQPRANEPIDPQRLTSSSAHFVIPRRQAR

SEQ ID NO: 120761 - protein, 409 aa, Glycine max
  Coding DNA Sequence Number=SeqID_3983
  Homolog annotation: Hit_ID=Q1SP02; Match level="QueryCoverage=64%, HitCoverage=67%, E-value=6e-14, Identity=25%"; Hit description=IMP dehydrogenase/GMP reductase
MIRTRGFGHALARVIGRVRQDEDDAGVPQVTEDVPHMAEDVPQVIENVPHMADDVAQMSEDALQMIADVDATIAKDLDHDVLTSFAEHVAQAIWTGQECPELKLVSHERKVALIGRPVPAIEGLGDQHLPPSNRELMITLDDVSSLFHLPISGTFHSFEALSVDEAVFLLMELLEVSGEEARAETVRGRGAYVCLSWSATTIHVVHLEAFRDLGQSGGYAWRAAALCWIYEHFPSVHQYVIDDAYEETSPRSSWWLTMKAHTKGITGASYQARCDALTVTDMCWLPHSDHRGLRWGPMVVTVRPERVLCQFGYIQSIPPPSVSASLSYDDIDYRWMHFSDNVVAVGDLCVVPGQVSADYMEWFSQISHSFMIPTQAGEQPRHAPAPDHEDYMQPDIPQFQWHLTPLDMQ

SEQ ID NO: 120762 - protein, 89 aa, Glycine max
  Coding DNA Sequence Number=SeqID_3984
MVRTRGLGQALGRAIGKVLGKRDETRRQRQQQVVVEDPPTAEEELVNDQPKAPIEEGAADVEGFPGGPHDTSVLSDLENHIALKVWNGE

SEQ ID NO: 120763 - protein, 80 aa, Glycine max
  Coding DNA Sequence Number=SeqID_3985
MDKPLIEPNGLTEFNLIIMVTIKEIGMLYIRLLEVLIKLLVVYAEQEIMCMEKEGEALLQLKASLVDICVSCVLSIFQLH

SEQ ID NO: 120764 - protein, 73 aa, Glycine max
  Coding DNA Sequence Number=SeqID_3986
MGWVNSEMGYGVTVLPLSVVAGEFSSFLWFWKVVSKHHVRRPHVPGTGSFSGLLLRKKCGKKGTESNKYGMHD

SEQ ID NO: 120765 - protein, 286 aa, Glycine max
  Coding DNA Sequence Number=SeqID_3987
  Gene Ontology: Mol. function=murein DD-endopeptidase activity; Cellular component=outer membrane-bounded periplasmic space; Biological process=peptidoglycan metabolic process
  Homolog annotation: Hit_ID=Q668V6; Match level="QueryCoverage=88%, HitCoverage=92%, E-value=1e-106, Identity=72%"; Hit description =Penicillin-insensitive murein endopeptidase precursor
  Pfam annotation: Domain name=Peptidase_M74; Domain location=47-286; Score=534.7; E_value=1e-157; Accession=PF03411.4; Description =Penicillin-insensitive murein endopepti
MAIVLMDHLLRQRGQNADVNSSVPRCAVSLAATPWQQIHQPIAGSPQSIGSFANGCIVGAQQLPLNSPNYQVMRQDQRRYYGHPDLIAFIQRLSTQVHQLQLGQVLIGDMGMAAGGRFSSGHASHQTGLDVDIWLQLPQSRWTAQQLLKPQPLDLVGPDDRQVIARHWQPQIDSLIKLAAKDDDVTRIFVNPAIKKQLCADAGNDRAWLNKVRPWFAHRAHMHVRLRCPPGSLECEDQAPPPPGDGCGAELESWFLPKKPGTTPPVKKSPPPLPPSCQALLDKHLL

SEQ ID NO: 120766 - protein, 204 aa, Glycine max
  Coding DNA Sequence Number=SeqID_3988
  Homolog annotation: Hit_ID=Q5PCW8; Match level="QueryCoverage=43%, HitCoverage=98%, E-value=2e-30, Identity=73%"; Hit description =Hypothetical protein yfcL
CGSAGASRPVRARRTGVARTVQRAAGGRSAGGANERRAATAGQQHAGGAASQPLLGAQIAEREKGRTLKRGASDRPGQSGSEARLGKQVIPHAHHQRLVARRQFTGGDGVLQAVGDLNLQRFRRVFAALLNFRYCQRQMATQITAGKQFVVAGVFDHIVNQRQNAGLEFYDHLLIILHLSECGSQIFRPRKLCRRQCRRTIIAG

SEQ ID NO: 120767 - protein, 154 aa, Glycine max
  Coding DNA Sequence Number=SeqID_3989
  Homolog annotation: Hit_ID=Q1STJ5; Match level="QueryCoverage=40%, HitCoverage=56%, E-value=3e-08, Identity=41%"; Hit description=Zinc finger, BED-type predicted
  Pfam annotation: Domain name=zf-BED; Domain location=102-144; Score =17.3; E_value=0.0072; Accession=PF02892.5; Description=BED zinc finger
MFHGSNVFATTNNQGTIVDSGTTLAYLVQEAYNPFVKVKNMQTEEPSSRQPTLQSSHQPTPVESSTGIAEGPNNELMQQPPSMEVDDHVASSTKTGGGGLKSIVWNHFDKIKTIDGQDKAQCKYCKKFLGGGSIKEWNKAFACPYGEMNSEKVT

SEQ ID NO: 120768 - protein, 91 aa, Glycine max
  Coding DNA Sequence Number=SeqID_3990
MVEATKARCGDGGDSEKAIMVVEVALAGCGGGGGDGGGGGGKKTYEEFKIVVNVMSIKPRIGLGVRQISIHLNALGRLPIVGRNEKELLQQ

SEQ ID NO: 120769 - protein, 185 aa, Glycine max
  Coding DNA Sequence Number=SeqID_3991
  Gene Ontology: Mol. function=catalytic activity; Cellular component =cytosol; Biological process=cellular metabolic process
  Homolog annotation: Hit_ID=Q1T188; Match level="QueryCoverage=87%, HitCoverage=50%, E-value=5e-82, Identity=89%"; Hit description=NAD -dependent epimerase/dehydratase
MDVSFHWFDRRKFLKGGKAYQMWYTLSKTLAEDAAWKFVKENNIDMVTINPAMVIGPLLQPVLNTSAASILNVINGAQTFPNASFGWVNVKDVANAHILAYENASANGRYCLVERVAHYSEIVKILRDLYPTLQLPEKCADDNPYVPIYQVSKEKAKSLGIEYTPLEVSLKETVDSLKEKKFTNF

SEQ ID NO: 120770 - protein, 74 aa, Glycine max
  Coding DNA Sequence Number=SeqID_3992
  Homolog annotation: Hit_ID=Q4U0Z7; Match level="QueryCoverage=52%, HitCoverage=4%, E-value=2e-07, Identity=58%"; Hit description =Cellulose synthase BoCesA4a
MENISANFKNPPSTKERKRGGLDTKGNRGQGEGTPWPRNNTKDHPRNRGGLDTKGNMLPCTFYVYREKRPDNGQ

SEQ ID NO: 120771 - protein, 102 aa, Glycine max
  Coding DNA Sequence Number=SeqID_3993
MSSSSVKWLVHYDGQIIKTNERDTFQSPHPLFFETKRGLEKKNLGKALSSTMDQEEDDEEEAEHVSPITIVPPYYIPPYMQNLEESNFQDFEYGHSLDHEEV

SEQ ID NO: 120772 - protein, 86 aa, Glycine max
  Coding DNA Sequence Number=SeqID_3994
MKNMSNHTQVANEGGHRRWFPRVAWPQLRRFTREKASETIGFFKNDKKKEGEVLPWALWQAGTMADGHTTTNNEWGIAKGSKIATL

SEQ ID NO: 120773 - protein, 193 aa, Glycine max
  Coding DNA Sequence Number=SeqID_3995
  Gene Ontology: Mol. function=catalytic activity; Cellular component =cytosol; Biological process=cellular metabolic process
  Homolog annotation: Hit_ID=P93700; Match level="QueryCoverage=82%, HitCoverage=49%, E-value=2e-72, Identity=79%"; Hit description =CPRD14 protein
  Pfam annotation: Domain name=3Beta_HSD; Domain location=10-193; Score= -145.5; E_value=0.031; Accession=PF01073.9; Description=3-beta hydroxysteroid dehydrogenaseisomerase family
  Pfam annotation: Domain name=Epimerase; Domain location=9-193; Score=- 56.4; E_value=0.019; Accession=PF01370.11; Description=NAD dependent epimerasedehydratase family
  Pfam annotation: Domain name=NAD_binding_4; Domain location=11-184; Score=-74.4; E_value=0.00082; Accession=PF07993.2; Description=Male sterility protein
  Pfam annotation: Domain name=adh_short; Domain location=7-138; Score=- 62.2; E_value=0.069; Accession=PF00106.15; Description=short chain dehydrogenase
  Pfam module annotation: Pfam domain module=3Beta_HSD::Epimerase::NAD _binding_4::adh_short; Domain location=10-193::9-193::11-184::7-138
MSSGAGKVVCVTGASGYIASWIVKFLLNRGYTVKATVRDTSDPKKINHLVGLDGAKERLHLYKANLLEEGSFNSVVQGCHAVFHTASPFYHNVKDPQAELLDPALKGTLNVLKSCVNLPTLERVVLTSSVAAVAYNGKPRTPDVVVDETWFSDPGFCRESQNQELGYMLSISKVNYATFLATISFKHGMLLLY

SEQ ID NO: 120774 - protein, 158 aa, Glycine max
  Coding DNA Sequence Number=SeqID_3996
MEIPQQWFNDSKFLGFSLCLVIGGFQQNSYEGCHEVLIQIICLCYYPTFNASILQDFKDIGLYFDANNLRLRIIFKFKGPYQRLDIVKKCGVRPLLIANTERLHMEVNYNLNRREYESETEILMKYIIAENFEDSSDDPVNWSYSLKRSKMVCSPKIR

SEQ ID NO: 120775 - protein, 360 aa, Glycine max
  Coding DNA Sequence Number=SeqID_3997
  Gene Ontology: Mol. function=galactosyltransferase activity; Cellular component=Golgi stack
  Homolog annotation: Hit_ID=Q2MGS1; Match level="QueryCoverage=57%, HitCoverage=42%, E-value=2e-67, Identity=54%"; Hit description =Glycosyltransferase sugar-binding region containing DXD motif; Alpha 1,4-glycosyltransferase conserved region
  Pfam annotation: Domain name=Gb3_synth; Domain location=136-250; Score=-15.4; E_value=0.0005; Accession=PF04572.3; Description=Alpha 1,4-glycosyltransferase conserved region
MGILGATILDCPCYCRSVISCMSFSWGNVSPGCLWCGICCLGCTLFGISLVSESLLFHHPDACVVVFSEMVELDFFKESFVKDGYKVAVAILRYKVAVATPMLDELLKDMPAHIFATVWFEWKKTGFCSTHYSELIHLAALYNLFIKECLEEFNMTYDDTSLRGNGVDPLTRVDRKYLGEENKSVKHLELKVEPSYIFIPVSSQNITRRPLFDSEMGMAVSFLTELERFRIQPHSDDQWVWKAEPSGQYTAKSAYSVPWGEVSSEHQDGAFKELWNLKLPPKIVIFAWRLIRDRLPTKSNFKITPLWWESLSWVNIMGAFPKSPKATLSPTYTWSDSRHEVSQMEMVVGCIDMDHLDAKK

SEQ ID NO: 120776 - protein, 111 aa, Glycine max
  Coding DNA Sequence Number=SeqID_3998
  Gene Ontology: Mol. function=RNA-directed DNA polymerase activity
  Homolog annotation: Hit_ID=Q1RSZ9; Match level="QueryCoverage=99%, HitCoverage=8%, E-value=2e-27, Identity=58%"; Hit description =Polynucleotidyl transferase, Ribonuclease H fold
MEAFSSVFAYCQHLKSLSDQLKNVDFPVDNSRLVLQLVFSLTEPYKRVATLIRQSDPLPQFYQARSILVLEEFCLKKAAQTSSSAMVARDLDESQEMSDHSSARLTNNGGK

SEQ ID NO: 120777 - protein, 534 aa, Glycine max
  Coding DNA Sequence Number=SeqID_3999
  Gene Ontology: Mol. function=phosphatidylcholine-sterol O -acyltransferase activity; Biological process=lipid metabolic process
  Homolog annotation: Hit_ID=Q71LX7; Match level="QueryCoverage=99%, HitCoverage=100%, E-value=0.0, Identity=64%"; Hit description =Lecithine cholesterol acyltransferase-like protein
  Pfam annotation: Domain name=LACT; Domain location=56-429; Score= -37.9; E_value=6.2e-10; Accession=PF02450.6; Description =Lecithin:cholesterol acyltransferase
  Pfam annotation: Domain name=Lipase_2; Domain location=117-277; Score= -97.6; E_value=0.043; Accession=PF01674.8; Description=Lipase (class 2)
  Pfam annotation: Domain name=PGAP1; Domain location=29-288; Score= -84.5; E_value=0.018; Accession=PF07819.3; Description=PGAP1-like protein
  Pfam module annotation: Pfam domain module=LACT::Lipase_2::PGAP1; Domain location=56-429::117-277::29-288
MAILLGEILQSLELWLKLIKNPQPQPYVNPNLDPVLLVPGVGGSMLHAVDETDGSHERVWVRFLNAEYTLKTKLWSRYDPSTGKTESMDPNSTIIVPEDRHGLHAIDILDPDLMFGSDSVYYFHDMIVEMRKWGFEEGKTLFGFGYDFRQSNRLKETMDRLAAKLESIYNAAGGKKINIITHSMGGLLVKCFMCLQSDIFEKYVKNWVAICAPFQGAPGTIYSTFLNGMSFVEGWEQNFYISKWSMHQLLIECPSIYELMGCPNSHWQHIPVLELWRERRDSDGKSHIVLESYPPCDSIEVLKQALLNNTVNYNGVDLPLPFNLEILKWANKTWEILSSAKLPSQKWYSVKCINNGLLDASSFGSGDKPVTDLQQLCYFQAKYVCVDGDGTVPIESAKADGLNAEARVGVPGEHQRILREPHVFRLLKHWLKAGEPDPFYNPVNDYVILPTAFEMERHKEKGVEVASLKEEWEIISKVQDDQSCTADKVCSISVSQEGANQSYSEAHATVIVHPDNEGKQHVQLNALAVSVDAS

SEQ ID NO: 120778 - protein, 79 aa, Glycine max
  Coding DNA Sequence Number=SeqID_4000
MEGMIYIEMHNAKIISTVEQTCTKKSVFSHSHAAVHALTLSHGGSHSHCGSECVLILSHTVVHALTLTLLNNALTGFKG

SEQ ID NO: 120779 - protein, 429 aa, Glycine max
  Coding DNA Sequence Number=SeqID_4001
  Gene Ontology: Mol. function=transferase activity, transferring glycosyl groups; Cellular component=endoplasmic reticulum membrane; Biological process=GPI anchor biosynthetic process
  Homolog annotation: Hit_ID=Q2QQC9; Match level="QueryCoverage=84%, HitCoverage=67%, E-value=6e-92, Identity=48%"; Hit description =Expressed protein
  Pfam annotation: Domain name=Mannosyl_trans2; Domain location=14-424; Score=268.6; E_value=1.2e-77; Accession=PF04188.3; Description =Mannosyltransferase (PIG-V))
  Subcellular localization annotation: CTP_CleavageSite=48; ConfidenceScore=5.08e-01
MVETLPHHTPPPPNHHQVLVLKSAICSRLLLVTLIILFRTLVSPYDTSASLNPPCLSTPNPNSTTHPSPLENGVVWDSVYFLRIAQCGYEYEQTFAFLPLLPLSLSLSSHTLFAFLSPFLNQRPLLALSAYVINNMAFVLAALYFYKLSLTVLKDPQIALRATVFFCFNPASIFYSSIYSESLYALLCFGGMYHFMSGGNNLAVLFFALSGCARSNGVLNAGYLCFQTMHRAYHAMFQEKRVTCLMANFIDRVWMLMILGVEVGGCETEYLIDSLSLYQLALQIVIAGALRTACIFAPFVAFQAYGYYNMCVGRSPDEIRPWCKARIPLLYNYIQSHYWGVGFLRYFQLKQLPNFLLASPILSLALCSVVHYAKSRPQNFLSLGFLAPMEEKSRGVVFLLDELSRSKEARSVKKSSVRVEGMVLKQIVF

SEQ ID NO: 120780 - protein, 223 aa, Glycine max
  Coding DNA Sequence Number=SeqID_4002
  Gene Ontology: Mol. function=transposase activity; Biological process= transposition, DNA-mediated
  Homolog annotation: Hit_ID=Q1SC10; Match level="QueryCoverage=55%, HitCoverage=18%, E-value=2e-26, Identity=48%"; Hit description =Ubiquitin-activating enzyme, E1; Transposase, IS4
MVMFLHIVAHNLEYRVVHLDYYRSKETISSQFNNVLRDVMKVSEDYLKFHTYNLEGLEAIKWSWFENCVVALDGTHIPVLVFLEDRPKYRNRKSNVSTNVLAACGPDLRFIYVLSGWERSVGDSQAGDLELLFIVDQVLTRPTERVQNNVTNDVTTIQVTEEWTRFRDTLATNMFANHQVVDDEEEAPSTLKVDNISNIDKGNCFLFLSEHVDHDANKVHEKP

SEQ ID NO: 120781 - protein, 119 aa, Glycine max
  Coding DNA Sequence Number=SeqID_4003
  Gene Ontology: Mol. function=catalytic activity; Biological process =cellular metabolic process
  Homolog annotation: Hit_ID=Q1T188; Match level="QueryCoverage=92%, HitCoverage=34%, E-value=2e-51, Identity=84%"; Hit description=NAD -dependent epimerase/dehydratase
MWGNVIFVESAETFPNASYGWVNVKDVANAHILAYENASANGRYCLVERVAHYSEIVKVLPDLYPTLQLPEKCADDKPYVPIYQVSKEKAKSLGIEYTPLEVSLKETVDSLKEKKFTNF

SEQ ID NO: 120782 - protein, 650 aa, Glycine max
  Coding DNA Sequence Number=SeqID_4004
  Gene Ontology: Mol. function=RNA-directed DNA polymerase activity; Cellular component=nucleus; Biological process=RNA-dependent DNA replication
  Homolog annotation: Hit_ID=Q1T5K4; Match level="QueryCoverage=64%, HitCoverage=71%, E-value=1e-57, Identity=33%"; Hit description=RNA -directed DNA polymerase
MEDPNSGNHQLQEATTIWNMAKQLGETGGSEQGEIIDKIRAMEERDKKEAERLVKKEHVDMICFQETKKEIIVKSACQALWWDFDVSWEMQPATNTVGGILWTMVKGGTSSQYSTIYSPCDIQNKRTLWDNVKQLKNANPGGLWCIMGDFNNIRDPTERLGTCQKGLGESNIKEFNDWIEDMEVDNVPWVGRKFTWFKLNGASRSKLDRFLVSPEWLVKWPGNWGPKPFRILNCWLLDNSFKTIVQKCWNSNQQWGWGGPDGLNFKFIKKFWHILEPDVLQFLAEFHANGTFPRGCMYKIVAKLLARRMKMVIEEAKMSQKSCLVLKVDYEKTYDSISWDFLLHMLRRTCFSSKWIKWIDGSSKSFKWILALALGHVLIKRGLRKGDPLAPLLFNVVIEALNGLLRKALEKNLFTGFPVGSNNVRISILQYADDTIFFGEEKMENVKAIKAILRTFELVSGLKINFAKSSFGAIGVPDQWKQLAANYLNCSLLAIPFVYLGIPSRENPRRCQLWDPVINKVPNRVVDKIVSLQQRFLWGGRPEHNKIAWIKWETHQGQLWARVLESKYGGTGSNGTMWKVGCGDRIKFWEDRWDTGWEWNFIWRRPLFDNEIATIVSFLRDVEGKIIQQHRSDVWVANKNKFTKAASADQ

SEQ ID NO: 120783 - protein, 345 aa, Glycine max
  Coding DNA Sequence Number=SeqID_4005
  Homolog annotation: Hit_ID=Q9LVR9; Match level="QueryCoverage=25%, HitCoverage=13%, E-value=8e-30, Identity=67%"; Hit description =Arabidopsis thaliana genomic DNA, chromosome 5, P1 clone:MQL5
MRKSNSRSQKQGRICWRMSFCSLPSRFPNVLDTLTSSKEIIDLLKTVDSLFHSKQAGSGKPMLNNLYRYVPIICEQLQDWEDGLCETDADGSFLHENWNKDLRLFADGEDGGQQLLQLFILRAEAELQAISGDNLVPSLQCLDSLKAKLGCLFDGNTVIKSSSTCPDSVPHQQSRDEIFKPRRAGNHAFADVKYKGDWMRRPISNDEIAWLAKMLIRLSDWLNESLGLNQAESSQVSSAVSYVEVSADVAHICGPSEALKFFLCTIGSWFLFLGAASLGCMRKYGLRVNLRILASKKVVMCCGNQQKIASPPHFAHWECSNGNSLLQPLCTSYLVRQGLNSAQLM

SEQ ID NO: 120784 - protein, 133 aa, Glycine max
  Coding DNA Sequence Number=SeqID_4006
  Gene Ontology: Mol. function=DNA binding; Cellular component=nucleus; Biological process=regulation of transcription, DNA-dependent
  Homolog annotation: Hit_ID=Q94FG3; Match level="QueryCoverage=73%, HitCoverage=51%, E-value=2e-14, Identity=43%"; Hit description=Myb -like transcription factor Myb 3
MVAQKCSIFMFYIHTYATWQWILSWSLIAGRLPGRTDNEIKNYWNSHLCKKVNQKVEKPESSTRHEIIGQNDQNAGDNRAMSENEVEINESGNLDVSLDVNEFFNFSEESFGFDWLNKYLELDQIPESTERSE

SEQ ID NO: 120785 - protein, 197 aa, Glycine max
  Coding DNA Sequence Number=SeqID_4007
  Homolog annotation: Hit_ID=Q1SD71; Match level="QueryCoverage=33%, HitCoverage=25%, E-value=7e-14, Identity=63%"; Hit description =Ubiquitin-conjugating enzyme, E2
MNELRSVSFVACRLYTGIHAKPKPKFKSGAISESTTALNVDQTNTSVISGDIKTTPASAALPVPVLATTTTRGNNQEQAAAVNGSSAATVISAASAPPKKEGGQAKAQADKKKIDARKKILHFDRERGEGVGMWSPGFNICFIKRVRFQELCQTILEVFWERTLKMVTSTAPPTESDEDTIRGCRKGRESTEKWNEN

SEQ ID NO: 120786 - protein, 210 aa, Glycine max
  Coding DNA Sequence Number=SeqID_4008
  Gene Ontology: Mol. function=small conjugating protein ligase activity; Cellular component=cytosol; Biological process=protein modification process
  Homolog annotation: Hit_ID=Q651V2; Match level="QueryCoverage=70%, HitCoverage=58%, E-value=2e-77, Identity=92%"; Hit description =Putative ubiquitin carrier protein E2
  Pfam annotation: Domain name=UQ_con; Domain location=76-209; Score =180.6; E_value=4e-51; Accession=PF00179.16; Description=Ubiquitin -conjugating enzyme
MSCLTINTERLFYNQYFPLVLILLQFFFGLVASFDLISKFENSVWEGPFLFSAKQIAGAFVLMATNENLPPNVIKQLAKELKNLDESPPEGIKVVVNDDDFSTIFADIEGPAGTPYENGVFRMKLLLSHDFPHSPPKGFFLTKIFHPNIANNGEICVNTLKKDWNPSLGLRHVLIVVRCLLIEPFPESALNEQAGKMLLENYEEYARHAR

SEQ ID NO: 120787 - protein, 196 aa, Glycine max
  Coding DNA Sequence Number=SeqID_4009
  Gene Ontology: Mol. function=DNA binding
  Homolog annotation: Hit_ID=Q9LVR7; Match level="QueryCoverage=78%, HitCoverage=58%, E-value=1e-58, Identity=71%"; Hit description =Arabidopsis thaliana genomic DNA, chromosome 5, P1 clone:MQL5
  Pfam annotation: Domain name=DUF124; Domain location=2-165; Score =48.2; E_value=2.8e-11; Accession=PF01987.7; Description=Protein of unknown function DUF124
MENAYLPENEVGIWQWLFGKTITSIVLRNSGPSDGFVGIAAPYFARILPIDLAMFNGEILCQPDAFLCSVNDVKVSNIVDQRGRNAVASAEGFLRQKLSGQGLAFILAGGSVVQKNLEIGEVLAVDVSSIVAVTSAVNIQIKYNGPARRTMFGETQYPSPIPSHSEESLGNGVRSFFIGNTMDPTLPWTPSILGAL

SEQ ID NO: 120788 - protein, 91 aa, Glycine max
  Coding DNA Sequence Number=SeqID_4010
  Gene Ontology: Mol. function=transcription corepressor activity; Cellular component=signalosome complex; Biological process=red or far red light signaling pathway
  Homolog annotation: Hit_ID=Q6I668; Match level="QueryCoverage=51%, HitCoverage=97%, E-value=2e-17, Identity=87%"; Hit description=CSN complex subunit 2
MSQTLFWGFLPLFFLPPLPCANGQELNVPEHDVEQLLVSLILDNRIQGHIDQVNRLLERSDRSKGMKKYTAVDKWNTQLKSLYQTISNRVG

SEQ ID NO: 120789 - protein, 90 aa, Glycine max
  Coding DNA Sequence Number=SeqID_4011
  Gene Ontology: Mol. function=hydrolase activity, acting on ester bonds
MVELQKFSLLLALLSMLLDEVAISQLRKWITEEVLCQPKVEVSVCERETDHEEKMSEKTTKIEPCGTNQDKGVNGVEINKGSETVEVAQA

SEQ ID NO: 120790 - protein, 699 aa, Glycine max
  Coding DNA Sequence Number=SeqID_4012
  Gene Ontology: Mol. function=protein kinase activity; Biological process=protein amino acid phosphorylation
  Homolog annotation: Hit_ID=Q1SD79; Match level="QueryCoverage=99%, HitCoverage=99%, E-value=0.0, Identity=87%"; Hit description =Tyrosine protein kinase, active site
MDVLCRSPDQESVGSGTKRSSVSSGGRPQNQKEFFYKFVESDSLTAKLVDWFESVTENSELKQQAFDVPFELIELQKFDYALEGISFQQLTRMPNAVHASTSDAVEATAYLAIEDFLHASIKGLWEAFWSQDEPMPFSVACLYNANMKFYQAEKAIANGRLGGLCGTGILLNNPRHPHGKWDHVLELALLRPDIGGHAVGSDRQPSPSVLGEALFCALRMLLARSLSRLSFFPDPSTVFVLLVDSQYGGVVKVEGDVNKLNFDVNNVYECAAEWVKDHSRISVSPIDRIWNKLGNANWGDIGALQVLFATFHCIMQYAGMPKHSVEDLAADHSSRLQTRRVERQLGDTGVNGNGLLRYQQCSVSPEIVEVQDDSVKVDSKESMITEGTILWLEDSDWQKGYQIKEVINTSELTYFIASHVEEPGKNLFLYVGSHPSQLEPAWEDMNLWYQVQRQTKVLTIMKQKGLSSKYLPRLSASGRIIHPGHCRRPSSGGNCDHPWCGTPILVTSPVGETVAEMVRTGQFGSDEAIRCCHDCLSALSTVASAGIRHGDIRPENVICVKSGVRHPYFVLIGWGHAILEDRDRPAMNLHFSSTYALQEGKLCSASDAESLVYMLYYSCGGVFPDLDSVEGALQWRETSWSRRLIQQKLGDISTVLKAFADYVDSLCGTPYPIDYDIWLRRLRRSIHEDDHGKEIDVTG

SEQ ID NO: 120791 - protein, 89 aa, Glycine max
  Coding DNA Sequence Number=SeqID_4013
  Homolog annotation: Hit_ID=Q10M68; Match level="QueryCoverage=46%, HitCoverage=10%, E-value=5e-12, Identity=78%"; Hit description =Serologically defined breast cancer antigen NY-BR-84, putative, expressed
MSFIKTTEEERKRNKTTRRTELGEEEQEHEDGGSERDDTAGERAAVEILVDFRVRVEVAELAHYAIHDDDDDASIQFPPNYCVDPKLKI

SEQ ID NO: 120792 - protein, 424 aa, Glycine max
  Coding DNA Sequence Number=SeqID_4014
  Gene Ontology: Mol. function=protein binding; Cellular component =endoplasmic reticulum; Biological process=ER to Golgi vesicle -mediated transport
  Homolog annotation: Hit_ID=Q10M68; Match level="QueryCoverage=98%, HitCoverage=81%, E-value=4e-79, Identity=57%"; Hit description =Serologically defined breast cancer antigen NY-BR-84, putative, expressed
  Pfam annotation: Domain name=DUF1692; Domain location=219-420; Score =390.4; E_value=2.7e-114; Accession=PF07970.2; Description=Protein of unknown function (DUF1692)
MVKVQFDVTFPALPCSILSLDAMDISGEQHLDVKHDIIKKRLDSHGNVIETRQEGIGAPKLTESMPALPFELRQHKAPCTSTAEVMKGMLLETEIEKPLQRHGGRLEHNETYCGSCYGAEESDDDCCNSCEDVREAYRKKGWALSNPDLIDQGCSWVNLALDGLFTSIGDGSVHLVGTGFTKSACWLCCRLATMTSLEQSSSLCCSWVDESRCRLASSFAMFICKREGFLQRIKDEEGEGCNVYGFLEVNKVAGNFHFAPGKSFQQSGVHVHDLLAFQKDSFNLSHHINRLAFGEYFPGVVNPLDNVHWTQETPSGMYQYFIKVVPTVYTDVSGHTIQSNQFSVTEHFRTGDVGRLQSLPGVFFFYDLSPIKVTFTEENVSFLHFLTNVCAIVGGIFTVSGILDSFIYHGQRAIKKKMELGKFN

SEQ ID NO: 120793 - protein, 317 aa, Glycine max
  Coding DNA Sequence Number=SeqID_4015
  Homolog annotation: Hit_ID=Q1RTD3; Match level="QueryCoverage=42%, HitCoverage=21%, E-value=4e-15, Identity=34%"; Hit description=IMP dehydrogenase/GMP reductase
MGCCKGSLSNMVKGTVRQSKMLLSTIFPDEAVGSKSYNIDKGLEDEVRGGECLVRGTGWKNKDFETGVDLLKVDEDMCKVHNARIKKGVGKKSFLRNTELVVTFGLWVNEGTKDFGLDGLLSKEAFQDGLNPQEMKKDSLDLGDEECQQCLGTYYVGYNKGSVESGNKKALGDGYIYLEGLWKEIGSNVVVINVYSPCDNFKKRRLKEDLLVGDGSGLDPIMKDFNQFIDNMELVDIPLAGRSFTWYRHNGSVKSRLDRALLSLEWFSTWVGGTLSVSDRKTLDDCPVILKNVVRDWSPKPVQIVEATFMMMNQDDS

SEQ ID NO: 120794 - protein, 101 aa, Glycine max
  Coding DNA Sequence Number=SeqID_4016
LLNRLSESNVKSITGELSLIFQGFKKYYLIFGYVKFFLLDLVLKIIKNNIQFKDDAYISTVFESRHSKTVLTSTTSLKVGILRRCLNKQHLRMPIFKDVAE

SEQ ID NO: 120795 - protein, 370 aa, Glycine max
  Coding DNA Sequence Number=SeqID_4017
  Gene Ontology: Mol. function=kinase activity; Cellular component =membrane; Biological process=protein amino acid phosphorylation
  Homolog annotation: Hit_ID=Q10SF4; Match level="QueryCoverage=86%, HitCoverage=66%, E-value=1e-62, Identity=43%"; Hit description =Protein kinase, putative, expressed
  Subcellular localization annotation: CTP_CleavageSite=47; ConfidenceScore=5.33e-01
THHHHRSPFSPPPHALSLQNNNPLPNSPPIYHTARVFTSPARYTFPVSDKGTHIVRLHFHPFTTPNLDLGLAQFHVLLNAHVALSNFTRLLSDATNPSIVEYLIWVDAEKLEIVFVPNKDSRLAFVNAIEVISAPKDLVPDTAQYLSSSKLEKFEGLNKQALEVVYRVTVGGVKVTPFNDSLWRTWVPDDGFFRPSVGSEKLYFGGRINYHVGGASREVGPDNVYNSARLIRSKNDSVPNVNMTWVFPVVGGYKYLVRLHFCDIASISVGLLYFNVYVNGNLAYEDLDLSYVTNSLASPFYADFVVDGGDGALSVGVGPSKSSMPHVIDGILNAVEVMKLNNSRSSLDGEEVDWVEGICVLVKVACEFVG

SEQ ID NO: 120796 - protein, 292 aa, Glycine max
  Coding DNA Sequence Number=SeqID_4018
  Pfam annotation: Domain name=Transposase_23; Domain location=142-212; Score=11.6; E_value=6e-05; Accession=PF03017.5; Description=TNP1ENSPM transposase
KTKKKLQEAAQLGSVDGIIDPPSPVRRHVKWKMTCTKKTWEMTTKAAKEIAEKIDSFEEQATQGSFVPHGRQDVLAAAIGRPEHPGRVRATGADIRDQLEESITEKVTRQAPPEPLVGPGPSGPRVSTKGSCVDPSGNDPETSDSDRCDLYIEADPARLVALGRVYKGSTLVHNTPLLSGQVKVSVDEVKDADASVPVPTAEVSLVGQALHTFLAWPTHLINSLSYQIVVSPPKPPPKPGPEVDDPLYLMTLTIPELFLRPYQVRWDAPVFGVVNPDFPLYIKHEDLSEIAH

SEQ ID NO: 120797 - protein, 856 aa, Glycine max
  Coding DNA Sequence Number=SeqID_4019
  Homolog annotation: Hit_ID=Q84P21; Match level="QueryCoverage=31%, HitCoverage=52%, E-value=6e-58, Identity=45%"; Hit description=4 -coumarate-CoA ligase-like protein
  Pfam annotation: Domain name=AMP-binding; Domain location=223-821; Score=99.4; E_value=1.1e-26; Accession=PF00501.18; Description=AMP -binding enzyme
  Pfam annotation: Domain name=Transposase_23; Domain location=379-437; Score=-16.1; E_value=0.066; Accession=PF03017.5; Description =TNP1ENSPM transposase
  Pfam module annotation: Pfam domain module=AMP-binding::Transposase _23; Domain location=223-821::379-437
MPYYGVIEDIWELDYYEFKVHVFKLLTTMIHSSWQCKLDRCFMSKIHDSRWSVVLQGRTTCIDDLIDGSTLDVNEMSAFCEQMPFINGEDQEDDVHANRNDHDEGLWENIRILMATPKRSPPHPSEAMSRKTRQSSRLRRLIVRSLDQPQPMINGNFDILEGDNAKKKVMSTVATRWRKFKSSLTTKYVYVDNDDQQKDDPFVKYVIDAATWAEFAKSHQTPNWQWKMAHTKRYGQMTSTTAQEISDNIVSNYLYVSQEALFHMVIMTLNMAIGRPKHPGRVRVAGKGVTISQYFGQASRDSNSSSTSISQQQLAQIIELKQAIKLELSQISSQHSPPLEAPDIQVLAARVSTKGSYAKADTIPSGKEPSDVHADTMGLYVVGDQCTELVALGKVYDSASTIHNVPYADDVVRVSVGDAQVPFPTSEIQFVKQAIGTFVGWPTHLVKPVSNEDSPKRLSKRVTSVGMDNAVAVVDPLGKLVKNMFDVYQKPIDLPFDGAKFGIPNLKDGFFITHADDNIVVWLCSLRKKPDVNIKAAVNRQIKLYLGGLNQSCQDCYAVKSSLKAEDGILYPLDTCKSHFHNETTVVVCRFVCESQFDVFLAFIPMFHIYGLLFFGLGLLCVCVTTISMQKYDLPAVPPMILALVKHARKARCDLSSLRRVGLGAAPLSKEVAQEFRRMFPWIELRQGYGLTESSGGATFFASDKDTNAHTDSCGKLIPTICAKVVDIETGKPLPPQKEGELWFKSPTIMKGYLGNLEATSATIDSEGWLRTGDLGYIDENGFVYIVERIKELIKYNGYQVTAAELESVVLSHLLIVDAAVTVVEDEETGQIPMAYVVRATGSELSENQVIQFVAG

SEQ ID NO: 120798 - protein, 342 aa, Glycine max
  Coding DNA Sequence Number=SeqID_4020
  Gene Ontology: Mol. function=thiamin pyrophosphate binding; Cellular component=cytoplasm; Biological process=branched chain family amino acid catabolic process
  Homolog annotation: Hit_ID=P71323; Match level="QueryCoverage=72%, HitCoverage=45%, E-value=4e-84, Identity=67%"; Hit description =Indolepyruvate decarboxylase
  Pfam annotation: Domain name=Glucokinase; Domain location=263-342; Score=-196.3; E_value=0.0002; Accession=PF02685.6; Description =Glucokinase
  Pfam annotation: Domain name=TPP_enzyme_C; Domain location=81-227; Score=53.0; E_value=9.8e-13; Accession=PF02775.11; Description =Thiamine pyrophosphate enzyme, C-term
  Pfam module annotation: Pfam domain module=Glucokinase::TPP_enzyme_C; Domain location=263-342::81-227
RVIDLQPFHASVAGETFAPLTMAQALAALLPVYQRHCAHWATGVADMPDDTPPAAAAVISQQAFWQAMQRFLQPGDIILADQGTAAFGAAALRLPHDAQLLVQPLWGSIGYTLPATFGAQTAQPDRRVILIIGDGSAQLTIQELGSMQRDGLSPIIFLLNNEGYTVERAIHGAEQRYNDIAQWNWTALPQAMSLNCAAQSWRISETAQLDAVMALLSQARCLSLIEVVMEKQDLPPLLRTVTAALHQRNSHKRSSRRMTKYALVGDVGGTNARLALCEVETGAISQAKTFSTSDYDNLEAVIRHYLDEQKQDITDGCIAIACPITGDWVEMTNHDWAFSTRQ

SEQ ID NO: 120799 - protein, 216 aa, Glycine max
  Coding DNA Sequence Number=SeqID_4021
  Gene Ontology: Mol. function=transferase activity; Cellular component= intracellular; Biological process=glycolysis
  Homolog annotation: Hit_ID=P0A6V8; Match level="QueryCoverage=99%, HitCoverage=67%, E-value=1e-102, Identity=82%"; Hit description =Glucokinase
  Pfam annotation: Domain name=Glucokinase; Domain location=1-211; Score=300.4; E_value=3.3e-87; Accession=PF02685.6; Description =Glucokinase
MAIPMLTAQDVLQFGGKSPVQDKPIAIYGAGTGLGVSHLVHVDKRWVSLPGEGGHVDFAPNSEEEDAILEVLRAELGHVSAERVLSGSGLVNLYPAIVKSDQREPENLKPKDVTERALQDSCIDCRRALTLFCVIMGRFGGNLALNLGTFGGVYIAGGIVPRFLEFFKASGFRAAFEDKGRFRDYLVDIPVYMITHDQPGLLGAGAHLRQALGRVL

SEQ ID NO: 120800 - protein, 412 aa, Glycine max
  Coding DNA Sequence Number=SeqID_4022
  Gene Ontology: Mol. function=two-component response regulator activity; Cellular component=fimbrium; Biological process=two -component signal transduction system (phosphorelay)
  Homolog annotation: Hit_ID=Q2YHS3; Match level="QueryCoverage=58%, HitCoverage=100%, E-value=9e-98, Identity=71%"; Hit description=LytT protein
  Pfam annotation: Domain name=His_kinase; Domain location=29-85; Score= 24.9; E_value=1.7e-06; Accession=PF06580.3; Description=Histidine kinase
  Pfam annotation: Domain name=LytTR; Domain location=313-411; Score =92.3; E_value=1.4e-24; Accession=PF04397.6; Description=LytTr DNA -binding domain
  Pfam annotation: Domain name=Response_reg; Domain location=171-283; Score=106.9; E_value=5.9e-29; Accession=PF00072.14; Description =Response regulator receiver domain
  Pfam module annotation: Pfam domain module=His_kinase::LytTR::Response _reg; Domain location=29-85::313-411::171-283
MAVGLSQIISTQLEVSRAEQLREMANKAELRALQSKINPHFLFNALNAISSSIRLNPDTARQLVINLSRYLPLSRQRRGHAKRERSGRSRPRGGARYRCRHQRRGGQPGGAQRNAGQQNWPAECASPGETAVRPRLNHHPSSARYGNRLYPQQKWSAAVRPAHPVSGNLSVKAIIVEDEFLAQQELSWMIQQHSQISIEACFDDGLEVLKYLQTHRVDVIFLDINIPSLDGMLLAQNINQFIHKPLIVFITAWKEHAVEAFELQAFDYILKPYHESRIITMLNKLEASAQQQQAQQHNPAASAPQTVNLVKDERIIVTDINDIYYVEAHEKLTFVYTRREAYVMSMAISEFCSRLPESMFFRCHRSYCVNLSKIGEIEPWFNNTYLVKLRDMDAQVPVSRSKVKAFRQLMHL

SEQ ID NO: 120801 - protein, 831 aa, Glycine max
  Coding DNA Sequence Number=SeqID_4023
  Gene Ontology: Mol. function=3-hydroxyacyl-CoA dehydrogenase activity; Cellular component=fatty acid beta-oxidation multienzyme complex; Biological process=fatty acid metabolic process
  Homolog annotation: Hit_ID=P77399; Match level="QueryCoverage=77%, HitCoverage=90%, E-value=0.0, Identity=61%"; Hit description=Fatty acid oxidation complex alpha subunit [Includes: Enoyl-CoA hydratase (EC 4.2.1.17); ...
  Homolog annotation: Hit description=3-hydroxyacyl-CoA dehydrogenase (EC 1.1.1.35); 3-hydroxybutyryl-CoA epimerase (EC 5.1.2.3)]
  Pfam annotation: Domain name=3HCDH; Domain location=447-540; Score =131.9; E_value=1.7e-36; Accession=PF00725.12; Description=3 -hydroxyacyl-CoA dehydrogenase, C-terminal domain
  Pfam annotation: Domain name=3HCDH_N; Domain location=263-445; Score =297.7; E_value=2.1e-86; Accession=PF02737.8; Description=3 -hydroxyacyl-CoA dehydrogenase, NAD binding domain
  Pfam annotation: Domain name=ECH; Domain location=1-145; Score=138.7; E_value=1.5e-38; Accession=PF00378.10; Description=Enoyl-CoA hydrataseisomerase family
  Pfam annotation: Domain name=PGAM; Domain location=673-786; Score =33.6; E_value=6.8e-07; Accession=PF00300.12; Description =Phosphoglycerate mutase family
  Pfam module annotation: Pfam domain module=3HCDH::3HCDH_N::ECH::PGAM; Domain location=447-540::263-445::1-145::673-786
ARSDAQLAGIVLISGKRDNFVAGADISMIASCETAQQAEALARQGQEVMAEIAALPFPVVAAIHGACLGGGLELALACDARICSLDEKTRLGLPEVQLGLLPGSGGTQRLPRLIGVQQALPLILSGKQLRAKQALKLGLVDDAVPQAILLATAVARVHKGKHAARSLSRRDRLLQGPLARPLLFTLAKRQTDGKTHGNYPATDRILQVVRIGLEQGSAAGHAAEARAFGELAMTAQSAALRSLFFASTALKKEPMADAPPRPLQQIGVLGGGLMGGGIASVTALKAGLPVRIRDINLNGVNHALQYSWDLLSKKVKRRQLKPAERQQQMARISGGTDYQGFRQRDLVIEAVFEDLALKQQMVAEIEEHCQPHTIFASNTSSLPIAQIAAGAQRPENVIGLHFFSPVDKMPLVEVIPHSGTSAQTLATTVDLARRQGKTAVVVADRPGFYVNRILAPYINEAMRCLLEGEPIEHIDSALVKFGFPVGPLQLLDEVGIDVGSKISPILEQAYGSRFSAPQAVSAILADDRKGRKNQKGFYDYQRTRWPRKRQADASLYRLLQLKPQAKQSEQQIATRCVMLMLNEAVRCLDEAVIRSARDGDIAAVFGIGFPPFLGGPFRYIDQRGAGEIVNTLRTLMQQYGERFTPCDAVHSQNEASGAVVPGDIDKQQRCFMQVFIMRHGDAALEAASDAVRPLTLCGCDESRQMASWLNGQTPGIDKVLVSPYLRAGQTLATVREALKLPEGQEVLPELTPGGDPGMVACHLQALAVQGAHAVLVISHLPLVGYLVSELCPQEAPPMFATSAIACVEFDADACEGKLAWQVSPAKLAKAM

SEQ ID NO: 120802 - protein, 349 aa, Glycine max
  Coding DNA Sequence Number=SeqID_4024
  Gene Ontology: Cellular component=integral to membrane; Biological process=lipid transport
  Homolog annotation: Hit_ID=Q9F0Y5; Match level="QueryCoverage=99%, HitCoverage=81%, E-value=1e-131, Identity=64%"; Hit description =Outer membrane protein FadL
  Pfam annotation: Domain name=Toluene_X; Domain location=16-349; Score= 344.3; E_value=2.1e-100; Accession=PF03349.6; Description=Outer membrane protein transport protein (OMPP1FadLTodX)
MNHKNLFAKSAVAAAVALVSSHVYAAGFQLNEFSAIGLGRAYSGEGAMGDTAASASRNPATMALMDRPSFSIGAVYIDPEVDISGNSPTGNSLNASNIAPNQWIPNIHYVHPINDQWWIGASATSNYGLATEFNNGYTAGGFGGKTDLMTGNFNLSTAYRLNDNFSFGVGFDAVYAKAKIERYAGEAGARAGLPADTQVAHLKGDEWGYGWNAGILYEVDKNNRFGFTYRSKVKIDFDGDYKSNIPRAFNGTPQAIALGLPYGTSGATIPGSLTLNLPEMWEVSGWHKVAPQWAVHYSLAYTSWSQFQELKATGSNGQTLFYKDEGYRDAYRIALGTTYNYDDNWTFRT

SEQ ID NO: 120803 - protein, 300 aa, Glycine max
  Coding DNA Sequence Number=SeqID_4025
  Gene Ontology: Mol. function=binding; Cellular component=periplasmic space; Biological process=cytochrome complex assembly
  Homolog annotation: Hit_ID=UPI00005F76D4; Match level="QueryCoverage =100%, HitCoverage=73%, E-value=1e-91, Identity=56%"; Hit description= COG4235: Cytochrome c biogenesis factor
  Pfam annotation: Domain name=TPR_2; Domain location=101-134; Score =16.0; E_value=0.14; Accession=PF07719.7; Description=Tetratricopeptid e repeat
  Pfam annotation: Domain name=TPR_2; Domain location=172-205; Score =15.3; E_value=0.22; Accession=PF07719.7; Description=Tetratricopeptid e repeat
  Pfam module annotation: Pfam domain module=TPR_2::TPR_2; Domain location=101-134::172-205
MVRELQQTLLTDVPGDAAARAHHSSRWVLLPGVIVLVLVSVGVYLKTGGLAQLAGWQSVQQEYPALRARVMDPNAQPLTMEELARLQLGLRTSLQNDPQNLNDWAMLGRLGMVLNNATDASQAFEHALQLAPDNLELQQDYAEVLTRSSDPQDNRQANMLLKDLLKRDHSNVRTLSLLAFNAFEQQQYGEAIGAWQVMLKLLPAGDRRITMIERSIEQAKTDAGQQNSQLALTVSLTPEAEKMLPPGGVLYISVSDGVSPVPVAVKRLPLSHFPLSLTLDDSNAMMPDRLLSAQHQVQIR

SEQ ID NO: 120804 - protein, 348 aa, Glycine max
  Coding DNA Sequence Number=SeqID_4026
  Homolog annotation: Hit_ID=Q7CJB8; Match level="QueryCoverage=39%, HitCoverage=20%, E-value=1e-62, Identity=82%"; Hit description =Cytochrome c-type biogenesis protein
  Pfam annotation: Domain name=AhpC-TSA; Domain location=153-270; Score= 67.8; E_value=3.5e-17; Accession=PF00578.11; Description=AhpCTSA family
  Pfam annotation: Domain name=CcmH; Domain location=286-348; Score= -21.3; E_value=5.6e-06; Accession=PF03918.5; Description=Cytochrome C biogenesis protein
  Pfam annotation: Domain name=Redoxin; Domain location=152-287; Score =100.3; E_value=5.7e-27; Accession=PF08534.1; Description=Redoxin
  Pfam module annotation: Pfam domain module=AhpC-TSA::CcmH::Redoxin; Domain location=153-270::286-348::152-287
MVLGHLGVAVTVVGIAFSTQYSVERDVRMKAGDSVDIHNYHFIFRDVHNLQGPNYSGGVAIIDVTRNGKPEVVLHAEKRFYTAARTMMTEAAISGGFTRDLYAALGEELDDGSWAVRIYYKPFVRWIWFGGVFMALTRNASGDDPTRLESALIGKPVPVFKLEALDQPGKIYNQQVLTDGKPLLLNVWATWCPTCRAEHQYLNTLAEQGIRVVGLNYKDDRSKAVTWLNTLGNPYALSLYDGDGMLGLDLGVYGAPETFLIDGHGIIRYRHAGDMNDRGGRRMKQLLMLLAGLLLSTSLWAAIDTYQFDSVQQEEQYRELTASLRCPKCQNNSIADSNAMIAADMRLK

SEQ ID NO: 120805 - protein, 148 aa, Glycine max
  Coding DNA Sequence Number=SeqID_4027
  Gene Ontology: Mol. function=transporter activity; Cellular component= integral to membrane; Biological process=transport
  Homolog annotation: Hit_ID=P37327; Match level="QueryCoverage=91%, HitCoverage=43%, E-value=5e-57, Identity=80%"; Hit description=Inner membrane protein yfdC
MKPSPSNNTHDNDVDSEEKEQGTDIEVDEDALPSRAAAIHEEIRQDGEKELERDGMALLWSAIAAGLSMGASLMAKGIFQVHLAGVPGAYLLENLGYTFGFVIVIMARQQLFTENTVTAVLPVMHKPTGGNFMLLLRLWSVVLIGNLI

SEQ ID NO: 120806 - protein, 400 aa, Glycine max
  Coding DNA Sequence Number=SeqID_4028
  Gene Ontology: Mol. function=heme transporter activity; Cellular component=membrane; Biological process=cytochrome c oxidase complex assembly
  Homolog annotation: Hit_ID=Q9Z649; Match level="QueryCoverage=53%, HitCoverage=86%, E-value=1e-100, Identity=80%"; Hit description=CcmC
  Pfam annotation: Domain name=CcmE; Domain location=277-400; Score =254.5; E_value=2.2e-73; Accession=PF03100.6; Description=CcmE
  Pfam annotation: Domain name=Cytochrom_C_asm; Domain location=7-186; Score=203.0; E_value=6.8e-58; Accession=PF01578.11; Description =Cytochrome C assembly protein
  Pfam module annotation: Pfam domain module=CcmE::Cytochrom_C_asm; Domain location=277-400::7-186
MSMWKWLHQWAKPERLYQLCGRLIPWFAILGVGALLLGWIWGFGFAPADYQQGNSFRIMYIHVPAAMWSMGVYASMAIAAFIGLVWQMKMADLAAAAMAPIGAVFTFIALVTGSAWGKPMWGTWWIWDARLTSELVLLFLYMGVIALYHSFDDRRTAGRAAGILILVGVVNLPIIHFSVQWWNTLHQGSSGILQQAIDPSMRTPLRWSILGYLLVEDAKHDACLLIVERVFRHGRLCLLRLAGRVFYADSADRSGAAHRVVPSPPAGRDSPARVRVNIRRRNRLYVVVAVLVGLGLATSLVMYALRSNIDLFYTPSEILYGKGEDHQKPEAGQRLRVGGMVMPGSVKRDPKTLAVSFKLYDANGVVSVSYEGILPDLFREGQGVVAQGVLEDGNLVNAKE

SEQ ID NO: 120807 - protein, 331 aa, Glycine max
  Coding DNA Sequence Number=SeqID_4029
  Gene Ontology: Mol. function=nucleoside-triphosphatase activity; Cellular component=outer membrane-bounded periplasmic space; Biological process=cytochrome complex assembly
  Homolog annotation: Hit_ID=Q9Z651; Match level="QueryCoverage=53%, HitCoverage=85%, E-value=1e-65, Identity=69%"; Hit description =Cytochrome c biogenesis ATP-binding export protein ccmA
  Pfam annotation: Domain name=ABC_tran; Domain location=32-193; Score =115.3; E_value=1.7e-31; Accession=PF00005.17; Description=ABC transporter
  Pfam annotation: Domain name=CcmB; Domain location=184-328; Score= -88.9; E_value=0.0072; Accession=PF03379.4; Description=CcmB protein
  Pfam module annotation: Pfam domain module=ABC_tran::CcmB; Domain location=32-193::184-328
MNLPSMLEVINLACVRDERTLFHGLSFQVQAGDVVQIEGPNGAGKTSLLRLLAGLSRPEQGEVRWQQQSIRRQREIWQQNLLYLGHHPGVKSVLSPRENLHFWHGDRSEDTLYDALEQVNLLGYEEVPVAQLSAGQQRRVALARLWLSPAPVWILDEPLTAIDKHGVEKLMARFADHADNGGVRELKIAFRSGAEVVNPLCRAAGIAAGAGAAVSRRLSRWIAGAAAVAADAAADHRAGQSDCALADYRAAADFTLAAGGAAAVAGFCWLAGNGADAANRHANPEFSRAAIDAAGQGLPIGGYLAILGAMLAVSATLSPFATAAALRISLH

SEQ ID NO: 120808 - protein, 208 aa, Glycine max
  Coding DNA Sequence Number=SeqID_4030
  Homolog annotation: Hit_ID=UPI00005FA5CA; Match level="QueryCoverage =83%, HitCoverage=39%, E-value=5e-26, Identity=40%"; Hit description =COG3515: Uncharacterized protein conserved in bacteria
  Subcellular localization annotation: CTP_CleavageSite=50; ConfidenceScore=5.13e-01
MAAVGGWQYLHRPDPLQAQLVASLAPVPATLTSQQRDVLRQRTSLPPALLADTQQQLSRLEQFAPDWNIAYGQQLVEQAQVLWPEQAGSLSARWQHQLEASTLPAQNLAAWHQGMMKLAQLSERLNGLDEQKGKYITVSELKSSVFGMMTRFQQAEPIEEQLRQIHSLPASAPQRQQLIRQLEQHLRSQIYTLWQMKNSIEVAEGEEQ

SEQ ID NO: 120809 - protein, 174 aa, Glycine max
  Coding DNA Sequence Number=SeqID_4031
  Gene Ontology: Mol. function=N-acetyltransferase activity; Biological process=metabolic process
  Homolog annotation: Hit_ID=UPI00005F86ED; Match level="QueryCoverage =97%, HitCoverage=90%, E-value=4e-42, Identity=49%"; Hit description =COG1670: Acetyltransferases, including N-acetylases of ribosomal proteins
  Pfam annotation: Domain name=Acetyltransf_1; Domain location=66-146; Score=37.4; E_value=5e-08; Accession=PF00583.14; Description =Acetyltransferase (GNAT) family
MQLLTPRLSLSRLQPEDWQIFKAVHEDAATMTWVSEIPDENDIRQRFNERLAPWQPSSFHMLCLVARLRDSGEAIGLFGCSAEWHPYRQAEVGYMLRHACTGQGYGSEALQALCTFLLQADFHKLKALVIEGNWPSRRILEKNGFALEGTLRDNYRLNGQWVNDWVFGRLNEAG

SEQ ID NO: 120810 - protein, 75 aa, Glycine max
  Coding DNA Sequence Number=SeqID_4032
MRLWFKLLSLISVLCLTPSTCSVTSVAYTFVYSHCMSLPLKDKLIRQALESVVFHLLAKPICWLSERPLSAALLG

SEQ ID NO: 120811 - protein, 105 aa, Glycine max
  Coding DNA Sequence Number=SeqID_4033
MEGNCDYLITEEGLLEGVKHFAVWPLSQAADSCFGTGHWPTEYPKPQGWIEYEVEDLDSATKILKEKGYNLLVANRVEPWGQTVTRLLSPEGLLTGLTITPWLRG

SEQ ID NO: 120812 - protein, 190 aa, Glycine max
  Coding DNA Sequence Number=SeqID_4034
  Gene Ontology: Mol. function=transcription factor activity; Cellular component=intracellular; Biological process=regulation of transcription, DNA-dependent
  Homolog annotation: Hit_ID=Q8ZPF5; Match level="QueryCoverage=99%, HitCoverage=56%, E-value=2e-91, Identity=88%"; Hit description =Putative transcriptional regulator
  Pfam annotation: Domain name=LacI; Domain location=2-27; Score=46.3; E_value=1e-10; Accession=PF00356.11; Description=Bacterial regulatory proteins, lacI f
MATIKDVALRAGVSTATVSRVMNQTAWVEPVTRERVEKAMRELNYRRNAAAIALAKRSGNMLGLLTGNLADPFFAHLARGVESVARKWQYRLMVCSGGHDEAMEKAGLDFLVNQGCEAIVVHASRLSEKELLRYSAHFPAMVIVNRYIAGMANRCIWLENSAAAREATHHLLAQGHRCIACVTSDLPIID

SEQ ID NO: 120813 - protein, 379 aa, Glycine max
  Coding DNA Sequence Number=SeqID_4035
  Gene Ontology: Mol. function=catalytic activity; Biological process =trehalose biosynthetic process
  Homolog annotation: Hit_ID=Q8LCM4; Match level="QueryCoverage=88%, HitCoverage=90%, E-value=1e-118, Identity=62%"; Hit description =Trehalose-phosphatase, putative
  Pfam annotation: Domain name=Hydrolase_3; Domain location=120-360; Score=-76.6; E_value=0.011; Accession=PF08282.2; Description =haloacid dehalogenase-like hydrolase
  Pfam annotation: Domain name=Trehalose_PPase; Domain location=121 -354; Score=343.6; E_value=3.3e-100; Accession=PF02358.7; Description= Trehalose-phosphatase
  Pfam module annotation: Pfam domain module=Hydrolase_3::Trehalose _PPase; Domain location=120-360::121-354
MTNRNVNNTLMELAMSISNRSALPRAAVPGLMALFGGVLGPPQKKLLRKTLEDGSVNKGGNKVINTWIDSMRASSPTRSAKSTQNNQNQDPTSPWTLYHPSALSMFDHIVCESKGKQIVTFLDYDGTLSPIVADPDKAYMSKKMRATLKDLARHFPTAIVSGRCLDKVYNFVRLAELYYAGSHGMDIKGPTNKRSTKKGNEQVLFQPASEFLPMINEVYNILVEKTKSVPGAKVENNKFCLSVHFRCVDEKNWASLGEQVSLVLNEYPKLKLTQGRKVLEIRPAIKWDKGKALEFLLESLGYANSDNVFPIFIGDDRTDEDAFKVLRRRGQGIGILVSKITKETDASYTLQDPTEVGQFLRHMVEWKRTSSQYQKLDSR

SEQ ID NO: 120814 - protein, 1348 aa, Glycine max
  Coding DNA Sequence Number=SeqID_4036
  Gene Ontology: Mol. function=protein binding
  Homolog annotation: Hit_ID=Q1SD81; Match level="QueryCoverage=97%, HitCoverage=97%, E-value=0.0, Identity=56%"; Hit description=H+ -transporting two-sector ATPase, alpha/beta subunit, central region; TonB box, N-terminal
MGSEIGIKVRKVVVISIRGGYRSACNHPFLVGFFCFLLLLYRSFPFLFSVLVSASPVLVCTAILLGTLLSFGQPNVPEVEIEEKVTHDISSFQAGFSEGDTVFADRDESYFVKGYSENRSDVEERGIEEETSLVSERDNRAEEDQGLLSDLPPDDEKLPDFQHKKQEKEEVEREREFHSFELGKNREVHEENLRSEAVSSDDEAIEKQYVMVRKVDDDILEFENEKTPGDHVDFSASSSWKQVENDGDEDDSVESGSDGAESSSPDASMADIIPMLDELHPLLDLDAPQPAHVSCDGSDAASEKSDDDSVESDDDTENHVDADDDGIDEPDDEEEEEVAGGKEEDESKSAIKWTEDDQKNLMDLGNLELERNKRLENLIARRRARRLMDEKNLIDLDCVDIPCNVAPIATTRHNPFDFPDDSFAAMGLPPIPGSAPSILQPRRNPFDIPYDSNEEKPDLKADSFQQEFTVFHQKEAFFRRHESFSVGSSVLGLSKQERYDWKPVFISERMASEGTSYPSFQRQSSEVSDSKLSSVPDTESVSSIDQDDGKFSEQDLSQETELISNIDHASDAVEHGSQSSGENDSVEIIQVEESNAHHDEVEIVLGGVEDPSEMVFFPKTREVEIHEQFNAGETHLRREPSDEESVGSSRSSHSSLSEVIDSIPDENMEKEENLQQGDGHLSESGISTQASVEESDFQQVSGEVEENHHVDPVYDLSPQASETLQSIPSVSSHDSAMELSERAYPASVEMTANVADEESEVHDHRQEGYTSGHDKNQATSSELHVEAKNELRSEKSEDVNNITANELSAVAPNFVDHNGSTMAEPQVVPVSVDSNLSFDIGSIKDVTNLGLVHGQDLADHIRADSEILHQDNVDSPDSDYQMASEKSHLSDNESVEESALPNAESRFDNANMSTPVQDADEMFDSAASDAHHISSNGSSMPAPRDFQLSPTAGPAPVVHPNLPSEETEHIEKFSSNNDAIFQIQQGKVNIHQDLDKNMVAFTSDSQHEIDVKSPSNLENNLSSSDKSVVAQSSSDHDEIQSSNAIQVESAHGFGTSNDEVGELHDAADKFPPSIYSVTSEKFETPEFVSPTGEADLEVDRHREVENEDQNEVLETGLPSEESMSQVTEENSNEFDDMKEIDEEFLSELDTVGDFSVNDAGVSLHTDVEHEKTRDAQLSSLPKDVKTEEVEQDIPVLEARSLEDINLAFKQLQEGVDVEEVILPSTIKDQDVSEESRDHLEVNSDLQVVEARSLEDINIALNQVSEGNKGELPNSLDSKDTSVKVEENEVGSAKVNEFFDVATSSEEMSRTTVDKSEDVPNSSSGNEEKSHSRKSSSSSSSSSSSSDSD

SEQ ID NO: 120815 - protein, 140 aa, Glycine max
  Coding DNA Sequence Number=SeqID_4037
  Gene Ontology: Mol. function=transporter activity; Cellular component= intracellular; Biological process=transport
  Homolog annotation: Hit_ID=Q1SD80; Match level="QueryCoverage=89%, HitCoverage=36%, E-value=2e-32, Identity=56%"; Hit description =Cellular retinaldehyde-binding/triple function, N-terminal
MVKPFLEPKTYKKVIFVYPDNPRSHMVMEEHLDMDKLESYFGGKNTVGFNYQAYAQKMKEGDRSMSDVFDSCRSSLPGFLSSEFHESVQSETNDSEDEASSDGVVFSNLEEDDDSTHGKMPCSQYESSGVDELIEKDMKS

SEQ ID NO: 120816 - protein, 43 aa, Glycine max
  Coding DNA Sequence Number=SeqID_4038
MTIHVQSKLKTGGLGDAFSSNHHGDTEHGSLKHIIHIPDDETF

SEQ ID NO: 120817 - protein, 193 aa, Glycine max
  Coding DNA Sequence Number=SeqID_4039
  Homolog annotation: Hit_ID=Q1SD82; Match level="QueryCoverage=87%, HitCoverage=64%, E-value=7e-21, Identity=36%"; Hit description=P -type trefoil
MEETQVLHELHKLSQIESEETLNQMLCTLWSTRKTGLPLSDKSHFQSLLHLPSPSHLDPVLACLRSLVRKCAHQNLARDDLLRLFPRDLPIQLQTNLVSALQRNRDRWKEDVSHVIPQLKGTINFAPSLLWPRQEQDFDAVAVPAVVPDVGPSGVNSCFQCDAVGASDNLILNLLKRNASDTLGHSLSNTIIE

SEQ ID NO: 120818 - protein, 232 aa, Glycine max
  Coding DNA Sequence Number=SeqID_4040
  Gene Ontology: Mol. function=protein serine/threonine kinase activity
  Homolog annotation: Hit_ID=Q1SD87; Match level="QueryCoverage=90%, HitCoverage=37%, E-value=1e-78, Identity=72%"; Hit description =Regulation of nuclear pre-mRNA protein
  Pfam annotation: Domain name=DUF618; Domain location=47-132; Score =95.0; E_value=2.3e-25; Accession=PF04818.4; Description=Protein of unknown function, DUF618
MIHLVSLHIPKRPPPLRDTLSHWCISHRKRAKEIVETWDKLFNASQKEQRISFLYLANDILQNSRRKGSEFVNEFWKVLPAALRHVYESGDENGRKAVTRLISPAITMFPFPLTSIYLAIHVDIWEERKVFGSRGQGLKDDVMGKNPLPSASNGKSSNSIKTVKRDAHSVRIKLAVGCLPEKILTAFQPVLDEHLNEKDALNNCSAAVREVGKVVEDVENTLAHGKRIARGT

SEQ ID NO: 120819 - protein, 128 aa, Glycine max
  Coding DNA Sequence Number=SeqID_4041
  Gene Ontology: Mol. function=protein serine/threonine kinase activity; Cellular component=microtubule; Biological process=cell division
  Homolog annotation: Hit_ID=Q5ZCG1; Match level="QueryCoverage=67%, HitCoverage=18%, E-value=1e-17, Identity=45%"; Hit description =Katanin p80 (WD40-containing) subunit B 1-like protein
  Pfam annotation: Domain name=WD40; Domain location=28-66; Score=39.6; E_value=1.1e-08; Accession=PF00400.22; Description=WD domain, G-beta repeat
MKPLLIVNSKPQFGVTYLCTDNSNLIALLLSFIHLGHSQGISTIKFSPDGHWVVSGGFDSVLKVWDLTGGKLLHDFKFHKGHIGVVLGVCSIAFHLDGQTLFVGLEDSIKRVEPYSGGLETEKKESTE

SEQ ID NO: 120820 - protein, 112 aa, Glycine max
  Coding DNA Sequence Number=SeqID_4042
  Homolog annotation: Hit_ID=Q1SD87; Match level="QueryCoverage=30%, HitCoverage=6%, E-value=9e-07, Identity=79%"; Hit description =Regulation of nuclear pre-mRNA protein
MDTLRVLDYEYGFSHECIVIIAIEQIQIVLVYCIYLIFRAFEDFHGQFYMLTLLYFKLCRNQLESTLVNDLQEQEKKLKQYMEQLENGEAARASFCFLSLNMHFRNKYSCFY

SEQ ID NO: 120821 - protein, 134 aa, Glycine max
  Coding DNA Sequence Number=SeqID_4043
  Homolog annotation: Hit_ID=Q1S7C5; Match level="QueryCoverage=64%, HitCoverage=7%, E-value=7e-07, Identity=30%"; Hit description =Integrase, catalytic region
  Subcellular localization annotation: CTP_CleavageSite=57; ConfidenceScore=5.28e-01
ICKSYTAKLEVQKSQHVELAMKVFKCPKNQSFLIFFKASTTGGETIPATRTPTSVTSVPMNQDVSSTSLPMTNFSKQITKKLNDKIILMWKQQIQPTITMLGFNNFVTSPQIPPRYLFDADHDLDHLNPQFSLW

SEQ ID NO: 120822 - protein, 95 aa, Glycine max
  Coding DNA Sequence Number=SeqID_4044
MATTEIEEDEWIYESIMSEEINMNEDKEEEPTVVETIDCFVDYSDAFNTSHVFLTREDILQWARTVAYDIGFVAMMMRSDTSTGKRGRTSFILIC

SEQ ID NO: 120823 - protein, 111 aa, Glycine max
  Coding DNA Sequence Number=SeqID_4045
  Subcellular localization annotation: CTP_CleavageSite=70; ConfidenceScore=5.16e-01
MAGGIPYGYGSNSLPPPPPPPLPPHVTIGLSMPGPQPAQQQQQSPPGFYRPPGIGFYGQSHLSTPPPVPRHMFLWEIAVKAEDFPAGCVIIWCYSPLDEFSELHLAHNLGG

SEQ ID NO: 120824 - protein, 166 aa, Glycine max
  Coding DNA Sequence Number=SeqID_4046
  Gene Ontology: Mol. function=RNA-directed DNA polymerase activity; Biological process=RNA-dependent DNA replication
  Homolog annotation: Hit_ID=Q1RYC6; Match level="QueryCoverage=91%, HitCoverage=28%, E-value=1e-22, Identity=36%"; Hit description=RNA -directed DNA polymerase
MKKIMPSIIDERESTFIEGRHLLQSALIANEVVDEAKRRKKSCIVFKVDYEKAYDSAGILSQMNKVDRGVLEIRIYFSIVREACSKNLFRGFKVGSNSVDISILQYADDTIFFGEASMENVKALKEILRSFALASGLKINFAKSSFGAIDMSDVRQVASNILRRGG

SEQ ID NO: 120825 - protein, 339 aa, Glycine max
  Coding DNA Sequence Number=SeqID_4047
  Gene Ontology: Mol. function=RNA-directed DNA polymerase activity; Cellular component=membrane; Biological process=RNA-dependent DNA replication
MWGDTTVSWEVQPIINSAGGLLCMWTENTFTLQRKVVGNGFICLTGLWIKEALQVHIVNIYSPCDMQSKRVLWETIKHLKTANQGGLWCIMGDFNNIRDPMERMKVCQRGMKESNIQEFNEWIDDMEVEEAPWIGRKFTWFRPNGIARSKLDRFLVSPKWLTKWPGSIQHPLDRNFFGHCLVLLRSKVVDWGPKPFRVQDCWLLNKSFKSIVKECWLSQQQSGWGGFVLKEKIKKLKERLKTWNRDRFGDTLKKYKKIEGELNQLEVNLADRPLSPQQMIIRKQLQEDLWIAAQSHESLLRQKARATWVKEGDCNSRFFHLLVNTTHRNNNLNGVWIEG

SEQ ID NO: 120826 - protein, 60 aa, Glycine max
  Coding DNA Sequence Number=SeqID_4048
MASPMTCRDTQVVIWASKPVDMQRLTSSSSPLSSRDGESDDMRRYPSGYPYKPTSVNLDP

SEQ ID NO: 120827 - protein, 88 aa, Glycine max
  Coding DNA Sequence Number=SeqID_4049
MSPPPLVFTQKNLSNSLELGPFSLQNSLDMQKLQEKAKLHSKIWFQAYIGGFVRARALSAILNRLACISEFRLSTCFSSSADGLKRCA

SEQ ID NO: 120828 - protein, 276 aa, Glycine max
  Coding DNA Sequence Number=SeqID_4050
  Gene Ontology: Mol. function=aspartic-type endopeptidase activity; Cellular component=riboflavin synthase complex; Biological process =RNA-dependent DNA replication
MDRFADDGKLGQGFTLADDLVEVDIGNGDRPRPTFISAKLDSECKQQLTDLLKEYKDCFDWDYTEMPGLDRSIVEHRLPIKSGFRPHQQPDRRCNPSILHDIKAKITKFIEAKLIRQCRYAEWISNVVQVYKKNGKLWVCIDFRNLNKATPMDGYPMPVADLLVDAAAGHQIISFMDGNAGYNQIFMAEEDIPKTAFRCPGHVGLFEWMVMTFGLKNAGATYQRALNFIFHGFIGKLVEIYIDDVVVKSGDFTKHLADLQKVLECTRKHCLKMNPN

SEQ ID NO: 120829 - protein, 48 aa, Glycine max
  Coding DNA Sequence Number=SeqID_4051
MKLSLSRTTPRSGILGTIADKYEASSPLKNNELGLRGSLLQGPGGLVL

SEQ ID NO: 120830 - protein, 230 aa, Glycine max
  Coding DNA Sequence Number=SeqID_4052
  Gene Ontology: Mol. function=RNA-directed DNA polymerase activity; Cellular component=intracellular; Biological process=RNA-dependent DNA replication
MPGLDRSIVEHRLPIKSGFQPHQQPAHRCNPNILPNIKVEITKLIEAKFIRQCRYAEWISNVVPVYKKNGKLRVCIDFRNLNKATPMDGYPMPVADLLVDAAAGHWIISFMDGNAGYNQIFMAEEDIPKTAFRCPGHVGLFEWIVMTFGLKNAGATFQRAMNFIFHEFIGKLVEIYIDDVVVKSGDFTKHLVNMRKRGIEISRRSIDAINKIVAPTNKTELQSLIGKSIT

SEQ ID NO: 120831 - protein, 127 aa, Glycine max
  Coding DNA Sequence Number=SeqID_4053
  Gene Ontology: Mol. function=nucleic acid binding; Biological process= DNA integration
  Homolog annotation: Hit_ID=Q8W5J8; Match level="QueryCoverage=99%, HitCoverage=35%, E-value=8e-15, Identity=39%"; Hit description =Putative retroelement
MDFLLTAFDEQNTLNKRVELKLIKLAAALPVATNIEQVKNITTRGGKATRDPPYPKEKQRTSAPVQPAVIEEESPVEAEDLLQPPRTGEMRKDFYDTNYLLFPRRNRGLQSDEQFGTYICKVHQRYS

SEQ ID NO: 120832 - protein, 220 aa, Glycine max
  Coding DNA Sequence Number=SeqID_4054
LRFLEEGRGCSHAVEPDSDSETDSYDLTRECYHIDGAVETTDETRDAAAGGRATAAREDPRTPVNDGQLDPPPQEDRTAQLAQLRELKMKLDEDRERLVLLEQILEQDLPYPPGGSVRRRAREVHRQIVGDAEPEQPVSRFPRASQNVVAATMLLRNMPEPSNSQARRIRDEVQTLLQVAAVQQAESSASRRRGAATEKHDEQPLNEEEVSVHQQPHPRG

SEQ ID NO: 120833 - protein, 83 aa, Glycine max
  Coding DNA Sequence Number=SeqID_4055
  Subcellular localization annotation: CTP_CleavageSite=34; ConfidenceScore=5.14e-01
MSATPAGYPDLVQVRTPVGSKDVRGVNGVRPRCQAFYAKSESNQSTKISLAYSLVSLYFWFMTDDVVYHGYCANYHHPAADDE

SEQ ID NO: 120834 - protein, 404 aa, Glycine max
  Coding DNA Sequence Number=SeqID_4056
  Gene Ontology: Mol. function=DNA binding; Biological process=DNA recombination
  Homolog annotation: Hit_ID=UPI00005F13DF; Match level="QueryCoverage =95%, HitCoverage=96%, E-value=1e-145, Identity=63%"; Hit description= COG0582: Integrase
  Pfam annotation: Domain name=Phage_integrase; Domain location=215 -376; Score=106.3; E_value=9e-29; Accession=PF00589.13; Description =Phage integrase family
MPLNARQVETAKPRDKAYKLTDGGGLYLMVNTNGSKYWRMKYRFGGKEKKLSFGTYPTISLAEARTKRDEARKVLANDKDPGEVKKAAQLAKKLSVTNTFEAIALEWYNAKVSGWSKSYADYVNRGFKNNVFPFLGSQPVNEIKPLELLSVLQRMEKRGAPELASKVRQRCSEVFRYAIVTGRAEYNPAADLGSALQGHDKQHYPFLTATELPDFLQKLSSYSGSLITLLATRLLMLTGLRTVELRLAEWSEIDFDNRIWEIPKTRMKMKRPHVIPLSTQSLSALRQLEELTGTYPLIFAGRNDVNKAMSEASINMVIKRVGYDKRATGHGFRHTMSTILHEQGFNTAWIEMQLAHVDKNSIRGTYNHAQYLDGRREMMQWYADYLDRLEGTNTIGKSCRGSFI

SEQ ID NO: 120835 - protein, 96 aa, Glycine max
  Coding DNA Sequence Number=SeqID_4057
MEQHQIKELSSPNSTNIDLDKRMSKNRRSLQDIMSMRWDNVFTIHATTNEIDGSVEFSIMLHVRDAKRKLQKRKINTLAENADSHPSTQQGLMFCI

SEQ ID NO: 120836 - protein, 133 aa, Glycine max
  Coding DNA Sequence Number=SeqID_4058
MGETHEIPHHNLADFEPWLGYATKGQAVGGIPLQNPSEGPHFCPQPQPLHFAVGRAPLAMAENGKLDRIEERLKVVEGSEDYAFANLEELFLVPNVVTPPKFKVSDFDKYKETTCPKNHLKDVLSEDGGISKR

SEQ ID NO: 120837 - protein, 76 aa, Glycine max
  Coding DNA Sequence Number=SeqID_4059
  Subcellular localization annotation: CTP_CleavageSite=43; ConfidenceScore=5.01e-01
MRWNTSTVRAVTTLGLPQQSAGLGAILGRWNSVREKSPDPTPSQGGRPGQLGGRPVPSPVRPPLPSRGFSSLLDVR

SEQ ID NO: 120838 - protein, 236 aa, Glycine max
  Coding DNA Sequence Number=SeqID_4060
  Gene Ontology: Mol. function=iron ion transporter activity; Cellular component=integral to membrane; Biological process=iron ion transport
  Homolog annotation: Hit_ID=Q9LZC8; Match level="QueryCoverage=98%, HitCoverage=94%, E-value=3e-36, Identity=43%"; Hit description =Transporter like protein
MEENVKLKESPFTGQQGKPSELITYLYIGHFLARWGARMWKFSVGLYMINIWSESLLYAAIYGAVESASIAVFGSIIGRWVDKLSCVKVSPKVTDEIPITCLSFGTLMTATLKWEGIPAYVIGIARGISVVIGIAATAVYPVLQSHISTIRTGLWSIWSQDLVSESDRLIVGGVQSSLQSLMGLLAYVMGIIISDPRDFWKLTSISSSSHISCIPLLYPRIPCTKAPLPLRPSIVG

SEQ ID NO: 120839 - protein, 501 aa, Glycine max
  Coding DNA Sequence Number=SeqID_4061
  Gene Ontology: Mol. function=iron ion transporter activity; Cellular component=integral to membrane; Biological process=iron ion transport
  Homolog annotation: Hit_ID=Q9LZC8; Match level="QueryCoverage=84%, HitCoverage=93%, E-value=1e-134, Identity=52%"; Hit description =Transporter like protein
  Pfam annotation: Domain name=FPN1; Domain location=267-363; Score =23.2; E_value=0.00049; Accession=PF06963.3; Description=Ferroportin1 (FPN1)
  Pfam annotation: Domain name=MFS_1; Domain location=27-407; Score= -29.4; E_value=0.007; Accession=PF07690.6; Description=Major Facilitator Superfamily
  Pfam module annotation: Pfam domain module=FPN1::MFS_1; Domain location=267-363::27-407
MEETFILRREPLLAQHQETPSSLINHLYIGHFLARWGARMWEFSVGLYMINIWPDSLLYAAIYGAVESASIALFGSIIGRWVDKLCYVKVLQLWLVTQNLSFVVAGATVVALLLNSSLKLTNFSAFILMVLTINICGGIGVLSTLAGTILIEREWLLVISEGQPPEFLTKMNSVTRRIDLTCKLLAPVVTGFIISFVSLKASAITLALWNTVSVWVEYWLFTSVYKGIPALGQSSQRRMARLLESDQERSNPTLEGDRLLPVTDGSSELVDRKCSKKLYEKISEIPYIAAWRVYLQQEVVLPGLALALLFFTVLSFGTLMTATLEWEGIPAYVIGLARGISALIGIAATIVYPLLQSHISSIRTGLWSIWSQDLVPESDRLIVGGVQNSLQSLMDLLAYVMGIILSDPGDFWKLTLLSFLAVTLAAFLYCIHVLNLKKQTSLLVTNVFNIFALNGIRSLSLPSSQLLQLLPFLSESHLKCDIIDIVALGSIMNNATIKCFL

SEQ ID NO: 120840 - protein, 105 aa, Glycine max
  Coding DNA Sequence Number=SeqID_4062
MCLAIKFPLLFEAIKVSVKPTVTTFFLQSQCEYTIGSSLVILLTKNSHSTTTPHEKMVQKKTQYTKLARKQKESHRKKTHFIENNQDSLTNIPHRCRISQLLIPC

SEQ ID NO: 120841 - protein, 166 aa, Glycine max
  Coding DNA Sequence Number=SeqID_4063
  Gene Ontology: Mol. function=nucleic acid binding; Biological process= DNA integration
  Homolog annotation: Hit_ID=Q1T010; Match level="QueryCoverage=93%, HitCoverage=15%, E-value=3e-20, Identity=31%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=82-99; Score =27.3; E_value=3.1e-05; Accession=PF00098.13; Description=Zinc knuckle
MVNAMRACKEIISYQQVVEKILRTLHHGKEPWKGNKSNTATKNQEQVIVEGSESSKGKTTCQTSQKSNYNNNKEWKLDKRKVKCYNCQKLGHYAKEFWQGEGAKNKLNNHANLAQDEGSDSELVLLMATISSESSSDFSWYLDSGCSTHMTRKRDWFINLNKSSKS

SEQ ID NO: 120842 - protein, 346 aa, Glycine max
  Coding DNA Sequence Number=SeqID_4064
  Gene Ontology: Mol. function=methyltransferase activity; Cellular component=nucleus; Biological process=fatty acid biosynthetic process
  Homolog annotation: Hit_ID=Q2HRW2; Match level="QueryCoverage=99%, HitCoverage=93%, E-value=1e-125, Identity=67%"; Hit description=SAM dependent carboxyl methyltransferase
  Pfam annotation: Domain name=Methyltransf_7; Domain location=13-345; Score=467.4; E_value=1.8e-137; Accession=PF03492.6; Description=SAM dependent carboxyl methyltransferase
MQRKVAMKVKIILEENVKRMMSNINIESCCKIADLGCSSGPNALITMSNILNIMYNASLSLNKRVPRVFQIYLNDLFGNDFNSIIKLIPDFYQSIHQEKRGNFGTCFIHATPGSFYGRLFPDNYIHFFHSSYSLHWLSQAPKTSSNIAIPLNKGNVYITSTSSSLVYEAYFKQFEKDFKLFLKSRSEELRSGGIMVLTFIGRDKTRKINNPAEVIGMVLNGMVQEGLVEEEKLDFFDLPIYGPTAEEVGQVIEREGSFTLQTLKTIKIGWDANLEEEVDDGILDSKIRGEFIAKSIRAVLEPILSAEFSEDIMDELFSRYATLVAQLIEVETLEYTNVVVTLTKHS

SEQ ID NO: 120843 - protein, 60 aa, Glycine max
  Coding DNA Sequence Number=SeqID_4065
MEDGETLKLICILSWVLESFDLGAWEQLMVTKVNTRMETHMEAMEKEIDENREEMEARPL

SEQ ID NO: 120844 - protein, 68 aa, Glycine max
  Coding DNA Sequence Number=SeqID_4066
MEHITTSDERFKSLESTMSNIVTLMSQRTLDTLPSQTKVNPQNEEINVVSTRSGKSVVELKKKESLEH

SEQ ID NO: 120845 - protein, 129 aa, Glycine max
  Coding DNA Sequence Number=SeqID_4067
MKVIVAKPHPSVGKKNPSKNKVIPKDPGWSKKKGDDIIIQALGYGVDDYTRVLVKKTMFKVDRFFPFFIREAYDVKQALFGRQPMTCIHILCFSHNFLSFVKSNCLSIRGPWSFDHDPCIYRQNRVWLW

SEQ ID NO: 120846 - protein, 127 aa, Glycine max
  Coding DNA Sequence Number=SeqID_4068
  Gene Ontology: Cellular component=cytoskeleton; Biological process =phagocytosis
  Homolog annotation: Hit_ID=Q1SD88; Match level="QueryCoverage=63%, HitCoverage=25%, E-value=6e-26, Identity=67%"; Hit description =Engulfment and cell motility, ELM
  Subcellular localization annotation: CTP_CleavageSite=22; ConfidenceScore=5.15e-01
MEKANLVLGSGSILGRLLSFPSAALNMQNNRMFPPSLSPLQEERLRNLRQRLEVPFDGSKAEHQDALKQLWKLAYPDRELPSLKSDLWKEMGWQGSDPSTDFSFLCTFGTNGLQSLGMFLWNAEVAS

SEQ ID NO: 120847 - protein, 73 aa, Glycine max
  Coding DNA Sequence Number=SeqID_4069
MVMVLVGMPSSLQRRNENFSLTEELQRWHSERNGGPPQQIYQHCKAGKCQSQFHSGIEEKTKGAIVDILERDK

SEQ ID NO: 120848 - protein, 261 aa, Glycine max
  Coding DNA Sequence Number=SeqID_4070
  Gene Ontology: Mol. function=catalytic activity; Cellular component =cytosol; Biological process=metabolic process
  Homolog annotation: Hit_ID=Q75LI3; Match level="QueryCoverage=99%, HitCoverage=94%, E-value=3e-93, Identity=64%"; Hit description =Expressed protein
  Pfam annotation: Domain name=Hydrolase; Domain location=35-216; Score= 1.8; E_value=0.034; Accession=PF00702.16; Description=haloacid dehalogenase-like hydrolase
MDDTLYPLSTGLNLACRKNIEGYMLKHLLMEESEVPKLCVDLYREYGTTMAGLKAFGYEFDNDEFHAYVHGRLPYEKLKPDPVLRSLLLSMPQRKIVFTNADQAHAHQVLNRLGLNDCFDGIICFETLNPPNYTNVPTDTHLLTWSKSFNKDCNQVESGCFNSKTQILCKPSVEAIEAAIQIANVDPRKTLFFDDSARNIASGKAAGLNTVIVGRSDLVPGADYALNSIHNIKEALPKIWEVEGELQQMIQSPAVETMVLA

SEQ ID NO: 120849 - protein, 246 aa, Glycine max
  Coding DNA Sequence Number=SeqID_4071
  Gene Ontology: Mol. function=peptidyl-prolyl cis-trans isomerase activity; Cellular component=chloroplast; Biological process=protein folding
  Homolog annotation: Hit_ID=Q41651; Match level="QueryCoverage=99%, HitCoverage=100%, E-value=6e-51, Identity=46%"; Hit description =Peptidyl-prolyl cis-trans isomerase, chloroplast precursor
  Pfam annotation: Domain name=Pro_isomerase; Domain location=85-242; Score=185.6; E_value=1.2e-52; Accession=PF00160.11; Description =Cyclophilin type peptidyl-prolyl cis-
  Subcellular localization annotation: CTP_CleavageSite=78; ConfidenceScore=5.61e-01
MASSLSAQLVQCQNSLPPLQANFSQDVSKVQRSHVVCCGTKSPIGYGKTLASRSHNALRFSVTQQSVARSIRYRRMTCVNAADSVVELQAKIKLNSLCTDEKGYGYKGSSFHRIIKDFMIQGGDFTEGNVSSVIVVCMPAYMELVELVSMVLVLKMRVLPFQHFLAVKHVGPGILSMANAGPNNNGSQFFIFTVKTLWLDNWHVVFGHIIDGMDVVKTLESQETSRSDVPRKPCRIVNCGELPIEG

SEQ ID NO: 120850 - protein, 105 aa, Glycine max
  Coding DNA Sequence Number=SeqID_4072
MWNNTVATLMIAKPQRQCLNIAIDKVGEQEPRPWHKTRGKEQAEEEAIGADSEVEVRVAGGEKKKPTLQDSVLASFYATLSRNSKWVASLSASEFDDDDDDGAWW

SEQ ID NO: 120851 - protein, 78 aa, Glycine max
  Coding DNA Sequence Number=SeqID_4073
MDSFEVDSGCSGMLINLELDTSTLTATTEAAGASTQLSWGPILSPISFFLLYYTKKRENLTSFIVGNSNILLQAIILF

SEQ ID NO: 120852 - protein, 763 aa, Glycine max
  Coding DNA Sequence Number=SeqID_4074
  Gene Ontology: Mol. function=protein phosphatase type 2C activity
  Homolog annotation: Hit_ID=Q1S8C9; Match level="QueryCoverage=99%, HitCoverage=78%, E-value=2e-51, Identity=43%"; Hit description =Protein phosphatase 2C, putative
MGNGTSRVVGCLMPFNGKSGVDLEFLEPLDEGLGHSFCYVRPSIFESPAITPSNSERFTVDSSTLDSETLSGSFRHESIEERPGKNVAETTFKTISGASVSANVSTARTGNQNALLASDVLEPAASFEGTSSFAAIPLQPVPRGSGPLNGFMSGPLERFSSGPLDKGGGFMSGPIEKGVMSGPLDATDKSNFSAPLARGRRRPHLQRLMRSVSGPMRNTFSRTFSRHSMGGSWVQRLFLHPVSQLAWNSKEAKFRQEVSRNCAEVGSSELEYKHTQNLQWAHGKAGEDRVHVVLSEEQGWLFIGIYDGFSGPDAPDFLMSHLYKFIDKELEGLLWDYEDNPVDPLKPEVLKNGNDVVALECDREEMSDAHTISNEESSCCLENSCTVMVKDQSSNSEIVEVNAEVKVNIEQRNCGSPSIVHTDPESVPIGQLSGQGRRSVRLYELLQMESWNEQLLEQGRDSVVPREIAQERQMRFCSPDGKEDRSRHPDEGPTTSGQNGGAGFNSTNQVPIAPFSISGQRQNSRKSFIGTKIRKMYRKQKSLRKKLFPWSYDWHREETFFDQKLVESSGPIRICKSGVDHNAVLRAMARALERTEEEYLKMVENNMDKNPELALMGSCVLVMLMKDQDVYVMNLGDSRAILAQERPNDRHSNPCLIKDDMRHRNRSRELLVGMELDRISEESPVHNINKHVNMINKNREISVCRLKMRAVQLSTDHSTSIEEEVSRIRAEHPDDNQAIFNDRVKGQLKVTRAFGAGFLKRVS

SEQ ID NO: 120853 - protein, 52 aa, Glycine max
  Coding DNA Sequence Number=SeqID_4075
MSNVRINVKRKRVIRARMKITNDDLSVGTTASARRHLGWRCNDVGERTRARV

SEQ ID NO: 120854 - protein, 211 aa, Glycine max
  Coding DNA Sequence Number=SeqID_4076
  Gene Ontology: Cellular component=extracellular region; Biological process=cellulose and pectin-containing cell wall organization and biogenesis
  Homolog annotation: Hit_ID=Q9ZSI1; Match level="QueryCoverage=99%, HitCoverage=82%, E-value=1e-101, Identity=79%"; Hit description =Putative expansin-A17 precursor
  Pfam annotation: Domain name=DPBB_1; Domain location=19-107; Score =167.2; E_value=4.1e-47; Accession=PF03330.8; Description=Rare lipoprotein A (RlpA)-like double
  Pfam annotation: Domain name=Pollen_allerg_1; Domain location=118 -196; Score=143.9; E_value=4.3e-40; Accession=PF01357.11; Description= Pollen allergen
  Pfam module annotation: Pfam domain module=DPBB_1::Pollen_allerg_1; Domain location=19-107::118-196
MGGACGYGNLYTDGYGTKTAALSTVLFNDGKSCGGCYRIVCDASQVPQWCLRGTSIDITATNFCPPNLALPNDNGGWCNPPRPHFDMSQPAFQTIAKYKAGIVPILYMKVGCKRSGGIRFTINGRDYFELVLISNVGGAGEISRVWVKGSRMNNWESMTRNWGANWQSLRYVNGQSLSFRVQLRNGKTRTANNVAPSNWRFGQSFSSNVQF

SEQ ID NO: 120855 - protein, 244 aa, Glycine max
  Coding DNA Sequence Number=SeqID_4077
  Gene Ontology: Mol. function=drug transporter activity; Cellular component=membrane; Biological process=multidrug transport
  Homolog annotation: Hit_ID=Q1SD91; Match level="QueryCoverage=98%, HitCoverage=57%, E-value=1e-98, Identity=63%"; Hit description=Multi antimicrobial extrusion protein MatE
  Pfam annotation: Domain name=MatE; Domain location=58-180; Score =30.8; E_value=4.8e-06; Accession=PF01554.9; Description=MatE
MQFKYGIPGAMISTILAYWIPNIGQLIFITCGWCPETWKGFSVLAFKDLWPVAKLSISSGAMLCLEFWYSTILILLTGNMKNAEVQIDALSICININGWEMMIAFGFMAAAREKVAYLFTSNEDVATAVGDLSPLLAVSLLLNSIQPVLSGVAVGAGWQSTVAYVNIGCYYLIGIPVGIVLGNIIHLQVKGIWIGMLFGTLIQTIVLTIITYKTNWDEQVIIARSRINKWSKVESDHETTTSDN

SEQ ID NO: 120856 - protein, 249 aa, Glycine max
  Coding DNA Sequence Number=SeqID_4078
  Gene Ontology: Mol. function=drug transporter activity; Cellular component=membrane; Biological process=multidrug transport
  Homolog annotation: Hit_ID=Q1SD91; Match level="QueryCoverage=92%, HitCoverage=45%, E-value=1e-92, Identity=75%"; Hit description=Multi antimicrobial extrusion protein MatE
  Pfam annotation: Domain name=MatE; Domain location=1-113; Score=13.2; E_value=0.00036; Accession=PF01554.9; Description=MatE
MASALSTLCGQAYGAKEYDMMGVYLQRSWIVLFLTAICLLPLLIFAIPILTLLDQDETIAQVAGTISLWSIPVLFSFIVSFTTQTFLQSQSKNIIIAFLAAFSIVIHVFLSWLLTMKFKLGIAGAMTSTSLALWIPNIGQLIFITCGWCYDTSKWKGFSFLAFKDLWPVVKLSLSSLPTNGLILELWYSTILILLTGNMEDAEVQIDALSICLNINGWELMISLGFMAAARRTDLNKHLRLSSIVLEGL

SEQ ID NO: 120857 - protein, 58 aa, Glycine max
  Coding DNA Sequence Number=SeqID_4079
  Homolog annotation: Hit_ID=Q6QXQ2; Match level="QueryCoverage=64%, HitCoverage=71%, E-value=2e-08, Identity=78%"; Hit description =Ribosomal protein L2
MTSPSMPCDNDSSGITAFTTTMLSIDQMISWIGFYLTVYGSIACAWGVHVHGGGGDPK

SEQ ID NO: 120858 - protein, 259 aa, Glycine max
  Coding DNA Sequence Number=SeqID_4080
  Gene Ontology: Mol. function=RNA-directed DNA polymerase activity; Cellular component=riboflavin synthase complex; Biological process =RNA-dependent DNA replication
MDRFADDGKLGQGFTSADDLVEVDIGGGDKPRPTFISAKLDSECKQQLTDLLKEYRDCFAWDYTEMPGLDRSIVEHRLPIKSRFRPHQQPAHRCNPNILPDIKAELTKLIEAKFIRQCRYAEWISNVVPVYKNNGKLRVCIDFRNLNKATPMDGYPMLVADLLVDAAARHRIISFMDGNAGYNQIFMAEEDIPKTAFRCPGHVGLFEWVVMTFGLKNAGATYQRAMNFIFHEFIGKLVEIYIDDVVVKSRDFTKHLADL

SEQ ID NO: 120859 - protein, 300 aa, Glycine max
  Coding DNA Sequence Number=SeqID_4081
  Homolog annotation: Hit_ID=O05000; Match level="QueryCoverage=15%, HitCoverage=9%, E-value=5e-14, Identity=86%"; Hit description=NADH -ubiquinone oxidoreductase chain 2
HSVSPPKPIPNWVEEVDLPTEDQNDTINDLRDKCAILLESFSKNQSRDRFTWQDIAQRLVLEGKGTTAEVGATREDFQHAEAPFITQGWINLVETGIVGLAAGLAIPPSRRLECSLPVEDQIFIINATSILLIHGVVFSTSKKYDYPPLVSNVGWLGLLSVARLGGQRALGCGGAKQLERMNVRGAKKAQLPNLMRHRVRTAGNRSMGGSGSNTPGSGRHMSPNAMLNVRPTLHYVGTCAGEASGSGGHSTILLGGGLVCPAKGAMPWSEEYPESHVRQLNAPRGAAEELGDLLEHRIGN

SEQ ID NO: 120860 - protein, 198 aa, Glycine max
  Coding DNA Sequence Number=SeqID_4082
MDHTIPHMALLIYCPIRILRHKKSHEHSGLAAGFDPMGTIKMTPKRHFDGHAGKPKNIDAQSVSFRDTPEIKWKHRCIIKKSKPRRFRNVSVTFSVKNFAKVSTVLRRSSFVLHRSSIFNGLPSLGTDVWGANTFPVRKYNSRTFHLKVRRSRLFRFFRRFPQINVGGDSARIPFVEHASRESRVALPPKGRLRQLYI

SEQ ID NO: 120861 - protein, 559 aa, Glycine max
  Coding DNA Sequence Number=SeqID_4083
  Gene Ontology: Mol. function=nucleic acid binding; Biological process= metabolic process
  Homolog annotation: Hit_ID=Q1S3K9; Match level="QueryCoverage=97%, HitCoverage=91%, E-value=0.0, Identity=64%"; Hit description=IQ calmodulin-binding region
MTKSNRRFRTYNSDSGKITIHYDTFVSFDSKDIDKEKNMTMPRIRERSKVMDDRSEEDIQSALLDPDNPKYRAALKLQKVYKSFRTRRKLADCAILIEQSWWKLLDFAELKHSSISFFNIEKHETAISRWSRATTRAAKVGNGLSKDDKAQKLALQHWLEAIDPRHRYGHNLHFYYAKWLKCQSREPFFYWLDIGEGKEVNLEKCPRSKLQHQCIKYLGPMERLPYEVVVKDGRFFYRQSGKLLHTTGEGAHTKWIFVLSTSKILYVGKKKKGSFQHSSFLAGGATSCAGRLVVEYGMLKAVWPHSGHYRPTEENFKEFISFLLENDVQLSYVKMTSVDEEYHSSEEDFTENMSGLEAEEKANLMETKRTSAPVGHKTRQFQIFGRDLTSLEIPKRGHVLEGPENEKGGAGLSSKSFQMDSPTGDQETEQAFASELDNTITKQNFFDDDSHVGTIPKKSTLKRIASHKEMKSYQLGKKLSCKWTTGVGPRIGCVRDYPCKLQFRALEQVSLSPRSGCHSTSPRVSTPVSKISPKSLLRGLEHNTPLVRGISVIPVIHTS

SEQ ID NO: 120862 - protein, 405 aa, Glycine max
  Coding DNA Sequence Number=SeqID_4084
  Gene Ontology: Mol. function=zinc ion binding; Biological process =cell redox homeostasis
  Homolog annotation: Hit_ID=Q1S8X5; Match level="QueryCoverage=80%, HitCoverage=90%, E-value=1e-113, Identity=63%"; Hit description=Zinc finger, RING-type; RINGv
  Pfam annotation: Domain name=zf-C3HC4; Domain location=268-308; Score= 43.1; E_value=9.5e-10; Accession=PF00097.15; Description=Zinc finger, C3HC4 type (RING finger)
MARFDHFWNLDEFIVSTLTTDRLKRNIVEETMAARYWCHMCSQMVNPIMDMEIRCPFCQSGFVEEMGNTPSSSSIPNTSESDFESDRALSLWAPILLGMMGNPRHPRRLRQIANDNGNRDYVDGVADHGRETEYDQEFESILRRRRNSATILQLLQGIRTGLASESYENTDGHDHDREREREREREHMILINPLNQTIIVQGSYESNRDQSDNHSSVGSLGDYFTGPGFDILLQHLAENDPNRYGTPPAQKEAIEALPTVIINENSQCSVCLDDFEVGSEAKEMPCKHRFHSGCILPWLELHSSCPVCRLQLPLDESKQDSDLSRDSRSQREDESIEHDNDEERDGEGRNASGADFVKVCNPEVEKRDGRASHVVKELLGKTGEWGLGEGAKRFLLFQFGELAEI

SEQ ID NO: 120863 - protein, 252 aa, Glycine max
  Coding DNA Sequence Number=SeqID_4085
  Gene Ontology: Mol. function=hydrolase activity; Biological process =aromatic compound metabolic process
  Homolog annotation: Hit_ID=Q00T86; Match level="QueryCoverage=69%, HitCoverage=52%, E-value=8e-49, Identity=51%"; Hit description=[R] KOG1454 Predicted hydrolase/acyltransferase
  Subcellular localization annotation: CTP_CleavageSite=42; ConfidenceScore=5.49e-01
MAMSVGVALPSTTTSLSFLRYRSRSPIQNKIRFPRQIVSKLNSAEVQVQTCLQALYCSVWDWRGYSIRYQHSGNIGPALVLVHGFGANSDHWRNNISVLAQSHRVYSIDLIGYGYSDKPNPRQIGDHSFYTFETWATQLNEFCLDVIKDEAFFICNSIGGVVGLQAAVLAPHICQGIILLNISLRMLHIKKQPWYGKPFIRSLQRLLRDTDVGKFFFKTIATKESVRNILCQYAGQPKKKEMPDDETVNELE

SEQ ID NO: 120864 - protein, 277 aa, Glycine max
  Coding DNA Sequence Number=SeqID_4086
  Gene Ontology: Mol. function=identical protein binding; Biological process=negative regulation of enzyme activity
  Homolog annotation: Hit_ID=Q9STQ2; Match level="QueryCoverage=77%, HitCoverage=89%, E-value=5e-27, Identity=49%"; Hit description =Subtilisin protease-like
  Pfam annotation: Domain name=Subtilisin_N; Domain location=51-120; Score=24.1; E_value=0.00051; Accession=PF05922.7; Description =Subtilisin N-terminal Region
MAFPVRIRNAVQGANKDKPADLTLTRIRSQKGEEKRKNSPITVWIGMSPPKHDPANLWCQLSIHFSTKSPSEKDAENCILHSYKYSFSGFSAMLNPTQAATLANMREVVSVYRSESSQSHTTRSWDIMDLNLDSSEVTPLQLIYGEDIIVGVLDTAYTLDTTLDSILSGGSTKVADPFNMGAGHINPSKAVDPGLIYDIKSTDYVSFLCNMGFTQEQINKITDHPSPEPVHASCKHLVTKTNAILNYPSITLSNLHSTVTIKRTVRNVGRNKNFIFC

SEQ ID NO: 120865 - protein, 215 aa, Glycine max
  Coding DNA Sequence Number=SeqID_4087
  Homolog annotation: Hit_ID=Q1T2D5; Match level="QueryCoverage=41%, HitCoverage=8%, E-value=5e-09, Identity=38%"; Hit description=Chromo
MERCKAQTALPETRNGHDGAITRTNNAILEHGIDLRLDFLLLEVRISVRELIDDIEDGGLSVWEIVWEIFRWGTNTNVKEFTYTSYLGAFNCVAIADKHVNGLDEVSLHKVMCAASVNQNRDMVEVNPAGLSILGLSVGSSSARRSRNREGQRWPLVNFSSQWKQSPRSRRLAISSGVKRLMGKGGGLGEEGSNGGLGVGVTTERGVGECCGGLG

SEQ ID NO: 120866 - protein, 260 aa, Glycine max
  Coding DNA Sequence Number=SeqID_4088
  Gene Ontology: Mol. function=RNA-directed DNA polymerase activity; Cellular component=chromatin; Biological process=chromatin assembly or disassembly
  Pfam annotation: Domain name=rve; Domain location=21-135; Score=15.1; E_value=0.00033; Accession=PF00665.16; Description=Integrase core domain
MKEDIQRYITNCITCQQIKADHRHPPGLLCPLPESIWDLYLHISSHSVSRSYSWNFPVNSMELFKMSGTKLGMSSAYHPQSDGQTEAMNRIVEQYLRAFVHQNPATWGRFLVWAEWSYNTSVHSATGKTPYEVTYDKQPPSLPQYITGSSNIQVVDEWLTNRETLNASLIKKLTKAQQKMKEIADKQRRDWAGLPPEDTSWEKWEILKRDYNLEDKVVLEVGGTAMNSELAPETQSTKEEEVGAKRRIIRPKYLEDYIAK

SEQ ID NO: 120867 - protein, 229 aa, Glycine max
  Coding DNA Sequence Number=SeqID_4089
  Homolog annotation: Hit_ID=O80903; Match level="QueryCoverage=76%, HitCoverage=91%, E-value=1e-27, Identity=38%"; Hit description =Expressed protein
  Pfam annotation: Domain name=DUF588; Domain location=48-181; Score =71.9; E_value=2e-18; Accession=PF04535.3; Description=Domain of unknown function (DUF588)
MEDQKEKISGSKYLETNIDVQPEPSVDKHEPETDDGGATEVQRQWKRKEMLTFGPLGLRGIALSMSLFSLIFMARNKYGYGYEFDKFEEYRYLVAVATLSTLYTAVQVFRQVHEISTMKSLMQPRTEGLIDFVGDQVLAYLLISSTSSAIPLTDQMRKVTINVFTDFSAASIAFSLFAFCSLALSAVVSGYKLSTQTYTPIAMDSELAPETGAKRRIIRPKYLKDYITK

SEQ ID NO: 120868 - protein, 188 aa, Glycine max
  Coding DNA Sequence Number=SeqID_4090
MDRIKEAIAKLASSHLLLTEKLDELINRVTNLENTANPSPSPSSSSAIPIPQIQSTTPHRLKLDVPRFDRSDPSGWYSKLPSSLNTTQPLRLRGSPSRPFTWTDRPCVAIEARFAQSPYEDPTGLLFKLTQKGIVKEYLAQFEALANRIMGLSPASLLSCFISGLEPDVRHAVQALQPLTLVHAAGLA

SEQ ID NO: 120869 - protein, 152 aa, Glycine max
  Coding DNA Sequence Number=SeqID_4091
  Gene Ontology: Mol. function=serine-type endopeptidase activity; Biological process=proteolysis
  Homolog annotation: Hit_ID=P76176; Match level="QueryCoverage=99%, HitCoverage=57%, E-value=3e-46, Identity=57%"; Hit description =Putative protease ydgD precursor
MRLAILLFVGLFSFNLTAHADDEDGPSPEEIKTLFFGKDHRKAITDVSAAPWDAIGQLETESGNLCSATLISAHLALTAGHCLLTPPGKFDKPVALRFMAGAKGWRYEIHDIDARVEPSLARRLQADGEGWIVPPDAAPYDYGLVILHNPPS

SEQ ID NO: 120870 - protein, 235 aa, Glycine max
  Coding DNA Sequence Number=SeqID_4092
  Gene Ontology: Mol. function=sequence-specific DNA binding; Cellular component=nucleus; Biological process=regulation of transcription
  Homolog annotation: Hit_ID=Q40090; Match level="QueryCoverage=93%, HitCoverage=56%, E-value=5e-65, Identity=51%"; Hit description=SPF1 protein
  Pfam annotation: Domain name=WRKY; Domain location=66-124; Score =139.0; E_value=1.3e-38; Accession=PF03106.6; Description=WRKY DNA -binding domain
MISSEAAKQTDFSSERTETKPEYPSTQGFSAALASIKPEIQSNSAPGSVHFNSTYAPKSIREQKRSEDGYNWRKYGEKQVKGSENPRSYYKCTHPSCPTKKKVERSLEGHITEIVYKGSHNHPKPLGRKNGSQSIHQTSSSCTNSGISDQSVGEEDLEQTSQTSYSGGGDDDLGNEAKRWKGENENDGHSYSSAGSRTVKEPRVVVQTTSEIDILDDGYRWRKYGQKVVKGNPNP

SEQ ID NO: 120871 - protein, 480 aa, Glycine max
  Coding DNA Sequence Number=SeqID_4093
  Gene Ontology: Mol. function=catalytic activity; Biological process =metabolic process
  Homolog annotation: Hit_ID=Q1S8X4; Match level="QueryCoverage=96%, HitCoverage=31%, E-value=0.0, Identity=82%"; Hit description =Rhodopsin-like GPCR superfamily
  Pfam annotation: Domain name=TRAP_240kDa; Domain location=1-460; Score=-256.2; E_value=0.00015; Accession=PF06333.3; Description =TRAP240
MSNRYQDDWLKTSANSLQHWEKAPLEPYALQKPITYHVVCPDIDPLTSAAADFFQQLGTVYETCKLGTHSPQGLGNQIEIESAKLSSCGFVLLDCPQSMKIESSNASLVGSVIYVVCPFPDPTAILQTVIESSVAIGSVVQQSDRERRSSLHSQVVKALSGLATVDEASASNILVLSGFSIPKLVLQIVTVDAIFRVTSPSVSELVILKETSFTVYSKARRISRGISSDFAQSAFSSRSHSGLTQMPSPISGMWKDCVGPRMAGHSLPREGDIDASLRPGTWDNSWQPTRTGGLSCDPSRTGDNFLHDEIRYMFEPLFILAEPGSLENGISVIGSPTSESSKALADDSSGNYVQSTSTAGSVESASSTDASGSDPKTPPSLHCCYGWTEDWRWLVCIWTDSRGELLDCNIFPFGGISSRQDTKGLQCLFVQILQQGCLILQSCDPGLAKPRDFVIARIGGFYELEYLGKSVSASCEIYYM

SEQ ID NO: 120872 - protein, 398 aa, Glycine max
  Coding DNA Sequence Number=SeqID_4094
MVYISAHAKLERRDFSNEEGKEAELLAMEGSDDGMLAEHSLDLVRDPFDGSRIGSDIKKKSEPNSTLKASLKSEVVILLGLPLWTADCLSSPVLSLLLLTIPTTRKTTLSLRLNNKNKLKQGIGFVTRAVEQSTKVLKTGGGDDGGGGGFGGGGGCGDGIGENPNPMRKNLVSVGGVPEQDDVIVVGDLANEINGVNRKRNYLRFEMVKSNGRQRGSVTLINGDDVDTVVLPHPDGEVGGTGIDSESGWVWGFGAGMRGMEAELVWGAYWAWVHLVEVASLDCPIPEDKAGEEPFDGGAGGDGGDGCYHCGEGEVGEEDAGVRASRQCRMESSFPFKSLRTWKNALVNGGLTDMMFWHGGVEEKEAGRTNCYELGLSYFMLNYSNDYLLLRPMLGVLK

SEQ ID NO: 120873 - protein, 400 aa, Glycine max
  Coding DNA Sequence Number=SeqID_4095
  Gene Ontology: Mol. function=drug transporter activity; Cellular component=membrane; Biological process=multidrug transport
  Homolog annotation: Hit_ID=Q1SD89; Match level="QueryCoverage=99%, HitCoverage=99%, E-value=1e-166, Identity=73%"; Hit description =Multi antimicrobial extrusion protein MatE
  Pfam annotation: Domain name=MatE; Domain location=1-113; Score=7.4; E_value=0.00075; Accession=PF01554.9; Description=MatE
  Pfam annotation: Domain name=MatE; Domain location=173-336; Score =130.6; E_value=4.3e-36; Accession=PF01554.9; Description=MatE
  Pfam module annotation: Pfam domain module=MatE::MatE; Domain location=1-113::173-336
MSSALSTLCGQAYGAKEYAMMGVYLQRSWIVMSLTTLFLLPVFIFTRPILMLLGQDEIIAEVAGTISLWSIPIIFAFIASFTCQNFLQSQSRNTIIALLAAFSIVIHVFLSWLLTIQFKLEIPGAMTSTSLAFWIPNIGQLIFITCGWCSDTWKGFSFLAFKDLWPVVKLSLSSGVMLCLELWYNTILVLLTGNMENAEVQIDALSICLNINGWEMMISLGFMAAASVRVANELGKGSSKAAKFSIVVTVLTSLAIGFVLFLFFLFLREKLAYIFTTNKDVAQAVGDLSPLLAISILLNSVQPVLSGVAIGAGWQSIVAYVNIGCYYIIGVPVGVLLGNVLNLQVKGIWIGMLFGTFILTVVLIVITYKTDWDKQVIIARNRINKWSKVESDHEIITSDN

SEQ ID NO: 120874 - protein, 132 aa, Glycine max
  Coding DNA Sequence Number=SeqID_4096
  Gene Ontology: Mol. function=sequence-specific DNA binding; Cellular component=nucleus; Biological process=regulation of transcription
  Homolog annotation: Hit_ID=Q942D2; Match level="QueryCoverage=31%, HitCoverage=16%, E-value=2e-13, Identity=78%"; Hit description =Putative WRKY DNA binding protein
  Pfam annotation: Domain name=WRKY; Domain location=104-131; Score= -4.5; E_value=0.0025; Accession=PF03106.6; Description=WRKY DNA -binding domain
MESQDPQNSPPFLFTPMSMMQNPNLEPQGLHDDIDWVSLFSGQSNFLADANAMMECASSSSSSSSSSCALMAEKSDKETMKGGRLRKTTRPRFAFQTRSEDDILDDGYRWRKYGQKAVKNNMHPSIFKGLKD

SEQ ID NO: 120875 - protein, 138 aa, Glycine max
  Coding DNA Sequence Number=SeqID_4097
  Gene Ontology: Mol. function=3-methyl-2-oxobutanoate hydroxymethyltran sferase activity; Cellular component=membrane fraction; Biological process=pantothenate biosynthetic process
  Homolog annotation: Hit_ID=Q9M315; Match level="QueryCoverage=91%, HitCoverage=41%, E-value=2e-41, Identity=63%"; Hit description=3 -methyl-2-oxobutanoate hydroxy-methyl-transferase-like protein
  Pfam annotation: Domain name=Pantoate_transf; Domain location=1-137; Score=-68.7; E_value=1.3e-10; Accession=PF02548.6; Description =Ketopantoate hydroxymethyltransferase
MVTAYDYPAVVHLETAGVDICLVGDSAAMVVHGHHTTLPITLEEMLVHCRAGARGAKTPLLVGDLAFGIYESSSNQLGGRTLLAIVVLTESNSIAFGGGYCGLTSQAISVFGGFRPQGKNVASAVKVCLHASIWGLSD

SEQ ID NO: 120876 - protein, 139 aa, Glycine max
  Coding DNA Sequence Number=SeqID_4098
  Gene Ontology: Mol. function=metal ion transporter activity; Cellular component=integral to membrane; Biological process=metal ion transport
  Homolog annotation: Hit_ID=Q1SX80; Match level="QueryCoverage=77%, HitCoverage=26%, E-value=1e-44, Identity=81%"; Hit description =Zinc/iron permease
  Pfam annotation: Domain name=Zip; Domain location=1-136; Score=-58.5; E_value=0.0017; Accession=PF02535.12; Description=ZIP Zinc transporter
MKTFYGCNLNMFELYNGKPDIKLHIRRAISIYQGFALGGCISQAQFKASSATIMASFSALTTPLGVGIGMGISSGYNPYSTQGILDSLSSGILVYMALVDLIAADFLSKRMSCNFGLQILSYCMLFLGAGLMSSLAIWA

SEQ ID NO: 120877 - protein, 81 aa, Glycine max
  Coding DNA Sequence Number=SeqID_4099
  Homolog annotation: Hit_ID=Q1SI90; Match level="QueryCoverage=97%, HitCoverage=4%, E-value=6e-08, Identity=40%"; Hit description =Disease resistance protein; AAA ATPase
MTNLENVWNEDPNGILIMQLLQQVCVHKCESLTSVFPASVAKDLVKLEDLVVEDCEGLMAIVAEDNADPTGANLELTFPHH

SEQ ID NO: 120878 - protein, 171 aa, Glycine max
  Coding DNA Sequence Number=SeqID_4100
  Homolog annotation: Hit_ID=Q1STU5; Match level="QueryCoverage=56%, HitCoverage=58%, E-value=8e-11, Identity=35%"; Hit description =Leucine-rich repeat
ASEREKYSSEKEEIDAYKEQKKWENRVLTGEVLRAFLILSLMMIRFLVSFLCTLKGVKNYTRFSRVTWKGWFESLESLKVFECWSVEVIFKIKDSQQIDASAGIDTNLWLILVDNLPKLKQVWSTDPKGILNFKNLPSIVVSCCHKPRDVFPASVAKDVQKLECMSVQFCQ

SEQ ID NO: 120879 - protein, 219 aa, Glycine max
  Coding DNA Sequence Number=SeqID_4101
  Homolog annotation: Hit_ID=Q19QU4; Match level="QueryCoverage=99%, HitCoverage=100%, E-value=7e-53, Identity=47%"; Hit description =Plant cell wall protein SlTFR88
  Pfam annotation: Domain name=Hin1; Domain location=59-197; Score =83.4; E_value=6.9e-22; Accession=PF07320.4; Description=Harpin -induced protein 1 (Hin1)
MLETEQARPLAPSIERQSSDEDNTTPHPQTQGHKKLIKRCACPLISLLLIAIVIIVLIFTVFRVKDPVITMNSIKITKLQLVNTMSQQPGANMSLVADVSVKNPNVASFRYSNTTTSLYYHGVIVGEARGPPGRAKARRTLRMNVTIDVITARVISSPDFVTDLGSGLLTMSSFSRVPGQVKILNLIKRHVVVKMNCTTTFNISTQAIKEQSCKRKVKL

SEQ ID NO: 120880 - protein, 146 aa, Glycine max
  Coding DNA Sequence Number=SeqID_4102
  Homolog annotation: Hit_ID=Q019E6; Match level="QueryCoverage=73%, HitCoverage=46%, E-value=1e-20, Identity=40%"; Hit description =Homology to unknown gene
MTDIKSTKYQLVSSRDLTLNAYEEDCEFADPAGSFKGLQRFKRNCTNFGSLLEKSNMKLMKWEDFEDKGIGHWRFNCILSFPWRPILSATGYTEYYFDARSGKVCRHVEHWNVPKKALFKQILRPSRGFGLKDYVNRWLKAVQMKL

SEQ ID NO: 120881 - protein, 486 aa, Glycine max
  Coding DNA Sequence Number=SeqID_4103
  Gene Ontology: Mol. function=methyltransferase activity; Biological process=metabolic process
  Homolog annotation: Hit_ID=Q1SW51; Match level="QueryCoverage=71%, HitCoverage=75%, E-value=3e-66, Identity=39%"; Hit description =Generic methyltransferase
  Pfam annotation: Domain name=Methyltransf_11; Domain location=337 -432; Score=9.0; E_value=0.0071; Accession=PF08241.2; Description =Methyltransferase domain
  Pfam annotation: Domain name=Methyltransf_12; Domain location=337 -430; Score=9.6; E_value=0.059; Accession=PF08242.2; Description =Methyltransferase domain
  Pfam module annotation: Pfam domain module=Methyltransf _11::Methyltransf_12; Domain location=337-432::337-430
MKSFNILSPEDKGMTKQNVNTKLKRWRCAYYFIFIPGALALLLSVAAVSKFLSFKSFLGTESLYSNLNPEVPNRNQNEVLMKTVEMVIHKIEEELDKLRETKQDPSSTPSVFQQGSFLSDILGLLESAATSHQHSEGSNRQTDNFTIHPLVRKKKQSDEPADYFLREEIRKYVRIKPNRLGKQNFMGTNASFTSIGHACFAMKEELEEYMDYDVGEICNDDWKLAQKLMVHGCDPLPRRRCFSRAPKLYNQPFPINESLWKLPDDRNVRWSQYRCKNFLCLASNTTRKGFFKCADCFNLTNHEMPRWISLEADSNQTADFLISDVLGIKPKEIRIGLDFSVGTGTFAARMREFNVTIVSATINFGAPFNEMIALRGLVPLYLTINQRLPFFDNTLDLIHTTRFLDGWIDLVLLEFILYDWDRVLRPGGLLWIDSFFCLKEDLYAYLQAFKMLRYKKHKWVVVPKVDKDDQEMFFSAVLEKPPRQFR

SEQ ID NO: 120882 - protein, 299 aa, Glycine max
  Coding DNA Sequence Number=SeqID_4104
  Gene Ontology: Mol. function=RNA-directed DNA polymerase activity; Cellular component=chromatin; Biological process=RNA-dependent DNA replication
MPFWGHLAPKTLHLVGRISTQRVIILIDGGSTHNFVQQRMVRTLGLNAQPTHLLRVTVGNNNEVECHHLCVEVTVHVQGQSFTVGLHVLPLRGKQEIETQVRAMLQNGIIHPSTSHFSSPVLLVKKCDRSWRFCIYYQALNSITVKDRFPIPTIDELLDELGGASWFLKLDLLQGYPHILMKDDDVSKTSHYEFQVMPFGLCNAPSTFQVTMNSIFAPHLRKFIIVFFDDILVYNKSFPEHLTHLETTFQAQKAFDTLKDVVCKVSVLWLSDFSEPFVVEKDVSGVGMGTILSQRGIKA

SEQ ID NO: 120883 - protein, 86 aa, Glycine max
  Coding DNA Sequence Number=SeqID_4105
  Homolog annotation: Hit_ID=Q9C8A3; Match level="QueryCoverage=96%, HitCoverage=4%, E-value=2e-23, Identity=57%"; Hit description=Acetyl- CoA synthetase, putative; 45051-31547
EKIKLWLFLRGRHSSVVETAQTAVSGLRVVASGLWLAPGDSEEVAAALSQALRNCIERALLGLYYMRFGDVFSKFHQFQREEIFRL

SEQ ID NO: 120884 - protein, 105 aa, Glycine max
  Coding DNA Sequence Number=SeqID_4106
  Homolog annotation: Hit_ID=Q9C8A3; Match level="QueryCoverage=65%, HitCoverage=2%, E-value=2e-23, Identity=69%"; Hit description=Acetyl- CoA synthetase, putative; 45051-31547
MEWGAFVVVWYSSQGLPVSLLLGLGSMHQISWFQFLPHEPDLNPLPDKSVKVDQKDAAMLLVLSSHLQLQKEGFLSTWTNSFVGPWDPSQGLHNPGRDCVDLVVL

SEQ ID NO: 120885 - protein, 189 aa, Glycine max
  Coding DNA Sequence Number=SeqID_4107
  Homolog annotation: Hit_ID=Q5W7C9; Match level="QueryCoverage=41%, HitCoverage=33%, E-value=1e-11, Identity=54%"; Hit description =Unknow protein
ALRPIIPDNACILCLTAAAGTELADAYSPDTVIASSPGKEVMTRRPSTFTRHCSESGPCLSPSVADHPLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFHHVKVTLYR

SEQ ID NO: 120886 - protein, 79 aa, Glycine max
  Coding DNA Sequence Number=SeqID_4108
  Homolog annotation: Hit_ID=Q5W7C9; Match level="QueryCoverage=68%, HitCoverage=20%, E-value=2e-19, Identity=80%"; Hit description =Unknow protein
MEENSESALSTNKEAISNATRNLMESSILAQDERWRHALHMQVGREVVFPVADGWKRLLIPRRLRSKRRNPPEEGLASD

SEQ ID NO: 120887 - protein, 387 aa, Glycine max
  Coding DNA Sequence Number=SeqID_4109
  Gene Ontology: Mol. function=nucleic acid binding; Cellular component= intracellular; Biological process=chromatin modification
  Homolog annotation: Hit_ID=Q8RXE0; Match level="QueryCoverage=78%, HitCoverage=55%, E-value=3e-22, Identity=30%"; Hit description =Putative C2H2-type zinc finger protein
MLKGGHRFIDTVILVIKERTQSGSSIRSCWRDSFITHRAFCDALAHDSARHPSSLNPLGTHHLYGTNHMSLGLSAQLQNHQAATNSILSLGSAPKFEHLISPNLHHSPSSFGVQSPPPPPQSSSFFMTDPNQAFQDLQSQNQGHLFSNKQLHGLMQLPDLQGTTNINSTTSASSVSGSANNTNLFNLSFFPNTNASGSIINDQFSNMTGVTNNNQGTATLYSTNSPVNSNQVGLSSLFGNSSVQQDNMSPHMSATALLQKAAQMGSTTTTNELGMRSSMEDDEHSNHLRGLMNSFVNGNNLGQFHNVVEEPKKMPQNNNLGLCFGGSDKLTLDFLGVGGMVRNMNNGGGFSQREQQQQQHSMGITMSPLDPKLESAKANQHYGTSTL

SEQ ID NO: 120888 - protein, 230 aa, Glycine max
  Coding DNA Sequence Number=SeqID_4110
  Gene Ontology: Mol. function=nucleic acid binding; Cellular component= nucleus; Biological process=DNA integration
MSNHTWDLVDLPKGSKPIRCKWIFRKKLRTDGTIDKFKARLVVVGYTQKKEIDYFDTYSPVTKISTIRSLVALAAIHGLIVHQMDVKTAFLNGDLREEIYVEQPEGYVIQGQENKVCKLRKSLYGLKQAPKQWYEKFDQTLSHYIKKILKKKINYYDELPVRTPYDPSIHLKKNNGSSVSQTEYAKIIGSVMFLMNCTRPDIAYAVSRLSRYTHNPEGFCDANWVTDNDE

SEQ ID NO: 120889 - protein, 282 aa, Glycine max
  Coding DNA Sequence Number=SeqID_4111
  Gene Ontology: Mol. function=hydrolase activity, acting on ester bonds; Cellular component=nucleus; Biological process=lipid metabolic process
  Homolog annotation: Hit_ID=Q1SYS9; Match level="QueryCoverage=99%, HitCoverage=68%, E-value=2e-54, Identity=43%"; Hit description=GDSL -like Lipase/Acylhydrolase
  Pfam annotation: Domain name=Lipase_GDSL; Domain location=1-280; Score=41.3; E_value=3.3e-09; Accession=PF00657.12; Description=GDSL -like LipaseAcylhydrolase
QLLGFEKFIPPFANTSGSDILKGVNYASGGAGIRVETSSHLVYIKEPSSFMEIADKCSRCGCNYSHGDLKSLVIGAEIVGATISFGLQLANHRVIVSQIASRLGSSDLALQYLEKCLYYVNIGSNDYMNNYFLPQLYPASRIYSLEQYAQALIEELSLNLLALHDLGARKYVLARLGRIGCTPSVMHSHGTNGSCVEEQNAATSDYNNKLKALVDQFNDRFSANSKFILIPNESNAIDIAHGFLVSDAACCPSGCNPDQKPCNNRSDYLFWDEVHPTEAWNL

SEQ ID NO: 120890 - protein, 109 aa, Glycine max
  Coding DNA Sequence Number=SeqID_4112
MASPMTCEDIQVVIHTKDGESDDMRRYPSGYPYKTILLILTEKSGASEPVDTQRLASSSAPLSSRDGESDDMRRYPSGYPYKRFLLILTREVRWQAEIPKWLSVQNDFS

SEQ ID NO: 120891 - protein, 78 aa, Glycine max
  Coding DNA Sequence Number=SeqID_4113
MAVKGGLPMVMKKGAGIADRLMAEFIESTSANSQVPREHLLAVTSGRIAVVRTKVLELPPLSIVRSNQLARLNVEIGY

SEQ ID NO: 120892 - protein, 210 aa, Glycine max
  Coding DNA Sequence Number=SeqID_4114
MSISDLDQENVIPVTEANLKDEQKQAIAQAMEEFKQQCLRSFSINRSGEVVQKDALPAPRQVTFDANPGKLQDMVDNAINRALINQAGVLSNTVFNAVARTFKEGQIPPDYVGPSHHQPTAPEVTAPSAALTNASAQSAIPPSTLGTTGALSMPMATNPQISVGQHKLTTDMLASAMSGLTLPPNWWAYGMPPELTPGTSQITDMRGKLL

SEQ ID NO: 120893 - protein, 106 aa, Glycine max
  Coding DNA Sequence Number=SeqID_4115
MQKNACVWLAVESLVQNEFWMFASRSQRSKCRLMHYRLPLVLCECCITLMLGKLGRIDGDPVLRETRIWATWEYVSSVGGGQQGMVGLCAHCGCGKLVVHHRPTAT

SEQ ID NO: 120894 - protein, 290 aa, Glycine max
  Coding DNA Sequence Number=SeqID_4116
  Gene Ontology: Mol. function=nucleic acid binding; Biological process= DNA integration
  Pfam annotation: Domain name=zf-CCHC; Domain location=222-239; Score =12.4; E_value=0.0089; Accession=PF00098.13; Description=Zinc knuckle
  Pfam module annotation: Pfam domain module=Retrotrans_gag::zf-CCHC; Domain location=42-135::222-239
MVQSNQFCGKAHEDASAHLQHFLEICNTFTIAGVSKDAILLRLFPFSLLGRAKQWFYATKEKNTTWALCSTNFLAKFFPMGKTNALRGKITSFQQQNDESVPEAWERFQDYILECPHHGMESWLLMQTFYHGLSNSARETMDAAAGGAFLSLTIPQATALVEKMASNQSWNEERTQTRKRGGGMHQLKEVDMLSTKLDLLMKKLDDRAGDKKEVMHIYDSHMTCEECGDTGHSGNHCPKILEDVNYINNNNNNYYNRVAEPPKCLGPPTPAIVLRTSDGDAGSPPTLEVR

SEQ ID NO: 120895 - protein, 98 aa, Glycine max
  Coding DNA Sequence Number=SeqID_4117
MARTRRMQRQGQRDKRAGTQETFHIPSVVWIQFKVQRWRAASVNVVFSYQFSLFYESLITVNFPIETAASKNKVLSYSYMSREWIKFDFPSEFVDSKL

SEQ ID NO: 120896 - protein, 90 aa, Glycine max
  Coding DNA Sequence Number=SeqID_4118
MIHGGCHKHNAQPLRKESFHKVILYHHSSSTLQAKHGGVLQLPDSTKGRTWIHEHKHTEQDIANTALRTARQSKNIGDTVSRSADVKVHT

SEQ ID NO: 120897 - protein, 138 aa, Glycine max
  Coding DNA Sequence Number=SeqID_4119
GCGRARAAQGEAIGRRITARGEPERSGHVAGDPCKLRRGGARDGDDNVTSPDVKAELRMDWLGRRRGGTAGGARRSATELAVDEGGRNVALWRGGVAVDVRPLGGRTHGGGSLNGFGWDLVLWTELHELYNFGYKIKV

SEQ ID NO: 120898 - protein, 300 aa, Glycine max
  Coding DNA Sequence Number=SeqID_4120
  Gene Ontology: Mol. function=acyltransferase activity; Biological process=flavonoid biosynthetic process
  Homolog annotation: Hit_ID=Q8LE88; Match level="QueryCoverage=97%, HitCoverage=65%, E-value=4e-36, Identity=31%"; Hit description =Acyltransferase-like protein
  Pfam annotation: Domain name=Transferase; Domain location=1-296; Score=105.1; E_value=2.1e-28; Accession=PF02458.6; Description =Transferase family
MVTSFKCGGFAIGISTSHTTFDGLSFKTFLDNIASIASKKPLVVMPCHDRHLLAARSPPCVTFPHPEMLKLSDLPTCPDSNIFEASTEQLDFKVFKLTSNDITKLKEEAKNSSTSGGTSTTCVTGFNVITAHIWRCKALSCEDDNPNRSSTILYAVDIRSRLNPPLPKSYAGNAMLTAYATTKCKELEELPFMKLVEMVREGATRMTNEYARSIIDWGETNKGCPNREVLVSSWWRLGFEEVEYPWGKPKYCCPVVYHRKDIILLFPPIDGGGGVSIIVALPPKEMEKFYGLFNKFLTLD

SEQ ID NO: 120899 - protein, 138 aa, Glycine max
  Coding DNA Sequence Number=SeqID_4121
  Gene Ontology: Mol. function=ATP-dependent helicase activity; Biological process=RNA-mediated posttranscriptional gene silencing
  Homolog annotation: Hit_ID=Q8VY00; Match level="QueryCoverage=94%, HitCoverage=13%, E-value=5e-26, Identity=48%"; Hit description =Putative RNA helicase
  Pfam annotation: Domain name=PWI; Domain location=7-80; Score=6.4; E _value=0.0019; Accession=PF01480.8; Description=PWI domain
MVTMESDDSLKTWVSDKLMSLLGYSQPTVVQFMIGLSKQATSPAHLVGKLVEFGISSMDTHAFAEEIYSRVPRRSSAAMLARKQKTYSILKADNDSDDDYVDKSSVTTASSRRSDNHKKRFRKKTEVQDDQDYEAMCS

SEQ ID NO: 120900 - protein, 100 aa, Glycine max
  Coding DNA Sequence Number=SeqID_4122
  Gene Ontology: Mol. function=binding; Cellular component=membrane coat
  Homolog annotation: Hit_ID=Q2RBN7; Match level="QueryCoverage=99%, HitCoverage=7%, E-value=1e-23, Identity=65%"; Hit description =Clathrin heavy chain, putative, expressed
MTANLPHELIELLEKIVLQNFSFSGNFNMQNLLILNAIKANPSRVMDYKNRLENFDRSTVGLLMSYCITSILLIVLWSLLSRSKKMLFGAKWLKHYLTKA

SEQ ID NO: 120901 - protein, 63 aa, Glycine max
  Coding DNA Sequence Number=SeqID_4123
MMIDVGVHSVISLILAFILDRAAHHHRNNLETYFNEVRSLEAVRFKALCIQWAQYYLKFRNQT

SEQ ID NO: 120902 - protein, 53 aa, Glycine max
  Coding DNA Sequence Number=SeqID_4124
VVDDSGDGGDNDNNDFIGVGVDNYNVKSDGGVEDSNDASGSREKYNRKKYNCQ

SEQ ID NO: 120903 - protein, 86 aa, Glycine max
  Coding DNA Sequence Number=SeqID_4125
MAITFAASQRPAECMTRGNPSDLQPFDPEIDRTFHRLVRHHIVPFEHPEHSIIGESEHSVVDNFEHPDFEHYSFEHSDFKHSENMA

SEQ ID NO: 120904 - protein, 83 aa, Glycine max
  Coding DNA Sequence Number=SeqID_4126
  Subcellular localization annotation: CTP_CleavageSite=55; ConfidenceScore=5.32e-01
MGAGDGGGFGGGGVEVRVTKRSRTKLSLRLRSTLAWVSLCTTSSRHSREVWRVVCSDMVSPSTGQVEPKLFGLYYLLTLQANG

SEQ ID NO: 120905 - protein, 121 aa, Glycine max
  Coding DNA Sequence Number=SeqID_4127
MVSVILTREVRWGYRMVIHTFRQPGANEPVDAQRLTSSSAPFFIQGQRVRWQAEIPYGRPHLSSTEVNEFDGIRMMLVFTLVIQRHSSSTSHEILLCWARTIKFDSVGKRHGYPTLSLSRR

SEQ ID NO: 120906 - protein, 72 aa, Glycine max
  Coding DNA Sequence Number=SeqID_4128
  Gene Ontology: Mol. function=metalloendopeptidase activity; Cellular component=integral to membrane; Biological process=proteolysis
  Homolog annotation: Hit_ID=UPI000045BBB0; Match level="QueryCoverage =75%, HitCoverage=14%, E-value=3e-14, Identity=63%"; Hit description =COG4942: Membrane-bound metallopeptidase
  Pfam annotation: Domain name=Peptidase_M23; Domain location=2-70; Score=42.4; E_value=1.5e-09; Accession=PF01551.12; Description =Peptidase family M23
MQFHKGLDIAVDYGSDVRAAAAGTIIFSGQKGGYGNCVIVSHGNGLATLYGHLSELIAKVNDKKFILEKETV

SEQ ID NO: 120907 - protein, 132 aa, Glycine max
  Coding DNA Sequence Number=SeqID_4129
  Subcellular localization annotation: CTP_CleavageSite=50; ConfidenceScore=5.76e-01
MSSQGDNAFFYISKTTMSSQADNAFFYFLKTTMSSQGNNASFFYISKTTMSSKGNNAFIYISKMTMSSKGDNAFFYILKTTMSSKGDDAFIYISKKAMYSQGDNAIIYFSKTTMSSKGDNVFFYISKMTMSS

SEQ ID NO: 120908 - protein, 145 aa, Glycine max
  Coding DNA Sequence Number=SeqID_4130
MARCKRIQEDVKEMEDYFLKATDDVLTETDQAHRKVEVPINVNLVASKESEKEVQTPPQDTTCFKCEQVMQSYSPRALDRRLQEDWVRDVREGPRVLMSLRENVWSRHQCLFEKNARKTKKTMVYDFKNEVDNGVALAPMYHRVR

SEQ ID NO: 120909 - protein, 127 aa, Glycine max
  Coding DNA Sequence Number=SeqID_4131
  Subcellular localization annotation: CTP_CleavageSite=95; ConfidenceScore=5.15e-01
MSIKGGAGGAGGGDSISTSGEASGFTTGGCDSASAGSVLVGIGLGGTTSGALPKGNWASSQATLSRNCSMDIISLFCLLNKLCNIGIMGGACWASGSMVAIEGGGLDDEGMSSALALFLEAIYKKRM

SEQ ID NO: 120910 - protein, 157 aa, Glycine max
  Coding DNA Sequence Number=SeqID_4132
GTQFQRNQSSASYQWESFWQPEYYDKAEGVLNLDDLLMQFKDTIESMQQAFRRTATQISKLVDDMANPAVRQQEERAEIETHQESIFKVTSIHHQMTTEEKTSEVSSTPEYSCPAIASYVGGTEKGRLELSVEDQKVSFDLFEAMKHSDMGDACSDT

SEQ ID NO: 120911 - protein, 217 aa, Glycine max
  Coding DNA Sequence Number=SeqID_4133
  Gene Ontology: Mol. function=DNA binding; Cellular component =intracellular; Biological process=DNA integration
  Pfam annotation: Domain name=rve; Domain location=37-187; Score=58.7; E_value=1.9e-14; Accession=PF00665.16; Description=Integrase core domain
MAEATQLWKDVMPRHMEETMEHSGHMLKFGKVAFSSQRLELFDVWGIDFMGPFPMSGNCEYILVAMDYVSKWVEALPCRSANSKHAKRMFHEVIFRRFGIPRIVISDGGSHFIDKIFRKYLADHGVRHNVATPYHPQTSEFKAHWALKKWNMDLHLTSENRLMQLSELEEWREIAYHNSRIYKERTKRWHDKRIKHKEFKPGDKVLLFNSRVKLFGH

SEQ ID NO: 120912 - protein, 56 aa, Glycine max
  Coding DNA Sequence Number=SeqID_4134
PFHPGLFVGDAGGFQSPTREPLNVGGLVPPHCSLKSVVSDDACPGACFVQRDATTL

SEQ ID NO: 120913 - protein, 224 aa, Glycine max
  Coding DNA Sequence Number=SeqID_4135
  Gene Ontology: Mol. function=binding
  Homolog annotation: Hit_ID=UPI00006DABA5; Match level="QueryCoverage =87%, HitCoverage=98%, E-value=5e-55, Identity=54%"; Hit description =COG3342: Uncharacterized conserved protein
  Pfam annotation: Domain name=DUF1028; Domain location=2-191; Score =357.4; E_value=2.3e-104; Accession=PF06267.2; Description=Family of unknown function (DUF1028)
  Subcellular localization annotation: CTP_CleavageSite=34; ConfidenceScore=5.12e-01
MTLSIVGRCAKTGQLGIAVSSSSIAVGARCPWLRAGVGAVSTQNITLPALGPRILDRLSQGETAHQALQSGLASDDFFDYRQLTVLAVDGSSACFSGTHTLGVNHALCGSDCVAAGNLLANPEVIAAMVSAFTQQPGELAARLIAAMQAGMAAGGEAGPVHSAALAVVGEPSWPLVDLRVDWTEGDPIAELHQLWLAYQPQMQDYLTRALNPTLAPRYGVPGDE

SEQ ID NO: 120914 - protein, 354 aa, Glycine max
  Coding DNA Sequence Number=SeqID_4136
  Gene Ontology: Mol. function=RNA-directed DNA polymerase activity; Biological process=RNA-dependent DNA replication
AHRGGRYDSDEDRVAPEPPGPRVFSRAIRSTPLPSPFRPPTSIAKYNGDDRAIIRQLPLFLSDTARRWLEELPANQINDWVDLEKLFESMLDASRSSAPSCRTSPTMTSSWLSSLTVDELMDVVANYAAGEEAVGAFFNYEGGKGKRLVDEDGTPSRGLKKNKKKQKVRQHKRENFDDDLIAAVDRKKPRGPPDGGIFDKMFEEPCPYHKGGANHKLKDCRMLRKHFDGQGSKKDTRDDSKKEKAGSKEDNKDDDGFPAVHDCYMIYGGPSTQLTTRQRKRERREVFAARMAVPQYLNWSSTPITFDREDHPDKVVAPGVYPLVVDPIIVNTRLSKVLMDGGSSLNIIYLETLD

SEQ ID NO: 120915 - protein, 147 aa, Glycine max
  Coding DNA Sequence Number=SeqID_4137
MDKEEALMDSDFGPISNGEFLTPFEDEIHPTTEEDIGETNLGETPNIQIGDEDNINEHGIFIATSFTPCSYATSSQSFGLSNITTFEISNPLFLSIYKIFKRVVVDDKLSVLKQAQGIGAYKDNCRNIPSGIRVTNLSRIGARRSEE

SEQ ID NO: 120916 - protein, 70 aa, Glycine max
  Coding DNA Sequence Number=SeqID_4138
MIRKRTDIAEHFTWEGSLRNLDTTKDIRPAPMNPTLSANKMWDAKVTRKCHVPRYYHGPASQGISMSTLA

SEQ ID NO: 120917 - protein, 93 aa, Glycine max
  Coding DNA Sequence Number=SeqID_4139
MPNIKSSETDLKLKLKRARSRHRCGCCSQQVCYIFGGRNGARESQYQRNCSNNGGAEGVNDVGIDRERGMVMVKGTMDVAALAKKLSEKLRGR

SEQ ID NO: 120918 - protein, 281 aa, Glycine max
  Coding DNA Sequence Number=SeqID_4140
  Gene Ontology: Mol. function=RNA-directed DNA polymerase activity; Cellular component=chromatin; Biological process=chromatin assembly or disassembly
MAQRGVVLDTLHRTIKIPLPNESSYLLIQLVTPKRTIGQVHAANVSEVKNIPVVRDFPDVFPEDLPGLPPDRDVQFSIELKPGTAPISRRAYRMAPKELAELKTQLQELLQKGFIQPSSSPWGCPALFVKKKDQTLRLCVDYRPLNEVTIKNKYPLPRIDLLFDQLAGAKVFSKIDLRSGYHQIKIRPEDVPKTAFTTRYGLYEYLVMSFGLTNAPAHFMYLMNSVFMPELDKFVVVFIDDILIYSKTKKEHAEHLRIVLTRLREHQLYAKFSKCEFWLDK

SEQ ID NO: 120919 - protein, 247 aa, Glycine max
  Coding DNA Sequence Number=SeqID_4141
  Gene Ontology: Mol. function=metal ion binding; Cellular component =integral to membrane
  Homolog annotation: Hit_ID=Q9SZS2; Match level="QueryCoverage=89%, HitCoverage=81%, E-value=2e-39, Identity=45%"; Hit description =Putative RING zinc finger protein
  Pfam annotation: Domain name=zf-C3HC4; Domain location=37-83; Score =29.8; E_value=9.9e-06; Accession=PF00097.15; Description=Zinc finger, C3HC4 type (RING finger)
MESKYFDSNGEVSLKQKSKSISAEPTISTSEYDCFDCNICMESAHDPVVTLCGHLYCWPCIYKWLDVQSSSVEPYQQQTCPVCKSEISHTSVVPLYGCGTSNSESNAKKLQMSLGIPHRQPPCSLNAMLTSPRSRISHPSQQLHPSYFQTQSRPFHYQQFYGSYGTNGLPYLGGASMTSFFNTVIDMFGEMVLTRIFGISDANLFANPLNGSGSSRMRRQEMQIDNQISYKPDGAVCKRLGEEEFLE

SEQ ID NO: 120920 - protein, 143 aa, Glycine max
  Coding DNA Sequence Number=SeqID_4142
  Gene Ontology: Mol. function=nucleic acid binding; Biological process= DNA integration
MVVSETDGGTSGYGNYLPTILLVCHSPEWLMDTEANVHAGDTGALLMGNGSYARVLGVGIVIVKFSLGKTVLMKNVQHVLSIKKNLVSGSQLYRDGYKIVFEANKVILSKFGTFIGKVGFMAFTVLSRKLWLSYAVSKSEFNS

SEQ ID NO: 120921 - protein, 79 aa, Glycine max
  Coding DNA Sequence Number=SeqID_4143
MVVHSMASDLLPMEIRSYITNGIHNMFLHFSSDITLIINEFDDLVNNQSSLRLVKKLGLVKLSNMFCTKYDQTQNSLIS

SEQ ID NO: 120922 - protein, 146 aa, Glycine max
  Coding DNA Sequence Number=SeqID_4144
  Gene Ontology: Mol. function=ribonuclease H activity; Cellular component=mitochondrion; Biological process=DNA integration
  Pfam annotation: Domain name=RnaseH; Domain location=1-124; Score= -7.0; E_value=0.00026; Accession=PF00075.14; Description=RNase H
MFFDGSLNINGAGAGILFVSPNKDKLRYVLRILFPASNNVAEYEACLHGIRLAVELGVKRLYVYGNSALVINQLNKEWDATHEKMDLYCKEIRKWETNFYGIEYIHVVRDKNQAADALSKLGSSRAQIPRGIFVQDIHEPSVGSSL

SEQ ID NO: 120923 - protein, 80 aa, Glycine max
  Coding DNA Sequence Number=SeqID_4145
  Subcellular localization annotation: CTP_CleavageSite=50; ConfidenceScore=5.39e-01
MLWHRQYPRTVPATEVSKVYQGCAPRPSSFSSTITNTAHGGSIPGPDSVQASRVRNDLFFQLSVGHAFNMTKRAVKRSVP

SEQ ID NO: 120924 - protein, 58 aa, Glycine max
  Coding DNA Sequence Number=SeqID_4146
MNFVGIGILGDMMGSSTRKLVEMMGRVNLGLNVRMVAMKAWEEQMRKMSDKCESMSHF

SEQ ID NO: 120925 - protein, 293 aa, Glycine max
  Coding DNA Sequence Number=SeqID_4147
  Pfam annotation: Domain name=zf-CCHC; Domain location=91-105; Score =18.5; E_value=0.00088; Accession=PF00098.13; Description=Zinc knuckle
MYMHMNPQDGSSSAKKEKKDLALKASHKGKAKKIEVESSTSSDDDASIALMVRRTTKMLKKLNKNGVNFDSKKKKFFTSSKRKPISEMDFYNCGELGHLAHQCPKPKKDKYKKKKKEQDDSSDDEKNEKKPYKKKGGKKKEHYKKKNGKAYIVGDWLTYIESSSGDSSGNEIDDEKVAAIAIDAPSPSSSPPSTSSTHLCLMAKGDWKVQSEDESSESDSEYESPSYDELVKLLNKYTKVIRKTRSENEKLELENETLLAKLKSSDELRDQNEIMTTKLKELKLSLKELKEKP

SEQ ID NO: 120926 - protein, 148 aa, Glycine max
  Coding DNA Sequence Number=SeqID_4148
  Gene Ontology: Mol. function=GPI anchor binding; Cellular component =membrane; Biological process=root hair cell differentiation
  Homolog annotation: Hit_ID=Q9LIB6; Match level="QueryCoverage=77%, HitCoverage=18%, E-value=1e-23, Identity=52%"; Hit description=COBRA- like protein 8 precursor
IRENNITLSGGSAIEESIIGKVDGFQHRNTVWHHPEHGANEFDLSLHLGQVDGGLEIDQGEVGEDDAFSDGGGRVVPLGSTTLEAETNNSSWSNPTKTSHDLSSTRPLLSIVIVDSNRIHVFFYLDYWFAKNSQNFYCAESFPIVALC

SEQ ID NO: 120927 - protein, 78 aa, Glycine max
  Coding DNA Sequence Number=SeqID_4149
  Subcellular localization annotation: CTP_CleavageSite=11; ConfidenceScore=5.03e-01
MGRSLPPSLPQASLGSFRMHPQITKFTPLSYFTENFQKFYGSITEAPEAIFQQNGGGGCRLARLGKLSSPRRVWLLPP

SEQ ID NO: 120928 - protein, 229 aa, Glycine max
  Coding DNA Sequence Number=SeqID_4150
ESFQKIKTECVKGEIARSATEEAKKKALEDLEVERARSRSLSADVNRLKRALLEKDGAIAQASKVIEDLRITNTDLARSYKGIERANTDLVGENTALEEKIHGLKDELLDVQVEARSTKAQLEGEVALNGRLRTAISDLSASWELDPMDELREAARGDALVDQLCYLGGVPWLRHRHLQDRGENEERLHTLIDDAETPGERLAKLFEPEVLPPETSSGADDGGEGRDVD

SEQ ID NO: 120929 - protein, 243 aa, Glycine max
  Coding DNA Sequence Number=SeqID_4151
  Gene Ontology: Mol. function=RNA-directed DNA polymerase activity; Cellular component=chromatin; Biological process=RNA-dependent DNA replication
  Homolog annotation: Hit_ID=Q94I07; Match level="QueryCoverage=92%, HitCoverage=43%, E-value=6e-96, Identity=58%"; Hit description =Putative retroelement
MTSLPSVVSHLLQDYGDVFPEETRAGLPPIRGIEHQIDLIPGAALPNRPPYRTNPEETKEIQRQVQELLDKGFVRESLSPCVVPVILVPKKDGSWRMCVDCRAINNITVCYCHPIPRLDDMLDELSGSTIFTKIDLRSGYHQIRMKTGDEWKTAFKTKFGLYECKSFEEHVNHIRQVLEELRKEKLFANLEKCSFCTDHVVFLGFVVSGKGIEVDESKVKAIKDLPTPTYLNVMLAELAYEEF

SEQ ID NO: 120930 - protein, 87 aa, Glycine max
  Coding DNA Sequence Number=SeqID_4152
  Subcellular localization annotation: CTP_CleavageSite=16; ConfidenceScore=5.14e-01
LKLPEYGTDATGASVLASVLRQRPVPNPKHQTFPTAKDLTGRTHRASGAASDAYLGTLTSLKRDRSKTKLVPLDLRTISELPSARFT

SEQ ID NO: 120931 - protein, 138 aa, Glycine max
  Coding DNA Sequence Number=SeqID_4153
MELTLDQKKQRTCIIAITIHESFETHGLVMHNHKSQQKRHGRRAKITSGQTHLFIRAGRYSDASYAFTNDYYQEAGAFFTRTDNTLLDIQNTQAEHRRLLEEQQKWNQDHAAAVQELRQDTTTMNDNITTIMRFWNIG

SEQ ID NO: 120932 - protein, 155 aa, Glycine max
  Coding DNA Sequence Number=SeqID_4154
ALGDETLVGIEAVVPTSGGDPAWGGWVYESRGVTPFHGASRAAFAVLRDLMERFHRSWPTPSLGCFPGSEVNALERSADEDQHSDSAAMSAMYALMKTYGGLERCLGRLSGSLLTVQDEKRQLQREFDSEVERLQAELARVTRERDQAVQKNSEL

SEQ ID NO: 120933 - protein, 43 aa, Glycine max
  Coding DNA Sequence Number=SeqID_4155
MAINLELNLYWDVWIGCDDSHGKRSVAKGIADSWIDLEFWFSI

SEQ ID NO: 120934 - protein, 204 aa, Glycine max
  Coding DNA Sequence Number=SeqID_4156
  Gene Ontology: Mol. function=RNA-directed DNA polymerase activity; Biological process=RNA-dependent DNA replication
MSRGSFFRIRTDEARVILDRILEAEMDNTLHDETYEAEVDTLPNSSSTLAIPSSEPQEEEIPPPDFMLDIESDLFADFGNISNYHSIDKPQNGQFSIYLPSEYQLRELISVMSSQWLEESELSSDVIRLDTPSITIRCAYNSDRFNALYNPVVGINIMSESFALKLFKNLVLTPTTKVIKESSGRLVPSLGIINVLPLTVEGSM

SEQ ID NO: 120935 - protein, 85 aa, Glycine max
  Coding DNA Sequence Number=SeqID_4157
MGRGKSDLSLCRIREIRGCSGGYGNCSHGNQGIAQIGRWSNGDQSGGKLPIKEVADEKQSDMTKIRRGGVFVPLTNDGVPMTMDG

SEQ ID NO: 120936 - protein, 175 aa, Glycine max
  Coding DNA Sequence Number=SeqID_4158
SADDYGKGIADDAKEESGSCQLSCGGVSEFVDLSSAYSRVPREYLLAVTSGRIAVVGTKVFELSPLPILLHQHIFWHARWDKFKIKINMSTTEFDLENVIPVTEANLKDEQKQAIAKAMEDYKQQCLKSFSINRSSEVIQKEALPTPRQVTFDTNPGKLQDMVDSAINRALINQA

SEQ ID NO: 120937 - protein, 82 aa, Glycine max
  Coding DNA Sequence Number=SeqID_4159
FSCYSWWLPPPRQLEAAEEDWHELVIVRGHLPVIVRGLCLPQRRAERFLWCPSEDEVRATHLSHRTTKCWSTQRGRSVPVST

SEQ ID NO: 120938 - protein, 115 aa, Glycine max
  Coding DNA Sequence Number=SeqID_4160
  Homolog annotation: Hit_ID=Q1SMF0; Match level="QueryCoverage=80%, HitCoverage=17%, E-value=9e-09, Identity=33%"; Hit description =Tetratricopeptide-like helical
MAYEMDEDQNEEECGVNESHVDCSDAFNISQVFDNRDDVLQWARSVVHANGFVAIIIRFDTNTNSRGRTLFVLIGCERSGKYRCRKKKFVRRDTRTRKCGCPFKLHGKPVVGGQG

SEQ ID NO: 120939 - protein, 274 aa, Glycine max
  Coding DNA Sequence Number=SeqID_4161
  Homolog annotation: Hit_ID=Q21ND8; Match level="QueryCoverage=42%, HitCoverage=82%, E-value=5e-29, Identity=52%"; Hit description=Alpha- 1,6-glucosidases, pullulanase-type
  Pfam annotation: Domain name=UPF0047; Domain location=51-164; Score =109.2; E_value=1.2e-29; Accession=PF01894.8; Description =Uncharacterised protein family UPF0047
MQATSFWVAKFPFGVRAQQHPTVKRDSMAECTVPKWAQKTVSLPPLRRGCHLVTSKIVKEIEQDLSGFKCGLAHLFLQHTSASLTINENYDSDVREDTETFLNRIVPEGSSAPWKHTLEGPDDMPAHIKSSMFGCTLTIPITNGKLNMGTWQAHSRSSINASIVDSVPKVVVSSNVVKWQHHGGMVWWIFPDRHRQFVKGGLLCWCHRPQWCVYMVEFWPSAIFCHLSLITLVSKYICYMMPELNRAQLTRHAFVLVRTDEKMIFTGVECVECV

SEQ ID NO: 120940 - protein, 45 aa, Glycine max
  Coding DNA Sequence Number=SeqID_4162
MKLFQWVHRKVRQNSIDPFKDFTLDQVDPQEYMDQLDPQEAYGSS

SEQ ID NO: 120941 - protein, 242 aa, Glycine max
  Coding DNA Sequence Number=SeqID_4163
  Homolog annotation: Hit_ID=Q7GB25; Match level="QueryCoverage=50%, HitCoverage=7%, E-value=1e-32, Identity=67%"; Hit description =Multidrug resistance-associated protein 5
MSTTNSITKQHKFITILTCSNKTKLKVELVLHWKTLKNMRSKLSVLESVWGSSWDALVWGEANGDADVNLSLLIVTAAQGLAWILGGGVLNIYVLVLLQMLLSHQPALAFLCLVAIRGVTSIRVCRNSDLQEPLLVNEEPGSLNVNPYRDTGLFSLATLSWLNPLLSIGAKKLLKLKDIPLVAPRDRAKTSYKVLNSNWERLKAENENPSKQPSLTYFKNRRNDKLIMRKKLHKTKYFHCLR

SEQ ID NO: 120942 - protein, 135 aa, Glycine max
  Coding DNA Sequence Number=SeqID_4164
MHVRNGVKAKLQRPTHVEEEEDDARRSTAGQEEVKKHEHVREEARRRWVHDWVREEEKKLGSKILKCLLRHLHQNPTLQWTKTFLTKKRPSFTFVGIAPRGQGKWRRATVAWDCRLREGGHNLEKVQEACDECKK

SEQ ID NO: 120943 - protein, 96 aa, Glycine max
  Coding DNA Sequence Number=SeqID_4165
MSNSRANPIQGLFKLNCDGSYVYATNITSCGVVLCNSGRKFIPAFSRRLGHCSILEVKHGLIIESDCLKAVQLLDDVDHSGSQFCDLLDEIIVLKL

SEQ ID NO: 120944 - protein, 70 aa, Glycine max
  Coding DNA Sequence Number=SeqID_4166
  Homolog annotation: Hit_ID=Q9CAE1; Match level="QueryCoverage=92%, HitCoverage=7%, E-value=8e-10, Identity=49%"; Hit description =Putative aminopeptidase; 4537-10989
MTQRFAALASIAQNPVLEVLPTYDFILSLPFQVVNKWFALQAMSDIPDNVENVRKLLSNPTFDKHNLVLC

SEQ ID NO: 120945 - protein, 64 aa, Glycine max
  Coding DNA Sequence Number=SeqID_4167
ESRGKKRFKTLEKKLILLWWACAGEVQRDVVGERQRLNDLGSSGVVEAEAVERNDLVASGVEDA

SEQ ID NO: 120946 - protein, 139 aa, Glycine max
  Coding DNA Sequence Number=SeqID_4168
  Gene Ontology: Mol. function=threonine-tRNA ligase activity; Cellular component=mitochondrion; Biological process=tRNA aminoacylation for protein translation
  Homolog annotation: Hit_ID=O04630; Match level="QueryCoverage=88%, HitCoverage=20%, E-value=3e-47, Identity=68%"; Hit description =Threonyl-tRNA synthetase, mitochondrial precursor
  Pfam annotation: Domain name=tRNA_SAD; Domain location=59-108; Score =83.3; E_value=7.4e-22; Accession=PF07973.4; Description=Threonyl and Alanyl tRNA synthetase s
MDASSALGLALQEERFGFYYDAFYGELGLNDDHFKQIEAGALKAVAVEIINDLPADKTITVYRCGPLVDLCRGPHIPNTSFVKAIACLKASSAYWRGDKDRESLQRVYGISYPDQKSLKHLSMFELAPLHYATCLLWHF

SEQ ID NO: 120947 - protein, 344 aa, Glycine max
  Coding DNA Sequence Number=SeqID_4169
  Gene Ontology: Mol. function=threonine-tRNA ligase activity; Cellular component=mitochondrion; Biological process=tRNA aminoacylation for protein translation
  Homolog annotation: Hit_ID=O04630; Match level="QueryCoverage=73%, HitCoverage=35%, E-value=1e-112, Identity=78%"; Hit description =Threonyl-tRNA synthetase, mitochondrial precursor
  Pfam annotation: Domain name=HGTP_anticodon; Domain location=249-339; Score=97.5; E_value=4e-26; Accession=PF03129.10; Description =Anticodon binding domain
MSWTINTELVSPHITINSKSLSHLALDPYALLNCPLTTMPPEHHSATLKCLALSTNYRYSITTCCQNAGCCQDVNPFSSIMAFALNVAQDDAHIFCRESQIKDEVRNSLNFINYVYKIFGFTYELKLSTRPEKYLGDIATWDKAESALKEALDDFGKPWQLNEGDGAFYGPKIDISVSDALGRKFQCATLQLDFQLPDRFKLEFSAEDEAKIERPVMIHRAILGSVERMFAILLEHYKGKWPFWLSPRQAIVCPVSEKSQAYALQVRDQIHQAGYYVDADTTDRKIQKKVREAQLAQYNYILVVGEEEANTGQVSVRVRDLAEHKVMSIEKLLEHFRDKAAAFE

SEQ ID NO: 120948 - protein, 506 aa, Glycine max
  Coding DNA Sequence Number=SeqID_4170
  Gene Ontology: Mol. function=nucleotide binding; Cellular component =chloroplast; Biological process=cellular protein metabolic process
  Homolog annotation: Hit_ID=Q2MGR4; Match level="QueryCoverage=99%, HitCoverage=87%, E-value=0.0, Identity=84%"; Hit description=GroEL -like chaperone, ATPase
  Pfam annotation: Domain name=Cpn60_TCP1; Domain location=1-491; Score= 483.6; E_value=2.4e-142; Accession=PF00118.14; Description=TCP-1cpn60 chaperonin family
RNVILSESGNLKVINDGVTIARSIELSDAIENAGAILIQEVASKMNELAGDGTSTAIILARAMIESGLLAVAFGANPISLKKGMEKTVKELVKFLKERSVPVEGREHIRAVASISAGNDEYVGNLIAEAMEKIGSDGVISIESSSSSETSVIIEEGMKFDKGYMSPHFITNQEKSIVEFDWVKVLVTDQKISNVKEIVPLLEKAMQLSVPLLIIAEDITRQVLETLVVNKMQGLLRVAVVKCPGFGGAKKALLQDIALMTGADFLSGDLGLTLDGATSDQLGTALKVTITSNATTIIADPSMKAEIQARISQIKKDLSETDNANLSRKLSERIAKLSGGIAVIKVGAHTEVELEDRKLRIDDAKNATFAAISEGIVPGGGATYVHLLDLIPTIMNSMEDLEEQIGADIVAKALLEPAKSIATNAGVDGDIVVQKIRTHDWRIGYNAMTGTYEDLLNAGVADPSRVARCALQSAVSVAGAVLTTQAILVDKIKKTKPPVPLVPGITP

SEQ ID NO: 120949 - protein, 139 aa, Glycine max
  Coding DNA Sequence Number=SeqID_4171
MSSSDKLDEALLRLSNHKTLLGESMNTLTQKIDDLLTRVTPMFSSPSSSYTPPPPPVPTQSHKMKLEVPRFDGTKSLGWIFKINQFFEYHRTPENERLTIASFYMEGRALSWFQWTTVNGQFTSWIVFLQALQTRFAPS

SEQ ID NO: 120950 - protein, 100 aa, Glycine max
  Coding DNA Sequence Number=SeqID_4172
MDVEEVYGGESSDGRMSRQRIDQKVMKAMTFQHSGVATTGVTVEVNKGTAIEMKGGTSVGMNGGIAVNVISGSAVGVNGGTVVVVGVAEESLTPSESAPE

SEQ ID NO: 120951 - protein, 975 aa, Glycine max
  Coding DNA Sequence Number=SeqID_4173
  Gene Ontology: Mol. function=RNA-directed DNA polymerase activity; Cellular component=chromatin; Biological process=chromatin assembly or disassembly
  Pfam annotation: Domain name=RnaseH; Domain location=404-520; Score= -34.7; E_value=0.098; Accession=PF00075.14; Description=RNase H
  Pfam annotation: Domain name=rve; Domain location=656-814; Score =69.2; E_value=1.3e-17; Accession=PF00665.16; Description=Integrase core domain
  Pfam annotation: Domain name=zf-H2C2; Domain location=597-638; Score =14.4; E_value=0.0044; Accession=PF09337.1; Description=His(2)-Cys(2) zinc finger
  Pfam module annotation: Pfam domain module=RVT_1::RnaseH::rve::zf -H2C2; Domain location=209-373::404-520::656-814::597-638
ELVTQLRLPCQPTPSPLRVMVGNGLNLQCTSFCEAIILDIQSTQFTMDLHVLPIVGANVVLGVQWLKSLGPILTDYNSLCMQFIYEGRIITLQGDKEFTLNPITSSQFRGMSQTKETGLYCHISLIETDSITSQNFHPDIQKLLTKFASLFQQPNTLPPERETDHHIHLLPHLAPVNVRPYRYPHFQKCEIETQIDAMLQKGLIQPSTSPFSFSVLLVKKHDGTWRFCVDYRALNAIMIRDRFPIPTIDELLDELGGARCFSKLDLLQGYHQIRMHYDDIPKTAFRTHHGHYEFKVMPFGLCNAPSSFQATMNAIFCPYLRQFIIVLSAHHFVLKLTKCFFAQDQVEYLGHLVSYRGVEPLASKVAAIHNWPIPQTTRATAFDQLKQALSHAHVLALPDFTMPFTVETDASGIGMGKVFSQNNHPIAFFSKSFPPKLLRASAYVRELFAITAAVKKWRQYLLGHRFTIITDHRSLKELLTQVIQTPEQHIYLARLMGYDYQIQYRTSAHNQAADALSRCFDQDSTLLSLSVPCPLFLTELYNQLDAHQEYNQLRQEILKNPEKHAGLSLAQKLILRKGRIWLPRDLEIIPILLVEYHTTPTGGHMGVAKTIARLMENFDWEGLRADVTKFVAQCLDCQYIKYETKRVAGLLCPLPVPHRPWEDLSLDFITGLPPYHGNTVILVVVDWFSKGIHLGMLPASLTAQVVATLFMEIIGKIHGLPRSLVSDRDPLFVSKFWQELFRRSGTQLRMSSAYHPQSDGQTEVLNRVIEQYLRAFCSSPATRMGIILALGRMLLRAQERMRKVADANRREVNYQIGDWVMLKLRPYRQVSAKGPQATMGKLTKRFYGPFQILDRIGKAAYRLKLPEGTRIHPVFHCSLLKPFKGNPEQGSESKLPGKFWCNGKGYCQKKHPGKTGSSCEQIITLRTRPRTRNKGAVTKHMGAVSRKALEGHHKTFLPQRLHMMRGQHDHNRISQ

SEQ ID NO: 120952 - protein, 336 aa, Glycine max
  Coding DNA Sequence Number=SeqID_4174
  Gene Ontology: Mol. function=protein binding; Cellular component =integral to membrane; Biological process=cortical actin cytoskeleton organization and biogenesis
  Homolog annotation: Hit_ID=Q5S2C4-2; Match level="QueryCoverage=98%, HitCoverage=23%, E-value=1e-144, Identity=74%"; Hit description =Isoform 2 of Q5S2C4
MRECILGNFRRRLLGVLKTDNDLQRPTVLESLIKRHISIVHLAEQHISMDITQGIREVLLSEAFPGPVSSLHLFEKPTDQHTGLATESVCNWYIENIIKDVSGAGILFVPIHKCFRSTRPVGGYFAESVTDLRELQAFVRIFGGYGVDRLDRMLKEHTDALLNCIDTSLRSNRDVIEAVATSLHAGDRIEREASVKQIVDLETGIGFCVQAGLALAFDQLLAEASGAILEEGAPLIHSLLDGVVKHLPDGVPEKEEIRRMRTVANTVGVNNHDSVWVRSILEEVGGASDGSWGLLPYLFATFMTSNIWSTTAFNVDTEGFSNNIHCLARSVWLYFG

SEQ ID NO: 120953 - protein, 291 aa, Glycine max
  Coding DNA Sequence Number=SeqID_4175
  Gene Ontology: Mol. function=DNA-directed RNA polymerase activity; Cellular component=nucleus; Biological process=transcription
  Homolog annotation: Hit_ID=Q2MGQ5; Match level="QueryCoverage=69%, HitCoverage=63%, E-value=5e-93, Identity=86%"; Hit description=RNA polymerase, dimerisation
  Pfam annotation: Domain name=RNA_pol_A_bac; Domain location=2-64; Score=-0.4; E_value=0.0011; Accession=PF01000.16; Description=RNA polymerase Rpb3RpoA insert domain
  Pfam annotation: Domain name=RNA_pol_L; Domain location=107-181; Score=16.9; E_value=0.0076; Accession=PF01193.14; Description=RNA polymerases L  13 to 16 kDa subunit
  Pfam module annotation: Pfam domain module=RNA_pol_A_bac::RNA_pol_L; Domain location=2-64::107-181
TLDVTSKDLYSSDPTVSPVDFSDPSATDSDNNRGIIIVKLRRGQELKLRAIARKGIGKDHAKWSPAATVTFMYEPEIHINEDLMETLTLEEKREWVDSSPTRVFEIDPVTQQVMVVDAEAYTYDDEVLKKAEAMGKPGLVEIIARQDSFIFTVESTGAVKASQLVLNAIEILKQKLDAVRLSEDTVEADDQFGELGAHMRGVDWGQCFLKLSLQQILPYYGWHCNPKAQNSERSFACCPCSSSCQYQLHRGAPGYVTMILRSTLIRAHNTVVSLHHEDALRQEKHVRATRQ

SEQ ID NO: 120954 - protein, 455 aa, Glycine max
  Coding DNA Sequence Number=SeqID_4176
  Gene Ontology: Mol. function=transmembrane receptor activity; Cellular component=membrane; Biological process=defense response
  Homolog annotation: Hit_ID=Q2HUN2; Match level="QueryCoverage=94%, HitCoverage=37%, E-value=1e-129, Identity=56%"; Hit description=TIR; Disease resistance protein
  Pfam annotation: Domain name=ABC_tran; Domain location=222-356; Score= -65.0; E_value=0.097; Accession=PF00005.17; Description=ABC transporter
  Pfam annotation: Domain name=NACHT; Domain location=222-373; Score= -24.7; E_value=0.0048; Accession=PF05729.3; Description=NACHT domain
  Pfam annotation: Domain name=NB-ARC; Domain location=188-455; Score =88.1; E_value=2.8e-23; Accession=PF00931.13; Description=NB-ARC domain
  Pfam annotation: Domain name=TIR; Domain location=27-159; Score =162.8; E_value=8.9e-46; Accession=PF01582.10; Description=TIR domain
  Pfam module annotation: Pfam domain module=ABC_tran::NACHT::NB -ARC::TIR; Domain location=222-356::222-373::188-455::27-159
MANLQMVNYAAAASSSSCVASLKSYDVFLSFRGEDTRGNFTSHLYDALIQAKLETYIDYRLQKGEEISQALIEAIEESQVSVVIFSEKYGTSKWCLDEITKIMECKEGQGQVVIPVFYKIDPSHIRKQQGSFNKAFEEHKRDPNITNDRVQKWRSALTKAANLAGWDSITYRTEAKFIKDIVKDVLYKLNLIYPIETKGLIGIERNYAEIESLLEIGSREIRVIGIWGMGGIGKTTLAISLHAKLFSQFEGHCFLGNVRVQAEKHGLNALRRTLFSELFPGENLHVHVPKVESHFITRRLKRKKVFLILDDVASSEQLEDLIGDFNCFGPGSRVIVTTRDKHIFSHVDEIYEVKELNHHDSLQLFCLNAFREKHSKNGFEELSESVLAYCKGNPLALKILGACLRSRSEQAWNSELRKLQKIPNVKIHNVLKLSFDDLDHTEQDIFLDIACFLKG

SEQ ID NO: 120955 - protein, 79 aa, Glycine max
  Coding DNA Sequence Number=SeqID_4177
  Subcellular localization annotation: CTP_CleavageSite=42; ConfidenceScore=5.13e-01
MRQTSWESHVVRSLTVGITSPSASTSRFQLESVTLQKVVEPRQQLRQPCQEEEGTDGSSEESLQQDQERDGQRRKKEKE

SEQ ID NO: 120956 - protein, 432 aa, Glycine max
  Coding DNA Sequence Number=SeqID_4178
  Gene Ontology: Mol. function=metal ion binding; Cellular component =integral to membrane; Biological process=ubiquitin cycle
  Homolog annotation: Hit_ID=Q8GW38; Match level="QueryCoverage=58%, HitCoverage=63%, E-value=2e-79, Identity=63%"; Hit description=RING -H2 finger protein ATL1D
  Pfam annotation: Domain name=zf-C3HC4; Domain location=151-192; Score= 33.3; E_value=8.7e-07; Accession=PF00097.15; Description=Zinc finger, C3HC4 type (RING finger)
  Subcellular localization annotation: CTP_CleavageSite=49; ConfidenceScore=5.80e-01
MYRGHSRILQSNGAITNPPIVSPSSSSSSSSPSVPYVSNYQKQTAPSPSSSSGNRISPAILFIIVILAVLFFILGLLHLLVRFLIKQRSSSNNSSIPQSNRYPDMSDSDAYQRQLQQLFHLHDSGLDQAFIDALPVFFYKEIIGLKEPFDCAVCLCEFLEQDKLRLLPMCNHAFHIECIDTWLLSNSTCPLCRGTLYSPFENSVFDFESQLEEDGMSGSGGIGSVNKTTESHIVNGKRVFSVRLGKFRSTNNNQDGMVVERGEGESSTSSVNLDVRRCYSMGSFQYVVADSDLRVALGTSSGSMRQLKGRTATNGSSFIDGDAVEGKKINIARKGESFSVSKIWQWSRKDKLTGSSDAHFLNSSTVTSTLPWMNKARGVIELVNCAINIIRQRELKINLECNQSPVLLTESSMFMKSYKLVEVVMKKSIVSA

SEQ ID NO: 120957 - protein, 333 aa, Glycine max
  Coding DNA Sequence Number=SeqID_4179
  Gene Ontology: Mol. function=transmembrane receptor activity; Cellular component=membrane; Biological process=defense response
  Homolog annotation: Hit_ID=Q2HS00; Match level="QueryCoverage=96%, HitCoverage=31%, E-value=2e-75, Identity=46%"; Hit description=TIR
  Pfam annotation: Domain name=LRR_1; Domain location=140-161; Score =6.5; E_value=17; Accession=PF00560.23; Description=Leucine Rich Repeat
  Pfam annotation: Domain name=LRR_1; Domain location=163-184; Score =9.4; E_value=5.1; Accession=PF00560.23; Description=Leucine Rich Repeat
  Pfam annotation: Domain name=LRR_1; Domain location=186-205; Score =6.7; E_value=16; Accession=PF00560.23; Description=Leucine Rich Repeat
  Pfam annotation: Domain name=LRR_1; Domain location=207-228; Score =11.3; E_value=2.2; Accession=PF00560.23; Description=Leucine Rich Repeat
  Pfam annotation: Domain name=LRR_1; Domain location=257-281; Score =3.0; E_value=80; Accession=PF00560.23; Description=Leucine Rich Repeat
  Pfam annotation: Domain name=LRR_1; Domain location=283-305; Score =10.3; E_value=3.4; Accession=PF00560.23; Description=Leucine Rich Repeat
  Pfam annotation: Domain name=LRR_1; Domain location=307-328; Score =11.2; E_value=2.3; Accession=PF00560.23; Description=Leucine Rich Repeat
  Pfam annotation: Domain name=LRR_1; Domain location=48-70; Score=6.9; E_value=14; Accession=PF00560.23; Description=Leucine Rich Repeat
  Pfam annotation: Domain name=LRR_3; Domain location=117-136; Score =39.6; E_value=1.1e-08; Accession=PF07725.3; Description=Leucine Rich Repeat
  Pfam module annotation: Pfam domain module=LRR_1::LRR_1::LRR_1::LRR _1::LRR_1::LRR_1::LRR_1::LRR_1::LRR_3; Domain location=140-161::163 -184::186-205::207-228::257-281::283-305::307-328::48-70::117-136
MGWNIVQQESIEDPGRRSRLWDPEEVYDVLKYNRGTEAVEGIILDLSKIEDLHLSFNSFRKMSNIRFLKFYFGGEWSSRCKIYLPMNGLETLSDKLRYLHWHGYCLESLPSTFSAKFLVELAMPYSNLQKLWDGVQNLVNLKDINLGFCENLVEVPDFSMASNLKVLDLEGCTEIESLQTDVHLKSLQNLRLSNCSSLKDFSVSSVELERLWLDGTHIQELPSSIWNCAKLGLISVRGCNNLDSFGDKLSHDSRMASLNNLILSGCKQLNASNLHFMIDGLRSLTLLELENSCNLRTLPESIGSLSSLQHLKLSGSNVESLPASIVKSPTSGS

SEQ ID NO: 120958 - protein, 273 aa, Glycine max
  Coding DNA Sequence Number=SeqID_4180
MSKEKDSDDNQVDTFSDSVMLERFHTLVEIDNLNLEPDWDPITELESILSDSYNMSSMSTHSATISQIEVHGTNVAAILEKLEVLLETSLEILSSDDEVKQQFHHVLEQLNQFKDQIPVRLHAVIYKLKSFIEDVDIRYATAQRTIQDYDQLLQSRSLLSKNLESAKAQQDKINLKVSEGKIQFEKINSEIDELEHKLCTLVMTRDKLKRALDNCAAENNKLKTQVAKWVPECKSIITALKEYETSYKVALTNKRKTEDEWADLKKTFVANKI

SEQ ID NO: 120959 - protein, 111 aa, Glycine max
  Coding DNA Sequence Number=SeqID_4181
MAGEGANVWQLQWRRRKVGLTGRRGHKSGGASSDSFCTAEYGSPDKNTSQKTYTVCQKKGNEWNGPPETGKRMIKERQRPKGLSGDSGSPVRNDFSLFPQPSSRYHEILFL

SEQ ID NO: 120960 - protein, 373 aa, Glycine max
  Coding DNA Sequence Number=SeqID_4182
  Gene Ontology: Mol. function=sugar porter activity; Cellular component=integral to membrane; Biological process=carbohydrate transport
  Homolog annotation: Hit_ID=Q1T6J4; Match level="QueryCoverage=93%, HitCoverage=68%, E-value=1e-141, Identity=68%"; Hit description =Sugar transporter superfamily; Major facilitator superfamily MFS_1
  Pfam annotation: Domain name=Sugar_tr; Domain location=1-348; Score =272.8; E_value=6.8e-79; Accession=PF00083.14; Description=Sugar (and other) transporter
PSLTINHLLFQSVPIYVSEMAPYKYRGALNMCFQLSITIGIFVANLFNYYFSKILNGQGWRLSLGLGAVPAFFFVIGSFCLPDSPSSLVERGHHEEAKRELVKIRGTTEVDAEFRDILAASEASQNVKHPWRTLMDRKYRPQLVFAICIPFFQQFTGLNVITFYAPILFRTIGFGSRASLMSAVIIGSFKPVSTLVSILVVDKFGRRTLFLEGGAQMLICQIIMTVAIAVTFGTNGNPGTLPKWYAIVVVGVICVYVSGFAWSWGPLAWLVPSEIFPLEIRPAAQSITVGVNMISTFFIAQFFTSMLCHMKFGLFIFFGCFVVIMTTFIYKLLPETKGIPLEEMSMVWQKHPIWGKFLESDITTQNDKINGKC

SEQ ID NO: 120961 - protein, 317 aa, Glycine max
  Coding DNA Sequence Number=SeqID_4183
  Gene Ontology: Mol. function=RNA-directed DNA polymerase activity; Cellular component=nucleus; Biological process=RNA-dependent DNA replication
  Homolog annotation: Hit_ID=Q1STT2; Match level="QueryCoverage=76%, HitCoverage=61%, E-value=3e-51, Identity=39%"; Hit description =Lipocalin
MGFRNLHGFNLVMLGKQGLKLSTNEDAMVTKIFKVKYFPKVGFLYANLGHNPSYIWRNIHTSQVPVKEGMHWRLRNGHKINIWSQPWTNIISQILNKADSQAIQATPLLNTTSDDVLRWKFSSIEIYTVRSSYHHLMENMINNDDYKVPADWILLWQLKVPPKIKYFRGGHCSILCEYCHLENSWHVIFGCEHSLSQELPVKFVMLLWCIWRCMKDKIWNNIDLQHHVSISLMMQSYVEWCHARIGNRDHNRNHHQPASLTWHKPNEGYIKCNIDATLFKENNTFGVGICLRGHQGDYICPRTFHSKGVPNPRTAEA

SEQ ID NO: 120962 - protein, 69 aa, Glycine max
  Coding DNA Sequence Number=SeqID_4184
MDEDTPREVGVCDDNGGWRLNRFSQYLPDDINLKVMRMTSPDSNSEGEQTSDAMERHRENKDVPMENLP

SEQ ID NO: 120963 - protein, 315 aa, Glycine max
  Coding DNA Sequence Number=SeqID_4185
  Gene Ontology: Mol. function=DNA-3-methyladenine glycosylase I activity; Biological process=base-excision repair
  Homolog annotation: Hit_ID=Q6ZBQ9; Match level="QueryCoverage=49%, HitCoverage=56%, E-value=4e-54, Identity=51%"; Hit description =Putative 3-methyladenine-DNA glycosylase
  Pfam annotation: Domain name=Adenine_glyco; Domain location=107-250; Score=149.9; E_value=6.9e-42; Accession=PF03352.4; Description =Methyladenine glycosylase
  Subcellular localization annotation: CTP_CleavageSite=76; ConfidenceScore=5.55e-01
MEKKTSVQESRKFNQLFFPKQHNKVYPIRLQRSSSTSSLSSLSSSLSQKSDDSSLTDSLNLADESFQFALNLISPRCQRREPEIINDAHQQQIPQTAEAGELKRCNWITKNCDEAYIQFHDECWGVPAYDDKKVFAGFDPNTVAKMEEKEIMEIASNKEVLLADCRVRCIIVRECGSFSCYIWGYVNHKPVINRYRYPRDVPLRTTKADTISKDLIKRGFQFLGPVIVYSFMQAAGLAIDHLVDCYRHNECLFSFPYMPILAREGESALRPWLWNTTCLVCYIVILKNWCENGWLLRYFLNNEDPDAEDFLLFVH

SEQ ID NO: 120964 - protein, 174 aa, Glycine max
  Coding DNA Sequence Number=SeqID_4186
  Gene Ontology: Mol. function=sugar porter activity; Cellular component=integral to membrane; Biological process=carbohydrate transport
  Homolog annotation: Hit_ID=Q1T6J4; Match level="QueryCoverage=82%, HitCoverage=28%, E-value=1e-52, Identity=65%"; Hit description=Sugar transporter superfamily; Major facilitator superfamily MFS_1
METPIKYPGNLTLRVVLTCIMAASGGLIFGYDHGVSGGVTSMDSFLKQFFPSVYEKESNMKPSSNKYCKFNSQILTLFTSSLYLSALVAGLGASSITRMLGRRATMIIGGICFVGGALLNGFAVSIWMLIVGRLLLGFGIGCANQKQPLCICKCEATCNDPPSDLCIARSLQAL

SEQ ID NO: 120965 - protein, 64 aa, Glycine max
  Coding DNA Sequence Number=SeqID_4187
MGLCKLGLWVLCCLTSKISSLLPIKIDETRVFNPPSSKPSPLLEFQCMLSAEVLALIGLRNSKA

SEQ ID NO: 120966 - protein, 179 aa, Glycine max
  Coding DNA Sequence Number=SeqID_4188
  Subcellular localization annotation: CTP_CleavageSite=42; ConfidenceScore=5.10e-01
MKQVKSPLTSIQYFLSQRQSGNLHSQSEPNLKRENVNVVMTRSKRIQEDSQEKEVEVPAYGNPVSKKERDEKKKILAFPQKLGVRELEPTNITLHLADRSLVYPRGAIEDVLVRLGRLTLRLGDEKVYANVCPLERVITSKDLDWELNLEGIVLKLNPPDEEPPVSAAKTCSGIMIREC

SEQ ID NO: 120967 - protein, 200 aa, Glycine max
  Coding DNA Sequence Number=SeqID_4189
  Gene Ontology: Mol. function=DNA binding; Biological process=DNA integration
MWLPHRRLNSNMMEVMKGNMLKLLDANIIYPFSDNEWFMVDECIVLGHKVSSTSIEVDPANVEVIAQLPLLNCVNVVRSFLGHVGFYKRFEFDLEIKDKKGPKNFVANHLSCLEPFVKQATDEGTIHETFLDEHLLVMATLPEAPWCSLQSLSSRKGKDWWQRLNNIFDYMSKWVKVVALPTNDARSAQDVKQALPRGML

SEQ ID NO: 120968 - protein, 370 aa, Glycine max
  Coding DNA Sequence Number=SeqID_4190
  Subcellular localization annotation: CTP_CleavageSite=31; ConfidenceScore=5.09e-01
MDQSLLSNVMVWTTSNNILQPFSGFKYTFFLPMHKVSNVLDVLIRLHRSEIPLAEIPEYDSEMERACRRNNAGIRKRKMAKANAGNGNNGGNEGNKERLKIASVTCELEHYYLGSMLTSILEEIPPCSKNICLKLESNSKDYIAYSMAIPHRVKIIEAMASNVYNGVGDRRILKRPTEVHLMMALPRPPHVCDESGETRHVVEDCPYTHALEEVKYVGGNGANYDPYSNTFNQALPFQTEPNLKEKLKLVSTRSGKPHAKYKKKEKVASPKKENEAHIEESQTKHMEAPTERSSMTRKEKEETQPINITLQLVDKFIAYPKGVVEDVLVKVNTLIFSADFVMLDIEEDKDFSIILRLPFLNTCDMAIEDM

SEQ ID NO: 120969 - protein, 200 aa, Glycine max
  Coding DNA Sequence Number=SeqID_4191
  Gene Ontology: Mol. function=RNA-directed DNA polymerase activity; Biological process=RNA-dependent DNA replication
MMIVVPVEQNLRAKGQNMGGAGGSRWLREGGDAKDPAVSDGINSDINERDRRKESWNLLCDLANDTSFPWLTFGDFNDLLSDDEKIGLIDHPMWLIRGFRETLNDCNLYDLPMKGYQFTWNRSRGENDGIKEKLDRGAATLDWIDLFPNFKILNGLSPKYDHSPITMKLNDVKRRHFQKHIRSENAWFLEIELNGVVMEV

SEQ ID NO: 120970 - protein, 157 aa, Glycine max
  Coding DNA Sequence Number=SeqID_4192
MTSEHTLYCPTSSSQTFDKLQHNWNVFLTHTSGEGNQCANFTKLHAGQAAAQLERVPDSYSQGKEINVLTSLSYMQDKQQHNWNVFLTHTSGEGNQCANFTKLHAGQAAAQLERVPDSYSQGKEINVLTSLSYMQDKQQHNWNVFLTHTLRGRKSMC

SEQ ID NO: 120971 - protein, 322 aa, Glycine max
  Coding DNA Sequence Number=SeqID_4193
  Gene Ontology: Mol. function=oxidoreductase activity; Cellular component=membrane; Biological process=electron transport
  Homolog annotation: Hit_ID=Q2LAK3; Match level="QueryCoverage=99%, HitCoverage=88%, E-value=1e-133, Identity=73%"; Hit description =Cytochrome P450 monooxygenase CYP89H3
  Pfam annotation: Domain name=p450; Domain location=1-320; Score=31.5; E_value=2.1e-12; Accession=PF00067.12; Description=Cytochrome P450
MFYLLVFMCFGERLDNGKVRDIERVLRQMLLRFGRFNILNFWPKVTMILLHKRWEELFRYRKEQEDVMVPIIRARKQKRAKEGVGLNDGVVVSYVDTLLDLQLPEEKRELSEEEMVTLCNEFMNAGTDTTSTALQWIMANLVKYPHMQEKVVEEIREIVGEREEREVKEEDLHKLSYLKAVILEGLRRHPPAHIVSHAVTEDVVFNDYLVPKNGTVNFMVAMIGLDPKVWEDPMAFKPERFLNDEEFDITGNKEIKMMPFGAGRRICPAYNLALLHLEYFVANLVWNFKWRVPEGGDVDLSEILEFSGVMKNALQIHISPRI

SEQ ID NO: 120972 - protein, 45 aa, Glycine max
  Coding DNA Sequence Number=SeqID_4194
MPLAFSISDSFSAEKEAVVKAQAVMKNFADAKRRDVQYSVVTGFM

SEQ ID NO: 120973 - protein, 104 aa, Glycine max
  Coding DNA Sequence Number=SeqID_4195
MNKKVEEDVEMERAKYRLHSVEAMHFKIILMMPKNLESNKFQESRIIKIKIQDSKFKIFQKKNLLPRVLLSGNRLPEDSNRLPIANIVFKLIYKAVIDYHNHCF

SEQ ID NO: 120974 - protein, 58 aa, Glycine max
  Coding DNA Sequence Number=SeqID_4196
MTSSDHRTKGRQKVTGKEVGADCRGRDGRAAQIVSVYQQLIKAGVSLGKRVTGYSSEC

SEQ ID NO: 120975 - protein, 100 aa, Glycine max
  Coding DNA Sequence Number=SeqID_4197
  Subcellular localization annotation: CTP_CleavageSite=29; ConfidenceScore=5.37e-01
MWCFSFSFFLSISTALLIQIPSSRFTSVVAGRTQSTDTARHEIVVEVRMEFDFLADNIGWRQRSATEKRRAPVTAMAAGDRNMKNMHMRKLKVNEILFVK

SEQ ID NO: 120976 - protein, 55 aa, Glycine max
  Coding DNA Sequence Number=SeqID_4198
MRRKEYASQGETEIEVLSGGSGGEAVQCMRHRGRWSWLWMKLGKEDEDEEAKCDD

SEQ ID NO: 120977 - protein, 498 aa, Glycine max
  Coding DNA Sequence Number=SeqID_4199
  Gene Ontology: Mol. function=monooxygenase activity; Cellular component=membrane; Biological process=electron transport
  Homolog annotation: Hit_ID=Q1SYF8; Match level="QueryCoverage=99%, HitCoverage=100%, E-value=1e-178, Identity=63%"; Hit description=E -class P450, group I
  Pfam annotation: Domain name=p450; Domain location=32-494; Score =375.4; E_value=8.7e-110; Accession=PF00067.12; Description =Cytochrome P450
MEAWFIILVTLCVCVLIRAILFSLHKKTITIPPGPPHIPIISSILWLRKSISELEAVVKTLHAKYGPIITLRIGTEPTIFIADHSLAHQALIQHGSLFANRPKDGGFKILTNNRHQINSSSYGATWRTLRRNLASQMLHPSRVKSFSGIRKEVLHTLLTRLKSDSESNKSIKVIDHFQYAMSCLLILMCFGEPLDEGKVREIELVLRKLLLHFQSFNILNFWPRVTRVLCRNLWEQLLRMQKEQDDALFPLIRARKQKRTNNVVVSYVDTLLELQLPEEKRNLSEGEISALCAEFINAGSDTTSMSLQWVMANLVKYPHVQERVVDEIRNVLGERVREEREVKEEDLQKLPYLKAVILEGLRRHPPGHFTLPHVVAEDVVFNDYLVPKNGTVNFMVGMIGLDPKVWEDPMAFKPERFLNDEGFDITGSKEIKMMPFGAGRRICPGYKLALLNLEYFVANLVLNFEWKVPEGGDVDLTEKQEFITVMKNALQVHFIPRI

SEQ ID NO: 120978 - protein, 131 aa, Glycine max
  Coding DNA Sequence Number=SeqID_4200
MTKVTHQRLQEVQLKRRRRNMGIKIQMMTERKGRENLQSATKEAARRLHRKQVRMNPYEAKLNLDQLISTPTTSVFGNLLVLLYSPESDEQSVEDKTLENRTEHVRENENEPLRERRTHRGESKLSEGERE

SEQ ID NO: 120979 - protein, 84 aa, Glycine max
  Coding DNA Sequence Number=SeqID_4201
MESSNEKMTGKRKVLGKNNEKQEVILHGIWRWNVYWLMYLEIKGIWATRVTEVEKVLHNWDDIVDLCAKDRATGHGAETAMDAG

SEQ ID NO: 120980 - protein, 74 aa, Glycine max
  Coding DNA Sequence Number=SeqID_4202
MNLTQPRGFEGFKTSTKRQEGVGGGTIEEVGLLLRAPSIIAGTPRKIMKFHFYPSIKLIRINESISPILIGKSV

SEQ ID NO: 120981 - protein, 94 aa, Glycine max
  Coding DNA Sequence Number=SeqID_4203
MAKNAPLLSSSLKSWVKGPVFIVAVVDLSSATYEGVLENKHRQKEEKLEGAAAGVSLSLDHALSKYHPLSKTSACLASKGNLEGNLPRKHAPNA

SEQ ID NO: 120982 - protein, 966 aa, Glycine max
  Coding DNA Sequence Number=SeqID_4204
  Gene Ontology: Mol. function=protein serine/threonine kinase activity; Cellular component=integral to membrane; Biological process=multicellular organismal development
  Homolog annotation: Hit_ID=Q9FGL5; Match level="QueryCoverage=94%, HitCoverage=94%, E-value=0.0, Identity=61%"; Hit description =Receptor protein kinase
  Pfam annotation: Domain name=LRRNT_2; Domain location=27-68; Score =9.3; E_value=0.09; Accession=PF08263.3; Description=Leucine rich repeat N-terminal domain
  Pfam annotation: Domain name=LRR_1; Domain location=121-142; Score =15.0; E_value=0.28; Accession=PF00560.23; Description=Leucine Rich Repeat
  Pfam annotation: Domain name=LRR_1; Domain location=145-167; Score =16.8; E_value=0.076; Accession=PF00560.23; Description=Leucine Rich Repeat
  Pfam annotation: Domain name=LRR_1; Domain location=169-193; Score =5.6; E_value=26; Accession=PF00560.23; Description=Leucine Rich Repeat
  Pfam annotation: Domain name=LRR_1; Domain location=195-217; Score =0.7; E_value=2.1e+02; Accession=PF00560.23; Description=Leucine Rich Repeat
  Pfam annotation: Domain name=LRR_1; Domain location=219-241; Score =17.2; E_value=0.06; Accession=PF00560.23; Description=Leucine Rich Repeat
  Pfam annotation: Domain name=LRR_1; Domain location=243-266; Score =14.2; E_value=0.49; Accession=PF00560.23; Description=Leucine Rich Repeat
  Pfam annotation: Domain name=LRR_1; Domain location=268-290; Score =8.5; E_value=7.4; Accession=PF00560.23; Description=Leucine Rich Repeat
  Pfam annotation: Domain name=LRR_1; Domain location=292-314; Score =14.9; E_value=0.29; Accession=PF00560.23; Description=Leucine Rich Repeat
  Pfam annotation: Domain name=LRR_1; Domain location=316-338; Score =9.2; E_value=5.5; Accession=PF00560.23; Description=Leucine Rich Repeat
  Pfam annotation: Domain name=LRR_1; Domain location=340-360; Score =5.8; E_value=24; Accession=PF00560.23; Description=Leucine Rich Repeat
  Pfam annotation: Domain name=LRR_1; Domain location=388-410; Score =8.8; E_value=6.3; Accession=PF00560.23; Description=Leucine Rich Repeat
  Pfam annotation: Domain name=LRR_1; Domain location=412-433; Score =12.8; E_value=1.1; Accession=PF00560.23; Description=Leucine Rich Repeat
  Pfam annotation: Domain name=LRR_1; Domain location=436-458; Score =8.4; E_value=7.6; Accession=PF00560.23; Description=Leucine Rich Repeat
  Pfam annotation: Domain name=LRR_1; Domain location=460-482; Score =15.2; E_value=0.23; Accession=PF00560.23; Description=Leucine Rich Repeat
  Pfam annotation: Domain name=LRR_1; Domain location=484-506; Score =9.2; E_value=5.4; Accession=PF00560.23; Description=Leucine Rich Repeat
  Pfam annotation: Domain name=LRR_1; Domain location=508-530; Score =17.2; E_value=0.058; Accession=PF00560.23; Description=Leucine Rich Repeat
  Pfam annotation: Domain name=LRR_1; Domain location=531-550; Score =2.4; E_value=1e+02; Accession=PF00560.23; Description=Leucine Rich Repeat
  Pfam annotation: Domain name=LRR_1; Domain location=72-96; Score=4.9; E_value=34; Accession=PF00560.23; Description=Leucine Rich Repeat
  Pfam annotation: Domain name=LRR_1; Domain location=98-119; Score =5.4; E_value=28; Accession=PF00560.23; Description=Leucine Rich Repeat
  Pfam annotation: Domain name=Pkinase; Domain location=656-936; Score =182.7; E_value=9e-52; Accession=PF00069.15; Description=Protein kinase domain
  Pfam annotation: Domain name=Pkinase_Tyr; Domain location=656-936; Score=74.4; E_value=3.7e-19; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=27-68::121 -142::145-167::169-193::195-217::219-241::243-266::268-290::292 -314::316-338::340-360::388-410::412-433::436-458::460-482::484 -506::508-530::531-550::72-96::...
  Pfam module annotation: =98-119::656-936::656-936
  Subcellular localization annotation: CTP_CleavageSite=66; ConfidenceScore=5.10e-01
MSHPFITLFATIILIIVSLSQAITTKNNNQSQFFSLMKDLSLSGKYPTNWDAAGKLVPVCGFTGVTCNTKGDVISLDLSDRSSLSGNFPPDICSYLPQLRVLRLGHTRFKFPIDTILNCSHLEELNMNHMSLTGTLPDFSSLKKSLRVLDLSYNSFTGQFPMSVFNLTNLEELNFNENGGFNLWQLPADIDRLKKLKVMVLTTCMVHGQIPASIGNITSLTDLELSGNFLTGQIPKELGQLKNLQQLELYYNYHLVGNIPEELGNLTELVDLDMSVNKFTGSIPASVCRLPKLQVLQLYNNSLTGEIPGAIENSTALRMLSLYDNFLVGHVPRKLGQFSGMVVLDLSENKFSGPLPTEVCKGGTLGYFLVLDNMFSGEIPQSYANCMMLLRFRVSNNRLEGSIPAGLLALPHVSIIDLSNNNLTGPIPEINGNSRNLSELFLQRNKISGVINPTISRAINLVKIDFSYNLLSGPIPSEIGNLRKLNLLMLQGNKLNSSIPGSLSSLESLNLLDLSNNLLTGSIPESLSVLLPNSINFSHNLLSGPIPPKLIKGGLVESFAGNPGLCVLPVYANSSDHKFPMCASAYYKSKRINTIWIAGVSVVLIFIGSALFLKRRCSKDTAAVEHEDTLSSSFFSYDVKSFHKISFDQREIVESLVDKNIMGHGGSGTVYKIELKSGDIVAVKRLWSHASKDSAPEDRLFVDKALKAEVETLGSIRHKNIVKLYCCFSSYDCSLLVYEYMPNGNLWDSLHKGWILLDWPTRYRIALGIAQGLAYLHHDLLLPIIHRDIKSTNILLDVDNQPKVADFGIAKVLQARGGKDSTTTVIAGTYGYLAPEFAYSSRATTKCDVYSYGVILMELLTGKKPVEAEFGENRNIVFWVSNKVEGKEGARPSEVLDPKLSCSFKEDMIKVLRIAIRCTYKAPTSRPTMKEVVQLLIEAEPRGSDSCKLSTNDVSNVTVIKKPYEL

SEQ ID NO: 120983 - protein, 405 aa, Glycine max
  Coding DNA Sequence Number=SeqID_4205
  Gene Ontology: Mol. function=protein binding; Cellular component =integral to membrane; Biological process=protein amino acid phosphorylation
  Homolog annotation: Hit_ID=Q1T435; Match level="QueryCoverage=85%, HitCoverage=34%, E-value=3e-50, Identity=38%"; Hit description =Leucine-rich repeat; Leucine-rich repeat, cysteine-containing type
  Pfam annotation: Domain name=LRRNT_2; Domain location=38-80; Score =54.7; E_value=3e-13; Accession=PF08263.3; Description=Leucine rich repeat N-terminal domain
  Pfam annotation: Domain name=LRR_1; Domain location=113-136; Score =7.3; E_value=12; Accession=PF00560.23; Description=Leucine Rich Repeat
  Pfam annotation: Domain name=LRR_1; Domain location=138-160; Score =13.0; E_value=1; Accession=PF00560.23; Description=Leucine Rich Repeat
  Pfam annotation: Domain name=LRR_1; Domain location=162-185; Score =5.9; E_value=22; Accession=PF00560.23; Description=Leucine Rich Repeat
  Pfam annotation: Domain name=LRR_1; Domain location=187-209; Score =13.9; E_value=0.58; Accession=PF00560.23; Description=Leucine Rich Repeat
  Pfam annotation: Domain name=LRR_1; Domain location=211-234; Score =3.8; E_value=56; Accession=PF00560.23; Description=Leucine Rich Repeat
  Pfam annotation: Domain name=LRR_1; Domain location=261-286; Score =4.0; E_value=51; Accession=PF00560.23; Description=Leucine Rich Repeat
  Pfam annotation: Domain name=LRR_1; Domain location=289-312; Score =8.0; E_value=9.2; Accession=PF00560.23; Description=Leucine Rich Repeat
  Pfam annotation: Domain name=LRR_1; Domain location=318-340; Score =9.2; E_value=5.5; Accession=PF00560.23; Description=Leucine Rich Repeat
  Pfam annotation: Domain name=LRR_1; Domain location=343-364; Score =10.6; E_value=2.9; Accession=PF00560.23; Description=Leucine Rich Repeat
  Pfam annotation: Domain name=LRR_1; Domain location=366-389; Score =8.0; E_value=9.2; Accession=PF00560.23; Description=Leucine Rich Repeat
  Pfam annotation: Domain name=LRR_1; Domain location=391-405; Score =2.3; E_value=1.1e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1; Domain location=38-80::113-136::138-160::162-185::187-209::211-234::261 -286::289-312::...
  Pfam module annotation: Domain location=318-340::343-364::366 -389::391-405
MSCYSLKLFYALLLLLLHAAGSILGFNSLPNSAEIKCIESERQALLNFKHGLKDDSGMLSTWRDDGNNGDCCKWKGIQCNNQTGHVEMLHLRGQDTQYLRGAINISSLIALENIEHLDLSYNAFEWRHIPELLGSFANLRYLNLSVCFFIGSIPSDIGKLTHLLSLDLGNNFYLRGKIPYQLGNLTHLQYLDLSYNDLDGELPYQLGNLSQLRYLDLAGWNSFSGALPFQVGNLPLLHTLGLGGNFDVKSKDAEWLTNLSSLTKLRLSSLHNLSSSHHWLQMISKLIPNLKELRLFDCSLSDTNIQSLFYSPSNFSTALTILDLSKNKLTSSTFQLLSNFSLNLQELYLGHNNIVLSSPLCPNFPSLVILDLSYNNMTSSVFQGGFNFSSKLQNLDLQNCSLTDE

SEQ ID NO: 120984 - protein, 482 aa, Glycine max
  Coding DNA Sequence Number=SeqID_4206
  Gene Ontology: Mol. function=transporter activity; Cellular component= outer membrane; Biological process=transport
  Homolog annotation: Hit_ID=Q4UNL3; Match level="QueryCoverage=82%, HitCoverage=53%, E-value=1e-117, Identity=52%"; Hit description=TonB- dependent receptor
RIVGDRAVDVIEVALHAVAVVLVPQARFQLVARHVPGERRGHTGAVDRILGGADRYRDLAAGTRVGRIGRAEPVALATVAVVVDVDLQAHRLVQAEIAGDAGQVVIAQAVAGVVRIPRAVDAAAERAACSGHGTVPVRRVVVPVPAETIDHLQRQVLVIGLDAARGVEQRGNPAVRSEVVGGLAVELLQLLRALALPLVAFRVCAGQVGRKALMFTGLQARIAAARVVAAKALCQNHAVFGGRVDRIELEHAAKVAGGRRTQRANAGGNLRAAQVLADHRAADVQAVAVAVGHVAQRDAIKGVAEAVLVETTQADAGGPFVGAGGIGRFEVHARLAGQQLQRVGTRRQDLHVLGGHTLHLAGFAAADHRDRIEGGGRRCVDGGGGFSDSQRRQRSTDQQGQQIAAERSVGRHGGGFLGHAGRRRAASKGSSGGIVEASRYMSFTRHIRTFGVWNGLPARRRLPASGRHACYSNEPIELWARL

SEQ ID NO: 120985 - protein, 378 aa, Glycine max
  Coding DNA Sequence Number=SeqID_4207
  Gene Ontology: Mol. function=oxidoreductase activity, acting on the aldehyde or oxo group of donors, disulfide as acceptor; Biological process=metabolic process
  Homolog annotation: Hit_ID=UPI00006B70C1; Match level="QueryCoverage =100%, HitCoverage=54%, E-value=1e-108, Identity=50%"; Hit description=2-oxoisovalerate dehydrogenase, E1 component, alpha and beta fusion
  Pfam annotation: Domain name=E1_dh; Domain location=1-223; Score= -126.9; E_value=0.0096; Accession=PF00676.10; Description =Dehydrogenase E1 component
  Pfam annotation: Domain name=Transket_pyr; Domain location=266-376; Score=-41.8; E_value=0.0017; Accession=PF02779.14; Description =Transketolase, pyrimidine binding dom
  Pfam module annotation: Pfam domain module=E1_dh::Transket_pyr; Domain location=1-223::266-376
MAERSRQVPGIDPLRDAALSFAASADDPASGGRHKVWGSKPLWVLPQTSTIASHLPKALGTALAIESGKRLGQALPLPAPILFVCEDNGLGISVKTPDGWIAERFSRQPGLDYFFADGLDLATGHAQVQAAVEHCRRTRRPTFLHLRTTRLMGHAGTDFEVEWRALPELCAAEAQDPLLRSAQIAMESGWMDAAAIEVAYETMRARCMAAAADAEGHPTLQSLQDVMAPLAPYTPAAVQAEACREVPAETREALYGGAETLPERQAPRHLAIQINHGLQELLAKYPQSLLFGEDVAQKGGVYTVTKDLLRRFGPRRVFNTLLDETMILGMAQGLANMGMLPIPEIQYLAYLHNAIDQVRGEACSLQFFSNDQYRNPML

SEQ ID NO: 120986 - protein, 144 aa, Glycine max
  Coding DNA Sequence Number=SeqID_4208
  Homolog annotation: Hit_ID=Q1S6K5; Match level="QueryCoverage=51%, HitCoverage=57%, E-value=3e-22, Identity=61%"; Hit description =HesB/YadR/YfhF
  Pfam annotation: Domain name=Fe-S_biosyn; Domain location=54-129; Score=17.9; E_value=3.7e-05; Accession=PF01521.11; Description=Iron -sulphur cluster biosynthesis
MVGCLERDTEVANSTPGAAIGDGAARLRLLHSLLLLLFTIATSSSDSDPDLEPLHMTKNCVRELEASESSADRKMLPLSVETGGCAGFQVFERDGIKLVVDNISYDFVKGATVDYVEELSSHSFLHRYYNTELHHNFSMVVNRK

SEQ ID NO: 120987 - protein, 671 aa, Glycine max
  Coding DNA Sequence Number=SeqID_4209
  Gene Ontology: Mol. function=nucleoside-triphosphatase activity; Cellular component=integral to membrane; Biological process=transport
  Homolog annotation: Hit_ID=Q93YS4; Match level="QueryCoverage=98%, HitCoverage=81%, E-value=0.0, Identity=66%"; Hit description=White -brown complex homolog protein 23
  Pfam annotation: Domain name=ABC2_membrane; Domain location=416-625; Score=173.4; E_value=5.8e-49; Accession=PF01061.14; Description=ABC -2 type transporter
  Pfam annotation: Domain name=ABC_tran; Domain location=91-267; Score =135.9; E_value=1.1e-37; Accession=PF00005.17; Description=ABC transporter
  Pfam module annotation: Pfam domain module=ABC2_membrane::ABC_tran; Domain location=416-625::91-267
MYIAAEDIEAGTPKPKFQTEPTLPIYLKATMKLHLAINAANRTCYMAINIAWSGSVLYKFTDVTYKLVMKGITTTKEKDILKGITGSVNPGEVLALMGPSGSGKTSLLNLLGGRLIQCTIGGSITYNDQPYSKFLKSRIGFVTQDDVLFPHLTVKETLTYAALLRLPNTLRKEQKEKRALEVIEELGLERCQDTMIGGSYVRGISGGERKRVCIGNEIIINPSLLFLDEPTSGLDSTTALRIVQMLQDIAELVIKLMTWKDVSLDYGLVQFEFITNLLVLYQAGKTVVTTIHQPSSRLFHKFDKLILLGKGSLLYFGKASDAMDYFQFIGCAPLIAMNPAEFLLDLANGNVNDISVPSELKDKVQMGNAEAETSNGKPSASVVQEYLVEAYDSRVAEIEKTKLMIPVPLDEELKSKQFSILFSRGFRERRHDYFSWLRITQVLATAVILGLLWWQSDAKTPKGLQDQAGLLFFIAVFWGFFPVFTAIFTFPQERAMLTKERTTDMYRLSAYFVARTTSDLLLDLVLPVFFLLVVYFMANLRLGSGRFFFSILTVFLCIIAAQGLGLAIGATLMDLKRATTLASVTVMTFMLAGGFFVKKVPIFISWIRYISFNYHTYKLLLKVQYEHITPTIDGIRIDSGFTEVAALTAMVFGYRLLAYLSLRRMKLLAGN

SEQ ID NO: 120988 - protein, 134 aa, Glycine max
  Coding DNA Sequence Number=SeqID_4210
MEDSMRLGFMAVVAVSGSMAFSVHQVHKRILSKFMDIFECEMGGVLNAHGQKNLCGSEKHQAKKKVRFAKEALRNNSCRKGDKMIKIRLQRIKAEEIWVMKNVQKWRHGPKEDMMPPNRAVLYKGIMKYRKRSI

SEQ ID NO: 120989 - protein, 68 aa, Glycine max
  Coding DNA Sequence Number=SeqID_4211
MDNWSLMDLVWPLDIVGDMRIHGDGVVALLEVDDGEVATWKDLLGGFQRHKGVPSAMVAMSLDHNDYC

SEQ ID NO: 120990 - protein, 47 aa, Glycine max
  Coding DNA Sequence Number=SeqID_4212
MVEASLAVVVAKPRSVMTMVMRMEKRENESEWCCLETIEAEERKCCI

SEQ ID NO: 120991 - protein, 498 aa, Glycine max
  Coding DNA Sequence Number=SeqID_4213
  Gene Ontology: Mol. function=signal transducer activity; Cellular component=spindle; Biological process=cell division
  Homolog annotation: Hit_ID=Q9SZA4; Match level="QueryCoverage=87%, HitCoverage=95%, E-value=0.0, Identity=71%"; Hit description=WD -repeat protein-like protein
  Pfam annotation: Domain name=WD40; Domain location=215-252; Score =26.0; E_value=0.00014; Accession=PF00400.22; Description=WD domain, G-beta repeat
  Pfam annotation: Domain name=WD40; Domain location=256-293; Score =11.9; E_value=1.5; Accession=PF00400.22; Description=WD domain, G -beta repeat
  Pfam annotation: Domain name=WD40; Domain location=298-336; Score =45.3; E_value=2.1e-10; Accession=PF00400.22; Description=WD domain, G-beta repeat
  Pfam annotation: Domain name=WD40; Domain location=346-387; Score =15.1; E_value=0.26; Accession=PF00400.22; Description=WD domain, G -beta repeat
  Pfam annotation: Domain name=WD40; Domain location=434-472; Score =31.5; E_value=2.9e-06; Accession=PF00400.22; Description=WD domain, G-beta repeat
  Pfam module annotation: Pfam domain module=WD40::WD40::WD40::WD40::WD4 0; Domain location=215-252::256-293::298-336::346-387::434-472
MGDNISNPRKMLAYQFEPIYHRCKTTVSFAHHHLLHIPSPTMDVGSWSSSPSKIKSRFSFQDRLFRRKNSQENLDRFIPNRSAMDFDYAHYMLTEGNKKGKEKENPVVTSPSREAYQKQLAEAFNMNRTRILAFKNKPRTPVELIPSSILNPPPPPPNSSKPRRYIPQSSEKTLDAPDILDDYYLNLLDWGSGDVLSIALGNTVYLWNASDSSTAELVTVDEEDGPVTSVAWAPDGRHVAIGLNNSHVQLWDSHASRLLRTLKGGHQARVGSLSWNNHILTTGGMDGRIVNNDVRVRHHIVESYRGHQQEICGLRWSPSGQQLASGGNDNVIHIWDRTMVSSNSPTHWLHRFEEHRAAVKALAWCPFQANLLASGGGGGDHCIKFWNTHTGACLNSVDTGSQVCALLWSKNERELLSSHGFTQNQLALWKYPSMLKMAELKGHTSRVLYMAQSPNGCTVASAAGDETLRFWNVFGTAQASKPAPTASTDPFAHVNRIR

SEQ ID NO: 120992 - protein, 85 aa, Glycine max
  Coding DNA Sequence Number=SeqID_4214
MTAAPSPGGGGGGRNTYIRKARSAQLKVEVDEVGSGVALSRASSASLGLSFSFTGFTLPPDEIADSKPFSDDDIQGSFAISSASL

SEQ ID NO: 120993 - protein, 110 aa, Glycine max
  Coding DNA Sequence Number=SeqID_4215
  Gene Ontology: Mol. function=RNA-directed DNA polymerase activity; Biological process=RNA-dependent DNA replication
MWFDAYISRVVGDGRNISFWKDVWVGKDTLKAKFSRLFLLSEQQEAKVIDMGFWEEGEWSWNFRWRRKFFVWENDIFNTLQALFRFGPMGCQPDLMSTRSSIRLGVVFVG

SEQ ID NO: 120994 - protein, 41 aa, Glycine max
  Coding DNA Sequence Number=SeqID_4216
MRRGVDNHQGMTKGRLTSYFSHFPDNFKEMDFWPILKQYGK

SEQ ID NO: 120995 - protein, 184 aa, Glycine max
  Coding DNA Sequence Number=SeqID_4217
  Gene Ontology: Mol. function=sequence-specific DNA binding; Cellular component=nucleus; Biological process=regulation of transcription, DNA-dependent
  Homolog annotation: Hit_ID=O82632; Match level="QueryCoverage=62%, HitCoverage=40%, E-value=2e-30, Identity=53%"; Hit description=GATA transcription factor 11
  Pfam annotation: Domain name=GATA; Domain location=115-150; Score =33.3; E_value=8.4e-07; Accession=PF00320.17; Description=GATA zinc finger
MGKFATFIEYFPAVMSDLLQIVLKVERCHELSFLTSESSSSTDTLPPFASNDTLQNSPFLHSKTPRLGKARSKCSRAASGDWSTRLLHLVTLEQVKPPQANKREGMNVECFGCKCLHCGTEKTPQWRTGSMRPKTLCNMFDMRFKSRRLVPEYCPTASPTFMSTKHLNSHRKVLELRWQKEMQR

SEQ ID NO: 120996 - protein, 479 aa, Glycine max
  Coding DNA Sequence Number=SeqID_4218
  Gene Ontology: Mol. function=protein binding; Cellular component =integral to membrane; Biological process=protein amino acid phosphorylation
  Homolog annotation: Hit_ID=Q1T435; Match level="QueryCoverage=93%, HitCoverage=81%, E-value=3e-53, Identity=36%"; Hit description =Leucine-rich repeat; Leucine-rich repeat, cysteine-containing type
  Pfam annotation: Domain name=LRRNT_2; Domain location=20-62; Score =54.7; E_value=3e-13; Accession=PF08263.3; Description=Leucine rich repeat N-terminal domain
  Pfam annotation: Domain name=LRR_1; Domain location=120-142; Score =17.1; E_value=0.062; Accession=PF00560.23; Description=Leucine Rich Repeat
  Pfam annotation: Domain name=LRR_1; Domain location=144-167; Score =9.1; E_value=5.8; Accession=PF00560.23; Description=Leucine Rich Repeat
  Pfam annotation: Domain name=LRR_1; Domain location=169-191; Score =13.1; E_value=1; Accession=PF00560.23; Description=Leucine Rich Repeat
  Pfam annotation: Domain name=LRR_1; Domain location=193-216; Score =7.4; E_value=12; Accession=PF00560.23; Description=Leucine Rich Repeat
  Pfam annotation: Domain name=LRR_1; Domain location=243-268; Score =4.0; E_value=51; Accession=PF00560.23; Description=Leucine Rich Repeat
  Pfam annotation: Domain name=LRR_1; Domain location=271-294; Score =9.4; E_value=5; Accession=PF00560.23; Description=Leucine Rich Repeat
  Pfam annotation: Domain name=LRR_1; Domain location=300-322; Score =10.0; E_value=3.8; Accession=PF00560.23; Description=Leucine Rich Repeat
  Pfam annotation: Domain name=LRR_1; Domain location=325-346; Score =10.6; E_value=2.9; Accession=PF00560.23; Description=Leucine Rich Repeat
  Pfam annotation: Domain name=LRR_1; Domain location=348-371; Score =8.0; E_value=9.2; Accession=PF00560.23; Description=Leucine Rich Repeat
  Pfam annotation: Domain name=LRR_1; Domain location=373-399; Score =6.6; E_value=16; Accession=PF00560.23; Description=Leucine Rich Repeat
  Pfam annotation: Domain name=LRR_1; Domain location=402-425; Score =7.1; E_value=13; Accession=PF00560.23; Description=Leucine Rich Repeat
  Pfam annotation: Domain name=LRR_1; Domain location=428-450; Score =16.1; E_value=0.13; Accession=PF00560.23; Description=Leucine Rich Repeat
  Pfam annotation: Domain name=LRR_1; Domain location=453-475; Score =19.8; E_value=0.0099; Accession=PF00560.23; Description=Leucine Rich Repeat
  Pfam annotation: Domain name=LRR_1; Domain location=95-117; Score =11.2; E_value=2.3; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1; Domain location=20-62::120-142::144-167::169-191::193 -216::243-268::...
  Pfam module annotation: Domain location=271-294::300-322::325 -346::348-371::373-399::402-425::428-450::453-475::95-117
AAGSILGFNSLPNSTEIKCIESERQALLNFKHGLKDDSGMLSTWRDDGNNGDCCKWKGIQCNNQTGHVEMLHLRGHGRQYLSGAINISSLIALENIEHLDLSYNDFEVSHIPELMGSFTNLRYLNLSDCYFIGIIPSDIGKLTHLLSLDLGGNSYLHGQIPYQLGNLTHLQYLDLSYNDLDGELPYQLVNLSQLRYLDLAGGNSFSGAFPFKVGNLPLLLTLGLGGKFDVKSKDAEWLTNLSSLTKLRLSSLHNLSSSHHWLQMISKLIPNLRELRLVGCSLSDTNIQSLFYSPSNFSTALTILDLSSNKLTSSTFQLLSNFSLNLQELYLGHNNIVLSSPLCPNFPSLVILDLSYNNMTSSVFQGGFNFSSKLQNLDLQNCSLTDGSFLMSSSFIMRSSSSLVSLDLSSNLLKSSTIFYWLFNSTTNLHNLDLGYNMLEGPIPDGFGKVMNSLEVLYLSDNKLQGEIPSFFGNMCALQ

SEQ ID NO: 120997 - protein, 99 aa, Glycine max
  Coding DNA Sequence Number=SeqID_4219
  Homolog annotation: Hit_ID=Q1SP03; Match level="QueryCoverage=59%, HitCoverage=10%, E-value=6e-08, Identity=42%"; Hit description=IMP dehydrogenase/GMP reductase
MDEVQGQSFSKVYGKIWDLEMIEVLVEVIASLTQYYDQSLRCFTFGDFQLAPTIEDFKGILGCPIGGRKPYLFSRYYLFVARVARVVKISEQELDRVKQ

SEQ ID NO: 120998 - protein, 182 aa, Glycine max
  Coding DNA Sequence Number=SeqID_4220
MFLDTPVVLEPGECYATYTSYEDGYGLGVAHFRPDLADSPIQLLQALIFDTYHCLMHRPGSCSRFFDLRDFESLSPAINLAYIRKNCWNPDDPTITFPWTRKARAREPSDTSAPSSSAPPTSAPLAPPAPTPAPAPSGTFAQSTKILVLMLRSLHHGLCLVMQSIHDLAQHRSIISMEAFMA

SEQ ID NO: 120999 - protein, 55 aa, Glycine max
  Coding DNA Sequence Number=SeqID_4221
MGARDSSFMNRAHHEVGREHPELVEEYPPMSPKPLPQPLVSPLALARALAATPGL

SEQ ID NO: 121000 - protein, 1124 aa, Glycine max
  Coding DNA Sequence Number=SeqID_4222
  Gene Ontology: Mol. function=protein binding; Cellular component =integral to membrane; Biological process=defense response to fungus
  Homolog annotation: Hit_ID=Q949G8; Match level="QueryCoverage=96%, HitCoverage=95%, E-value=1e-133, Identity=29%"; Hit description =HcrVf2 protein
  Pfam annotation: Domain name=LRRNT_2; Domain location=32-74; Score =45.7; E_value=1.6e-10; Accession=PF08263.3; Description=Leucine rich repeat N-terminal domain
  Pfam annotation: Domain name=LRR_1; Domain location=1008-1029; Score =15.1; E_value=0.25; Accession=PF00560.23; Description=Leucine Rich Repeat
  Pfam annotation: Domain name=LRR_1; Domain location=107-129; Score =13.4; E_value=0.84; Accession=PF00560.23; Description=Leucine Rich Repeat
  Pfam annotation: Domain name=LRR_1; Domain location=132-154; Score =14.5; E_value=0.39; Accession=PF00560.23; Description=Leucine Rich Repeat
  Pfam annotation: Domain name=LRR_1; Domain location=156-179; Score =10.0; E_value=3.8; Accession=PF00560.23; Description=Leucine Rich Repeat
  Pfam annotation: Domain name=LRR_1; Domain location=181-204; Score =8.0; E_value=9.2; Accession=PF00560.23; Description=Leucine Rich Repeat
  Pfam annotation: Domain name=LRR_1; Domain location=206-228; Score =17.4; E_value=0.051; Accession=PF00560.23; Description=Leucine Rich Repeat
  Pfam annotation: Domain name=LRR_1; Domain location=230-253; Score =7.6; E_value=11; Accession=PF00560.23; Description=Leucine Rich Repeat
  Pfam annotation: Domain name=LRR_1; Domain location=280-302; Score =0.8; E_value=2e+02; Accession=PF00560.23; Description=Leucine Rich Repeat
  Pfam annotation: Domain name=LRR_1; Domain location=308-331; Score =9.4; E_value=5; Accession=PF00560.23; Description=Leucine Rich Repeat
  Pfam annotation: Domain name=LRR_1; Domain location=337-359; Score =7.5; E_value=11; Accession=PF00560.23; Description=Leucine Rich Repeat
  Pfam annotation: Domain name=LRR_1; Domain location=362-383; Score =8.7; E_value=6.7; Accession=PF00560.23; Description=Leucine Rich Repeat
  Pfam annotation: Domain name=LRR_1; Domain location=385-407; Score =8.0; E_value=8.9; Accession=PF00560.23; Description=Leucine Rich Repeat
  Pfam annotation: Domain name=LRR_1; Domain location=410-434; Score =6.0; E_value=22; Accession=PF00560.23; Description=Leucine Rich Repeat
  Pfam annotation: Domain name=LRR_1; Domain location=439-462; Score =7.1; E_value=13; Accession=PF00560.23; Description=Leucine Rich Repeat
  Pfam annotation: Domain name=LRR_1; Domain location=465-487; Score =15.7; E_value=0.17; Accession=PF00560.23; Description=Leucine Rich Repeat
  Pfam annotation: Domain name=LRR_1; Domain location=490-512; Score =19.0; E_value=0.017; Accession=PF00560.23; Description=Leucine Rich Repeat
  Pfam annotation: Domain name=LRR_1; Domain location=514-536; Score =12.8; E_value=1.2; Accession=PF00560.23; Description=Leucine Rich Repeat
  Pfam annotation: Domain name=LRR_1; Domain location=543-565; Score =8.5; E_value=7.2; Accession=PF00560.23; Description=Leucine Rich Repeat
  Pfam annotation: Domain name=LRR_1; Domain location=567-590; Score =11.3; E_value=2.2; Accession=PF00560.23; Description=Leucine Rich Repeat
  Pfam annotation: Domain name=LRR_1; Domain location=592-615; Score =9.2; E_value=5.5; Accession=PF00560.23; Description=Leucine Rich Repeat
  Pfam annotation: Domain name=LRR_1; Domain location=616-638; Score =4.6; E_value=39; Accession=PF00560.23; Description=Leucine Rich Repeat
  Pfam annotation: Domain name=LRR_1; Domain location=640-663; Score =13.6; E_value=0.7; Accession=PF00560.23; Description=Leucine Rich Repeat
  Pfam annotation: Domain name=LRR_1; Domain location=665-688; Score =1.8; E_value=1.3e+02; Accession=PF00560.23; Description=Leucine Rich Repeat
  Pfam annotation: Domain name=LRR_1; Domain location=710-728; Score =1.6; E_value=1.4e+02; Accession=PF00560.23; Description=Leucine Rich Repeat
  Pfam annotation: Domain name=LRR_1; Domain location=736-757; Score =7.0; E_value=14; Accession=PF00560.23; Description=Leucine Rich Repeat
  Pfam annotation: Domain name=LRR_1; Domain location=760-782; Score =13.2; E_value=0.98; Accession=PF00560.23; Description=Leucine Rich Repeat
  Pfam annotation: Domain name=LRR_1; Domain location=784-806; Score =16.1; E_value=0.12; Accession=PF00560.23; Description=Leucine Rich Repeat
  Pfam annotation: Domain name=LRR_1; Domain location=808-830; Score =11.2; E_value=2.3; Accession=PF00560.23; Description=Leucine Rich Repeat
  Pfam annotation: Domain name=LRR_1; Domain location=833-855; Score =13.1; E_value=1; Accession=PF00560.23; Description=Leucine Rich Repeat
  Pfam annotation: Domain name=LRR_1; Domain location=857-879; Score =14.4; E_value=0.41; Accession=PF00560.23; Description=Leucine Rich Repeat
  Pfam annotation: Domain name=LRR_1; Domain location=936-958; Score =19.6; E_value=0.011; Accession=PF00560.23; Description=Leucine Rich Repeat
  Pfam annotation: Domain name=LRR_1; Domain location=960-982; Score =17.4; E_value=0.053; Accession=PF00560.23; Description=Leucine Rich Repeat
  Pfam annotation: Domain name=LRR_1; Domain location=984-1006; Score =18.3; E_value=0.029; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1; Domain location=32-74::1008 -1029::107-129::132-154::156-179::181-204::206-228::230-253::280 -302::308-331::337-359:...
  Pfam module annotation: Domain location=:362-383::385-407::410 -434::439-462::465-487::490-512::514-536::543-565::567-590::592 -615::616-638::640-663::665-688::710-728::736-757::760-782::784 -806::808-830::833-855::857-879:...
  Pfam module annotation: Domain location=:936-958::960-982::984-1006
MSEIIKVVTTLPSKVSILGFNSLPNSAEIKCIETERQTLLNFKHGLIDRYGILSTWSDDHTNRDCCKWKGILCNNHTGHVETLHLRGQDTQYLRGSINISSLIALENIEHLDLSNNDFQGSHIPEIMGSFTNLRYLNLSHSLFRGSIPSDIGKLTHLRYLDLGSNGYLRGQIPYQLGNLSQLLYLDLGRNKYLHGQLPCQLGNLTHLQYLDLSYNDFQGELPYQLGNLSQLRYLDLARGNSFSGALPFQVRNLPLLHTLGLGGNFDVKSKDAEWLTNLSSLTKLKLTSLRNLSSSHHWLQMISKIIPNLRELRLVGCSLSDTNIQSLFYSPSNFSTALTILDLSLNKLTSSTFQLLSNFSLNLQELYLYDNNIVLSSPLCLNFPSLVILDLSYNNMTSLVFQGGFNFSSKLQNLHLQHCSLTDRSFLMPSTSSMSSSSSLVSLDLSSNLLKSSTIFYWLFNSTTNLHKLSLYHNMLEGPIPDGFGKVMNSLEVLDLSGNKLQGQIPSFFGNVCALRSLDLSNNKLNGEFSSFFRNSSWCNRDIFTNLDLSDNRLTGMLPKSIGLLSELEDLNLVRNSLEGEVTESHLSNFSKLKYLRLSENSLSLKFVPSWVPPFQLEYLGIGSCKLGPTFPSWLKTQSSLYWLDISDNGINDSVPDWFWNKLQNMGLLNMSSNYLIGAIPNISLKLPFRPFIHLKSNQFEGKIPSFLLEASHLILSENNFSDVFSFLCDQSTAAKFATLDVSHNQIKGQLPDCWKSVKQLLFLDLSSNKLSGKIPTSMGALVNIEALILRNNGLTGELPSSLKNCSSLFMLDLSENMLSGPIPSWIGESMQQLIMLNMRGNHLSGNLPVHLCYLKSIQLLDLSRNNLSRGIPTCLKNLTAMSEQTINSSDTMSRIYWYNNTYYEIYGSYSLGGYMLGITWMWKGVERGFKNPELKLKSIDLSSNNLTGEIPKEFGYLLGLVSLNLSRNNLSGEIPSQIGNLSSLESLDLSRNHISGRIPSSLSEIDYLQKLDLSHNSLSGRIPSGRHFQTFEASSFEGNIDLCGEQLNKTCPGDGDQTTEEHQEPPVKGDDSVFYEGLYISLGIGYFTGFWCLLGPLLLWPPWRIAYIRFLNRLTDYVYVCLW

SEQ ID NO: 121001 - protein, 70 aa, Glycine max
  Coding DNA Sequence Number=SeqID_4223
MVVEEAKSTMGTNAEEEKMVIVRFGDLQTMRRVRTGKRLLMKKKQMAVAAQAEKSLPVSPAGGPQPLPLL

SEQ ID NO: 121002 - protein, 167 aa, Glycine max
  Coding DNA Sequence Number=SeqID_4224
  Gene Ontology: Mol. function=catalytic activity; Biological process =trehalose biosynthetic process
  Homolog annotation: Hit_ID=Q45RR4; Match level="QueryCoverage=44%, HitCoverage=55%, E-value=2e-26, Identity=76%"; Hit description =Trehalose-6-phosphate phosphatase
  Pfam annotation: Domain name=Trehalose_PPase; Domain location=1-119; Score=-77.3; E_value=0.097; Accession=PF02358.7; Description =Trehalose-phosphatase
  Subcellular localization annotation: CTP_CleavageSite=21; ConfidenceScore=5.15e-01
MDATSTLPTPASPTLLCTPPGSSQKKSWAALVEKVRLVLNEYPQLRLTQGRKVLEICLTIKWDNGKALEFLLESLGYENSNDVFPIYIGDDRTNEDAFRDRIWMASSTMQSLLDLRVVPKGTSHYQIIQQALQLLHECFKADCNLERQRKKAAKDGGKGNRKGDRGR

SEQ ID NO: 121003 - protein, 178 aa, Glycine max
  Coding DNA Sequence Number=SeqID_4225
  Homolog annotation: Hit_ID=O82089; Match level="QueryCoverage=16%, HitCoverage=24%, E-value=6e-07, Identity=80%"; Hit description =Copper homeostasis factor
MGPTYSDMGCKLALEDKKRVAFRRRQRHEHVDATRHAKPCNCSSLASQQQKACVCCFIKLPCRICHQALRCARKWACYGSKNNRAGFVNSLAFAKSGEFLVAGVGHTVVLKVGMSCQGCAGAVNRILGKMEGIFIPKFQLISFSLKLLAIFCWVIKWFSCSQLTFGHNQEYPAQVKGC

SEQ ID NO: 121004 - protein, 47 aa, Glycine max
  Coding DNA Sequence Number=SeqID_4226
MAFANDLREIEMSTTKKLRNMGRKPLKCFSVHKLLQLLDRKLKVMNL

SEQ ID NO: 121005 - protein, 169 aa, Glycine max
  Coding DNA Sequence Number=SeqID_4227
  Gene Ontology: Mol. function=protein binding; Cellular component =thylakoid; Biological process=photosynthesis
  Homolog annotation: Hit_ID=Q4W7J1; Match level="QueryCoverage=97%, HitCoverage=12%, E-value=9e-55, Identity=63%"; Hit description =TONSOKU protein
  Pfam annotation: Domain name=TPR_1; Domain location=114-147; Score =26.4; E_value=0.0001; Accession=PF00515.18; Description =Tetratricopeptide repeat
  Pfam annotation: Domain name=TPR_1; Domain location=31-64; Score=6.9; E_value=0.81; Accession=PF00515.18; Description=Tetratricopeptide repeat
  Pfam annotation: Domain name=TPR_1; Domain location=74-107; Score =15.8; E_value=0.07; Accession=PF00515.18; Description=Tetratricopepti de repeat
  Pfam annotation: Domain name=TPR_2; Domain location=114-147; Score =27.3; E_value=5.3e-05; Accession=PF07719.7; Description =Tetratricopeptide repeat
  Pfam annotation: Domain name=TPR_2; Domain location=31-64; Score=3.9; E_value=11; Accession=PF07719.7; Description=Tetratricopeptide repeat
  Pfam annotation: Domain name=TPR_2; Domain location=74-107; Score =17.6; E_value=0.047; Accession=PF07719.7; Description=Tetratricopepti de repeat
  Pfam module annotation: Pfam domain module=TPR_1::TPR_1::TPR_1::TPR _2::TPR_2::TPR_2; Domain location=114-147::31-64::74-107::114-147::31- 64::74-107
MKKYFKSTMDLAVKLKDNPPNSKSSFLKEYIDAHNNIGMLEMGLDNLHESWKILTRGLEICEEEEVAEYGDGHSRLHHNLGNVYMDLRDWDKARKYIKTNIVICNRIEHAQGETNGYINLGEVHYRTQKYEDASSYYEKALGLAKSLEDEDALVRQVEQNIETERETVK

SEQ ID NO: 121006 - protein, 46 aa, Glycine max
  Coding DNA Sequence Number=SeqID_4228
MAHPKDGSMKNEGHLAIADGILEMTKETRLGFFLAILGPTVCYKPS

SEQ ID NO: 121007 - protein, 137 aa, Glycine max
  Coding DNA Sequence Number=SeqID_4229
MRIGSRREREETESCRGRFNGERSTALTRRQWPTAVITEEVEHVDHAANEVHEEPQGPLTDHVCVDTKGFSSGPRGTSVLTSYADHGERQRNLEGLYLRLGVGKRVQVHGLVRGARGLREATEVWMTPLPVKEDKSG

SEQ ID NO: 121008 - protein, 41 aa, Glycine max
  Coding DNA Sequence Number=SeqID_4230
MVTFGRGVFIGGELGSLGRKLLVENSGTIQGVGFSMESGFG

SEQ ID NO: 121009 - protein, 50 aa, Glycine max
  Coding DNA Sequence Number=SeqID_4231
MAPFSLSIGCKRFGWANEGKHVLGGSKWWRDVGEVTKVGGDLDWFEGEGG

SEQ ID NO: 121010 - protein, 156 aa, Glycine max
  Coding DNA Sequence Number=SeqID_4232
  Pfam annotation: Domain name=Transposase_23; Domain location=91-156; Score=-16.3; E_value=0.07; Accession=PF03017.5; Description =TNP1ENSPM transposase
  Subcellular localization annotation: CTP_CleavageSite=52; ConfidenceScore=5.21e-01
MSFSLPLAPPLRRCLSHVHSLSLVSFLHSHSCISTPLPHSHSRPVSLPLTAIAALGGSAKYTSRGKNVAKKLLSDKENIVFDGSSGQDPDTGVSEKCGLYIDENPPYLIALGRVYEGSTIVHNVPLGNDQVKIDIEEVCDANARIPVPTQEVQLVG

SEQ ID NO: 121011 - protein, 569 aa, Glycine max
  Coding DNA Sequence Number=SeqID_4233
  Gene Ontology: Mol. function=diacylglycerol kinase activity; Cellular component=intracellular; Biological process=protein kinase C activation
  Homolog annotation: Hit_ID=Q9FG16; Match level="QueryCoverage=99%, HitCoverage=92%, E-value=0.0, Identity=61%"; Hit description =Selenium-binding protein-like
  Pfam annotation: Domain name=PPR; Domain location=101-135; Score=9.0; E_value=0.65; Accession=PF01535.11; Description=PPR repeat
  Pfam annotation: Domain name=PPR; Domain location=163-197; Score =42.1; E_value=1.9e-09; Accession=PF01535.11; Description=PPR repeat
  Pfam annotation: Domain name=PPR; Domain location=264-298; Score =30.3; E_value=6.9e-06; Accession=PF01535.11; Description=PPR repeat
  Pfam annotation: Domain name=PPR; Domain location=299-333; Score =25.4; E_value=0.0002; Accession=PF01535.11; Description=PPR repeat
  Pfam annotation: Domain name=PPR; Domain location=31-65; Score=17.5; E_value=0.047; Accession=PF01535.11; Description=PPR repeat
  Pfam annotation: Domain name=PPR; Domain location=335-369; Score =12.8; E_value=0.22; Accession=PF01535.11; Description=PPR repeat
  Pfam annotation: Domain name=PPR; Domain location=401-435; Score=6.3; E_value=1.4; Accession=PF01535.11; Description=PPR repeat
  Pfam module annotation: Pfam domain module=PPR::PPR::PPR::PPR::PPR::PP R::PPR; Domain location=101-135::163-197::264-298::299-333::31 -65::335-369::401-435
QSPHCFLHRFNHQLAHYAIRVASQIQNPNLFIYNAFIRGCSTSENPENSFHYYIKALRFGLLPDNITHPFLVKACAQLENEPMGMHGHGQAIKHGFEQDFYVQNSLVHMYATVGDINAARSVFQRMCRFDVVSWTCMIAGYHRCGDAESARELFDRMPERNLVTWSTMISGYAHKNCFEKAVEMFEALQAEGLVANEAVIVDVISSCAHLGALAMGEKAHEYVIRNNLSLNLILGTAVVGMYARCGNIEKAVKVFEQLREKDVLCWTALIAGLAMHGYAEKPLWYFSQMEKKGFVPRDITFTAVLTACSRAGMVERGLEIFESMKRDHGVEPRLEHYGCMVDPLGRAGKLGEAEKFVLEMPVKPNSPIWGALLGACWIHKNVEVGEMVGKTLLEMQPEYSGHYVLLSNICARANKWKDVTVMRQMMKDRGVRKPTGYSLIEIDGKVHEFTIGDKIHPEIEKIERMWEDIILPKIKLAGYVGNTAETMFDIDEEEKEGALHRHSEKLAIAYIIKIWPPTPIRIVKNLRVCEDCHTATKLISMVFQVELIVRDRNRFHHFKEGTRSCMDYW

SEQ ID NO: 121012 - protein, 95 aa, Glycine max
  Coding DNA Sequence Number=SeqID_4234
MVCLGGRHGDGAEKSYPKHHSLTTWVMYGVGRQETTIHLLFSYPKSSHLWMDWYQREGIATMLLQQPTSHFMQHSGCRIGSSDCVECINTMYLEP

SEQ ID NO: 121013 - protein, 470 aa, Glycine max
  Coding DNA Sequence Number=SeqID_4235
  Homolog annotation: Hit_ID=Q2R276; Match level="QueryCoverage=71%, HitCoverage=67%, E-value=1e-30, Identity=31%"; Hit description =Expressed protein
  Pfam annotation: Domain name=DUF593; Domain location=69-162; Score =188.2; E_value=2e-53; Accession=PF04576.6; Description=Protein of unknown function, DUF593
MDLESSGDSVKCCKHCGCGCSDCSMAAQSSGNWLRSVKRKHKQLEQGDQFSVPGPDCDLVARVEIGNECDALREAVSSQQKSIQDLYEELEEERNAASSAANETMTMILRLQREKAELQLEARQFKRFVEERTSHDQQELLALEELLYKREQAIHSLTCEVQAYKHRLMSFGISESEGEGDQYEFPPYEYPPLRCNAMHASTDDNDEIDIDKYAFGETPKDRLKNLESRISQMERSPTYSQMDGEFSGKNILEKVIVGQSPRRAKHSRKFSCDSSSLCPEYMMDSPSFRKIDEDLSNLKKVDNASEAGDDMIDKVYTIDSEFKAGASVYDYYATTPRDFVDHADFEDLHVKKLYMRLQALEADRESMRQAIISMRTDKAQLVLLKEIAQELCKEMSQQKKMTARSFISSFSFFTVFKGFGGGSPRLSLSFSVFKGPISDYELGYDLDSWSWRYQNTVVLPLEPCCNPKHN

SEQ ID NO: 121014 - protein, 632 aa, Glycine max
  Coding DNA Sequence Number=SeqID_4236
  Gene Ontology: Mol. function=receptor activity
  Homolog annotation: Hit_ID=Q2R2A5; Match level="QueryCoverage=62%, HitCoverage=84%, E-value=1e-136, Identity=54%"; Hit description =Transcription factor jumonji, putative, expressed
  Pfam annotation: Domain name=JmjC; Domain location=444-555; Score =25.6; E_value=3.6e-06; Accession=PF02373.13; Description=JmjC domain
MDYTLCKVFFPLMAIRGMALDDYCTLCNAYPETLSHALGDCTWVRGAWNNLGINDTWNFFQHNVHRSLVHDNSARDEFIKALQLHASLESMLHEYPAEDLAASLEDWGIARDVGAHMMVVESDCSEALRLIDEHPPTASDFSNLLDEIQMLGGIVTHSHIETETKNLAVDDNTMRSFRMRNLLSSVKKKTIENRNKTSRNCISITKELARLVEEEEEEEEVNEEGFNIKSSAPSHTHGVQPLGNLYLNTGSTNSRDTGLGNLHTLSDDLVLDILGFLDASSLGILATGLGNPPMFLLVTLHLISSLMLLGVSKLATFIRIICFQSWLCANLGMKPEWLERDNVEPNKPVLLEGCIDNWGVLRNWDRDYLVRLCGDVKFSVGSLEMKLGEYFGYSGQVREERPLYLFDPKFAEKVSKLGDDYDVPVYFREDLFGVLGNERPDYRWVIIGPSGSGSSFHVDQNSTSAWNAVIKGSKKWILFPPDVIPPGVHPSPDGADAASPVSIIEWFMNFYGATKNWQKKPIECVCKAGEVIFVPCGWWHLVINLEESIAITQNYVSKRNLMNVLDFLKRPNATLVSGTRDRVNLYDKFKNAIEASFPGEIDELTRKEEERKIQQRKLSFWDTDADTYSGAF

SEQ ID NO: 121015 - protein, 96 aa, Glycine max
  Coding DNA Sequence Number=SeqID_4237
  Homolog annotation: Hit_ID=Q5XPJ9; Match level="QueryCoverage=53%, HitCoverage=3%, E-value=8e-18, Identity=82%"; Hit description =Protein SCAR2
MPLSKYRVRNEYSLADPELYRAADKDDPEALLEAVAMAGLVGLLRQLGDLAEVLKGKKLKEIWRWQCGDWFKLCNCEDFKSWTNEVPDDRFWLDGS

SEQ ID NO: 121016 - protein, 1629 aa, Glycine max
  Coding DNA Sequence Number=SeqID_4238
  Gene Ontology: Mol. function=actin binding; Cellular component =cytoskeleton
  Homolog annotation: Hit_ID=Q5XPJ9; Match level="QueryCoverage=99%, HitCoverage=94%, E-value=2e-74, Identity=39%"; Hit description =Protein SCAR2
  Pfam annotation: Domain name=WH2; Domain location=1534-1553; Score =3.9; E_value=11; Accession=PF02205.10; Description=WH2 motif
  Pfam annotation: Domain name=WH2; Domain location=1567-1585; Score =14.2; E_value=0.39; Accession=PF02205.10; Description=WH2 motif
  Pfam module annotation: Pfam domain module=WH2::WH2; Domain location =1534-1553::1567-1585
MATAARGHGLMARVKQLEAEVPSLEKAFFSQTHHSSFYTNGGIDWHPNLRFEQNLVTRGDLPRFIMDSYEECRGPPRLFLLDKFDVAGAGACLKRYTDPSFFKMESTSSVTATIEVQREKRIRKVKLKKGARLRDGETPNAVPSHAKLHQLLLEERIENGYSNPARRVKLKKRQLNGPAVETRDGKSYMEKFLETPSPDHKMVCETSIFPLPVKQTPYDTSEAGIKILEISSISPVKKSLGNKNTYSSPDENELELKPFSEMDGGTNEDLVKVKEQISDGVTDKKSSNHLKLPDAAELAINEQKKIEGSLDGHHSDDVTSEVDNYMDALTTMESELETDNEYKPKNSFLNIQKAANTNDKEEHQLQAQFSDSQSFGDSSMSDDSSSFNQDRNEEHIKVEAQSSDSQSTGTSSTLDDNSSFRRDGNGQHREPQAHFSDSQSVGSSSTSDENFKKDKSYLPHSDSLTTAVENIQSEPILFTNAKCCELKVEDAPSNQLPQNVEFQHTDCERFVMHDDAPVHEEEISSDLGQASSDLMTSGQVLCSNLGSTLPVILPAATQSDETPSAPAELNLRLDDDNADRTGLVESISSKPVSLSLTDDAHPVGSSAKTSLDNLDDDDPYIHCDDLLQVLNDLELAHGDECSDHSEIKMSQAEPPKENPSKILVNRDIGSPVEDPVSPSMEELNLNSGATLAHDCQDSKDEDCTVTTQLNSETPVSPLSCFTGGLLSDSTHNNTQDEPGSAEIEVSSSDLQSKVGEIPKMVHDDEINGSTFSVNPVEDDGHFKRSSPDNHVMVNDLVTENVQSDDQAVYSAPSVDSAENDEGVVSCPASSQICSPSRGLSDLEEPPLSSHSYPMEIKSNEVELTQIAMVTNAEKSENQSAPLLDVASSDVVNSSLSNITKLEESLSTFADSQKKEIEVDEAVARDSLTELEEQKIVDQPEIASVDVQLNLNKLVPFDLPDSEICNNIQKSSPREKFQHGAFVDDAEMVPKFLGLDAQQSESLSYGLHDPLQNDRDGFSSPSGNQLEPETDLDLFSKSQIGEQDAEFPLREEKNFASEKPQFQQMQKYQLEQESTNATSDCVSEIHADEPSSFYSLPQSSSQENNAAKRVMDPLKPLLPNLFPKATENKLDEMPPMPPLPPMQWRMGKVQHASLASQREELEVSQVSVQPNRPDKQSLFGLPTSERETLYQNPFLPVMALESDKLQHSSGFAVGVSGHPVAIPFQFPIMVNESKGQYNYLLLDSNQIQNPLLTLPVASMGMPPQGFIVAPEGEVIQNSNPCAPIPSAAYAVLGHNSIPPQEKSTQPPHQLMMETTPDDKSLQQSMSNMVSMDRPPHGHAVASEGEMELNSNPGPTIPPAECAVSGHDSLSPQEKLTQPPSQLLMEHSSDDKTLLQFVTNVVSMDSSNSHIVSSEGEMEQSSNPDPPTPPVECAVPGPGHDSISSHENPTKPPSQLMSETSSEFKTLQQSISNVEGEQGHLPISFMSPPNMESMEPNQSFLPFEGGMEMSLDTSDHTSDLESERTNGKPKNKLPRPRNPLIDAVAAHDKSKLRKVTERVMPQIAPKVDERDSLLEQIRTKSFNLKPAVTTRPSIQGPKTNLKFAAILEKANAIRQALAGSDEDDDADWSDS

SEQ ID NO: 121017 - protein, 140 aa, Glycine max
  Coding DNA Sequence Number=SeqID_4239
MMVKGVRLALSFVFGAIIIMMLFNVYLHFCSQNYREVAIIVTSDGINNQEAIDKCSTFVYSMVKELEPKKNMVVECAMCLSDYEECNMVNNIRPKCDVVDNMVVDKFTTARFLESKQNTLQTCSSTLRTLLSSSSPFQDP

SEQ ID NO: 121018 - protein, 211 aa, Glycine max
  Coding DNA Sequence Number=SeqID_4240
  Subcellular localization annotation: CTP_CleavageSite=40; ConfidenceScore=5.64e-01
MVDATRSKGQLSRGSSGCTATRSSLRAFVSKRLFVRIQVSGKSYSGTASTVCAELLHFGVESCIRREVQVLQPISLAQAVSYARLQEEKLMAARRPPPYHPPTTTATTVITQSPSPNPTLPLLPTPQCTTTTSIPFKCLTPEEPAVCREKGLCFHCDQKFSRGHKCSSLLFLLVIEDEELTPQLAPPRSPSPDLLQEPPPAQLSLHALSGH

SEQ ID NO: 121019 - protein, 52 aa, Glycine max
  Coding DNA Sequence Number=SeqID_4241
MALADTDVVVDIALLCYTFIAYQAFTKEDGLPGAPYPCNSHRGCSCNLQFQI

SEQ ID NO: 121020 - protein, 308 aa, Glycine max
  Coding DNA Sequence Number=SeqID_4242
  Homolog annotation: Hit_ID=Q1RXU1; Match level="QueryCoverage=54%, HitCoverage=28%, E-value=1e-27, Identity=47%"; Hit description =Chorismate mutase; Prefoldin; tRNA-binding arm
NSYFYQSRTILNKARELAAKKDINAIEELAQTEVEKAMSLWNSDKSFRDDYEKRLLPSLDMRQLCRDGRMRNPDEKPLLEEPKPAETDTLPKSSVKQPKEEEPKSSPPETVPEQKIQKETKKKGKDLKSNLNKVLEDTDEYEFELPKVNKEPPIDPEKLKEMKREEEIAKAKQALERKKKQAEKAAAKAATRAQKEAEKKLKVREKKAKKVAGGTGAVPSPEEPANEAVEVAEQKTDDSMEASAPAKEKVPKESSVKFRNRAKALKGPDTIPKAIMKRKSLDLEGAVNQFSVGGLARFCRLIIREMAR

SEQ ID NO: 121021 - protein, 107 aa, Glycine max
  Coding DNA Sequence Number=SeqID_4243
  Gene Ontology: Mol. function=D-lactate dehydrogenase (cytochrome) activity; Cellular component=mitochondrion; Biological process =electron transport
  Homolog annotation: Hit_ID=Q2W2Y6; Match level="QueryCoverage=88%, HitCoverage=20%, E-value=2e-25, Identity=55%"; Hit description =FAD/FMN-containing dehydrogenase
  Pfam annotation: Domain name=FAD-oxidase_C; Domain location=1-100; Score=-14.9; E_value=6.4e-06; Accession=PF02913.9; Description=FAD linked oxidases, C-terminal domain
MYVCIVSLASTVIAHAGDGNFHTVILFDPNQEEQRREAERLNQFMVHAALSLEGTCTGEHGVGTGKMKYLEEELGVEALRTMKKIKAVLDPNDIMNPGKLIPPHVCF

SEQ ID NO: 121022 - protein, 58 aa, Glycine max
  Coding DNA Sequence Number=SeqID_4244
  Gene Ontology: Mol. function=iron ion transporter activity; Cellular component=integral to membrane; Biological process=iron ion transport
  Homolog annotation: Hit_ID=Q5Z922; Match level="QueryCoverage=84%, HitCoverage=10%, E-value=2e-10, Identity=56%"; Hit description =Putative SLC11A3 iron transporter
MWEFSVGLYMINIWPDSSLYAAIYGTIESASTALFDPIIGRWVDKLSYVKENTQTSLD

SEQ ID NO: 121023 - protein, 276 aa, Glycine max
  Coding DNA Sequence Number=SeqID_4245
  Gene Ontology: Mol. function=protein serine/threonine kinase activity; Cellular component=mitochondrion; Biological process =protein amino acid phosphorylation
  Homolog annotation: Hit_ID=Q1S6K1; Match level="QueryCoverage=99%, HitCoverage=79%, E-value=1e-110, Identity=49%"; Hit description =Pentatricopeptide repeat
  Pfam annotation: Domain name=PPR; Domain location=117-151; Score=6.0; E_value=1.4; Accession=PF01535.11; Description=PPR repeat
  Pfam annotation: Domain name=PPR; Domain location=12-46; Score=50.2; E_value=6.8e-12; Accession=PF01535.11; Description=PPR repeat
  Pfam annotation: Domain name=PPR; Domain location=152-186; Score =29.6; E_value=1.1e-05; Accession=PF01535.11; Description=PPR repeat
  Pfam annotation: Domain name=PPR; Domain location=187-221; Score =15.6; E_value=0.11; Accession=PF01535.11; Description=PPR repeat
  Pfam annotation: Domain name=PPR; Domain location=222-256; Score =18.8; E_value=0.02; Accession=PF01535.11; Description=PPR repeat
  Pfam annotation: Domain name=PPR; Domain location=47-81; Score=39.6; E_value=1e-08; Accession=PF01535.11; Description=PPR repeat
  Pfam annotation: Domain name=PPR; Domain location=82-116; Score=21.3; E_value=0.0035; Accession=PF01535.11; Description=PPR repeat
  Pfam module annotation: Pfam domain module=PPR::PPR::PPR::PPR::PPR::PP R::PPR; Domain location=117-151::12-46::152-186::187-221::222-256::47- 81::82-116
MVLKHRVKPDVFTFNILISGYCRNSQFNLALEMFHEMGKMGCLPNVVTFNTLIKGLFREGNVEEAIGMAREMVQLGIRFSSVSCEILVQGLCKEGRVLQACELLLEFCEKKVLPEGFDCFALLEVLCGEGYAMRALEVVYELWNGGSVPSLVACIVMVDGLRGLGKIDEARRLVERMLEEGLVLDVVTFNCVLRDICDKRRTNEANRLRLLASSKGFEPDEMTYRILVMGYIGEGGREQGELLVDEMLDMGFIPDLASYNQLMSGLSNCRRPTRRQ

SEQ ID NO: 121024 - protein, 259 aa, Glycine max
  Coding DNA Sequence Number=SeqID_4246
  Gene Ontology: Cellular component=chloroplast thylakoid membrane
  Homolog annotation: Hit_ID=Q1S6K0; Match level="QueryCoverage=91%, HitCoverage=74%, E-value=3e-82, Identity=70%"; Hit description=SOUL heme-binding protein; Bacterial regulatory factor, effector
  Pfam annotation: Domain name=SOUL; Domain location=107-257; Score =47.1; E_value=7.5e-12; Accession=PF04832.3; Description=SOUL heme -binding protein
  Subcellular localization annotation: CTP_CleavageSite=68; ConfidenceScore=5.72e-01
MLLFATLLLFSLQSSILTPIPVKPTKLSSNLSVTNSASYGERISSSTRRRTISPFESRISLIFALAPQANTLSQRLLADVAAETAKYVFPKRFENRNLEEALMSVPNLETVEFKVLSRRDQYEIREVENRVISSCSPNVQPYFVAETTMPGKSGFDFNGASRSFNVLAEYHFGKNTTKEKMEMNTPVFTSKNQSDGVKMDMTTPVLTTKMEDQDNWKMSFVMPSKYGANLPLAKDSSVRIKEVPRKIIDVVSFSGALLP

SEQ ID NO: 121025 - protein, 119 aa, Glycine max
  Coding DNA Sequence Number=SeqID_4247
MATPTIETPKQSENLNREEASKNEKCTRNGNKWRRREKNTSLEEGDKHKRIITRMREIAKKKTPLIEGLQNSIPKFGKAQKLRRKERTESRALPLSHMNFAIMISLDGEKPDILLMVTV

SEQ ID NO: 121026 - protein, 296 aa, Glycine max
  Coding DNA Sequence Number=SeqID_4248
  Gene Ontology: Mol. function=D-lactate dehydrogenase (cytochrome) activity; Cellular component=mitochondrion; Biological process =electron transport
  Homolog annotation: Hit_ID=Q26VY6; Match level="QueryCoverage=91%, HitCoverage=49%, E-value=1e-59, Identity=47%"; Hit description =Putative D-lactate dehydrogenase, oxidoreductase
  Pfam annotation: Domain name=FAD-oxidase_C; Domain location=149-291; Score=-32.9; E_value=0.00014; Accession=PF02913.9; Description=FAD linked oxidases, C-terminal domain
  Pfam annotation: Domain name=FAD_binding_4; Domain location=1-74; Score=-14.4; E_value=0.025; Accession=PF01565.13; Description=FAD binding domain
  Pfam module annotation: Pfam domain module=FAD-oxidase_C::FAD_binding_ 4; Domain location=149-291::1-74
MDVVVEPGIGWMELNEYLEPYGLFFPLDPGPGASIGGMCATRCSGSLAVRYGTMRDNVISLKVVLANGDIVKTASRARKSAAGYDLTRLMIGSEGTLGVITEVTLRLQKIPQYSVDYRFILKLFHSFILPCVSSSCNFVSSPHYMAYPSSLKNTVAMCNFPSVKDAADVAIATMMSGIQVSRVELLDEVQVKAINIANGKNLPECPTLMFEFIGTEAYAREQTQIVRKLVSEHNGSDFVFAEEPEAKKELWKVRKEALWACFAMEPNLVAMTTISISNQVNMDLRVHMLVVDRETE

SEQ ID NO: 121027 - protein, 77 aa, Glycine max
  Coding DNA Sequence Number=SeqID_4249
MIRSEVKMRFVTSHEYRAEPSEQNMGYPVTGWVDSRMETGTIQEMRTTLINHAVSQIMEVKSKTKQKILLTRTPVKE

SEQ ID NO: 121028 - protein, 50 aa, Glycine max
  Coding DNA Sequence Number=SeqID_4250
MVGSSLEVHQRGVASVEVKVLRVGGDCYDGWFVVRGTPDQADPLGLYEST

SEQ ID NO: 121029 - protein, 129 aa, Glycine max
  Coding DNA Sequence Number=SeqID_4251
MMKVYGKTSLQAECESNALFNVIMATDPTSPPQSDGQSEATSKRSRTTTRLRTLTLRTVDQPRPAVYVDPATGRASGPMREKFHSYLGVVAREKVPIIHNNWKDVPETLKEIVWNDILIKVRDQNKSCV

SEQ ID NO: 121030 - protein, 151 aa, Glycine max
  Coding DNA Sequence Number=SeqID_4252
  Pfam annotation: Domain name=DUF1471; Domain location=66-151; Score =82.6; E_value=1.2e-21; Accession=PF07338.3; Description=Protein of unknown function (DUF1471)
MDAPQHLLAQRVIQLAVLVLKCRGHQRPAADKCVYRHYASPPAALLFNTSRDNGLSSNQYAEEYIMKNVKIFATAALLATASFATFAADLPSSQPAADAQKIGVVSVSGASNLSALESELASKAAASGASSYRIVAAGGQNKLYGTAEIFN

SEQ ID NO: 121031 - protein, 275 aa, Glycine max
  Coding DNA Sequence Number=SeqID_4253
  Gene Ontology: Mol. function=transferase activity; Cellular component= endoplasmic reticulum; Biological process=response to oxidative stress
  Homolog annotation: Hit_ID=UPI00005F73C2; Match level="QueryCoverage =76%, HitCoverage=94%, E-value=3e-87, Identity=71%"; Hit description =COG0625: Glutathione S-transferase
  Pfam annotation: Domain name=GST_C; Domain location=158-259; Score =23.0; E_value=0.001; Accession=PF00043.15; Description=Glutathione S- transferase, C-terminal domain
  Pfam annotation: Domain name=GST_N; Domain location=54-128; Score =47.1; E_value=6e-11; Accession=PF02798.10; Description=Glutathione S- transferase, N-terminal domain
  Pfam module annotation: Pfam domain module=GST_C::GST_N; Domain location=158-259::54-128
MAAQLYSAVRPRFAADDLAQGSEREIRAAFINMICYFGRYQVEESEQRVVHQLEGCSFPNWVGSRQRILWFLEELGVPYQVQRYERDPQTMLAPAALKKIHPLGKSPVIVDGDLTLAESGAIIEYLQEAYDAQGMFMPTDFHARQQYRYWLHYAEGSLMPLLVMKLVFSRLGQPPIPWLLRPVAGAIGKGVQREYLDKQIAPHCEYLEQHLNKGSWFVGNDFSAADIQMSFPLEAMAARGALDDCPKLRGFLQRIHARPAYQRALEQGGPYDLLS

SEQ ID NO: 121032 - protein, 118 aa, Glycine max
  Coding DNA Sequence Number=SeqID_4254
  Gene Ontology: Mol. function=oxidoreductase activity; Cellular component=membrane; Biological process=fatty acid biosynthetic process
  Homolog annotation: Hit_ID=Q3KFG0; Match level="QueryCoverage=98%, HitCoverage=46%, E-value=1e-23, Identity=50%"; Hit description=Short- chain dehydrogenase/reductase SDR
  Pfam annotation: Domain name=adh_short; Domain location=10-118; Score= -11.0; E_value=2.9e-05; Accession=PF00106.15; Description=short chain dehydrogenase
MTTAQPLQGKVAFVQGGSRGIGAAIVKRLASEGAAVAFTYAASADRAESVASAVTAAGGKALAIKADSADAAALQQAVRQAVSQFGNLDILVNNAGVFTLGSTEELALDDLDRMLAVN

SEQ ID NO: 121033 - protein, 55 aa, Glycine max
  Coding DNA Sequence Number=SeqID_4255
MVFGLTIDSGFGGGLACLGEIGYLCPFGSFGGARSKKGRCKKKKGRSRNKQCAFT

SEQ ID NO: 121034 - protein, 33 aa, Glycine max
  Coding DNA Sequence Number=SeqID_4256
MEMEVNVRITMRIRVRGSPLQPHRNFVLNSQFT

SEQ ID NO: 121035 - protein, 682 aa, Glycine max
  Coding DNA Sequence Number=SeqID_4257
  Gene Ontology: Mol. function=zinc ion binding; Cellular component =membrane; Biological process=defense response
  Homolog annotation: Hit_ID=Q9FHX1; Match level="QueryCoverage=99%, HitCoverage=81%, E-value=0.0, Identity=47%"; Hit description=TMV resistance protein-like
  Pfam annotation: Domain name=DZC; Domain location=621-656; Score =89.1; E_value=1.4e-23; Accession=PF08381.1; Description=Disease resistancezinc fingerchromo
  Pfam annotation: Domain name=FYVE; Domain location=184-252; Score =50.3; E_value=6.7e-12; Accession=PF01363.12; Description=FYVE zinc finger
  Pfam annotation: Domain name=RCC1; Domain location=134-181; Score =19.1; E_value=0.0061; Accession=PF00415.9; Description=Regulator of chromosome condensation (RCC1)
  Pfam annotation: Domain name=RCC1; Domain location=28-77; Score=23.6; E_value=0.00069; Accession=PF00415.9; Description=Regulator of chromosome condensation (RCC1)
  Pfam annotation: Domain name=RCC1; Domain location=80-129; Score =24.4; E_value=0.00041; Accession=PF00415.9; Description=Regulator of chromosome condensation (RCC1)
  Pfam module annotation: Pfam domain module=DZC::FYVE::RCC1::RCC1::RCC1 ; Domain location=621-656::184-252::134-181::28-77::80-129
TIAVACGVWHTAAVVEVIATHSSTSISSGKLFTWGDGDKNRLGHGDKEARLKPTCVAALIDSNFHKIACGHSLTAGLTKSGRVFTMGSTVYGQLGNPQSDGKVPCLVGDKIARESIEEIACGAYHVAVLTSKNEVYTWGKGANGRLGHGDIEDRKTPALVEALKDRHVKYIACGSNYSAAICLHKWVSGAEQSQCSTCRQAFGFTRKRHNCYNCGLVHCHSCSSRKALRAAHAPNPGKPYRVCDSCYAKLNKVAEASNSNRRNALPRLSGENKDRLDKSDLRLSKAVIHSNMDLIKQLDSKAAKQGKKGDTFSLVHPSQPPSLLQLKDVVLSSALDLRRTVPRPVVAPSGVSSRSVSPFSRRPSPPRSATPIPTTSGLAFSKSISDSLKKTNELLNQEVQKLHAQVESLRQRCELQELELQRSAKNTQEAMALAAEESAKCKAAKEVIKSLTAQLKDLAEKLPPGVYDAENVRPAYLPNGIEPNGIRHPDSNGEQHSRAESISASSLASMGLESALLNRTAGNSPGTYGTNPHQQIRSPVSSNGANNYPDVKLPNRGGAIQASSGNVSDTADGRDSGNFHNGDSGLKLRSVAPAADSNQVEAEWIEQYEPGVYITLVALSDGTRDLKRVRFSRRRFGEHQAETWWSENRDKVYERYNVRSTDKSANQAARSSEGAVSPVSQT

SEQ ID NO: 121036 - protein, 63 aa, Glycine max
  Coding DNA Sequence Number=SeqID_4258
MNYSTFSVIHYIISDYQGRRLYAESLKQKGSDYKKLDSIIELFIENTILGVQDRSNIRHHMGR

SEQ ID NO: 121037 - protein, 568 aa, Glycine max
  Coding DNA Sequence Number=SeqID_4259
  Gene Ontology: Mol. function=phosphotransferase activity, alcohol group as acceptor; Biological process=protein modification process
  Homolog annotation: Hit_ID=Q1SI70; Match level="QueryCoverage=99%, HitCoverage=98%, E-value=0.0, Identity=68%"; Hit description =Phosphatidylinositol 3-and 4-kinase, catalytic; Ubiquitin
  Pfam annotation: Domain name=PI3_PI4_kinase; Domain location=262-523; Score=306.4; E_value=5.3e-89; Accession=PF00454.17; Description =Phosphatidylinositol 3- and 4-kinase
  Pfam annotation: Domain name=ubiquitin; Domain location=108-180; Score=6.0; E_value=0.064; Accession=PF00240.13; Description =Ubiquitin family
  Pfam annotation: Domain name=ubiquitin; Domain location=31-100; Score= 72.1; E_value=1.8e-18; Accession=PF00240.13; Description=Ubiquitin family
  Pfam module annotation: Pfam domain module=PI3_PI4_kinase::ubiquitin:: ubiquitin; Domain location=262-523::108-180::31-100
MSIALSSVCKEKVHWEGQPGHCSGEPILIYLTVDGAVTPMRVFESDSIASVKLRIQQCKGFVVKKQKLVFSGRELARNGTLIKEYGVTDGNVLHLVLRLSDLLFIVVRTVSGKEFEFHIDRHRNVGYLKQRIRKKKGEGFIDLEDDQELFCNDEKLDDQSLFHDICKSDDDVIHLIIKKSAKVRTTPIHKDLNLSVEAPAKRVKHKWEKHVQIAKVPPDVGFWLEPIIVNPKINFFPFLWDMINSTFEGLKKGNHPIRSSEGTGGTYLMRDSTGQEHVSVFKPMDEEPMAVNNPRGLPNSSNGEGLKRGTKVGEGALREVAAYLLDHPKSGPRLASGEAVGFSGVPPSVMVQCLHQEFNHPNGFACSSKHVKIGSLQKFMSNDGNCEDYGPSAFPVEEVHKIAVLDIRLANADRHAGNILIRKEADGQIKLIPIDHGYCLPDKFEDCSFDWLYWPQARQPYSPETVDYINSLDAEKDLELLKCYGWDIPLECARTLRISTMLLKKGVERGLTPYAIGSIMCRENLNKESVIEEIIGEAQDSLLPGMEESAFLEAISQIMDYHLDKLAN

SEQ ID NO: 121038 - protein, 92 aa, Glycine max
  Coding DNA Sequence Number=SeqID_4260
MEVEEPWLGLWLPLNYRVDMRARMIFMDNWVVGKEKGCYWLSNDIVGLVGNSYAKTQTYIQYGIMSVKNQVGRLRVHDKTNHTLASQVTLTR

SEQ ID NO: 121039 - protein, 140 aa, Glycine max
  Coding DNA Sequence Number=SeqID_4261
  Gene Ontology: Mol. function=calcium ion binding; Cellular component =membrane; Biological process=abscisic acid mediated signaling
  Homolog annotation: Hit_ID=Q3HRP5; Match level="QueryCoverage=89%, HitCoverage=57%, E-value=2e-38, Identity=59%"; Hit description =Calcineurin B-like protein 2
  Pfam annotation: Domain name=efhand; Domain location=105-133; Score =7.5; E_value=2.1; Accession=PF00036.22; Description=EF hand
  Pfam annotation: Domain name=efhand; Domain location=68-96; Score =27.3; E_value=5.3e-05; Accession=PF00036.22; Description=EF hand
  Pfam module annotation: Pfam domain module=efhand::efhand; Domain location=105-133::68-96
MGCCCTKQRVDHKDPAVLASQTYFNISEIEALYDLFKKLSSSIIHDGVISKEEFQLGLFGSSEKRSLFADRVFQLFDSKNDGVIEFGEFVKALSVFHPAAPQAQKADFAFRLYDISQRGFIERGEVNNMNCVKHEYLPLP

SEQ ID NO: 121040 - protein, 175 aa, Glycine max
  Coding DNA Sequence Number=SeqID_4262
  Gene Ontology: Mol. function=nucleic acid binding; Cellular component= nucleus; Biological process=DNA integration
MDVIFLHNDLEEKIYMEQPKGFSIGELGRLGYVEKVLDMFNMSNAKPMDAEVEYMSKVPYANIVGCLIYVMVCTKSDLAHVVNQVCKFMSNPGKQHWEGGPSVARYVDFDYAGDLDDRRPTAGYVFTLGDGLGEVQLHCDRQSAIDLAKNQVYHAKTKHIDVRFYKISELTTSGQ

SEQ ID NO: 121041 - protein, 83 aa, Glycine max
  Coding DNA Sequence Number=SeqID_4263
MNTNRICEETFPDIYAPNTLKDTTDKSLSAQVSVPPRLADKLKLSAKKSIKKSKGALGAKSRAKCMNALLSPNIVALSAGSPH

SEQ ID NO: 121042 - protein, 234 aa, Glycine max
  Coding DNA Sequence Number=SeqID_4264
  Gene Ontology: Mol. function=nucleic acid binding
  Homolog annotation: Hit_ID=Q8H0P8; Match level="QueryCoverage=94%, HitCoverage=81%, E-value=4e-75, Identity=66%"; Hit description=RNA -binding protein
  Pfam annotation: Domain name=RRM_1; Domain location=130-211; Score =18.6; E_value=0.0028; Accession=PF00076.12; Description=RNA recognition motif. (a.k.a. RRM, R
MICLLPVCLSGNEMHNHVARDDDRTGHRMLKDTQTIGSAYDHYLQSGQLSSFTSGEVSAVGGLGLARGGGGGLSGHSLADPAVMGRHGGGGSDLAPNGRGVNYGGQLPVDAVSRPGPETGSLPPDASSTLYVEGLPSDSTRRELFIFLNLTLDIFRPFVGYREVRLVSKESKHRGGDPHYLCFVDFANPACAATAMSALQGYKVDELNPESSHLRLQFSRYPGPRSGPAFRSKR

SEQ ID NO: 121043 - protein, 49 aa, Glycine max
  Coding DNA Sequence Number=SeqID_4265
MMEVLVLGCTGVVVFLHGAHFFFHALTQHIALRSLSLSVGMNRMDHNGM

SEQ ID NO: 121044 - protein, 692 aa, Glycine max
  Coding DNA Sequence Number=SeqID_4266
  Gene Ontology: Mol. function=glutamate carboxypeptidase II activity; Cellular component=integral to membrane; Biological process =regulation of inflorescence meristem size
  Homolog annotation: Hit_ID=Q9M1S8; Match level="QueryCoverage=98%, HitCoverage=97%, E-value=0.0, Identity=51%"; Hit description =Probable glutamate carboxypeptidase 2
  Pfam annotation: Domain name=PA; Domain location=147-238; Score=26.7; E_value=7.9e-05; Accession=PF02225.12; Description=PA domain
  Pfam annotation: Domain name=Peptidase_M28; Domain location=333-514; Score=74.7; E_value=3e-19; Accession=PF04389.7; Description =Peptidase family M28
  Pfam annotation: Domain name=TFR_dimer; Domain location=553-690; Score=44.1; E_value=4.8e-10; Accession=PF04253.6; Description =Transferrin receptor-like dimerisation domain
  Pfam module annotation: Pfam domain module=PA::Peptidase_M28::TFR _dimer; Domain location=147-238::333-514::553-690
MMPKQPMNVLTTKPSPLSTMVVMLILCILGFYALHFPHSSTPSENLSHLEKLFLSTSSNSTISSYLRALTMHPHLAGTKPASDTTRYVLNHFTSLGLSAHTTTYTTLLSFPVRSSLSAHFNDGSSVSLRLTEEASGAGVVAAYHAYSPSGAVHAPAVFANYGRQRDYRALAAMGVNVSGCVVVVRKGGEMGRGAVVERAEVNGAAAVLVYGEGDTWRKGFERGHVMRGGIGDPLTPGWAGVEGAETLGLEDREVLKRFPKIPSMPLSAEVADTILSSLGGVHVPLHWRGTLRSKVRHVGPGPTLLNFTYEGEKKVATIQNVFAVIKGSEEPDRYVLLGNHRDAWTYGAVDPSSGTAALLDIARRFSALLGLGWKPRRTIILCSWDAEEFGMIGSTEWVEQNLINLGSKAVAYLNVDCAVQGPDFFVGSTPQLDNLILEVTNKVKDPDSDGVSLYENWAAGGGGNNIQRLSGVDSDFAPFVQHAGVPSIDMYYGRDFPVYHTAFDSYNWMAEYGDPFFHRHVAGVWGLLALHLADDPILPFNYVSYANELQLYKNTLSNLIDQKISLHPLTLSIEEFASAAKEADDEIKKLRLQETEGCFVDMKKRALNDRLMLAEKGFLDADGLQGKQWFKHLVFGPSSDHERINFFPGISDSTITSAGVSERERLASIQHEIWRVARAIRRAASALRGEFT

SEQ ID NO: 121045 - protein, 72 aa, Glycine max
  Coding DNA Sequence Number=SeqID_4267
  Subcellular localization annotation: CTP_CleavageSite=43; ConfidenceScore=5.20e-01
MYNFRVQFFTQVANGGANVILQAYSCKVFTSKLMLVHSTSHPLAKVVERVQQGSTALQQLCGRHYILANSTT

SEQ ID NO: 121046 - protein, 107 aa, Glycine max
  Coding DNA Sequence Number=SeqID_4268
  Homolog annotation: Hit_ID=Q5JML8; Match level="QueryCoverage=43%, HitCoverage=33%, E-value=1e-15, Identity=80%"; Hit description=DNA -binding protein-related-like
MGEREREQGYESLMHIDKILMSMMYFQGRQKIQSSYLCSNLFCAVDMMKAGATVILRNAKIDMFKGSMRMAVDKWGRVEVTDPADFEVKEDNNLSLVEYELVNVVEE

SEQ ID NO: 121047 - protein, 77 aa, Glycine max
  Coding DNA Sequence Number=SeqID_4269
MKSRIELEVIRLPIGAITGIDRGDMEGEGGVRVEDVEEGEVETKEFEWKEFGKVEKRRVVPRGVKVAGGERLDIAKE

SEQ ID NO: 121048 - protein, 143 aa, Glycine max
  Coding DNA Sequence Number=SeqID_4270
MSHFIKWKGREKGGNTFRGPTIGVARHREHRIQQCGSSSTVIRKHRFHAETRFDRKCVEERRYLKTRLEIEVCFGSRNGDRAGLGLAPAARLAAPAAREAAERSKHLAADIVNEETELWVWILFLGCCYIGLPWAYLHPVLLL

SEQ ID NO: 121049 - protein, 934 aa, Glycine max
  Coding DNA Sequence Number=SeqID_4271
  Gene Ontology: Mol. function=translation initiation factor activity; Cellular component=eukaryotic translation initiation factor 3 complex; Biological process=translational initiation
  Homolog annotation: Hit_ID=Q9XHM1; Match level="QueryCoverage=99%, HitCoverage=100%, E-value=0.0, Identity=70%"; Hit description =Eukaryotic translation initiation factor 3 subunit 8
  Pfam annotation: Domain name=PCI; Domain location=663-793; Score =130.0; E_value=6.7e-36; Accession=PF01399.17; Description=PCI domain
  Pfam annotation: Domain name=eIF-3c_C; Domain location=794-934; Score= 214.6; E_value=2.2e-61; Accession=PF05469.2; Description=Eukaryotic translation initiation fac
  Pfam annotation: Domain name=eIF-3c_N; Domain location=40-656; Score =1250.0; E_value=0; Accession=PF05470.3; Description=Eukaryotic translation initiation fac
  Pfam module annotation: Pfam domain module=PCI::eIF-3c_C::eIF-3c_N; Domain location=663-793::794-934::40-656
MASRFWTQGGSDSEEEESDYGEEDEHSAGEQAPNQDVTSKYFVDNASDSDDSDGQKRVVRSAKDKRFEEMVSTVDQMKNAIKINDWVSLQESFDKINKQLEKVMRVTESEKVPNLYIKALVMLDDFLVQALANKDAKKKMSSSNAKALNSMKQKLKKNNKQYEELITKCRENPESEEEKEEEESEDEYESDDIEPEQLPEAKSDSEASQYDNEKQDAGDGPWDQKLSKKDRLLDKQFMKDPSEITWDTVNKKFKEVVAARGRKGTGRFEQVEQLTFLTKVAKTAAQKLEILFSVVSAQFDVNPGLNGHMPINVWKKCVQNMLVILDILVQHPNIVVDDSVEPDENETQKGVDYNGPIRVWGNLVAFLERIDVEFFKSLQCIDPHTRDYVERLRDEPLFLVLAQNVQEYLERVGNFKAASKVALRRVELIYYKPQEVYVAMKKLTELTEDGDNGVEASEEKGFEESRIPTAFVATPEVVARKPTFPENSRTIMDVLVSLIYKYGDERTKARAMLCDIYHHALLDEFSIARDLLLMSHLQDSVQHMDISTQILFNRAMSQLGLCAFRVGLISEAHGCLSELYSGGRVKELLAQGVSQSRYHEKTPEQLTTIFNSQERLERRRQMPYHMHINLELLETVHLVSAMLLEVPNMAANVHDAKRKLISKTFRRLLEVSDRQTFTGPPENVRDHVMAATRFLSKGDFQKAFDIIVSLDVWKFVRNRDTVLEMLKDKIKEEALRTYLFTFSSSYESLSLDQLTKFFDLPVSCTHSIVSRMMINEELHASWDQPTGCILFQDVEHSRLQALAFQLTEKLSILAESNERATEARIGGGGLDLPLRRRDGQDYAAAAAGSGTASSGGRWQDLSLSQPRQSSGRAGYVGGGGRPMALGQGSGYSRDRSGRGSGAGYQSGRYQGGSALRGPHGDVSTRMVSLKGVRA

SEQ ID NO: 121050 - protein, 676 aa, Glycine max
  Coding DNA Sequence Number=SeqID_4272
  Gene Ontology: Mol. function=zinc ion binding; Cellular component =integral to membrane; Biological process=protein transport
  Homolog annotation: Hit_ID=P93231; Match level="QueryCoverage=96%, HitCoverage=66%, E-value=0.0, Identity=75%"; Hit description =Vacuolar protein sorting-associated protein 41 homolog
  Pfam annotation: Domain name=Clathrin; Domain location=304-465; Score= 27.8; E_value=1.8e-05; Accession=PF00637.10; Description=Region in Clathrin and VPS
EREVRLYLFSPRKIQKFDFVLNRPEVRPVTWNNDELSTDALPVHGFEHYRAKDYSLAHAPFSGSSYAGGQWAAGDEPLYYIVSLKDVVIAKPRDTEDHISWLLQHGWHEKALAVVESGQGRSELLDEVGSRYLDHLIVERKYSEAASLCPKLLRGSASAWERWVFHFAHLRQLPVLVPYMPTENPRLRDTAYEVALVALATNPSFHKDLLSTVKSWPSVIYSALPVISAIEPQLNTSSMTESLKEALAELYVIDEQYEKAFLLYADLMKPEVFDFIDKHNLHDAIRGKVVQLMRLDCKRAVPLLIQNRDLISPPEVVKQLLNADDKSDCRYFLHLYLHSLFEVNPHAGKDFHDMQIFYVEALRVSFGETVELYADYDPKMLLPFLRSSQHYTLEKAYEICIKRDLLREQVFILGRMGNSKQALAVIINKLGDIEEAVEFVTMQHDDELWEELIKQCLHKPEMVGILLEHTVGNLDPLYIVNKVPNGLEIPRIWAGLKFQRYIQLRDRLVKIITDYRTETSLRNGCNDILKADCVNLLIKYYKEARHGISLGNEEDEPRVKMSDTRASQVFDKSPSLRTVEVKSKTRGGGRCCICFDPFSIQTVSVIVFFCCHGYHTTCLMDSSYTSSNKKEVQATTLEAETYDDYNGYDDDASDDDEEAKSGGPRMRCILCTTAAS

SEQ ID NO: 121051 - protein, 95 aa, Glycine max
  Coding DNA Sequence Number=SeqID_4273
MKTESKVAALENEVANLRSTLAEMKSKADEHQEKSMEMLTKGMEKLTSSLGWKKLQGNPMDEYGWMSDGNIFEQLTALQQVGSVDEMSKYRNLKS

SEQ ID NO: 121052 - protein, 358 aa, Glycine max
  Coding DNA Sequence Number=SeqID_4274
  Gene Ontology: Mol. function=zinc ion binding; Cellular component =integral to membrane; Biological process=protein transport
  Homolog annotation: Hit_ID=P93231; Match level="QueryCoverage=85%, HitCoverage=29%, E-value=1e-135, Identity=76%"; Hit description =Vacuolar protein sorting-associated protein 41 homolog
  Pfam annotation: Domain name=WD40; Domain location=127-169; Score =0.2; E_value=35; Accession=PF00400.22; Description=WD domain, G-beta repeat
  Pfam annotation: Domain name=WD40; Domain location=194-229; Score =2.5; E_value=19; Accession=PF00400.22; Description=WD domain, G-beta repeat
  Pfam annotation: Domain name=WD40; Domain location=48-83; Score=1.2; E_value=27; Accession=PF00400.22; Description=WD domain, G-beta repeat
  Pfam annotation: Domain name=WD40; Domain location=86-124; Score =30.1; E_value=7.8e-06; Accession=PF00400.22; Description=WD domain, G-beta repeat
  Pfam module annotation: Pfam domain module=WD40::WD40::WD40::WD40; Domain location=127-169::194-229::48-83::86-124
MAPFPPENGVEGDDEREEEDEEEEEDDEEEVEDEEDEEEPRLKYQRMGGSIPSLLASDAASCIAVAERMIALGTHGGTVHILDFLGNQVKEFSAHASVVNDLSFDTEGEYIGSCSDDGSVVINSLFTDEKLKFEYHRPMKAVALDPDYARKMSRRFAGGGLAGHLYLNSKKWLGYRDQYLLFVNDKITPPYPPHPPQKVLHSGEGSIHAVKWRASLVAWANDAGVKVYDTANDQRITFIEKPRGSPRPELLLPHLVWQDDTLLVIGWGTSVKIASIRTNHQKAANGSFRQVPLSGMTQVDIVASFQTSYFISGLAPFGDALVVLAYIPGEEDGDKDFSSTAPSRQEIPPSILNEVVTS

SEQ ID NO: 121053 - protein, 284 aa, Glycine max
  Coding DNA Sequence Number=SeqID_4275
  Homolog annotation: Hit_ID=Q1SYT0; Match level="QueryCoverage=42%, HitCoverage=51%, E-value=7e-21, Identity=42%"; Hit description =Calcium-binding EF-hand
MSGRGRGRGGWGWGRGGGFNTFASQVPFDLFPEAVTLPDVNLDDIHDDTKKLLRWDSHLQNYWEASPYFLEDKTSKKRQSMHIAKFSDRKKNDFTRDSLSQVLMFNDFPQELVQGASKRASRRKKFRWNPESEMKKLDFFEQQEKTNQGKEENDENEKKDGEDGDEDENAQEEDEEDISDDDYNQNIDFDDDEDDYNDVDDGDGIVTLLFQCISHFSFTSIILIQIQQLWQVCSTYQFFCSTTIFPLSQMNLPIRYQYGECSSAHPVTAIQAWTVAPLILQFGS

SEQ ID NO: 121054 - protein, 190 aa, Glycine max
  Coding DNA Sequence Number=SeqID_4276
  Gene Ontology: Mol. function=nucleic acid binding; Cellular component= nucleus
  Homolog annotation: Hit_ID=Q7X971; Match level="QueryCoverage=99%, HitCoverage=11%, E-value=1e-30, Identity=43%"; Hit description =Putative Splicing factor 3B subunit 3
MALSCAYFMAEIAMSIKKSFLYVIYEPKVNVLWLSDSTVMEMMGSYSYRLPADDVLQGGNGPKTNVDSLQNTIIATTLLGSIMIFIPLSREEYELLEAVQARLVVHHLTAPVLGNDHNEFRSRENRVGVPKILDGDMLTQFLELTSMQQKMILSLELPDMVKPSLKPLLPSHVSVNQVVQLLERVHYALN

SEQ ID NO: 121055 - protein, 190 aa, Glycine max
  Coding DNA Sequence Number=SeqID_4277
MTKLTFNNMSKTIREIPKWSWSTVPKRMKINYLSYINKLLLICIVVLLTTFLTVKCSLPHSSVTEINLPETSTSVYNITLNSFFNFKHPTTKYLLPSAPPNNTLSWPRPFILNLSNTILHQISTNITCQSEISKKNDDLATNRANHEPTGPNRHIQKTTHTKSISNDHQCTVLQLQSCSTSTQESSSSFI

SEQ ID NO: 121056 - protein, 207 aa, Glycine max
  Coding DNA Sequence Number=SeqID_4278
  Gene Ontology: Mol. function=RNA binding; Cellular component=nucleus; Biological process=rRNA processing
  Homolog annotation: Hit_ID=Q015A6; Match level="QueryCoverage=96%, HitCoverage=53%, E-value=1e-30, Identity=37%"; Hit description=[J] KOG2915 tRNA(1-methyladenosine) methyltransferase
  Pfam annotation: Domain name=GCD14; Domain location=1-203; Score =214.3; E_value=2.9e-61; Accession=PF08704.1; Description=tRNA methyltransferase complex GCD14
  Pfam annotation: Domain name=Methyltransf_11; Domain location=12-110; Score=26.7; E_value=8.4e-05; Accession=PF08241.2; Description =Methyltransferase domain
  Pfam annotation: Domain name=Methyltransf_12; Domain location=12-108; Score=14.9; E_value=0.022; Accession=PF08242.2; Description =Methyltransferase domain
  Pfam module annotation: Pfam domain module=GCD14::Methyltransf _11::Methyltransf_12; Domain location=1-203::12-110::12-108
MYLEIVPGCVVLESGTGSGSLTSSLARAVAPSGHVYTFDFHEQRAASARADFERTGLSSLVTVQVRDIQGEGFPDDLTGMADSVFLDLPQPWLAIPAAAKVLRHDGTLCSFSPCIEQVQRTCETLRTRFTDTRTFEVLLRTYEVREEKMQSLCGDSNGSVPSKRKQCSGGSYVLGSSPSTSSVMARPCGEARGHTGYLTFARVKSLS

SEQ ID NO: 121057 - protein, 275 aa, Glycine max
  Coding DNA Sequence Number=SeqID_4279
  Gene Ontology: Mol. function=hydrolase activity; Biological process =aromatic compound metabolic process
  Homolog annotation: Hit_ID=Q9LK01; Match level="QueryCoverage=94%, HitCoverage=95%, E-value=2e-61, Identity=44%"; Hit description =Hydrolase-like protein
  Pfam annotation: Domain name=Abhydrolase_1; Domain location=51-270; Score=41.0; E_value=4.1e-09; Accession=PF00561.10; Description =alphabeta hydrolase fold
MGTACGYGGGIVDALNANFYGNGTQTLVLAHGYGTDQTVWRYLIPFLACYFKVLVFDLPFAPNVRPSSLYDPKKYSTFNGYAQDLVCLLDELNLSKTIYVGHSMSAMIGCLAATKKPQLFEHLVLLAGSPMYLNKEGYEGGFTRSELDKIFESIKQNFSGWAHSFAPYAISANDPAAVAEFECSLLRMKPEVALSVAKTVFLSDLRCVLPRVRVPASTIIQTRKDPIVPVNVSFYMQKELGSLSKVIILETEGHFPQLTAYRSLLQALKDSLSLN

SEQ ID NO: 121058 - protein, 189 aa, Glycine max
  Coding DNA Sequence Number=SeqID_4280
  Gene Ontology: Mol. function=carbohydrate binding
  Homolog annotation: Hit_ID=Q6ZLH2; Match level="QueryCoverage=90%, HitCoverage=34%, E-value=3e-47, Identity=51%"; Hit description =Lipase-like protein
  Pfam annotation: Domain name=DUF620; Domain location=1-176; Score =222.5; E_value=9.6e-64; Accession=PF04788.3; Description=Protein of unknown function (DUF620)
MRNEEWRGMRTEKGGLDPLAVSAVFSAAQYMGEKQISGIDCFVLKLSPDQKDLVDRSDNTAEMIKHVAFGYFSQRNGLLVHLEDSYLTRIQSPGTHPTYWETTMSTKIEDYKMVDGVMIAHAGHSTVIITRFGDNLKTGPAITRLEESWTIDDVAFNVQGLSMDCFIPPKELHKDYPQEDLDWRSPLHR

SEQ ID NO: 121059 - protein, 348 aa, Glycine max
  Coding DNA Sequence Number=SeqID_4281
  Homolog annotation: Hit_ID=Q75HI8; Match level="QueryCoverage=77%, HitCoverage=65%, E-value=3e-76, Identity=53%"; Hit description =Putative phosphatase
  Pfam annotation: Domain name=PAP2; Domain location=94-227; Score =62.1; E_value=1.8e-15; Accession=PF01569.12; Description=PAP2 superfamily
MEGEGAAVWQGAVLGGIIFWLVSASYLNATRKLRSFLQPWVTHHVDTQTPIILKIQSYGFGFLDALFSGLSCVVSVPFYTAFLPLLFWSGHGKLARQMTLLMAFCDYIGNCTKDVVSAPRPASPPVKRVTATKDEEDNALEYGLPSSHTLNTVCLSGYLLRYVLTHTQIQGAYVTYLGVSLACMLVFLIGLGRIYLGMHSVVDVLAGLLIGLVVLAFWLMVDEYIDSFVISGQNVTSFWAALSFLLLFAYPTPELPTPSFEYHTAFDGVALGIGVKGDQNGEGENCGVSLGRELSLRASALGLLYAAVVIELFGDVRIKYSPRICFGSPPILTEHARKGQRRAVLCLG

SEQ ID NO: 121060 - protein, 62 aa, Glycine max
  Coding DNA Sequence Number=SeqID_4282
MDYLDEEQRRAITMKSSFILLCYAVGFGLGSAKAGEYLGEVNGGFEWCERGVAAAAAALIVL

SEQ ID NO: 121061 - protein, 392 aa, Glycine max
  Coding DNA Sequence Number=SeqID_4283
  Gene Ontology: Mol. function=phosphoprotein phosphatase activity; Cellular component=cytoplasm; Biological process=protein amino acid dephosphorylation
  Homolog annotation: Hit_ID=Q07100; Match level="QueryCoverage=84%, HitCoverage=90%, E-value=1e-149, Identity=78%"; Hit description =Serine/threonine-protein phosphatase PP2A-3 catalytic subunit
  Pfam annotation: Domain name=Metallophos; Domain location=82-328; Score=124.3; E_value=3.5e-34; Accession=PF00149.18; Description =Calcineurin-like phosphoesterase
MQFHRCICCCPLIKLEFHLGNLCDKGLHYREQHQKALQHLSFECRSMLARVFYRVIVLLVRGLCEKAKEILTDESNVQPVKSPVTICGDIHGQFHDLAELFRIGGKCPDTNYLFMGDYVDRGYYSVETVSDENRKWDYAQVVDSSGFRMCCKDRGCFTYNFRHCGGLKEIILSYNFSMIDSLLVALKVRYPQRITILRGNHESRQITQVYGFYDECLRKYGNANVWKTFTDLFDFFPLTALVESEIFCLHGGLSPSIETLDNIRNFDRVQEVPHEGPMCDLLWSDPDDRCGWGISPRGAGYTFGQDISEQFNHTNSLKLIARAHQLVMDGFNWAHEQKVVTIFSAPNYCYRCGNMASILEVDDCKGHTFIQFEPAPRRGEPDVTRRTPDYFL

SEQ ID NO: 121062 - protein, 359 aa, Glycine max
  Coding DNA Sequence Number=SeqID_4284
  Gene Ontology: Mol. function=protein serine/threonine kinase activity; Cellular component=integral to membrane; Biological process=protein amino acid phosphorylation
  Homolog annotation: Hit_ID=Q9FNL4; Match level="QueryCoverage=92%, HitCoverage=99%, E-value=1e-82, Identity=51%"; Hit description =Serine/threonine protein kinase-like protein
  Pfam annotation: Domain name=Pkinase; Domain location=63-328; Score =25.6; E_value=4.3e-10; Accession=PF00069.15; Description=Protein kinase domain
  Pfam annotation: Domain name=Pkinase_Tyr; Domain location=63-328; Score=-16.4; E_value=1.8e-11; Accession=PF07714.7; Description =Protein tyrosine kinase
  Pfam module annotation: Pfam domain module=Pkinase::Pkinase_Tyr; Domain location=63-328::63-328
MNHVEHIAYDMVMITLSISLIVLAIILFLACKKKPVESEETLPVKLCARAYPLMEIDAATDGFNHRRIIGQGRLGTVYAGTLEQEEQQLVAVKRIHPFLVLSNAGFGFSSVLKWLSLAQHPNVVPITGFSEAPGERVVLMEFVHMASLDFYLHQNQDGASLLDWNKRFRIAAGAARGLQYLHEVVAPNIVHGCVKSSNILIDVNFCARICDYGLNFLAPVEKRGIVGYVDDEYWSERRGGGVATKESDVYGLGVVLLELLSGKGCEGGMLVKWALPLIRETSFSELLDPRLVIPSDMKPLVRLAKVASACVGNSRKCRPSMAQVATILNNLETEAKESENHFWWGILKEKGGTVPLSLG

SEQ ID NO: 121063 - protein, 99 aa, Glycine max
  Coding DNA Sequence Number=SeqID_4285
  Homolog annotation: Hit_ID=Q336V4; Match level="QueryCoverage=56%, HitCoverage=5%, E-value=5e-12, Identity=57%"; Hit description =Expressed protein
MAENFIFWKFPNMSLYQETLRWLLTVESIELLSEWILLNAFMQDFDPIRHVLEHVPVEENELTYFEKQAALRLAQLDRVAERLSRHVMEHHEVMGKLKR

SEQ ID NO: 121064 - protein, 284 aa, Glycine max
  Coding DNA Sequence Number=SeqID_4286
  Homolog annotation: Hit_ID=Q336V4; Match level="QueryCoverage=84%, HitCoverage=22%, E-value=1e-81, Identity=63%"; Hit description =Expressed protein
MTLTLSIPKKYITLCNHVRGVYCKVKGMNLVRELEKDLRIANVICMNGRRHLTSSMNEVSRDLIVNSYSKKKQALLDMLPTLTELRRALDMPSTLESLVEEGNYWKAFQVLSEYLQILDSLSELSAIQEMSRGVEVWLGRTLQKLDALLLGVCQEFKEDGYITVIDAYALIGDTAGLAEKIQSFFMQEVISETHSVLKAIVHEDEEGLSQNSRLTYSDLCLRIPDSKFRQCLLRTLAVLFDLMCSYHEIMEFQLERKDSAAQTSNKCNEEISCSPGETQEVDSD

SEQ ID NO: 121065 - protein, 79 aa, Glycine max
  Coding DNA Sequence Number=SeqID_4287
  Gene Ontology: Mol. function=peroxidase activity; Cellular component =vacuole; Biological process=response to oxidative stress
  Homolog annotation: Hit_ID=Q1T3V2; Match level="QueryCoverage=81%, HitCoverage=20%, E-value=5e-24, Identity=78%"; Hit description=Haem peroxidase, plant/fungal/bacterial
MGSHLQLSFLVLVMVTLATFMIPTFAQLTPNYYDKVCPKALPIIKSIVKQAIIREKRIGASLLRLHFHDCFVNDCFFII

SEQ ID NO: 121066 - protein, 151 aa, Glycine max
  Coding DNA Sequence Number=SeqID_4288
LSANMLIFFSPLNNCAKPLLCVEAVKLSVPCYAKLNSLTAKCESAALGPWMASKKRKAPATPSQVRYDRSRFTSPKALERYTDIVVPRKILSERNMVIYHTEFDKFKEELERRKWDEEFTNFNEGNIDAAIVKEFYANLYDPEDKSPNHVR

SEQ ID NO: 121067 - protein, 202 aa, Glycine max
  Coding DNA Sequence Number=SeqID_4289
  Gene Ontology: Mol. function=DNA binding; Biological process=DNA integration
  Homolog annotation: Hit_ID=Q2XEL9; Match level="QueryCoverage=88%, HitCoverage=45%, E-value=1e-28, Identity=40%"; Hit description =Putative transposase protein
  Pfam annotation: Domain name=rve; Domain location=1-122; Score=9.9; E_ value=0.00089; Accession=PF00665.16; Description=Integrase core domain
MSETTVFVRGCMEKAFLEGGLPDVIRTDNGSPFVAPGILALTQLSVWLIKLGIQPERTAPGCPGQNARHERMHRSLKVAMSHHDVFGSLPEQQAWCSGWRNEFNQEKPHEAHGQQPPAKIWTPSPRKWNGKVPEVGYPEGAKLYKVGEKGDLRLNGRTFLSAALRGEYVRFLEVDDGIDVILFDRLILAYYDRAEKRIIRID

SEQ ID NO: 121068 - protein, 231 aa, Glycine max
  Coding DNA Sequence Number=SeqID_4290
  Gene Ontology: Mol. function=signal transducer activity; Cellular component=membrane; Biological process=signal transduction
  Homolog annotation: Hit_ID=Q6D251; Match level="QueryCoverage=98%, HitCoverage=40%, E-value=1e-55, Identity=48%"; Hit description =Methyl-accepting chemotaxis protein
MLFGAIILQAVLAISLLSGFQERFEYVQTNAIPSIKDLNTLIDRSNQLALTLYKHQTQLQDSNMPAVEADIDQQIGGLKSLTDYYMKHDISSEEDKRLTEVAFSNIQRVTERLPAFLSASRAHQNAISLDLIEGQSGIGAAIRQLIADYQKQLMLNIAIGDELRATNRSTFHNVLWTTISGVVATVLVFGLFALFTVLRIRRSLADVGKVMMRASENLDLTLSADESRRDE

SEQ ID NO: 121069 - protein, 295 aa, Glycine max
  Coding DNA Sequence Number=SeqID_4291
MASRKRKAPSTPSQVRYDRSRFTSQEAWERYTDIIVPRKFLPERNVVVYTTEFDEFLDELDRRHWREELTNFLDGNIDVSIVKEFYANLYDPEDKSPKQVRVRDSEEEHDTLAQTWSVLSFSNLIPTSHTSDVTLDRARLIYGIIMKILMNVGYLISHQMSLIAQHDTSRLGFPALIIALCKTRGVQPDSRSLESLSPAINLAYIKKNCWNLDDPTVTFRGPRKARGKRSEAPSTSAPSEAPTPSSSLVPPSSSTQILVIPPTPLQMPLPAPSSTRPLDFLITPQMLHSMMQSLH

SEQ ID NO: 121070 - protein, 69 aa, Glycine max
  Coding DNA Sequence Number=SeqID_4292
MKSKHFQVKKRLSFEVQKCEGESGKASASRLRVKRKISALTTAGVFSQAQHKTGAKPKPTYSRKARGWH

SEQ ID NO: 121071 - protein, 89 aa, Glycine max
  Coding DNA Sequence Number=SeqID_4293
MLQMTNQMDKNGIRMKIETFKSLYHVDENGKMPLWAYKKAAPTPQESITSRKIEAEAVDCPKGELVTRISNKRDRPNAALGGSVIVVTP

SEQ ID NO: 121072 - protein, 71 aa, Glycine max
  Coding DNA Sequence Number=SeqID_4294
  Gene Ontology: Mol. function=GTPase activity; Biological process =immune response
  Homolog annotation: Hit_ID=Q9FNL5; Match level="QueryCoverage=81%, HitCoverage=5%, E-value=7e-20, Identity=83%"; Hit description =Similarity to guanylate binding protein
MPMTKIKLIQNETLALASTAAHRDHANEFLDELERGDGFGVHAEPFILVAIDKANWTRRINHRRRRRRRLQ

SEQ ID NO: 121073 - protein, 327 aa, Glycine max
  Coding DNA Sequence Number=SeqID_4295
  Gene Ontology: Mol. function=endonuclease activity
  Homolog annotation: Hit_ID=Q10R99; Match level="QueryCoverage=87%, HitCoverage=48%, E-value=1e-105, Identity=62%"; Hit description =Endonuclease/Exonuclease/phosphatase family protein, expressed
MADPAGIRLREWCKRGVAAAALIGLQCGCELTPYVLLRRPDKTVTTDDFPETAPLDGHFLRYKWYRVQSDKKVAVCSVHPSEQAALQCLGCVKAKIPVAKSYHCSPKCFSDAWQHHRVLHDRAASAANENGNEEEELYGRFNNSGSGSGSINTSLSSSASSASLTNGSAPVYPAAVTQRSGGETWFEVGQFKTYTPTADDIGHVLKFECAVVDSETKLAVGHVNTLLTSRVIPAPSPSPRRLIPVDGMGHLDADGRITSSGTFTVLSYNILSDAYASNDLYNYCPSWALSWPYRRQNLLREIVGYRADIICLQEVHKCCFGCDFVGH

SEQ ID NO: 121074 - protein, 661 aa, Glycine max
  Coding DNA Sequence Number=SeqID_4296
  Gene Ontology: Mol. function=molecular_function; Cellular component =nucleus; Biological process=chromosome segregation
  Homolog annotation: Hit_ID=Q8LFH0; Match level="QueryCoverage=95%, HitCoverage=56%, E-value=0.0, Identity=53%"; Hit description =Putative sister-chromatide cohesion protein
MTAIKISENRSGRNLDWKCIISMLLDESPSVELSDSDATNLVRLLCASVKKAIGERIVPATDNRKHYYNKAQKEVFESNKQDITVAMMKTYPLLLRKFISDKAKVSSLVEIVLHMNLEYYSLKRQEQNFKNLLQLVKEAFFKHGDKDPLRACVKAIDFCCIESQGELQDFARNKLKELEDEIIAKLKSAIKEVLDGGDEYSLLVNLKRLYELQLKRSVPINSLYEDIVTVLRGNRDMEDEVVGFLLLNMYLHLAWGLQSIVNEEAVSEASLNSLLSKRDTLLQELEYFLNLADDNREGGKYTSELGCRVCTILAETWFLFRTTNFNKTKLEKLGYQPDTDMLQKFWELCQQQLNISDEAEDEDVNKEYAVETNRDAVMIAAAKLIANDVVPKEDLASEIISHFVMHGTSVAEIIKHLITVLKKKDVDLASIFLEALKKAYHRHLVNMSGSENVSSENNSSSGCKDLAAKLSGTFIGVARIKHRPDILKVVRDGIEYAFVDAPKQLSFLEEAVLHFVSKLTAPDLSDITKDVQQRTTNVNTDENPSGWRPYKVFIANLLEKCAKNEGFQDEKEGVSVRRRGRPRKRQNIPGKKLFDEQSSSEDEDSISAYEQDAQDEGKRQEDEDDDDRLINSIPSSSKLRSLGVSRGESKVSASRTSGASS

SEQ ID NO: 121075 - protein, 69 aa, Glycine max
  Coding DNA Sequence Number=SeqID_4297
  Pfam annotation: Domain name=SLR1-BP; Domain location=1-64; Score= -13.3; E_value=0.025; Accession=PF07333.3; Description=S locus -related glycoprotein 1 binding
MKAGLASDFVVQGRAHGVKIPEHWCHKMIHLSNCELQKCFQECSKQPYGIGDCKDSTCFCTYYCKEPPL

SEQ ID NO: 121076 - protein, 92 aa, Glycine max
  Coding DNA Sequence Number=SeqID_4298
  Gene Ontology: Mol. function=structural constituent of ribosome; Cellular component=intracellular; Biological process=translation
  Homolog annotation: Hit_ID=Q8LK53; Match level="QueryCoverage=54%, HitCoverage=78%, E-value=1e-19, Identity=90%"; Hit description =Ribosomal protein small subunit 28
  Pfam annotation: Domain name=Ribosomal_S28e; Domain location=28-92; Score=149.4; E_value=9.4e-42; Accession=PF01200.9; Description =Ribosomal protein S28e
MTLNLWCMWSCFVLDLGGIALAEFIMRMESQVKHALVVKVMGRTGSRGQVTQVRVKFLDDQNRHIMRNVKGPVREGDILTLLESEREARRLR

SEQ ID NO: 121077 - protein, 88 aa, Glycine max
  Coding DNA Sequence Number=SeqID_4299
  Homolog annotation: Hit_ID=O82264; Match level="QueryCoverage=54%, HitCoverage=19%, E-value=7e-08, Identity=75%"; Hit description=NPL4 -like protein 2
MEPWPRLRDERGASGLDMSVNRWRSSRDFAKRRFWFVDRAVAATNSEHHRDGGFKTMGNWSGREAIGVSRKGSRKEKKKQVSASSTAE

SEQ ID NO: 121078 - protein, 588 aa, Glycine max
  Coding DNA Sequence Number=SeqID_4300
  Gene Ontology: Mol. function=DNA binding; Cellular component=nucleus; Biological process=regulation of transcription, DNA-dependent
  Homolog annotation: Hit_ID=Q2LAJ4; Match level="QueryCoverage=69%, HitCoverage=54%, E-value=6e-75, Identity=42%"; Hit description=Auxin response factor 3
  Pfam annotation: Domain name=Auxin_resp; Domain location=1-49; Score =53.6; E_value=6.4e-13; Accession=PF06507.4; Description=Auxin response factor
  Pfam annotation: Domain name=Mlo; Domain location=402-583; Score= -359.3; E_value=0.021; Accession=PF03094.6; Description=Mlo family
  Pfam module annotation: Pfam domain module=Auxin_resp::Mlo; Domain location=1-49::402-583
LDCSYSVGMRFRMRFETEDAADRRFTGLIAGISDVDPVRWPGSKWRCLLVRWDDIEAARHNRVSPWEIEPSGSASNSSNLMAAGLKRNRIEMTSAKLEFPNPNGIQTSDFGESLRFRKVLQGQEILGVNTPPFDGINAQSPWLYELGRCYPGSNCSGIPPTGNNIRVPHPASDFSCNGIGFSESFRFQKVLQGQEILPSQPYGRALSIEEARANGRYGFYDGCQLLNSRNGWSAQMHDNASHLHASVTPAQVSSPSSVLMFQQAVNPVSNCDYNINKCNKEMEGRIHYQGLYTSEMKGRTLASSPSDDLIVSRRAPEGASSIGMFDVHNQLGSSQLHESVSALRSSQKLVSSCKSSCRLFGFSLTEDTHVANEEVSASTITLPLSSGPSFTRLVEDEFHPGHSHPSKAVGSNCTKYFKRKRRQSLSEALEKIRTELMLLGFTSLLLTVSEKSIANICIPKGAGETLIPCASITFDDAKKQNVQSSWKLNSEKGTQVRTCIYASHKAWSLEEKTGEPGVREQQYFIFYLARCHVVSSFLTFGLGLAKGMLDLCLTNSPLVSDRPWKHMQIRRSESWEGETRTLEYQFAY

SEQ ID NO: 121079 - protein, 322 aa, Glycine max
  Coding DNA Sequence Number=SeqID_4301
  Gene Ontology: Mol. function=peroxidase activity; Cellular component =vacuole; Biological process=response to oxidative stress
  Homolog annotation: Hit_ID=Q40487; Match level="QueryCoverage=97%, HitCoverage=96%, E-value=1e-100, Identity=60%"; Hit description =Cationic peroxidase isozyme 40K precursor
  Pfam annotation: Domain name=peroxidase; Domain location=41-286; Score=448.1; E_value=1.2e-131; Accession=PF00141.13; Description =Peroxidase
MKIRFFLVACLAVFCVLGVCQGGNLRKKFYRKSCPQAEQIVRTKIQQHVSACPNLPAKLIRLHFHDCFVRGCDGSVLLDSTATNIAEKDAIPNLSLAGFDVIDDIKEALEAKCPGIVSCADILALAARDSVSAVKPAWEVLTGRRDGTVSVSGEALANLPAPFYNFTTLKASFASKNLNVHDLVVLSGAHTIGIGHCNLFSKRLFNFTGKGDQDPSLNPTYANFLKTKCQGLSDNTTTVKMDPNSSNTFDSNYYSILRQNKGLFQSDAALLTTKMSRNIVNKLVKKDKFFTKFGHSMKRMGAIEVLTGSAGEIRRKCSVVNA

SEQ ID NO: 121080 - protein, 915 aa, Glycine max
  Coding DNA Sequence Number=SeqID_4302
  Gene Ontology: Mol. function=protein binding; Cellular component =viral envelope; Biological process=chloroplast organization and biogenesis
  Homolog annotation: Hit_ID=Q1T3W0; Match level="QueryCoverage=99%, HitCoverage=100%, E-value=0.0, Identity=62%"; Hit description=Helix -hairpin-helix motif
  Subcellular localization annotation: CTP_CleavageSite=34; ConfidenceScore=5.67e-01
MNPSTLTPSHTHRPLLLPSPFHTRRRRFKVSLPRCSSSSAASSPPPPPPPPPQRPPKDLKGIDVLVDKLSPPARLATSAVIVAGAAAAGYGLGSRFGGSRYAALGGAVALGAAGGAAAYALNAAAPQVAAVNLHNYVAAFDDPSKLKKEEIEAIASKYGVSKQDEAFKTEICHIYSEFVSSVLPPGGEELKGDEVDRIVSFKNSLGIDDPDAAAMHMEIGRKFFRQRLEVGDRDADVEQRRAFQKLIYVSNLVFGDASSFLLPWKRVFKVTDSQIEVAVRDNAQRLFASKLKSVGREFAISDHLLPQFIFGIGGEYDGDRKIEDLKLLYRAYVSDALSGGRMEDDKLAALNQLRNIFGLGKREAEAISLDVTSKVYRKRLAQAAADGELEMADSKAAFLQNLCDELHFDPQKASELHEEIYRQKLQRCVADGELNEEDVAALLRMRVMLCIPQQIVEAAHSDICGSLFEKVVKEAIASGVDGYDAEIQKSVRKAAHGLRLTREVAMSIASKAVRKIFINYIKRARAAGNRTESAKELKKMIAFNTLVVTNLVEDIKGESTDISSEEPVKEDITQTDDEEWESLQTLKKIRPNKELTEKLGKPGQTEITLKDDLPERDRTDLYKTYLLYCLTGEVTRVPFGAQITTKKDDSEYLLLNQLGGILGLSSQEIVEVHRGLAEQAFRQQAEVILADGQLTKARVEQLNNLQKQVGLPQEYAQKIIKSITTTKMAAAIETAVTQGRLNMKQIRELKEADVDLDSMVSENLRETLFKKTVDDIFSSGTGEFDTEEVYEKIPSDLNINKEKARGVVHELAKGRLSNSLIQAVSLLRQRNQQGVVSSLNDLLACDKAVPSQPVSWEVPEELSDLYTIYLKSNPTPENLSRLQYLLGINDSTAAALREIGDRLLNTTAEEEKFVF

SEQ ID NO: 121081 - protein, 324 aa, Glycine max
  Coding DNA Sequence Number=SeqID_4303
  Gene Ontology: Mol. function=peroxidase activity; Cellular component =vacuole; Biological process=response to oxidative stress
  Homolog annotation: Hit_ID=Q40487; Match level="QueryCoverage=97%, HitCoverage=96%, E-value=1e-103, Identity=60%"; Hit description =Cationic peroxidase isozyme 40K precursor
  Pfam annotation: Domain name=peroxidase; Domain location=41-288; Score=456.1; E_value=4.4e-134; Accession=PF00141.13; Description =Peroxidase
MKMRFFLVACLAVFCILGVCQGGNLRKKFYKKTCPQAEEIVRTKIQEHVSARPDLPAKLIRMHFHDCFVRGCDGSVLLDSTATNTAEKDSIPNLSLAGFDVIDDIKEALEAKCPGTVSCADILALAARDTVSVKFNKPTWEVLTGRRDGTVSISGEALANLPAPFFNFTQLKESFASKGLTVHDLVVLSGAHTIGIGHCNLFSNRLFNFTGKGDQDPSLNPTYANFLKTKCQGLSDTTTTVEMDPNSSNTFDSDYYSILRQNKGLFQSDAALLTTKISRNIVNELVNQNKFFTEFGQSMKRMGAIEVLTGSAGEIRKKCSVVNS

SEQ ID NO: 121082 - protein, 373 aa, Glycine max
  Coding DNA Sequence Number=SeqID_4304
  Gene Ontology: Mol. function=pseudouridylate synthase activity; Biological process=tRNA processing
  Homolog annotation: Hit_ID=O22928; Match level="QueryCoverage=96%, HitCoverage=67%, E-value=4e-97, Identity=49%"; Hit description =Putative tRNA pseudouridine synthase
  Pfam annotation: Domain name=PseudoU_synth_1; Domain location=196 -284; Score=-7.4; E_value=0.033; Accession=PF01416.10; Description =tRNA pseudouridine synthase
MEIPENAWNGDPYGFGLANYVNSYLPFDIKVISILPSQRSFDPRKECILRKYSYLLPAEIIGIQSHFSDEVDYHISEFNDILNVFEGIHPFHNYTARSKYRKQFPNRQSSSKSGTSARESLSYESECEYSDGEENSETDEAYTENIVCQSQKFSETHHFAEPVVGSSNKNGNGLHDQDSRLVARARWLYEPDEADRLSASHFRKVFQCSCGKLETSLGYNYIEISIQGESFMLHQIRKMVGTAVAVKRKALPKDIIKLSLTRFSRIILPLAPSEALILRGNRFSIRTRPGNITRPEMQTIVKSEEIKKAVDDFYTSVMLPQVSKLLDPSRSPWDEWIEKLDAHTSIPNDQLDEVRKAWNLFKEKFETTTSTHP

SEQ ID NO: 121083 - protein, 76 aa, Glycine max
  Coding DNA Sequence Number=SeqID_4305
MSSVSSARAPTVRERLLSSFRDFEWGWAPLEGYQKELDRSLSPSEAVSYRQVGLDWTVTIRPRDPPTLYLSVIPGI

SEQ ID NO: 121084 - protein, 79 aa, Glycine max
  Coding DNA Sequence Number=SeqID_4306
  Subcellular localization annotation: CTP_CleavageSite=33; ConfidenceScore=5.11e-01
MGGYVGARASLLSTTPPFVVMTQELVASGDTLRLSAPRHSVTPSVIDEQRPIWSSAPFPEMSTSSGGDFFKSHKLSRTT

SEQ ID NO: 121085 - protein, 519 aa, Glycine max
  Coding DNA Sequence Number=SeqID_4307
  Gene Ontology: Mol. function=pseudouridylate synthase activity; Biological process=tRNA processing
  Homolog annotation: Hit_ID=O22928; Match level="QueryCoverage=86%, HitCoverage=86%, E-value=1e-123, Identity=50%"; Hit description =Putative tRNA pseudouridine synthase
  Pfam annotation: Domain name=PseudoU_synth_1; Domain location=79-196; Score=29.6; E_value=1.1e-05; Accession=PF01416.10; Description=tRNA pseudouridine synthase
  Subcellular localization annotation: CTP_CleavageSite=54; ConfidenceScore=5.71e-01
MASSCVSSSPHFLSIPTRVRDNRRISTLVAMLFPSSSSSFPFLLLPPTLLKCFCASTSTQSLPTPSEKWEPFLKKKVVMRVGYVGTDFRGLQMQRDEHRLSTVEKELETAIFTAGGMRDSNFGDLNKVKWGRSSRTDKGVHSLATMIAFKMEIPENAWKGDDYGIVLANRINSYLPNTIRVFSILPSTKRFDPRRECNLRKYSYLLPAGIIGIQSHFSQDEIDFHISEFNSILNVFEPNLTVTGDCLCIANKGEHPFHNYTVRSKYRKKYQVRQSSGNDVMSDRIGSSSLTSACESESEEGDDDDFVSGRPTTFSDKEESHKPPESSESNGLSSQNSSVVVRAKWLYEPDETDRLNASHFRKVFRCSCGKLETSLGYDYIEIRKMVGTAVAVKRNLIPRDAILLSLSKFSRIVLPLAPPEVLILRGNAFKMRASAGNFTRQEMVSMVESEQILEAVDEFYTSVVLPEVSKFLDSSNSPWAKWVENLDKYSSIPDAELDEVRKAWKTWKENFRLKSASKA

SEQ ID NO: 121086 - protein, 133 aa, Glycine max
  Coding DNA Sequence Number=SeqID_4308
MDMMKNSPCDVSSSSYMLIEASGDSEADWNPFAMGEHAYEIGRADDDAQSCIYDDSETCNAADELNGYDESWNNDDDDAEDEKKDDVIHHGTSYCDDDEMQQHQKSCVSDDSGQEFVDEMEKNRLFWEACLAS

SEQ ID NO: 121087 - protein, 41 aa, Glycine max
  Coding DNA Sequence Number=SeqID_4309
MAVKHQVGNVGVVIESGTRQPAYIYEACGQLSMPSAKPKMP

SEQ ID NO: 121088 - protein, 285 aa, Glycine max
  Coding DNA Sequence Number=SeqID_4310
  Gene Ontology: Mol. function=nucleic acid binding; Cellular component= ribonucleoprotein complex
  Homolog annotation: Hit_ID=Q7XAN8; Match level="QueryCoverage=83%, HitCoverage=55%, E-value=9e-37, Identity=40%"; Hit description =Putative CUG triplet repeat RNA-binding protein 1
  Pfam annotation: Domain name=RRM_1; Domain location=189-260; Score =84.8; E_value=2.6e-22; Accession=PF00076.12; Description=RNA recognition motif. (a.k.a. RRM, R
MTKSLILLTRQGSSVPLVVKWADTEKERQARRAQKAQSQASNVPHTDSQHPSLFGALPMSYVPPYNGYGYQAPVGYGLMPYRMPPMQSQHGYHNMMPHMNQGNALRPDLGPNMNPRNYHVPPASYVGSYPAVPGLQHPMAYPTGMISPRPMNTSPGSVSPASGNNNHAASSGASKNSGGQAEGPPGANLFIYHIPQEFGDQELATAFQPFGRVLSAKVFVDKATGVSKCFGFVSYDTPEAAQSAISMMNGCQLGGKKLKVQLKRDNKQGNLTDEAEQWNFVQFTL

SEQ ID NO: 121089 - protein, 261 aa, Glycine max
  Coding DNA Sequence Number=SeqID_4311
  Gene Ontology: Mol. function=transcription factor activity; Cellular component=nucleus; Biological process=regulation of transcription, DNA-dependent
  Homolog annotation: Hit_ID=O49515; Match level="QueryCoverage=82%, HitCoverage=68%, E-value=3e-31, Identity=41%"; Hit description=EREBP - like protein
  Pfam annotation: Domain name=AP2; Domain location=117-182; Score =151.6; E_value=2.1e-42; Accession=PF00847.10; Description=AP2 domain
NHGATSEGILENVWAKIMSSDRADGRKGDAAECSNSWEELPNLDGREGSMEILQRLPSLGRWISMGADFWEEVLEGIILPNTSNTEYSGSNNNLEIGSANETHNKVGDAVRIEKSVTKHYRGVRRRPWGKYAAEIRDSSKKGARVWLGTFDTAEEAALSYDKAALRIRGPKAYLNFPLEMVANALACDHKAVTHLACTCIGNKEKLINSRKRASREREAFDDIMNEQPATKKLECMVENELGAFVFHDLGSDYLDSLLSSF

SEQ ID NO: 121090 - protein, 264 aa, Glycine max
  Coding DNA Sequence Number=SeqID_4312
  Gene Ontology: Mol. function=transcription factor activity; Cellular component=nucleus; Biological process=regulation of transcription, DNA-dependent
  Homolog annotation: Hit_ID=O04681; Match level="QueryCoverage=51%, HitCoverage=90%, E-value=3e-33, Identity=55%"; Hit description =Pathogenesis-related genes transcriptional activator PTI5
  Pfam annotation: Domain name=AP2; Domain location=145-210; Score =150.0; E_value=6.2e-42; Accession=PF00847.10; Description=AP2 domain
MAIQNEGQQRTSRESKSTPPWVSQKPQNILYLCPHHSIDLCRVQNHLTHLANLPFLQKPKRDRPTPRRNKETNMGSNKTYEEEESTVLFSHSQTQTELLPFNENDPQDMVIYQVLNEANALTNTFLPQRLHQPQLCLEPTRNITKKHYRGVRRRPWGKYAAEIRDSARHGARIWLGTFQTAEEAAMAYDRAAFKMRGSKALLNFPAEIVAATELSFNNTNSNNHDAVSDSSAGSSCTNNSVQLNRNQSESCTSSTGHRKLIHLM

SEQ ID NO: 121091 - protein, 260 aa, Glycine max
  Coding DNA Sequence Number=SeqID_4313
  Gene Ontology: Mol. function=RNA-directed DNA polymerase activity; Cellular component=intracellular; Biological process=RNA-dependent DNA replication
  Pfam annotation: Domain name=G-patch; Domain location=182-235; Score =12.3; E_value=0.006; Accession=PF01585.13; Description=G-patch domain
RISLLGLLMNSEPHRALLVKILNEPHVAQDISVEGFRGIVSNITTNNYLTFTNEEVPVEGRGHNKALHVSIKFLDHIVTKVFVDNGSSLNVMPKTTLDKFPFNASHIRLSSMVVRTFDDPLGWGGPVNATPEIKVCSGRAAGYSIRGGRHTEESLETSFQVLEIVSNAYVESPLMHLRLSGTALMVARVMLNDGYESGMGLGQNGDGTTSLVEFTENRGRFGREAWLINKGMDCEWKGSPFVTSAKALLVRDRCARIRLW

SEQ ID NO: 121092 - protein, 87 aa, Glycine max
  Coding DNA Sequence Number=SeqID_4314
MCEDQVVVIDEENPQDRPNWVQACPPGFELENWKIIKQPEISITNSISNDESYESSDTEDSDVDLEQLINQAEKGKDEDWGLPPNLE

SEQ ID NO: 121093 - protein, 136 aa, Glycine max
  Coding DNA Sequence Number=SeqID_4315
  Subcellular localization annotation: CTP_CleavageSite=51; ConfidenceScore=5.02e-01
MSGPGASGVLKATSADPWSASFMVETRTLFVFHKSKNFTSDYEIRMPPTVPVNHYSDPEGQHNRIRILTGGTTRPVKDRSASPAEGTSRPVHTGGGPIDPTQAGITAAAGTRLALQWILVKGFRLYSFQLPDSMSP

SEQ ID NO: 121094 - protein, 235 aa, Glycine max
  Coding DNA Sequence Number=SeqID_4316
FALLRPDPQELAAKLCIPGRGFELNVDGQSLKILRKNMTTLAQTWSVLSFSNLIPTSHTSDVTLNRAKLIYGIIMKMDMNLGAKEGQGKRSEVPTTLALPETAAPSSSKTLVPPSQTPAIPPAPTQTPLPTPLSAGPSDFSFTPQMLHSMLQSLHRGQSIIMQSLQGLGLPSIMSMDEFDAQVAWPGAQPSPSGGGGAFAAQKPESEEPAVATVEGEDEFTPPELFYLDASIHMA

SEQ ID NO: 121095 - protein, 85 aa, Glycine max
  Coding DNA Sequence Number=SeqID_4317
MCRMHNTLQLANDQLVDEVYYRQPFIDAELLCTIIRTPDAILNLLQSTITPIHDALMYYNGKWNIPRQDVLKVLAQSNYWKRLCK

SEQ ID NO: 121096 - protein, 84 aa, Glycine max
  Coding DNA Sequence Number=SeqID_4318
MKSDKASQDIHSISQACSELQTRKGKQGSKGLSKELIQGKSIWLEAYKNKIASIISKYACELGSINKNQAKAIVQAINGAKHTK

SEQ ID NO: 121097 - protein, 148 aa, Glycine max
  Coding DNA Sequence Number=SeqID_4319
  Homolog annotation: Hit_ID=Q09JM0; Match level="QueryCoverage=38%, HitCoverage=98%, E-value=1e-10, Identity=63%"; Hit description=10 kDa putative secreted protein
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHVNGTCTWLVDPKDGEARLIALCARTRKES

SEQ ID NO: 121098 - protein, 106 aa, Glycine max
  Coding DNA Sequence Number=SeqID_4320
  Gene Ontology: Mol. function=sequence-specific DNA binding; Cellular component=nucleus; Biological process=regulation of transcription, DNA-dependent
  Homolog annotation: Hit_ID=Q56NI6; Match level="QueryCoverage=57%, HitCoverage=25%, E-value=1e-23, Identity=91%"; Hit description=MADS box protein M3
  Pfam annotation: Domain name=SRF-TF; Domain location=9-59; Score =111.4; E_value=2.5e-30; Accession=PF00319.9; Description=SRF-type transcription factor (DNA-binding and dimerisation domain)
MGRGRVVLERIENKINRQVTFSKRRSGLLKKAFELSVLCDAEVGLIIFSSRGKLFQYSSTEEKDMVLLLHFHFYNYTCIKHHRVLHARGLEFSDLAESTSDYVCDL

SEQ ID NO: 121099 - protein, 160 aa, Glycine max
  Coding DNA Sequence Number=SeqID_4321
  Gene Ontology: Mol. function=nucleic acid binding
  Homolog annotation: Hit_ID=Q41042; Match level="QueryCoverage=72%, HitCoverage=19%, E-value=1e-14, Identity=37%"; Hit description=Pisum sativum L
  Pfam annotation: Domain name=RRM_1; Domain location=86-148; Score =32.4; E_value=1.6e-06; Accession=PF00076.12; Description=RNA recognition motif. (a.k.a. RRM, R
  Subcellular localization annotation: CTP_CleavageSite=56; ConfidenceScore=5.07e-01
VMSVRNLGVKVLVIRGVYQFLAVLNCQKTSCLKTFHVNSSNLSHSFQRSERTQPVKASEISGDWEQETESKIIANCKDLSATSKTIYASNLAYSMEKDDMEFLFKNCGEIVDIRLHTDHNGRFKGHGHVEFATTEAAQKAWHSSRLFIALSLESNVGLAS

SEQ ID NO: 121100 - protein, 83 aa, Glycine max
  Coding DNA Sequence Number=SeqID_4322
  Gene Ontology: Cellular component=intracellular
  Homolog annotation: Hit_ID=Q1RWU7; Match level="QueryCoverage=70%, HitCoverage=10%, E-value=9e-14, Identity=64%"; Hit description=BRCT
MNDNVFDDLLILSCEDDYAICHRFLKRGTAVYSSELVLNGIVIQKLELERHQLFMNQVTRNNPSVSNRFGKIYRRRRGLFSGP

SEQ ID NO: 121101 - protein, 219 aa, Glycine max
  Coding DNA Sequence Number=SeqID_4323
  Gene Ontology: Mol. function=nucleic acid binding; Cellular component= ribonucleoprotein complex; Biological process=multicellular organismal development
  Homolog annotation: Hit_ID=Q7XAN8; Match level="QueryCoverage=77%, HitCoverage=36%, E-value=1e-42, Identity=54%"; Hit description =Putative CUG triplet repeat RNA-binding protein 1
  Pfam annotation: Domain name=RRM_1; Domain location=124-195; Score =56.5; E_value=8.5e-14; Accession=PF00076.12; Description=RNA recognition motif. (a.k.a. RRM, R
  Pfam annotation: Domain name=RRM_1; Domain location=17-89; Score =50.9; E_value=4.2e-12; Accession=PF00076.12; Description=RNA recognition motif. (a.k.a. RRM, R
  Pfam module annotation: Pfam domain module=RRM_1::RRM_1; Domain location=124-195::17-89
MAEGKEESKSSEESVKLFVGQVPKHMTEPELLAMFKEFALVDEVNIIKDKATRASRGCCFVICPSREEADKAVNACHNKRTLPGLLSVLHCAVFSPLRGLFVFASSPLQVKYADGELERLEHKLFIGMLPKNVSEVEISALFSKYGTIKDLQILRGSQQTSKGCAFLKYETKEQALTALEAINGKHKMELYYVNFADAIILDLQAAFSHEILLVRDVNI

SEQ ID NO: 121102 - protein, 244 aa, Glycine max
  Coding DNA Sequence Number=SeqID_4324
  Homolog annotation: Hit_ID=Q00M75; Match level="QueryCoverage=15%, HitCoverage=6%, E-value=3e-11, Identity=91%"; Hit description=PPR -repeat containing protein
MYGDHHEFTTLLAQDALLPQSKVGIQGEQPNTYPPENSEYQPLALEITKPAPTFAQTLPDQNHNTQTAEPLPKLAERTAKVVTEPAAETKQDVVKVSTTSQQNHGQETQEDNWKVYKRKRRKDVESSTTQMQNHESNQALGNEVPTDTDIPNAKGKGVRTCTQHPIERYVSYGKKLRTPLSRGSSLCEGMGEGCCTQSYPCICKEAVSGFEPMTNKSPRHNFTAAPGLALMSPMENCHKSAGPL

SEQ ID NO: 121103 - protein, 58 aa, Glycine max
  Coding DNA Sequence Number=SeqID_4325
MADMYYSDEVHLLSKEKKKIARSGSIGQDEVRGKVKEVITSIQFNLIQMQNEARYNVV

SEQ ID NO: 121104 - protein, 66 aa, Glycine max
  Coding DNA Sequence Number=SeqID_4326
  Homolog annotation: Hit_ID=Q56NI6; Match level="QueryCoverage=69%, HitCoverage=19%, E-value=6e-08, Identity=59%"; Hit description=MADS box protein M3
HFQGEDLEPLSFKDLQSLEKQLDITLALTRQHQTKKLMARADELREKDLNMLHFSHGSSPCGTFYT

SEQ ID NO: 121105 - protein, 772 aa, Glycine max
  Coding DNA Sequence Number=SeqID_4327
  Homolog annotation: Hit_ID=Q1SSF3; Match level="QueryCoverage=47%, HitCoverage=80%, E-value=1e-115, Identity=61%"; Hit description=BRCT
MLEGYKGALVDGDSFDDNNHSYPPAMLSHIHSPEPGDSTEAALGFVDQYLSSNDMDLFQGIHRGKTTREKSPYDVLSARGALNLAKKIKARTQNEEKEPFKWVESCQHDNKAGMFGKKIEASSNFGRYKQTYTRKRQKEGGHLQGQGNCNTSNRCDERLRQGSRMATKNNNSPKELDVQPIAINENVNVYSSVTHIEDMHDIGLDTQIAAEAMNALAFVPPSGCQFNDTHQPENALDGSLSDLTENEARLKNSSYIQNPDLHSITIKSNKKNASSSRFSKITFNSACKQEPNLVSWKMKKMRSKSSSEGQFENNTSFTMCSKHVSLEEVCSLGEHTSFQPAAEESEDWNNESRQTRIKDQQSHLTEGNNNVKEKGIKHKRKGNDLEAEPVKFGVWTRRLKFPTNSCTVARKSRLNHLAQVSPQLSATSSFSRTDSWVYPKRSRGKRKGANVGTSLDAPTAVCIDGKENKVFSTRSLQDQDDVDKSCFPHTRPLCNASCADDGRCLLQGNFVPPGSAGDAMKVENLPDMHPLLLAHVGISSNKSIAQSRSEMPATVTASKGIKVSNANHTYTEHQQKLCEKTLPKTSVLKELIRLGAPKFTSDKMWKDLRHRRDMTDVRVLFSQHLDDSIMKQQKKILARLNISVASCSMEATHFIADKFTRTRNMLETMALGKLVVNHLWLESCGQANCFIDEKNYILRDMKKEKEIGFNMPVSLARARQKPLLKGKRVYITPHIKPDKEVVASLVTAVHAQVYISPMHATPHLQLNRWLQY

SEQ ID NO: 121106 - protein, 186 aa, Glycine max
  Coding DNA Sequence Number=SeqID_4328
  Gene Ontology: Mol. function=DNA binding; Biological process=DNA integration
  Homolog annotation: Hit_ID=Q1SS72; Match level="QueryCoverage=96%, HitCoverage=12%, E-value=4e-48, Identity=45%"; Hit description =Integrase, catalytic region
MNESTPNIESYLYLHPSENPAVALVSPALDSSNYHSWSKSMITTLSAKNKVEFINGNAPEPLRTDRTYSAWSRCNNMVVSWIVHSVSVAIRQSILWMNKAEEIWDDLKSRYAQGDLLRVSDLQQEASSMKQGTLSVTEYFTKLRIIWDEIENFRPDPTCSCTIKCTCSVLTTIAQRKLEDRAMQFL

SEQ ID NO: 121107 - protein, 164 aa, Glycine max
  Coding DNA Sequence Number=SeqID_4329
DTGTSSMAVFGSEKDKQTSNREAGSNVKVVMLGNRSNGAEKRWLSRHNQHHRAESNRGFHLSHSSIVLSVPMETKACAEEVDLKYLGGDMVLITGIGEDIIKELCKEGVVAGWFGCCVGGIPLHAWDSQNIKKIVGSMDDVIDVDDDVENLHRIDCARVLVKTA

SEQ ID NO: 121108 - protein, 186 aa, Glycine max
  Coding DNA Sequence Number=SeqID_4330
  Gene Ontology: Mol. function=DNA binding; Biological process=DNA integration
  Homolog annotation: Hit_ID=Q1S3I6; Match level="QueryCoverage=93%, HitCoverage=12%, E-value=1e-12, Identity=31%"; Hit description =Integrase, catalytic region
  Pfam annotation: Domain name=zf-CCHC; Domain location=42-59; Score =12.8; E_value=0.0075; Accession=PF00098.13; Description=Zinc knuckle
  Pfam annotation: Domain name=zf-CCHC; Domain location=79-96; Score =14.2; E_value=0.0046; Accession=PF00098.13; Description=Zinc knuckle
  Pfam module annotation: Pfam domain module=zf-CCHC::zf-CCHC; Domain location=42-59::79-96
MPSIPKIFSYVAQQERQLSGINSLSNLSLESKENVSINAAKVTCEFCGRVGHTESVCYKKHGVPTSYEGRSKTYSRSVKTCTHCGKIGHTIDVCYKKHGYPPGYKFGNSKVVNNIMEGKTVNDQMQRQESHDLVHFSPEQYQALLALIQQPSSGSSIPTQPQVASISSCPTNTSPGYQHQSEDWYS

SEQ ID NO: 121109 - protein, 357 aa, Glycine max
  Coding DNA Sequence Number=SeqID_4331
  Gene Ontology: Mol. function=ammonium transporter activity; Cellular component=membrane; Biological process=transport
  Homolog annotation: Hit_ID=Q84KJ6; Match level="QueryCoverage=97%, HitCoverage=96%, E-value=3e-51, Identity=47%"; Hit description =Ammonium transporter
  Pfam annotation: Domain name=Ammonium_transp; Domain location=25-315; Score=-113.7; E_value=1.8e-06; Accession=PF00909.11; Description =Ammonium Transporter Family
MNVPLPSNLAVVDGSPEWFSRADNAWKLIAATLVGNPSWSAKCSRAHNLVRWSSEEEMGSELSIHVTLCFYIMSFGDELLPFWGKPAMSLEHAYLFKKAFLGAFPNATMCVFAAITLILIAGAVLGHMNFYAWMLPWPFSTPTLAHLVILDVLFFRKPSVIGAVQGMITGLVCITPAAGVVQGWASLIMGLLSGSIPWFTMMVIHKRSKLLQKVDDTMAVFHTHAIAETLGGLLTGLFADPRLNRLFYGHDAQYVVFFYGFGSNKLSTGFRQMGVQILGIIFVIFVNFIRIFFPLRISEEDMEIGDEAAHGEEAYAIWGQGDKLENSSSKYGSSLYNDVEAGAPKKKRAGTVQMMSN

SEQ ID NO: 121110 - protein, 111 aa, Glycine max
  Coding DNA Sequence Number=SeqID_4332
  Gene Ontology: Mol. function=protein dimerization activity; Cellular component=nucleus; Biological process=regulation of transcription, DNA-dependent
  Homolog annotation: Hit_ID=Q94JM3; Match level="QueryCoverage=94%, HitCoverage=12%, E-value=7e-30, Identity=60%"; Hit description=Auxin response factor 2
  Pfam annotation: Domain name=B3; Domain location=48-111; Score=12.4; E_value=0.0029; Accession=PF02362.12; Description=B3 DNA binding domain
MNVELKAEAYSDEVYAQVTLVPEVQKDNLCFEEEVNIDQIPSRNAAYSFSKILTPSDTSTHGGFSVPKKYADECFPPLDMTLQTPAQEIVAKDLNGFEWRFRHIYRVARMY

SEQ ID NO: 121111 - protein, 100 aa, Glycine max
  Coding DNA Sequence Number=SeqID_4333
  Gene Ontology: Mol. function=ATP-dependent helicase activity; Cellular component=spliceosome; Biological process=mRNA processing
  Homolog annotation: Hit_ID=UPI0000162AB8; Match level="QueryCoverage =85%, HitCoverage=12%, E-value=2e-33, Identity=80%"; Hit description =ATP binding / ATP-dependent helicase/ RNA helicase/ helicase/ nucleic acid binding
MTATRLYTEEYFLNHMSNEGIPEIQRSNMVSCLIQLNALGIDIILGFDWPASPSAEAMIRALEILYSLGVLDDDPKLTSPTGFQVAEIPLVNFSYHKHHV

SEQ ID NO: 121112 - protein, 281 aa, Glycine max
  Coding DNA Sequence Number=SeqID_4334
  Gene Ontology: Mol. function=hydrolase activity, acting on ester bonds; Cellular component=cytoplasm; Biological process=D-amino acid catabolic process
  Homolog annotation: Hit_ID=Q8VZ75; Match level="QueryCoverage=59%, HitCoverage=82%, E-value=1e-46, Identity=58%"; Hit description=RNA helicase-like protein
  Pfam annotation: Domain name=Tyr_Deacylase; Domain location=47-232; Score=168.0; E_value=2.4e-47; Accession=PF02580.7; Description=D-Tyr- tRNA(Tyr) deacylase
  Subcellular localization annotation: CTP_CleavageSite=55; ConfidenceScore=5.46e-01
MQLQLVSPCRVPRVGGAVVVGGIHRIGTLTSTVTVRRRSKAVTTAMRAVVQRVASASVEVEGRIVSEIGPGLLVLVGIHDSDSDADADYICRKVLNMRLFPNENTGKAWDHSVMQKNYQVLLVSQFTLYGFLKGNKPDFHVAMAPQRAKPFYASLVDRFRNAYNSDAIKVRTNINRLCSVLNTFSSAKIQVIYESSIKSVHFSLLPDKAELYDGVFGAMMKVKLCPSIPVQGIQLMQQNLDQWLIWLDEIELEFWLFRQKDQMQDTHYVLFILVEVLSPPM

SEQ ID NO: 121113 - protein, 405 aa, Glycine max
  Coding DNA Sequence Number=SeqID_4335
GLKKQSKRPRVPKRGPGVAELEKILREQETIDLVDNKGNPEGFSSFVSHHSNSNSYPSSSMKLQPPTSPKKTIPYPSFMSSNFPTNVPSAPIFDHLGATTPPTITSIYGNYGSLEKNNGGSGLVSPEKELFPLNLNSCKSNLNMNEPIDVNRCDFANSPTRNLSNETNSIWPYHATVQKRNNNKYSSSTANQFPGIPTSSVSLSMRLHSNNHPDPELPSNQSLCYSYMSRVPEEHKMVGMKRSHSSALENSLIPPSNFHVLPSFSHYNRAHQSSINDSHGASSFNSTKECYRDAKWGSTLELSNTRFNSDITVPGHAIPPFVTPEVPSPPMHLFPGVLSKGNVLPSQVNDEKMDSYKHSESSESNRKPFYNFLEVEDSEVSETTRGANRGGRETGRVGIDLNLKL

SEQ ID NO: 121114 - protein, 81 aa, Glycine max
  Coding DNA Sequence Number=SeqID_4336
  Gene Ontology: Mol. function=nucleotidyltransferase activity
  Homolog annotation: Hit_ID=Q6R3K4; Match level="QueryCoverage=92%, HitCoverage=15%, E-value=1e-12, Identity=42%"; Hit description=Metal- nicotianamine transporter YSL8
MEEEGNKLKGEEAFRKTRVPPWTKQITVRSVVTSFVLTIKAYTALLNNCGLLKQPFTRQENTVIQTFVVASSGIAFSSNHN

SEQ ID NO: 121115 - protein, 85 aa, Glycine max
  Coding DNA Sequence Number=SeqID_4337
  Homolog annotation: Hit_ID=Q9C5W9; Match level="QueryCoverage=54%, HitCoverage=7%, E-value=3e-09, Identity=59%"; Hit description=Auxin response factor 18
MKDRSRKFILLFMDRDILYTELWRACAGSFVYVPRVDDRVFYFPQGHLEQNEDGHFEGISSAYALVLFVGFDYQSNLCIETFICA

SEQ ID NO: 121116 - protein, 43 aa, Glycine max
  Coding DNA Sequence Number=SeqID_4338
MDEYKLPVILLTSYTSRYACMPFNKCVKKYLTSRWHALAKSQQ

SEQ ID NO: 121117 - protein, 762 aa, Glycine max
  Coding DNA Sequence Number=SeqID_4339
  Gene Ontology: Mol. function=RNA-directed DNA polymerase activity; Cellular component=chromatin; Biological process=chromatin assembly or disassembly
  Pfam annotation: Domain name=RVP_2; Domain location=227-340; Score= -41.7; E_value=0.0018; Accession=PF08284.2; Description=Retroviral aspartyl protease
  Pfam module annotation: Pfam domain module=RVP_2::RVT_1; Domain location=227-340::463-632
  Subcellular localization annotation: CTP_CleavageSite=34; ConfidenceScore=5.56e-01
MARPCAGSNGSTGMTSFPPGRPSSKLWRCDLLLRCMMTPAAPFARSWGLPTPFLLSCFISGLTPEIRRDVLALQPLSLVQAAAIARLQEDKLTDSRRPNRTRPPPLPPPTTTHPPPLPSPPLPPLLPAPPRTTYKRLSPAEMANRRERGLCYNCDERYSPTHRCRAKFFLLVATEDDDPDFSPTLPSTPDSQTLSTTTPSPDPTPLDLPTAQLSLHALSGHPIPSTLRVRGSIHNHELVVLVDGGSTHNFIHHRLLHFLRLTPEPIPRLAVMVGDGTDIDCTRVCRNVTLTIQEHQFIVDLHVMGLGGADLILGVAWLTHLGPITSDYSHLTMRFSHQGKPITIYGDASLDPSEISHGQVKRLVSTHQIAGLFHLQLQATHPITADNHTPPSPIRTLLSKYPRLFQPLHHLPPSQSTDHIIHLEPHSKPVNVRPYRYPYFQKTEIEKQVQDMLNRQLIRPSRSPYSSPVLLVKKKEGTWRFCVDYRALNSITIKDRFPLPTIDELLDDLGNSSWFSKMDLAQGFHQIRMSDADIFKTAFRTHEGHYEYVVMPFGLCNAPSTFQATMNSLFRPFIRKFVLVFFDDILVYSSDLQSHLNHLDCVLRTLQQADFRLKASKCIFGQRRIEYLGHFVSRRGVEPDSSKIQAMLHWPPPTTTKALRGFLGLIGFYRCFVKNYAQIAAPLTHLLKKDQFVWTLETQQAFEALKSAMTTTPVLALPDFSIPFTVETDASGSGMGVVLMQRGHPLAFFSKQFCPKLLRSST

SEQ ID NO: 121118 - protein, 111 aa, Glycine max
  Coding DNA Sequence Number=SeqID_4340
  Gene Ontology: Mol. function=nucleotidyltransferase activity; Biological process=aromatic amino acid family biosynthetic process
  Homolog annotation: Hit_ID=Q6R3K4; Match level="QueryCoverage=95%, HitCoverage=15%, E-value=3e-27, Identity=56%"; Hit description=Metal- nicotianamine transporter YSL8
MEEEGNNLKGEEAFRNTMMLPWTEQITVRSVVTSFVLSIVFIFIVCKLNFTTGIIPSLNVAAGLLGFAVINAYTTLLNNCGILKKPFTRQENTVIQTFVIAASGIAFSKVG

SEQ ID NO: 121119 - protein, 566 aa, Glycine max
  Coding DNA Sequence Number=SeqID_4341
  Gene Ontology: Mol. function=3-dehydroquinate dehydratase activity; Cellular component=integral to membrane; Biological process=aromatic amino acid family biosynthetic process
  Homolog annotation: Hit_ID=Q2XPY5; Match level="QueryCoverage=99%, HitCoverage=80%, E-value=0.0, Identity=58%"; Hit description=YSL transporter 1
  Pfam annotation: Domain name=OPT; Domain location=3-537; Score=396.8; E_value=3.2e-116; Accession=PF03169.6; Description=OPT oligopeptide transporter protein
  Subcellular localization annotation: CTP_CleavageSite=53; ConfidenceScore=5.06e-01
MGSYLLGMSPYIASQVDGGNTPINTKTISLGWMFGFLFVVSFVGLFSIVPLRKVMILKYKLTYPSGTATALLVNSLHTPKGAKLAKKQVALLFKSFCGSFAFGFFQWFFTAGDGCGFSTFPTFGLEAYSNRFYFDFSSTYVGVGMICPYLINASLLLGAVISWGILWPWIEHKKGIWYSADLPGSSLSGIQGYRIFTAIAMMLGDGLYHCIIMLIRVAYSLITQYLKKKVPSTVNHEDVDQNSSEDFDAQRRTEYFLKDEIPSWVAIIGYSVLAVISIITVSLIFPQLKWYHVLITYLIAPILAFCNAYGCGLTDWSLASNYGKVAIIIFSSWVGLEHGGLIAGLASCGVMMSIVSTASDLMQDFKTGYLTLASPRSMFMSQVLGTATGCLLSPLMFWFFNKAYTLGDPQGSYPAPYGEVYRGMALLGAKGFSSLPKNCLELAIIFFFLAVFINIVHDLLEHYETKYRIYRFVPNPMALAIPFYLGGYFAIDMCIGSLILFLWEKKNKQKAKDYGPALASGLICGDSLWSVPAAILSLAGANPPICMKFLSSAVNKKVDTFLSGGP

SEQ ID NO: 121120 - protein, 449 aa, Glycine max
  Coding DNA Sequence Number=SeqID_4342
  Gene Ontology: Mol. function=protein disulfide oxidoreductase activity; Biological process=cell redox homeostasis
  Homolog annotation: Hit_ID=Q8H558; Match level="QueryCoverage=33%, HitCoverage=60%, E-value=4e-31, Identity=48%"; Hit description =Peptide transporter-like
  Pfam annotation: Domain name=Glutaredoxin; Domain location=315-381; Score=55.1; E_value=2.3e-13; Accession=PF00462.14; Description =Glutaredoxin
MANIRIFDRWGPLQTSNGWDKGENFQSRCLHLFVFSNTLKLTKHSERERERERENFTHSLMGCVSSKHIKKDLKQEEEVTVTNGGGYVNHVVSLTSSTYGALMLDKEKEQLQLQPTVEEESKTSPPRIREEPEVINAWELMEGLEEGVPISNNPMKSPKSTPFLRGFISTDPKPKITPFKFLNQFGSPKSLRKFTGKENKVQVQPPNAGVRRLDYNFSPKGILKPSNFCSPLKGSPIRARRNSFGTDIKRRSPSPLFDPELLASYEKELSEEEEQIKRMVWATPKTRRVRKPLDSQTFIKTFEEKLPPGGENCVVIYTTTLRGIRKTFEECNKVRSIVESYCVHVVERDVSMDSGFKEELRKLMGTKQVKVPVVFVKGRLVGGAEEIVKLEEEGKLGVLFEGIPHKALGECEGCGGVRFVMCVECNGSCKVLDHENHKKTLRKRGTEQA

SEQ ID NO: 121121 - protein, 138 aa, Glycine max
  Coding DNA Sequence Number=SeqID_4343
  Gene Ontology: Mol. function=DNA binding; Cellular component=nucleus; Biological process=regulation of transcription, DNA-dependent
  Homolog annotation: Hit_ID=Q1S7P2; Match level="QueryCoverage=97%, HitCoverage=100%, E-value=7e-35, Identity=54%"; Hit description=SBP
  Pfam annotation: Domain name=SBP; Domain location=56-134; Score =179.5; E_value=8.1e-51; Accession=PF03110.5; Description=SBP domain
MDESWSEGKRSMSYKEEDEYEEEEEEEVSEYRDDGRKKKVVSSKRGSKAGGSVPPSCQVDGCSADLSEAKPYHRRHKVCEYHAKAPAVLIGDQHQRFCQQCSRFHELSEFDDSKRSCRRRLAGHNERRRKNASEYHEL

SEQ ID NO: 121122 - protein, 179 aa, Glycine max
  Coding DNA Sequence Number=SeqID_4344
  Gene Ontology: Mol. function=S-adenosylmethionine-dependent methyltransferase activity
MKKDIRSCCYSEGSTSTLNKQNDTCKVSSLALQDLMMQFELEAKLSDDFSGMRGRMSCVNDSNILRPTRKALNQYPRLSLDGGRDAMNHSFVNIQGRRSVCCDRRLKEGSIQENNDLGSKFRFCDGESMSLPHTLAGESVVWCKPGVVARLMGLEAIPLPVCTYQHESKQFLENGRVKE

SEQ ID NO: 121123 - protein, 520 aa, Glycine max
  Coding DNA Sequence Number=SeqID_4345
  Gene Ontology: Mol. function=peptidase activity
  Homolog annotation: Hit_ID=Q1S7P3; Match level="QueryCoverage=61%, HitCoverage=66%, E-value=1e-131, Identity=67%"; Hit description =Peptidase, trypsin-like serine and cysteine proteases
MAMSFGFLLLGMCSSGGTTLSASGMLVPDTLCDAQVAGCLYGDNCEDRVLVVTVASVVEPFLSPQQRDNIPQGRPDLISGVRIDVMTEEANEKSNQGTPCWLAAELLSLVGILNLLVPYYAVDIPASSNCLQSLIEASLGLPEHEWEVGWSLASYNNDSQPSKDFFQTHPWMSMLSNEIGSMMAETCCGLDVWRRPDLLDSKVSAMNKKGDFLLAVGSPFGVLSPMHFFNSISVGCIANCYPPHSSDGSLLMADIRCLPGMEGSPVFSEHACLIGVLIRPLRQKTYGEEIQLVIPWDAIVTASSSLLRKRPQNTQKGSSPLPIEKAMTSVCLVTIGDGVWASGVLLNSQGLILTNAHLLEPWRFGKEHVNGGGYGTNSERISSMLEGTAYLVNRVASNQVSQTSPLKMPILYPFAANEQGGYKSSPTYDNHRNIRVRLDHIKPWVWCYAKVVYVCKGPWDVALLQLESVPDNLLPITMNFSRPSTGSQAFVIGHGLFGPKRVPASAVPTIFTGNYNKVAF

SEQ ID NO: 121124 - protein, 78 aa, Glycine max
  Coding DNA Sequence Number=SeqID_4346
MVDPEHVISYHFQGRIEVLFTCALFNLGSEVGDFIYIQDKLVGLDKVNRAGHKEAQFVPGILDTYYSDDYRINWRRHY

SEQ ID NO: 121125 - protein, 88 aa, Glycine max
  Coding DNA Sequence Number=SeqID_4347
  Gene Ontology: Biological process=auxin mediated signaling pathway
  Homolog annotation: Hit_ID=Q9FNV7; Match level="QueryCoverage=47%, HitCoverage=36%, E-value=4e-18, Identity=97%"; Hit description=Auxin- repressed protein
  Pfam annotation: Domain name=Auxin_repressed; Domain location=1-75; Score=35.3; E_value=2.1e-07; Accession=PF05564.3; Description =Dormancyauxin associated protein
  Subcellular localization annotation: CTP_CleavageSite=43; ConfidenceScore=5.54e-01
MPSTPTTPMTPTTPTTPGSARKADNVWRSVFHPGSNSATKTIGAQMFDKPLPNTPTVYDWYIIAVQWGDQKQAPLKLKSLAKMTVGCM

SEQ ID NO: 121126 - protein, 115 aa, Glycine max
  Coding DNA Sequence Number=SeqID_4348
MQSQGLALPPEPEVGPSAARVSTKKSCVDPSGNDLDTGESKKCELYVKENPPRLVVLGRLYEGSTTVHNIPLRHDQVKFGVEEVRDTDAPIPVLIQEVQLIGRHLTPSLLVQHIL

SEQ ID NO: 121127 - protein, 69 aa, Glycine max
  Coding DNA Sequence Number=SeqID_4349
DSLEEHASHGSFVAHGRQDVLTAAIGRPEHIGRVCAIGASITIKQYFERVPRTFRTSSFMAPKDLEQLT

SEQ ID NO: 121128 - protein, 315 aa, Glycine max
  Coding DNA Sequence Number=SeqID_4350
  Gene Ontology: Mol. function=DNA binding
  Homolog annotation: Hit_ID=Q1RUD8; Match level="QueryCoverage=95%, HitCoverage=68%, E-value=3e-32, Identity=31%"; Hit description=IMP dehydrogenase/GMP reductase
MGSSQKPSLKKRFYQVKIKSLEVTSLRELGQLMGQLQRQAFRKAYGKIWDLARVEVSMEPIASLSQYYHQPLRCFTFEDFQLVPTVKEFEEILGCPLGGRKPYLFSGFYPSTTRVAKYQGSVWRKGQRPWQIKANGLSFIDILALLIFGVVLFPNMEGLVDLAAIDAFLAFHHGKESPVVAILAMYDTFDRGYEKSSARIVCCALALYVWLVSHLFLQEGRPVYPLQGHRSCVEKGKANWDGRIRILSSCEGCPNVPLMGTRGCINYNPVLAIRQLGYPMRGVPSDESITPFIAWGFSDHNARVLQGFRKAWDAA

SEQ ID NO: 121129 - protein, 183 aa, Glycine max
  Coding DNA Sequence Number=SeqID_4351
  Homolog annotation: Hit_ID=Q1T1Y0; Match level="QueryCoverage=28%, HitCoverage=13%, E-value=2e-07, Identity=54%"; Hit description =Ankyrin
  Pfam annotation: Domain name=DUF1723; Domain location=125-174; Score =38.2; E_value=2.9e-08; Accession=PF08330.1; Description=Protein of unknown function (DUF1723)
MAIKDTLSHEILISSVCFGGSKKQLCVHLRWLTRSKHRTMQDVTPPMKAPHRKGKMLQRDIEGNHCVGHVWIREERLEVKLVSLGAIVPYPFIWICQERQKVNLVSHNAPGATIPYSSTSSGLHGPVEGLMNVIFERCHQETSSFHLPNGEMTITLNDVSCLLHWPMTSRPINNVLSLFNGSC

SEQ ID NO: 121130 - protein, 162 aa, Glycine max
  Coding DNA Sequence Number=SeqID_4352
  Gene Ontology: Mol. function=dihydroxy-acid dehydratase activity; Cellular component=mitochondrion; Biological process=branched chain family amino acid biosynthetic process
  Homolog annotation: Hit_ID=Q9LIR4; Match level="QueryCoverage=58%, HitCoverage=15%, E-value=2e-34, Identity=76%"; Hit description =Dihydroxy-acid dehydratase
  Subcellular localization annotation: CTP_CleavageSite=30; ConfidenceScore=5.17e-01
MFLCSMLKTKVLNLDPSCSSRFLLHAKRVKAALSNGYALSPLSSPSAIVTLALQEISSFLPEILYKTTNNGLDAINNEVPGLEALAHATGAHGDGATDTNGVEAEGNHASGGNTVMHGLGKVEEVHVASVSLVPNRGDADLQLGYFVLGETNTVEHGLGGAL

SEQ ID NO: 121131 - protein, 250 aa, Glycine max
  Coding DNA Sequence Number=SeqID_4353
  Gene Ontology: Mol. function=oxidoreductase activity; Cellular component=proton-transporting two-sector ATPase complex; Biological process=response to gibberellin stimulus
  Homolog annotation: Hit_ID=Q4JH25; Match level="QueryCoverage=99%, HitCoverage=50%, E-value=4e-55, Identity=50%"; Hit description=GA 20- oxidase
  Pfam annotation: Domain name=2OG-FeII_Oxy; Domain location=30-129; Score=84.4; E_value=3.4e-22; Accession=PF03171.10; Description=2OG -Fe(II) oxygenase superfamily
MKQLGIKLLELLAISLGVDKLHYNYLFEEGCSVMRCNYYPSCQQPSLALGTGPHCDPTSLTILHQDQVGGLDVFADNTWQTVPPRPDALVINIGDTFMVFEKQHYQTTPISHGVNGENLRLFTTIFILKYRRQYLSSSIFVPGNKWWAEQETVKKKLQLQALSNGRYKSCLHRAVVNKYKERRSLAFFLCPKEDKVVSAPEDIVRRDGTKQYPDFTWSRLLEFTQKYYRADEATLQNFTKWLLSSKQQTL

SEQ ID NO: 121132 - protein, 94 aa, Glycine max
  Coding DNA Sequence Number=SeqID_4354
DRAHKTPNGPGEVQQVIGFPALITGLCQSYRVPVPPTRDRTRKTNSGPGEVQQGLKVSSSNYEPLSVLQSARRPQQGHQAPINRAFIEKYCAPR

SEQ ID NO: 121133 - protein, 184 aa, Glycine max
  Coding DNA Sequence Number=SeqID_4355
MDKLTSHVAYDSISYSLDSLSFSGLVAIQDHQPKLPSPNRAKDYQVSKHDSEFEFTSTKANLNSAVNPIKITPADQLISNGRLQPQALAIQTNQSLIRNLPSSSSSLLATHSSSKMSCSKTGSNMKYHEQLNEASKHANKKSTVTRTGFGQKMKSFLSPCRECRTIKQGAVKAQTVPGENLKID

SEQ ID NO: 121134 - protein, 77 aa, Glycine max
  Coding DNA Sequence Number=SeqID_4356
MPEEEAMVTELRKVRQRFVRENKEENLDAAVRGTSGHTLLSERREIKSSILFVTGTALNCYAMMAPIATRCHSTTYL

SEQ ID NO: 121135 - protein, 394 aa, Glycine max
  Coding DNA Sequence Number=SeqID_4357
  Gene Ontology: Mol. function=protein binding; Biological process =protein amino acid phosphorylation
  Homolog annotation: Hit_ID=Q0PY41; Match level="QueryCoverage=88%, HitCoverage=58%, E-value=1e-114, Identity=56%"; Hit description =Leucine-rich repeat family protein
  Subcellular localization annotation: CTP_CleavageSite=24; ConfidenceScore=5.02e-01
MPNLATFQFLLLWTLFPCFAFIARAAQRGPFGMRISCGARHNVQTEPTTTLWYKDFGYTGGIPTNASTTSYIAPPLKTLRYFPLSEGPSNCYNIYNVPKGHYSIRIFFGLVAQARATDEPLFDISIQGTQIYSLKSGWTTQDDQAFTQAQVFLMDGSVSICFHGTGHGDPAILSIEILQIDDKAYYFGPQWSRGIILRTVKRLSCGFGQSKYGVDYGADPWGGDRFWQHIKTFGDDSDRRRSVETRIKKASRPPNFYPETLYRSALVSTSSQPDLTYTLDVDPNRNYSVWLHFAEIDNSVTAEGQRVFDIMINGDVAFKDVDIVKLSGDRYTALVLNTTVTVNGRTLTIALSPKNGSFAIINAIEILEIIMTESKTLSDEGTYSTLCFQLEFSY

SEQ ID NO: 121136 - protein, 213 aa, Glycine max
  Coding DNA Sequence Number=SeqID_4358
MSIPDSPFAEDVEIDPSLDDDDEEEEETEEEEEEEEEVEEEEVEEEEEVEEEEVEEEEVEEELEEEEVEEIEVEEELEEEEVEEIEVEEELEEEVVEEIEVEEEEEEGEQGEEQQVEEMEEEEEEEVEEEEEEEEVEEEEEEEQEQQQQEAVEEKKEEQQQQHQAEAAMEEQEEVPMEEKEEDKPAVPGSPLDADKDRKADPKTTVTGLHMAG

SEQ ID NO: 121137 - protein, 741 aa, Glycine max
  Coding DNA Sequence Number=SeqID_4359
  Gene Ontology: Mol. function=nucleic acid binding
  Homolog annotation: Hit_ID=Q1S7Q2; Match level="QueryCoverage=90%, HitCoverage=70%, E-value=0.0, Identity=59%"; Hit description =Tropomyosin; Zinc finger, CCCH-type
  Pfam annotation: Domain name=zf-CCCH; Domain location=258-283; Score =26.3; E_value=0.00011; Accession=PF00642.15; Description=Zinc finger C-x8-C-x5-C-x3-H type (and similar)
MDSNQEKTWRVGLCGWATQALKLQSEIMLDVPEKTLFGACLAQYCLQLRWAKGCPQLRQFFQLNLNYGQHMEFEGQDKNLGPVSSVAENPEVMPPSSTHCMEENNVMLKKSDIPTLKKEELPLKYEISSHPKSRENLTSVEVCRSQGLDVEVENAGSLLQKKTFRGYCVPGCNSKANLCGDNNIDSRARATKSSSDTVQDMVIGPLPRDCLVEDSNGGQNSRNKIMLSEMESRDDAKQMTSRTRNLSPSAEIKDGNKRPRIICDFFAKGWCIRGSSCSFLHIKDTGDNTDQEAEADSVSTYQKRQLKVEEGVRENVERSRMNEQEATPSWHPSQEKQKFPPRDNLFPDNRFPFSASDNYLSPNLSLNSTCADGMATPRNQHMYKGYTSTLLSHSPNSSLVTQFAASSMSLSHRILAQSGRSLPFSSSLGASNVDSLKFLNTDKEYLTSKSTFSGSGREDFSLVSSSRVPSYPAGYKSKICSYDWEPSVPFRPSFFITSMNVSSPGDLYDPLRDSIEIPNIGDGSLKASLLIHGSNVQVSSQVRTYGDSAVVGEHMSNLNDDKSSVSSHNKFCENEPNKNCLPHEKDCLPPETEITSGTYQGKMGMGQHTFGVADSTKNERDVTECDARRHGEGSGHKKKRVDRDKKNHEMDVDFQIDGSIQKESKALKFFRAALVDHVKELLKPAWHEGHLSKDAHIMIVKKSVDKVVSTLEPHQIPIMDTAKQYVSSSQVKIAKLVNKYL

SEQ ID NO: 121138 - protein, 137 aa, Glycine max
  Coding DNA Sequence Number=SeqID_4360
  Homolog annotation: Hit_ID=Q1S5N2; Match level="QueryCoverage=36%, HitCoverage=10%, E-value=3e-08, Identity=49%"; Hit description=Viral capsid/hemagglutinin protein
  Pfam annotation: Domain name=DUF659; Domain location=3-107; Score= -28.1; E_value=4.3e-05; Accession=PF04937.6; Description=Protein of unknown function (DUF 659)
MGMRRNVGACKKTPPKVSIVEGSLSEETSRKILKGSMFVKNVDASGSMKTEEKLFELLNSLVKEIGEQNVGQLIMDNESNYLLAVCYSFKFIDFGLGEIFRSQKGIRKMAKAKKAIAVNNSRSGHDSCGVGLSSNVV

SEQ ID NO: 121139 - protein, 422 aa, Glycine max
  Coding DNA Sequence Number=SeqID_4361
  Homolog annotation: Hit_ID=Q6ZLE2; Match level="QueryCoverage=78%, HitCoverage=47%, E-value=4e-34, Identity=29%"; Hit description=F-box protein family-like
  Pfam annotation: Domain name=DUF295; Domain location=338-387; Score =10.2; E_value=0.046; Accession=PF03478.8; Description=Protein of unknown function (DUF295)
  Pfam annotation: Domain name=F-box; Domain location=80-127; Score =35.9; E_value=1.4e-07; Accession=PF00646.23; Description=F-box domain
  Pfam module annotation: Pfam domain module=DUF295::F-box; Domain location=338-387::80-127
MGVEAGVEAFTRSNSVLQPLKRNFIIQLPSQNVGEAKEEVEIIHIIGSFRVLNGDSMILYNADNRRKTVAEVKTENLELQSWADLPAELLESILSRLILVDNIRASSVCKRWHSVASDVRVVNQSPWLMYFPKFGDCYEFYDPVQHKTLTFELPELNGSRVCYTKDGWLLLYRPRTHRVFFFNPFTRELIKLPRFEMTYQIVAFSCAPTSPGCVLFTVKHVSPTVVAISTCYPGATEWTTVNYQNRLPFVSSIWNKLVFCNGLFYCLSLTGWLGVFDPVECTWSVLAVPPPKCPENFFAKNWWKGKFMAEHEGDILVIYTCCSENPIIFKLDQTLMKWEEMTTLDGVTLFASFLSSHSRTDLIGIMRNSVYFSKVRFYGKRCISFSLGDYRYYPRKQCHDWGEHDPFENIWIEPPKDFSACM

SEQ ID NO: 121140 - protein, 44 aa, Glycine max
  Coding DNA Sequence Number=SeqID_4362
MLKVYFLIVEIEEELKNITKGDPPQRERSEKIGIKKKFKKMAQG

SEQ ID NO: 121141 - protein, 154 aa, Glycine max
  Coding DNA Sequence Number=SeqID_4363
  Pfam annotation: Domain name=Dabb; Domain location=46-135; Score= -0.4; E_value=0.064; Accession=PF07876.3; Description=Stress responsive AB Barrel Domain
MLHSLYKSKDDLKAYFAHPSHDSIIKGNMLPIINDLTDLITLSSFVVHVSFLKLKEDTDKDEVLGVARGIPKSSKHISDQVQLLGRISHWGEPRAMDSNEELENYQKDKVKDQIKSVVAAFKPPFDMSQDIDFSEDPHPESAQKDHLVSEGICA

SEQ ID NO: 121142 - protein, 156 aa, Glycine max
  Coding DNA Sequence Number=SeqID_4364
  Gene Ontology: Mol. function=protein binding
  Homolog annotation: Hit_ID=O49527; Match level="QueryCoverage=66%, HitCoverage=12%, E-value=1e-20, Identity=49%"; Hit description =Pollen-specific protein - like
  Pfam annotation: Domain name=Rep_fac-A_3; Domain location=2-108; Score=111.6; E_value=2.3e-30; Accession=PF08661.1; Description =Replication factor A protein 3
SMDISNPAALVNAELLHFYVGRRVRIVVQVVRSDGGVVIGKSTDEKQLVVKGSPPPAAPLTTFVEVYGLVNSDKSIGAEIWTNFGDAIDMDSYNKLCQLANGEFKHLFLAIQPSAAVIAFYIRFWPFMLQRQLMLVCTEFCETYLSNNSHLVKCIM

SEQ ID NO: 121143 - protein, 103 aa, Glycine max
  Coding DNA Sequence Number=SeqID_4365
MIVFEMFLLFTNVATYPSTGGRCKGSQVCLPREENAQSRHQHFFMENVEKTEMCGLRTLIMKGSRVVFTHGEEGVVDKSGAFVPTYPRFVGKKSYLRSSCVKR

SEQ ID NO: 121144 - protein, 160 aa, Glycine max
  Coding DNA Sequence Number=SeqID_4366
  Subcellular localization annotation: CTP_CleavageSite=62; ConfidenceScore=5.00e-01
MYATTRHDLGRGGNSKIENTTNKNGKANKNPILFTSSFDRASTHANKNEVNVQVPTDSTQVEANNQENEHEEPIVGRKRKKTSINVKKTFKKAIRSGYTFKKKEVYLRKQLAVINDTGNVGSSRTVADFGGSRGETGGAVTVGKIVPELKHRIDRICSNG

SEQ ID NO: 121145 - protein, 164 aa, Glycine max
  Coding DNA Sequence Number=SeqID_4367
MWLGCNLSHCNLSHCLSVEHSSIQGCLPKTNRRAFNVGCFIVEAKLHDESRLIQRCYDDNKDDDKKLKGQSKNEFKMFKIESRTLQDSRGKLKNTLRFKRKVDFKNQESRFKDQASKNQDQDSRLKIQESREDLIKISMKRFFQKLSSTWIFLKTCLPKSFYSL

SEQ ID NO: 121146 - protein, 115 aa, Glycine max
  Coding DNA Sequence Number=SeqID_4368
  Gene Ontology: Cellular component=ribonucleoprotein complex; Biological process=mRNA metabolic process
  Homolog annotation: Hit_ID=Q2HTF4; Match level="QueryCoverage=51%, HitCoverage=75%, E-value=1e-25, Identity=95%"; Hit description=TonB box, N-terminal; Like-Sm ribonucleoprotein-related, core
  Pfam annotation: Domain name=LSM; Domain location=49-108; Score=63.5; E_value=6.8e-16; Accession=PF01423.12; Description=LSM domain
MLTRPCRGGSGSWGRLEGRLHGGVVVANLWDDVGYACVWQRKEDWNRVRVLTFCYVKLNANRMVVGTLRGFDQFMNLVVDNTVEVNGNEKNDIGMVVIRGNSVVTVEALEPVNRT

SEQ ID NO: 121147 - protein, 502 aa, Glycine max
  Coding DNA Sequence Number=SeqID_4369
  Gene Ontology: Cellular component=intracellular; Biological process =signal transduction
  Homolog annotation: Hit_ID=O82458; Match level="QueryCoverage=87%, HitCoverage=87%, E-value=1e-174, Identity=73%"; Hit description=Rac GTPase activating protein 1
  Pfam annotation: Domain name=PBD; Domain location=89-135; Score=50.2; E_value=6.9e-12; Accession=PF00786.18; Description=P21-Rho-binding domain
  Pfam annotation: Domain name=RhoGAP; Domain location=152-292; Score =117.5; E_value=3.9e-32; Accession=PF00620.17; Description=RhoGAP domain
  Pfam module annotation: Pfam domain module=PBD::RhoGAP; Domain location=89-135::152-292
MTEVLQLPSSSSCSRRPCGGLTPNDGSHPIPLINAPTVEEQQSVEIEEEEEKERERERDQLSILTLLIATFRKSLIGCSTTTSSSSSMEIGWPSNVRHVAHVTFDRFHGFLGLPVEFEPEVPRRPPSASANVFGVSTESMQLSFDARGNSVPTILLLMQRHLYAQGGLQAEGIFRINAENGQEEFVREQLNRGIVPDGIDVHCLAGLIKAWFRELPTGVLDPLSPEQVMQSQSEEECAQLVRLLPPTEAALLDWAINLMADVAQMENLNKMNARNIAMVFAPNMTQQFFLTCLLQMADPLTALMYAVQVMNFLKTLVVKTLREREESIVKSNPVPDLNSFDDDGNHSNPEMLDKEDSENGNDCGDDDEDTVFVTAEPSQQSPSHLTEDGCETETESKSLPTSTENFISSGNRLVVDSCPCTFVSQICSLAIGLQDCGLATGQTKGDQAKICRSKSLQLSTYDTDKCSRKVIELPVSGAAEKNCGMAIIERINSRTELAEAWR

SEQ ID NO: 121148 - protein, 90 aa, Glycine max
  Coding DNA Sequence Number=SeqID_4370
MHQVVGGYTQVIIRTKTTSVDLDPCVRWQAEIPQVVVGGYTQVIIRTKTTFANPDLCVRRQAEIPQVVICRKTTSTDPDPCVRWQADIPK

SEQ ID NO: 121149 - protein, 85 aa, Glycine max
  Coding DNA Sequence Number=SeqID_4371
  Subcellular localization annotation: CTP_CleavageSite=18; ConfidenceScore=5.22e-01
MGSAYFFMFSWAFISFLRIAQNVSSLSTSISSTASILEDPVSQPILRREGDAGLAGASSKKGKCAESPPTFIRGKRWKNQKSYVL

SEQ ID NO: 121150 - protein, 90 aa, Glycine max
  Coding DNA Sequence Number=SeqID_4372
MGSLANSHCQWRVCCAKPRGIKTATRSGELLCRFKSPPVLASPWLALETAIQTGGLATVLQVAAAGAESQIASHGGDLAVLFASKKISGL

SEQ ID NO: 121151 - protein, 86 aa, Glycine max
  Coding DNA Sequence Number=SeqID_4373
  Homolog annotation: Hit_ID=O64580; Match level="QueryCoverage=89%, HitCoverage=66%, E-value=1e-07, Identity=39%"; Hit description =Expressed protein
MEKNNSLPKYSCSYSEFGFTERSNSYNFNGPIQKGSGFSAANDPELKRKKRIKAYNVFTVEGKLKTSVRNGFKWIKNKFGDIRNGE

SEQ ID NO: 121152 - protein, 48 aa, Glycine max
  Coding DNA Sequence Number=SeqID_4374
MWDLKPLRAHVWALGSCTLRCFTPAFLIQVANLLQRVSPIHQSSCPVF

SEQ ID NO: 121153 - protein, 137 aa, Glycine max
  Coding DNA Sequence Number=SeqID_4375
  Homolog annotation: Hit_ID=Q9FGF5; Match level="QueryCoverage=38%, HitCoverage=30%, E-value=9e-14, Identity=71%"; Hit description =Arabidopsis thaliana genomic DNA, chromosome 5, P1 clone:MVP7
MPKKRKSIATSLDEVDRTLYASFCTAANSLSQLYTHSMNHQKLSFNAGERHALIGGLCYVVVVVVVKYWVLLWGILKCGMFFCSDMLESEFVRRKKNFISGFLDNKREDHGLEQLMYLITFRLALECTIALGVGIGD

SEQ ID NO: 121154 - protein, 178 aa, Glycine max
  Coding DNA Sequence Number=SeqID_4376
MIKALERETKRAQKEEWGRNKFRGALWGSNSELKLRRAERDEPRVESMILEGKLKACQRSKRSLTEQLSRTEENMWAINCQYKEKLNLPASHEQRIEGEHAKVSALQAEKEARERVIDSLHGEAMMWMDRFAFTLNGSQELPRLLAKAKAMEDMYSATEEVHGLFDYCQHMIDKPCLT

SEQ ID NO: 121155 - protein, 73 aa, Glycine max
  Coding DNA Sequence Number=SeqID_4377
MKNEEMMVLQAQSLRAIEGGGDYAFADMAELCLVPDVVILPMFKVSDLNKYKGTTFPKNHLKMYCMMLVDEYY

SEQ ID NO: 121156 - protein, 89 aa, Glycine max
  Coding DNA Sequence Number=SeqID_4378
MDPQELTSKLCILGHRFVLNAEGAPWKLLRKDLTTLAQTWSMLSYSNLAPTSHTSDLNMDRARFFRWPSPTPRGSAFQLSSLHSTWPKE

SEQ ID NO: 121157 - protein, 580 aa, Glycine max
  Coding DNA Sequence Number=SeqID_4379
  Gene Ontology: Mol. function=microtubule motor activity; Cellular component=microtubule associated complex; Biological process =microtubule-based movement
  Homolog annotation: Hit_ID=Q2HTE3; Match level="QueryCoverage=100%, HitCoverage=57%, E-value=0.0, Identity=89%"; Hit description=Kinesin, motor region
  Pfam annotation: Domain name=Kinesin; Domain location=15-357; Score =570.6; E_value=1.6e-168; Accession=PF00225.13; Description=Kinesin motor domain
MSSKEKGVNVQVLLRCRPFSDEELRSNVPQVVTCNEYNREVAVSQSIAGKHIDRVFTFDKVFGPSAQQRDLYDQAVIPIVNEVLEGFNCTIFAYGQTGTGKTYTMEGECKRAKSGPNGELPTGAGVIPRAVKQIFDTLESQNAEYSVKVTFLELYNEEITDLLAPEELSKASLEEKQKKQLPLMEDGKGGVLVRGLEEEIVTSAGEIFTLLERGSSKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKHIKNKPEVNQKMMKSTLIKDLYGEIERLKAEVYATREKNGVYIPKERYYQEETEKKAMSDQIEQMGVTIETQQKQLEDLQNKYVDQIRQCSDLSNKLDSTQKNLNKTSKLLANTEEELKKCHYTLKEKDFIISEQRKAENALAHQACVLRADLEKAHQDNASLFLKIGREDKLNSDNRAVVNNFQAELAQQVGSLCNTVATSLSEQNEHLEGVKKLCHSFLDLHDK

SEQ ID NO: 121158 - protein, 396 aa, Glycine max
  Coding DNA Sequence Number=SeqID_4380
  Gene Ontology: Mol. function=microtubule motor activity; Cellular component=microtubule associated complex; Biological process =microtubule-based movement
  Homolog annotation: Hit_ID=Q2HTE3; Match level="QueryCoverage=99%, HitCoverage=39%, E-value=1e-149, Identity=71%"; Hit description =Kinesin, motor region
MLYACIRRALMLTWRNYHQLYPLMFLASEATEAGSIFDDLQRTLSTQQDELELFAGKLRSRFNLSLEQIKDISDRSQEFVDKLFEESKKLEDYASQADQMQMKSIDEFKKAYEEQSKSDTEKLIANMTSLVSDHIRRQMDLVDSKLVDLRESGIKNKSFLDGHVSSMGDIVTNAKRKWQAFCVQAEKDAKDTADDSAAKHCRMEKLIQRGVHTAQSAFEHTKKTHEAVNEMGTKHISATESIVRNATDNNVQHVVEVHSARVTAEEDVAKNSEDLLEQLDVTSAQERESISGVLNVVRTHANTLETLREDHNGQATSIEHTTSKTFQQQYRDYEASGTTPIRCEPDVPTKGTIESLRSLPMEALLEEFRENNPYESNDVKELKPSLIPRSPLTQLN

SEQ ID NO: 121159 - protein, 113 aa, Glycine max
  Coding DNA Sequence Number=SeqID_4381
MISCLYVEKITILSEEQERVNEPVSHGPASERQFPAQQFHILQSSVETQGIDRRRETVEAEEYSQQMAERGHGMYYMPQTFAQYPTQMYQYPFQGHHTDTSASQQSFGGVVET

SEQ ID NO: 121160 - protein, 335 aa, Glycine max
  Coding DNA Sequence Number=SeqID_4382
  Gene Ontology: Mol. function=RNA-directed DNA polymerase activity; Cellular component=chromatin; Biological process=chromatin assembly or disassembly
MVGNVQHLECSCLCTNIPVEIQTAKFTVDLYVLPILGANIVLGVQWLKSLGHVLTYYNTLNMQFFHEGRLVELKGDNDANLRLLSSPRFHHLCRRQGDEFCFHITMLSNDTPSLDASSFPHEIQTLLIKFDALFQLPQSLPLARATNHHIHLLPQTTPVNDGSWRFCVDYRALNAVTVKDRFPIPTIDELLDELGGGHYFSMLDLLQGYHQIRMHSADIPKTAFHTHHSHYEFKVMPFGLCNAPPSFQATMNILFGPYLRQFIIIFFDDILIYSGVSGIPSITHGGRTRGFEGGSYSAMATHVAFDRLKEVLSIALILALPDFNKPLTLETDALG

SEQ ID NO: 121161 - protein, 94 aa, Glycine max
  Coding DNA Sequence Number=SeqID_4383
MLAPRIGQPQLRDQLLLNEVMSASSVDEEDNLVVTATFLAKRALCAKPECHSIKAKLSAACCAKPVLCFSEVEQSAPCCAKLKSSSVLEIVDLG

SEQ ID NO: 121162 - protein, 126 aa, Glycine max
  Coding DNA Sequence Number=SeqID_4384
MLSIVVGEPSVCRTLYNEQENKNSIRRELILLRNLRVWLRQNALPRTPWCSVQIQEKCLTKVAPQCSAHKNYKAYQGPTPWCRWHNLIKISTRVLSLDVDGAILLNALSRFYPSMQCSNVSKLVLR

SEQ ID NO: 121163 - protein, 82 aa, Glycine max
  Coding DNA Sequence Number=SeqID_4385
MDSVFKPCWSILLLMHGRWVLALGHVGILQHILFYLDSSVSHMHSVSVTEDDGALLRVPLMLALQRVPLPPTNHLSSYQLGD

SEQ ID NO: 121164 - protein, 183 aa, Glycine max
  Coding DNA Sequence Number=SeqID_4386
  Subcellular localization annotation: CTP_CleavageSite=26; ConfidenceScore=5.13e-01
PLPSCSPPRGRDLVPPICAPACTSIRCGSRHPFSQKVKTQGTLSSSDMELLPNANAKHGASSFFDVMARAWALGQFGWPERGNFDELNHKVETLDGQVKVFENEKVDKELKLKEVEDQRQSDRDEIKKLRKSLEVASHMVDDEKLAKLKLEATIKQEVLLMCLRIETCVAESREVGESEQKKD

SEQ ID NO: 121165 - protein, 136 aa, Glycine max
  Coding DNA Sequence Number=SeqID_4387
SGRLPEFFPDEPLLPESSRKTFSGSLPEEVFFRKTFGYFRKNTSSGNFPENVLPELPEEPLTGLPEHSAVSLCSPFFPASSPLVFYRPLLSFSTLKGVRETNLVRGEEEDDVRACLAGEEEAVRGEEEAVRGRNEE

SEQ ID NO: 121166 - protein, 133 aa, Glycine max
  Coding DNA Sequence Number=SeqID_4388
MSSTKGCLRVPTTKLVDVKLCVNVRVHYPPPSIEKGRSYEGTPTLNKNMSWKASKTEHKIPTRSEPRLPLNLYNKAHTIRREKTNTKGEQTTPWWEITPNPCDSYMEVFPTLVAEKYDLFCIKKYTTIINREK

SEQ ID NO: 121167 - protein, 54 aa, Glycine max
  Coding DNA Sequence Number=SeqID_4389
MEVRPPGGCAEAEWFLEKKCESHRLIAKAEWFLWEVCSIIDGWLRGLYVKSHIL

SEQ ID NO: 121168 - protein, 207 aa, Glycine max
  Coding DNA Sequence Number=SeqID_4390
  Gene Ontology: Mol. function=DNA binding; Cellular component=nucleus; Biological process=regulation of transcription
  Homolog annotation: Hit_ID=Q9SXQ0; Match level="QueryCoverage=83%, HitCoverage=74%, E-value=2e-60, Identity=65%"; Hit description=NAC -domain protein
  Pfam annotation: Domain name=NAM; Domain location=4-136; Score=169.8; E_value=6.9e-48; Accession=PF02365.6; Description=No apical meristem (NAM) protein
MGNMPPGYRFYPTEEELILFYLHNKLEGEREDMNRVIPVVDIYDYNPSQLPQISGEASMGDTEQWFFFIPRQESEARGGRPKRLTTTGYWKATGSPNHVYSSDNHIIGIKRTMVFYSGRAPNGTKTDWKMNEYSAIKGEPSSSISNKAVPTLRKEFSLCRVYKKSKCLRAFDRRPPPRRDVVSYSGAQNVEEQQKGSTLYDYHHKIM

SEQ ID NO: 121169 - protein, 81 aa, Glycine max
  Coding DNA Sequence Number=SeqID_4391
  Homolog annotation: Hit_ID=Q8LM84; Match level="QueryCoverage=96%, HitCoverage=5%, E-value=3e-08, Identity=36%"; Hit description =Putative retroelement
MESQHPLEEVNLRTEGNRKPTYDYGDMPRLIRELVEHKLPICEGKKLVKQAPRRFYPNVMEAIKAKIERLLKASVTPFGEF

SEQ ID NO: 121170 - protein, 235 aa, Glycine max
  Coding DNA Sequence Number=SeqID_4392
  Homolog annotation: Hit_ID=Q5Z918; Match level="QueryCoverage=59%, HitCoverage=56%, E-value=2e-36, Identity=54%"; Hit description=EREBP- 4 like protein
  Pfam annotation: Domain name=DUF862; Domain location=18-148; Score =122.3; E_value=1.4e-33; Accession=PF05903.5; Description=Eukaryotic protein of unknown function (DUF862)
MEKLRCQCNEQQACTSWEGVKLLVDQAHNNLSFRNLFQEPKGKEYGFGAHDFPTSGVFEVEPRKCPRFVYRCSVTLGHVNMHPSEFRTFIESIANEYHGDTYHLISKNCNHFTNDMSHRLNGKRIPGWVNRLARLAVKLCLGDLLVMGSNPETASLHMQGCLLPECVEVTTVKQLPEYHECSVLAEDEIIESLSTTSPCGSQSTSGLDDDQEKRLLSPLANKTDNLSFVKEAPLK

SEQ ID NO: 121171 - protein, 58 aa, Glycine max
  Coding DNA Sequence Number=SeqID_4393
MQSQLDDSVNTVYRDSIFMRLPASFGNLQVGINMTGCTGDTSFFIGKYLIHFCSSKLP

SEQ ID NO: 121172 - protein, 198 aa, Glycine max
  Coding DNA Sequence Number=SeqID_4394
MATMMEAMMSMKKIMEVNAAIVAATSAVAKHTLPPYDLPPNYTPPNVAHTPDENVNKSTPTLIESQQPQSDHAHISQPMGETYEIPHHNLADFESRLEYATEGQAVGGVPPPTTTLSFCMPDVIIPPKFKVSEFDKYNGTTCPKNHLKIADFHPLAKPIFCLSKPFAERNTPLAEREEESGRRMSCACSRGGGDILAA

SEQ ID NO: 121173 - protein, 93 aa, Glycine max
  Coding DNA Sequence Number=SeqID_4395
  Subcellular localization annotation: CTP_CleavageSite=37; ConfidenceScore=5.27e-01
MASIIVAIYSFMASMLAFICPCTSSISLITLALAQVRQRSDVTRFIFCPNFRKPVTSILDLDLMNLFLKACAWFKPHNPRNSKFDCQYFDHIS

SEQ ID NO: 121174 - protein, 96 aa, Glycine max
  Coding DNA Sequence Number=SeqID_4396
MVCTNQADMTGRLLAGSLAFECRIMHYLIVRILLPRSSNLAQRDGSWVKKDAPVQAAEDHSLSPHPQRDDSSSLMHNILDKLDGLHTFVGDRFDLC

SEQ ID NO: 121175 - protein, 137 aa, Glycine max
  Coding DNA Sequence Number=SeqID_4397
  Gene Ontology: Mol. function=RNA-directed DNA polymerase activity; Biological process=RNA-dependent DNA replication
  Pfam annotation: Domain name=zf-CCHC; Domain location=100-117; Score =27.8; E_value=2.5e-05; Accession=PF00098.13; Description=Zinc knuckle
  Pfam annotation: Domain name=zf-CCHC; Domain location=80-97; Score =23.2; E_value=0.00015; Accession=PF00098.13; Description=Zinc knuckle
  Pfam module annotation: Pfam domain module=zf-CCHC::zf-CCHC; Domain location=100-117::80-97
MEFLQLKQGNMNVAEYATKFKKLVRSTCPMKNNMNGPQHQGKPYLTSPKQYGNPPNNRRTIAMGFASGSGRKPTTFSTHITCYKCGKPRHISANCAYKGTTCFNCRQKGHIQRDCPYPKKEQNDGGLNDQTGHLKAT

SEQ ID NO: 121176 - protein, 187 aa, Glycine max
  Coding DNA Sequence Number=SeqID_4398
  Gene Ontology: Mol. function=ATPase activity, coupled to transmembrane movement of substances; Cellular component=integral to membrane; Biological process=transport
  Homolog annotation: Hit_ID=UPI00005F7440; Match level="QueryCoverage =99%, HitCoverage=29%, E-value=5e-38, Identity=52%"; Hit description =COG2274: ABC-type bacteriocin/lantibiotic exporters, contain an N -terminal ...
  Homolog annotation: Hit description=double-glycine peptidase domain
KNQLHVIDERARDLFPAVSARAQFADESVSHFDARLAYRGVAFAYDAGQPVLRDLSLTLERGECIAICGGSGAAGGADAGWARTGKCRRAAAVLPAKPGGHSVQRLGVAEHHAVRAVGAGPATAGGTGVAQFGAGGRGGAAAGGRERPGAGEPCRAVAGAAAASVAGARHVQPLPGVGAGRTDGESG

SEQ ID NO: 121177 - protein, 121 aa, Glycine max
  Coding DNA Sequence Number=SeqID_4399
  Subcellular localization annotation: CTP_CleavageSite=26; ConfidenceScore=5.21e-01
FSPSRCISPTNEAKSPFINRNNLPLRGVGVNRVLTYFGSIERKENFVPTLETFEEVPTSTTFDEVVACEVMQAPLELVGLGSSSSMDSFASWKINGSGMEKEEREETPLQGEDESRRSSPP

SEQ ID NO: 121178 - protein, 107 aa, Glycine max
  Coding DNA Sequence Number=SeqID_4400
  Gene Ontology: Mol. function=structural constituent of ribosome; Cellular component=ribonucleoprotein complex; Biological process =translation
  Homolog annotation: Hit_ID=Q9LX88; Match level="QueryCoverage=89%, HitCoverage=75%, E-value=6e-48, Identity=95%"; Hit description=40S ribosomal protein S15a-4
  Pfam annotation: Domain name=Ribosomal_S8; Domain location=5-106; Score=104.2; E_value=3.9e-28; Accession=PF00410.9; Description =Ribosomal protein S8
MVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQVIVFGLFYF

SEQ ID NO: 121179 - protein, 78 aa, Glycine max
  Coding DNA Sequence Number=SeqID_4401
  Subcellular localization annotation: CTP_CleavageSite=52; ConfidenceScore=5.20e-01
MAALFHFSLLFTVLLSSILLSNHSVKCDDHVFFFQANKSFSVLYFSPFLLVLASVSNGKSELDLFGRTIDLTSPNLWG

SEQ ID NO: 121180 - protein, 95 aa, Glycine max
  Coding DNA Sequence Number=SeqID_4402
MLTQGFQKFYGSITEATEAPETIFQKRGGACRPVASSLSNPTSKIALRIAQQCFFLTSRMSRNITDYLTMSVKYLEVVKRRLHATKQWSPDEIRV

SEQ ID NO: 121181 - protein, 139 aa, Glycine max
  Coding DNA Sequence Number=SeqID_4403
  Homolog annotation: Hit_ID=Q1SKD7; Match level="QueryCoverage=97%, HitCoverage=36%, E-value=8e-13, Identity=30%"; Hit description =Ankyrin
MAPRKLSLKRSRKDVAVEGTSATPEFDSHRFRSAEHQQRFKAIKGWSFHRERRVQLRDDEYTDFQEEIARRRWTSLVTPMAKFDPDIVLEFYANAWPTEEGIRDVRSWVRGQWIPFDADALSQFLGYPLVLQEGQECEY

SEQ ID NO: 121182 - protein, 79 aa, Glycine max
  Coding DNA Sequence Number=SeqID_4404
MEHTNLGIPRSCGSACPRTLGSRGSTGPNKDRRKSLKVYQSHTVRGEKVASAQDFVGHQRERTTLGCGFLFLGDNSVLF

SEQ ID NO: 121183 - protein, 128 aa, Glycine max
  Coding DNA Sequence Number=SeqID_4405
  Subcellular localization annotation: CTP_CleavageSite=48; ConfidenceScore=5.16e-01
MHHSHASMLIFLFTLVALLTAFFPRNQNCNHCNQKEITRFTTPLLRARVMSEIEEMQEQMKVDMKAMKEQMAIMMEAMMSMEKMMEVNAAIVVAASTATKVDPAHPSGLNQVNPPVSDIVGQGGEALG

SEQ ID NO: 121184 - protein, 226 aa, Glycine max
  Coding DNA Sequence Number=SeqID_4406
  Homolog annotation: Hit_ID=UPI00005F760D; Match level="QueryCoverage =45%, HitCoverage=70%, E-value=9e-32, Identity=71%"; Hit description =COG0668: Small-conductance mechanosensitive channel
HLWAVGAYAPQNGGINRRLEADVGQQVGEVAQHELAARAAARRANKQIAIAAVGPGDQDVDRNRQQARREGLLKAHAGDQHFYRHAGDKAVHHQCERIGSGATPELWPYSAIDSPGAEPWRARLASGYRTEIAELKNETWLAEGSNELINRQFVSSQNDQRNIAKALALWLDKVFIPSVNSIVWEFVGNVPWSDDGQPRQQRAARRTYPISGIAQRGIARPNGLYH

SEQ ID NO: 121185 - protein, 186 aa, Glycine max
  Coding DNA Sequence Number=SeqID_4407
DKELRGSNNGIIDDYHKWLKAQTQELVWLPKLKASSEEEAETPEESEEVQALKAKLERVQAVKEKFKMKAIKWGRNKFRGALWDSNSKLKLRRAETDQSRVEGMILEDKLKACQRSKRSLSEQLSRTEENMWAIIDQYKEKLSLAATHEQRLEDEYAKLPSLLAKAKTMADMYLAPEEVHGLLNYC

SEQ ID NO: 121186 - protein, 77 aa, Glycine max
  Coding DNA Sequence Number=SeqID_4408
MCLAIRRNLEGNLSCRHVLSASSAYSAIRLPPSRLSASLALSDYSLTRAKRENGAKRDVEELPCYGRKDPQLGILTE

SEQ ID NO: 121187 - protein, 110 aa, Glycine max
  Coding DNA Sequence Number=SeqID_4409
MGLDNVGEGSSRFRVGMEPPTTPSEEQPSLVTTIMPPSSQKAVGRGDGEEALLWNKHRHGGETPSFPSFIIGFEWLAKPGDTRKMTLMACKEDEYPFMRPAPGGPPSMST

SEQ ID NO: 121188 - protein, 121 aa, Glycine max
  Coding DNA Sequence Number=SeqID_4410
MVSRHHDDAYSTAKLLHRHPFPRPFERKEALLSRGRFHPHTEPGAALANIVQAHQPFKRGGPIAKTSQGTSSNEEFPMGNTSRSTSGWRIEPQESLLPIPNTESEIVDIAGKRGVPGVKVK

SEQ ID NO: 121189 - protein, 535 aa, Glycine max
  Coding DNA Sequence Number=SeqID_4411
  Gene Ontology: Biological process=regulation of GTPase activity
  Homolog annotation: Hit_ID=Q9FVH3; Match level="QueryCoverage=90%, HitCoverage=67%, E-value=3e-41, Identity=29%"; Hit description=ARF GAP-like zinc finger-containing protein ZiGA4
MPFFPCKRTIGFPDICCGSPGIHEDEIRRASSYHSYSQSPPYDYQYEDRRYGKQVAALTRKPGSDKARYKGKMSSIIYSPDRFSDHVYDDRFANERSGPRISDFSVSSGGEQLKSDVQSPNFHKDIKISSPSYQRRSGTSSSEDVWSQARNASLEINANAKRDVDGIRPPQRTASAQSTDNKFSSLRSYNSGSLADFFSEPVQASEPLQNRAFGIPRPPGPTRSVSMDFSKAPLESASSVDPFQFPAAPSAAPTVDLFQSSVSSAAPSFNENQLTQTSQLASIDFFADFSEQPSTVTSDGKALGLSVPKNKGWATFDMPQSTSSAAQVEIPATVPSSAKSIEERFDPFSTSHANVQQWPSFEISSVNAPSSVISNLRHDGVWNGEEQVSAIAENTKPWNAFEDSGDHHHLVDGLSQGLQLHNFPSADNHILGLIESEGSNEDEVKGIAPVGRFDNHDIPSHVSGSAYPPPMLPPMGDIQHNETKSKSTNPFDYPYETDVDHNNMELLHLKPFETPPQLKKSEVFVSRNDIVFPGI

SEQ ID NO: 121190 - protein, 148 aa, Glycine max
  Coding DNA Sequence Number=SeqID_4412
MGDFENLTISPNIELLPQTQPSLLQVKRKKERKKERKEEAEFGYQNYLIHLRFGGSFMRPLIIFSFLSSSFLLPISEIPNQKHRNPRNCKRNQSERKEKSQIFEFRNRDRKFSTTENRETVVAAFDLGFWGFLNWRKVEEDEERKNAL

SEQ ID NO: 121191 - protein, 161 aa, Glycine max
  Coding DNA Sequence Number=SeqID_4413
MSGKGLQHVRKSLSQYQRLRACLEIKWDTNWERGFLNSKTSTSLPLGTLKRWQRHSKRHDFGYTAVVGAVGPLRLQVLHDGKQNVRVVAGRSSRRDEVVKAIAGALGFWRVRERVFTARLYKLQNLRRCLMTPTLYVTISRTVYLQAPSLMTSIKTTTAGL

SEQ ID NO: 121192 - protein, 116 aa, Glycine max
  Coding DNA Sequence Number=SeqID_4414
MEAMKEQMATMMEAMMSMKKIMEVNAAAVTATNAVAKAPQFCPQTQPLHFTVGRVPPAMVEREKLHHIEERLRDIEGGGDYAFADMEELCLVPDVVIPLKFKVSDFDKYKGAPRIT

SEQ ID NO: 121193 - protein, 98 aa, Glycine max
  Coding DNA Sequence Number=SeqID_4415
ITTHGSKLVGGGCMKENAIHEGLKKGREWRIALSNHYAWLQTRGWRMHERKRNSWGSEKGRGWRIALEGAHESIMKYGSKLLGGGCMNVIAIHRAPKK

SEQ ID NO: 121194 - protein, 143 aa, Glycine max
  Coding DNA Sequence Number=SeqID_4416
LGRIDGDPVLRETRIWATWEYVSSVGGGQQGMETLGTSGGVLLPKTKLDQSRPNPGIVGDWNTVEASGNRLPACVIDYTEGWVTGNRLPVHPDEPARTLQRTVEWILPTPTPYRLVEPVQVIEVTSSEEDPEEDLEELPPKPA

SEQ ID NO: 121195 - protein, 92 aa, Glycine max
  Coding DNA Sequence Number=SeqID_4417
MGPKSTLRLMRTLGPSLASLVQSTWSLLSNVLAGNHEGRIEGSVLYRILELSFEDSTSISFPFLAMVLRQAVTSRGDHRWSLVVEGEVGGVG

SEQ ID NO: 121196 - protein, 112 aa, Glycine max
  Coding DNA Sequence Number=SeqID_4418
MTGPLDELIPCFLIRVDPWVLVPIALRGLHALTFRGLHVLALRNTRPHLQRATCPHLQRTTRPRLEDYTSSPSEDYTSSPSEDNTSSPLEGYMPSPSEGYTPSPSVDYTSSP

SEQ ID NO: 121197 - protein, 324 aa, Glycine max
  Coding DNA Sequence Number=SeqID_4419
  Gene Ontology: Mol. function=protein phosphatase type 2C activity; Cellular component=nucleus; Biological process=protein amino acid dephosphorylation
  Homolog annotation: Hit_ID=Q2QYR8; Match level="QueryCoverage=96%, HitCoverage=51%, E-value=8e-75, Identity=47%"; Hit description =Protein phosphatase 2c, putative, expressed
  Pfam annotation: Domain name=PP2C; Domain location=48-319; Score =42.7; E_value=1.3e-09; Accession=PF00481.12; Description=Protein phosphatase 2C
MGGCCSHDVSVRGKVESEMGDREYEYEHENDVSFEQGGALVRLRGSSRFVSMYAQQGQKGVNQDAMTVWEDYTGEKDVIFCGVFDGHGPLGHKVSQFIRDNLPSKLSAAIEISQQKTIKYYDANDAETGSFDDAYDDNNHNMSLASWEGCLLKSFDEMDEYLAQEINTDSYCSGCTAVTLIKQGGQLIVGNLGDSRAVLCTRDRDQLIPVQLTVDLKPDIPSRSWFWLQFPSITSPSSETSRIVNCEGRVFAAEEEPDVYRIWMPDDDCPGLAMSRAFGDFCLKDYGLISVPDVFYRKITPQDEFVVLATDGVSNNITVSPLHT

SEQ ID NO: 121198 - protein, 128 aa, Glycine max
  Coding DNA Sequence Number=SeqID_4420
  Gene Ontology: Mol. function=protein phosphatase type 2C activity; Cellular component=nucleus
  Homolog annotation: Hit_ID=Q1S458; Match level="QueryCoverage=71%, HitCoverage=18%, E-value=8e-18, Identity=47%"; Hit description =Protein phosphatase 2C-like
VWDVLTNSEVINIVASAPRRSIAAKLLVKRAVRAWRYKYPGSKVDDCAAICLFLGEQSVLLNSQSYMSRKSRQRSKHLNRTKSTRNEDNETVYGKIGVELERANSLSKLPRLARGMSKRQSSKYYTPS

SEQ ID NO: 121199 - protein, 59 aa, Glycine max
  Coding DNA Sequence Number=SeqID_4421
VWEEAGGCGGTGACSLGAWGRAWCRAPPVAPSGRALPDTPASGAAAPSCAAPYHVSRTP

SEQ ID NO: 121200 - protein, 113 aa, Glycine max
  Coding DNA Sequence Number=SeqID_4422
  Gene Ontology: Mol. function=nucleic acid binding
MVDLTTKLNAMEMEVSESFLVQFILNSFPAEFGQFQVNHNTLKEKWNFQEIKAILIQEERRLKKMKDNSIHLMAHDGASTSKIKLGKKGKGKFNLRVKDGGVGIPFDLNHKKN

SEQ ID NO: 121201 - protein, 84 aa, Glycine max
  Coding DNA Sequence Number=SeqID_4423
  Gene Ontology: Mol. function=nucleic acid binding; Cellular component= mitochondrion; Biological process=DNA integration
MESNYSKKWLNEMKEELKSMDDNKVWDLVEFPKGNIERYKARLVAKGFTQKDGIDYKETFSPISKKDSLRIVLALVAPYDLKLH

SEQ ID NO: 121202 - protein, 87 aa, Glycine max
  Coding DNA Sequence Number=SeqID_4424
PIEHPTQMIEESTLEIVQKKDESQVRKALRNKWVLKLKNEENNPNPRYKAHIVVKGCNQKKDIDFEEIFSLVVKMTSIKAILGLAAK

SEQ ID NO: 121203 - protein, 163 aa, Glycine max
  Coding DNA Sequence Number=SeqID_4425
  Gene Ontology: Mol. function=nucleic acid binding; Biological process= DNA integration
MVSKLKKSIYELKQAFRQWYLKFNDTIMSYGFVENTVDRCIYMKKGYINKVSKRFRMKKCSTGIVPIQKGDKFIHMQCPRNDLEQKKMKYIPYASVVGSLMYAQPCTLSDISFVVGILGRYQSNLGIDHWKVAKRVLRYLKGTKDYMLTYRRSDHLEVIGYSN

SEQ ID NO: 121204 - protein, 66 aa, Glycine max
  Coding DNA Sequence Number=SeqID_4426
  Subcellular localization annotation: CTP_CleavageSite=33; ConfidenceScore=5.13e-01
PLFPRRLVQGATGRAQPSGRALPDAPASGALLCCSLVRRAVPRVAYSMEAPVWETLCNKKNKPPSK

SEQ ID NO: 121205 - protein, 75 aa, Glycine max
  Coding DNA Sequence Number=SeqID_4427
  Subcellular localization annotation: CTP_CleavageSite=80; ConfidenceScore=5.09e-01
MKKNANNLTFRKTFFRKLLRPIPEEVLPENTSGRPSSGMGLSNFRKKFFRKWSFRTFLLLCLKFLPDTVFTVFLL

SEQ ID NO: 121206 - protein, 155 aa, Glycine max
  Coding DNA Sequence Number=SeqID_4428
  Subcellular localization annotation: CTP_CleavageSite=28; ConfidenceScore=5.05e-01
MVKGTTSGSGKSQTFATSGLAGCLDVVQANQNAYTASQDNLVGKVLVKKAGTNSAKTDDVAHQVFYNLSECSTESESSPKVNLFKDNRNPSKGFGMKFSSPSSDDEVLLEETDLQPLEEAWGHSLIGYVASRFPGKKALLDYCQKWGVKFLYSSS

SEQ ID NO: 121207 - protein, 116 aa, Glycine max
  Coding DNA Sequence Number=SeqID_4429
MSWPLIPRPPIQVVSCSTMIIRVNGWMKEVVARIVSFDTIDCKKLNKIREERMQTQFYTGSAITRAYVQYSSNPLEISTIFVKSITKSEPHRDNPSLVFRNPLQQETHSLLTNLIE

SEQ ID NO: 121208 - protein, 74 aa, Glycine max
  Coding DNA Sequence Number=SeqID_4430
MALSHTSTSTSCQEEKGRDCDSPIESSVCDDLCLTKERTFDHKLVSRNSSGQGLPYAHEGLMQSYPVRALDRRL

SEQ ID NO: 121209 - protein, 190 aa, Glycine max
  Coding DNA Sequence Number=SeqID_4431
MEKTMKNKKLKACRPWIFFINGVICFLKINDSGIEKEERLKTAQSRQKSYQDKRRKDLKFEIGDHDCNRNIHALTVGIYQITLLDISLSETSVLSATPTQEELRSAGNVSLNAKSGFLLTAFLKNFRPKTLTPPPPPPTTISGHHHKPSLIVAGPPHGDERFNRSKILRIQLEDLVENKLSILSFVVSLR

SEQ ID NO: 121210 - protein, 121 aa, Glycine max
  Coding DNA Sequence Number=SeqID_4432
SRISARQRDSNVNMTDLVSAEDDRAKKNVFTDNHLGISARQRDSNVSMTDLVSAEDDNVYTDNHSRISARQCDSNVSMADLVSAEDDAAKKNVYTDNHSGISARQRDSNVSMTDLVSAEDD

SEQ ID NO: 121211 - protein, 236 aa, Glycine max
  Coding DNA Sequence Number=SeqID_4433
  Gene Ontology: Mol. function=carbohydrate binding; Biological process= carbohydrate metabolic process
  Homolog annotation: Hit_ID=Q1SPM1; Match level="QueryCoverage=81%, HitCoverage=38%, E-value=1e-46, Identity=50%"; Hit description =Glycoside hydrolase, starch-binding
  Pfam annotation: Domain name=CBM_20; Domain location=85-175; Score =21.1; E_value=9.6e-07; Accession=PF00686.10; Description=Starch binding domain
MALNTSCSKAIVDMLGTHVPKCAIDVSNTPRFSLSQNDKKGCNLGFPKLVQNKGLFPLHAVPSKTMVDLDNLVLQSQEKPKESKTINVKFQLQCNCNYGEQFLVVGNDPMFGSWNPEKAIPMTWSEGHVWTAEMGVPVGKYQFKIILKTAEGEIVWQPGPDRNLHTWEAMNRITVCEYWDNAEQQKVTEDDEVPNTMEEDQLARTNKELQMESEMPNFAENLGNPKEKLKSRQPKC

SEQ ID NO: 121212 - protein, 285 aa, Glycine max
  Coding DNA Sequence Number=SeqID_4434
  Gene Ontology: Mol. function=double-stranded RNA binding; Cellular component=intracellular
  Homolog annotation: Hit_ID=Q5YDB5; Match level="QueryCoverage=57%, HitCoverage=19%, E-value=3e-36, Identity=53%"; Hit description=C -terminal domain phosphatase-like 2
  Pfam annotation: Domain name=dsrm; Domain location=81-144; Score =54.5; E_value=3.5e-13; Accession=PF00035.15; Description=Double -stranded RNA binding motif
MQALLFLICRGILLHLSLSYHRGTLIFPSSAQFLLAKTYPGCSSNLTSLSEEDGISQNHATSNSKDFQNEAGKVNFLPSLSIQVLQEIGRRCNSKVEFKTILSTSKDLQFSVEVLFTGEKIGVGMARTRKDAQQQAAENALRSLAEIISKHGSREKYVAHVEPQCRAVDKDFDKLSLGRDNGFLWDVVNLESSELQPEDGVPRENASEALDAETRSSTPNAINQQMDKRVSSPRSFKKQDLPLVQQLENWPSEFWERHIIVLYAKGFDVICSCNISAVAVVDMLR

SEQ ID NO: 121213 - protein, 62 aa, Glycine max
  Coding DNA Sequence Number=SeqID_4435
MEQPANNHNEDIHLEDYGLRSLRCKSTMPRKLLPFSARMLTFGRHRGCDNLRLTYRKKGRLN

SEQ ID NO: 121214 - protein, 330 aa, Glycine max
  Coding DNA Sequence Number=SeqID_4436
  Gene Ontology: Mol. function=double-stranded RNA binding; Cellular component=intracellular
  Homolog annotation: Hit_ID=Q5YDB5; Match level="QueryCoverage=99%, HitCoverage=42%, E-value=2e-74, Identity=48%"; Hit description=C -terminal domain phosphatase-like 2
MAERDYALEIWRLLDPGAHLIGSKQVLNRVICVKSGSRKSLLNVFQDGVCHPKMAMVIDDRSKVWEDKDQPRVHVVPAFTPYYAPQAETANAVPVLCVARNVACNVRGCFFKEFDESLLQRIAEIFFEDDIGLLPLPPDVSNYLMSEDVPNGNANAPISEGINGAEVERRLSQPDDKFSVDLVTRPMTNSVEFRHETSQPTAEPGLLGPPVKHDGNSVDRDYDMRKGLLGMRHGPDIRGQISAEPPLISRPPNQTSPSLIQPFGGGLVEDDIASRTQTNSWPSASFKESNVIKFDKHQAQQKPFSHSVIGSSPNVLPPQASQVKTEEVCQ

SEQ ID NO: 121215 - protein, 102 aa, Glycine max
  Coding DNA Sequence Number=SeqID_4437
  Gene Ontology: Mol. function=RNA-directed DNA polymerase activity; Cellular component=chromatin; Biological process=RNA-dependent DNA replication
MVKKPNGKWRMCTDYTNLNRVCPKDTYPLSNINRLVNRVAEHMMLSFLDAYSDYNQIRIDPKDEEKLTFITKFCNKVIPFGLKNIEATYKHLMEKVFQGQLG

SEQ ID NO: 121216 - protein, 268 aa, Glycine max
  Coding DNA Sequence Number=SeqID_4438
  Gene Ontology: Mol. function=RNA-directed DNA polymerase activity; Biological process=RNA-dependent DNA replication
MTLNIRNLDPPMVMHHLITALRSRPFVNNLCKKPTSDLDELRMRADKYTQMEELAEYRDQFGSMSCQPKKVMTNSTLARSVTMEGGISRRESHVLPNTFLLPLARIMDQALFVNIFPFPRKPTPSKVDYSKRCWYNRNRGHSTEECGALKDKIEEFIKLAHLKEFIHKPRMYQSEGRNKVEYSRGKDQEWARRLERQKSQSCSREKEERPLNQPRWITNTIIRGGATAFTRKKHLLQVRSVNMISRHQVPNMPPITFTIDDFKAIDLV

SEQ ID NO: 121217 - protein, 295 aa, Glycine max
  Coding DNA Sequence Number=SeqID_4439
  Gene Ontology: Mol. function=double-stranded RNA binding; Cellular component=intracellular
  Homolog annotation: Hit_ID=Q5YDB5; Match level="QueryCoverage=88%, HitCoverage=33%, E-value=3e-93, Identity=63%"; Hit description=C -terminal domain phosphatase-like 2
MSRLGFKHEVYDGDKHVGELDVIPLSSSSTTTPFHNSFRFPNNEIRIHHFSAKSERCPPLSILQTVAAFNVRCKLDSSVATEQKELIAIHASCFYEMKTAVVVVNDEEIHLVSMPSKRKKFPCFWCFAVPLGLYDACLAMLNLRCLAIVFDLDETLIVANTMKSFEDRIEALRGWLLRETDPLRVQGMSSELKRYLEDRLLLKQYAESDTVVDNGKVYKVQMEEAPPLSGSHEKLVRPVVRLQERNIVLTRINPEWKISVVFVFDLGYWLVFVVFGFWGFLRECEWWAEIARYGF

SEQ ID NO: 121218 - protein, 99 aa, Glycine max
  Coding DNA Sequence Number=SeqID_4440
MQIGTSTQGLNLIRKKEPNCGVQHQLPHKAKDHSVFRSRIQKDTKEGGKKVFFLIFLDPNSPKLAYGLPGPWNHLLAKQPARLGKLTTSGLRFSSPGRA

SEQ ID NO: 121219 - protein, 81 aa, Glycine max
  Coding DNA Sequence Number=SeqID_4441
  Subcellular localization annotation: CTP_CleavageSite=64; ConfidenceScore=5.09e-01
MVRTRSGQPGPTCDYTTGFPTLVASPKKWRNQGGTTTENGAPTPTPLVQGPMMRDHHRGSGGVTAAMARGCRGGAKKGKKK

SEQ ID NO: 121220 - protein, 125 aa, Glycine max
  Coding DNA Sequence Number=SeqID_4442
MIDGLGVAGWGVGGIEAEAAMLGQTCVVLTIGEVIVRSCCIYLKSFYSGVWSLDIKVLSGFVAEVEEDLGWDDIEDLSSIDENKTRQQSGGGASKVDLWKRLSATEQKEDLSWDIEDDDDETVKA

SEQ ID NO: 121221 - protein, 117 aa, Glycine max
  Coding DNA Sequence Number=SeqID_4443
MGSVRQQYCQQYNILLVLKELWRSNEELFKPRKVSIESRYKGRRELLQMEGLKWRCMIFLLIRTNQNATEILETFMCVMLEHNTTVHASYVEEIKLDGKNLYNELHFQLKILGSCRG

SEQ ID NO: 121222 - protein, 266 aa, Glycine max
  Coding DNA Sequence Number=SeqID_4444
MASNPSKVQKKAKTSKRKQRECSQATLNMLDMWFTDQNKKNNFKMIYVMKNVRIPKFLDMEWFSQQGFNFPNLLEAQGLSKFVQMKGTFYLELVNFFYTCACIDMEGNLYSIVSGGVRKFEESADGYNKMQAYKGMLLDLARNLRNRFRVGSLTAEDRMLEYLITYILTPRIQQSCTEPPTVANMNQMEEEVEKEAQQEPAHQWNPFESLMIQKMDVVLHLHQEHQAEVHSSLENITTRLVNIEIRLSLSKLLNPDEDEAWLCSCA

SEQ ID NO: 121223 - protein, 157 aa, Glycine max
  Coding DNA Sequence Number=SeqID_4445
MKPSERKEEAIDIDSLSAKVTNITRLSGVTHRGHIFVALDMPVRPTNAKGKAKVAVEDTNEASPTPDEDVPAGRFAVVTTCPFTGERGKAHGCAFQRRKYVRSRHQRLFVENVGKNRRKPVIKNIPSSGVVFTFEEGRQKRGSCSYVPSIEEEIRPT

SEQ ID NO: 121224 - protein, 142 aa, Glycine max
  Coding DNA Sequence Number=SeqID_4446
ASVSPIGCPFPPARSHHHDIGIAHARHPMDPKKSNRVLGFPALITGLCQFYGVPVAPSKFIRPPINQAFIKKYRAPRQAQGETPQQPGDGQQQATNAPPPPPEHLSSSTKRRPSPKPKVSKSTRSMIDKSSCVQLKTLKKRY

SEQ ID NO: 121225 - protein, 90 aa, Glycine max
  Coding DNA Sequence Number=SeqID_4447
  Gene Ontology: Mol. function=RNA-directed DNA polymerase activity; Biological process=DNA integration
MEIAKHMATPMSTACYLDKEETGQSIDIKQYQGYSDSDFAGSKIDRKSTSGTCHFIGYALVSWHSKKQSSVALSTAEAEYISVVVLKSFG

SEQ ID NO: 121226 - protein, 232 aa, Glycine max
  Coding DNA Sequence Number=SeqID_4448
MSSRGKKTISFLRVSPLFEQNCNCGQGFSKRFGPHKTDSEWHSGPTTEVPRRQGEGYGQSRRLGPVYGCVSFANFWDLVAIDAFLAYHHSKESPVERGVVLTNNPALAIRQLGYPMRGAPTEESMSPFLVRDFGAQNSKTIQRIHKAWETPLKKDQELRGIRNGIIGGYHEWLKVHIRGLDWLAKLKVVSKESFEAPEEDEEVQALKSELGKAKLAKEKFKLAATHVRKECA

SEQ ID NO: 121227 - protein, 95 aa, Glycine max
  Coding DNA Sequence Number=SeqID_4449
MTSHCSFFFLERYATISIRIRDLDHGVVLHSMITTLKPWIFANNLCRKQPKDLDELQARATRYIQMEELSTFRNQVCSAKQKKDDHTSVNHVNKP

SEQ ID NO: 121228 - protein, 82 aa, Glycine max
  Coding DNA Sequence Number=SeqID_4450
MSVLQWRKRNAKGKKEIPEGECVAVEKEKCKSERRRDMKREERSHFVAATCQQLCHVLANYAKAKMTKKTNKCVHVSNWIYG

SEQ ID NO: 121229 - protein, 79 aa, Glycine max
  Coding DNA Sequence Number=SeqID_4451
  Gene Ontology: Mol. function=protein serine/threonine kinase activity; Cellular component=membrane; Biological process=protein amino acid phosphorylation
  Homolog annotation: Hit_ID=Q8LF75; Match level="QueryCoverage=97%, HitCoverage=20%, E-value=3e-32, Identity=82%"; Hit description =Putative receptor ser thr protein kinase
SKGKYVALDWPKRAAICRGTASGLSFLHEEAQPNIVHRDIKASNILLDGSFNPKIGDFGLAKLFPDNVTHVSTRVAGTV

SEQ ID NO: 121230 - protein, 245 aa, Glycine max
  Coding DNA Sequence Number=SeqID_4452
  Gene Ontology: Mol. function=protein serine/threonine kinase activity; Cellular component=membrane; Biological process=protein amino acid phosphorylation
  Homolog annotation: Hit_ID=Q8LF75; Match level="QueryCoverage=72%, HitCoverage=39%, E-value=7e-39, Identity=51%"; Hit description =Putative receptor ser thr protein kinase
MVSFSWTEFMVVQNLVPGMFYKVSKGWHKFAGMGVPISGGNDGNRVLEAVKTVIVKMNFNDEDKNCRVGSCGGYLAPEYALLGQLTKKADVYSFGILMLEIISGKSSSIAAFEEDYLVLVEWGGTCIQFRIRGEILATHYSLASILSFGLFWLAWKLKGENRLLDLVDSELSEYDESVVYRFLIVALFCTQSAAQHRPSMKQVLEMLSKEVHLNEKALTEPGIYRWHSTGKKCGSLNETSSSQAI

SEQ ID NO: 121231 - protein, 77 aa, Glycine max
  Coding DNA Sequence Number=SeqID_4453
MDFNDEDNNSHVDSLWVEELEAMVYHLSMCNVCDQGIFFIGDFCLLEGNCIVRERMDLLEEKLHESQNSEQSSVKCG

SEQ ID NO: 121232 - protein, 115 aa, Glycine max
  Coding DNA Sequence Number=SeqID_4454
  Gene Ontology: Mol. function=protein serine/threonine kinase activity; Cellular component=membrane; Biological process=protein amino acid phosphorylation
  Homolog annotation: Hit_ID=Q8LF75; Match level="QueryCoverage=85%, HitCoverage=25%, E-value=3e-32, Identity=68%"; Hit description =Putative receptor ser thr protein kinase
  Pfam annotation: Domain name=Pkinase_Tyr; Domain location=29-115; Score=-165.6; E_value=0.026; Accession=PF07714.7; Description =Protein tyrosine kinase
MAGKGGWPLFVVATKKFSYNSLRSATRDFHPSSKIGGGGYGVVYKGVLRDGTQAAIKSLSVESKQGTHEFMTEIDMISNIRHPNLVELIGCCVEGGHRILVYEFLENNSLASSLL

SEQ ID NO: 121233 - protein, 89 aa, Glycine max
  Coding DNA Sequence Number=SeqID_4455
  Gene Ontology: Mol. function=chromatin binding; Cellular component =chromatin; Biological process=chromatin assembly or disassembly
  Homolog annotation: Hit_ID=Q1SAV4; Match level="QueryCoverage=55%, HitCoverage=12%, E-value=1e-10, Identity=60%"; Hit description =Integrase, catalytic region
ILDSCLDSSTQPPTCLMLVQWKGLAPEDSTWENWTDVCHAHHLEDKVVFPGADNVSSSSEKGTPPPANHEDRPRRNTMRPKCLEEYVST

SEQ ID NO: 121234 - protein, 1117 aa, Glycine max
  Coding DNA Sequence Number=SeqID_4456
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=99%, HitCoverage=97%, E-value=0.0, Identity=56%"; Hit description =Tyrosine protein kinase, active site
  Pfam annotation: Domain name=LRRNT_2; Domain location=18-57; Score =37.6; E_value=4.2e-08; Accession=PF08263.3; Description=Leucine rich repeat N-terminal domain
  Pfam annotation: Domain name=LRR_1; Domain location=110-132; Score =19.2; E_value=0.015; Accession=PF00560.23; Description=Leucine Rich Repeat
  Pfam annotation: Domain name=LRR_1; Domain location=134-156; Score =15.7; E_value=0.17; Accession=PF00560.23; Description=Leucine Rich Repeat
  Pfam annotation: Domain name=LRR_1; Domain location=158-180; Score =11.9; E_value=1.7; Accession=PF00560.23; Description=Leucine Rich Repeat
  Pfam annotation: Domain name=LRR_1; Domain location=182-204; Score =12.3; E_value=1.4; Accession=PF00560.23; Description=Leucine Rich Repeat
  Pfam annotation: Domain name=LRR_1; Domain location=206-228; Score =15.1; E_value=0.25; Accession=PF00560.23; Description=Leucine Rich Repeat
  Pfam annotation: Domain name=LRR_1; Domain location=230-252; Score =12.4; E_value=1.4; Accession=PF00560.23; Description=Leucine Rich Repeat
  Pfam annotation: Domain name=LRR_1; Domain location=254-276; Score =12.4; E_value=1.4; Accession=PF00560.23; Description=Leucine Rich Repeat
  Pfam annotation: Domain name=LRR_1; Domain location=278-300; Score =15.0; E_value=0.27; Accession=PF00560.23; Description=Leucine Rich Repeat
  Pfam annotation: Domain name=LRR_1; Domain location=302-324; Score =15.0; E_value=0.27; Accession=PF00560.23; Description=Leucine Rich Repeat
  Pfam annotation: Domain name=LRR_1; Domain location=326-348; Score =15.7; E_value=0.16; Accession=PF00560.23; Description=Leucine Rich Repeat
  Pfam annotation: Domain name=LRR_1; Domain location=350-372; Score =9.8; E_value=4.2; Accession=PF00560.23; Description=Leucine Rich Repeat
  Pfam annotation: Domain name=LRR_1; Domain location=374-396; Score =10.8; E_value=2.7; Accession=PF00560.23; Description=Leucine Rich Repeat
  Pfam annotation: Domain name=LRR_1; Domain location=398-420; Score =12.5; E_value=1.3; Accession=PF00560.23; Description=Leucine Rich Repeat
  Pfam annotation: Domain name=LRR_1; Domain location=422-444; Score =9.4; E_value=5; Accession=PF00560.23; Description=Leucine Rich Repeat
  Pfam annotation: Domain name=LRR_1; Domain location=446-468; Score =13.7; E_value=0.66; Accession=PF00560.23; Description=Leucine Rich Repeat
  Pfam annotation: Domain name=LRR_1; Domain location=494-516; Score =7.5; E_value=11; Accession=PF00560.23; Description=Leucine Rich Repeat
  Pfam annotation: Domain name=LRR_1; Domain location=518-540; Score =7.9; E_value=9.5; Accession=PF00560.23; Description=Leucine Rich Repeat
  Pfam annotation: Domain name=LRR_1; Domain location=542-564; Score =18.0; E_value=0.034; Accession=PF00560.23; Description=Leucine Rich Repeat
  Pfam annotation: Domain name=LRR_1; Domain location=566-588; Score =18.8; E_value=0.019; Accession=PF00560.23; Description=Leucine Rich Repeat
  Pfam annotation: Domain name=LRR_1; Domain location=590-612; Score =10.5; E_value=3.1; Accession=PF00560.23; Description=Leucine Rich Repeat
  Pfam annotation: Domain name=LRR_1; Domain location=61-84; Score=3.4; E_value=65; Accession=PF00560.23; Description=Leucine Rich Repeat
  Pfam annotation: Domain name=LRR_1; Domain location=614-636; Score =8.0; E_value=9; Accession=PF00560.23; Description=Leucine Rich Repeat
  Pfam annotation: Domain name=LRR_1; Domain location=638-660; Score =14.4; E_value=0.42; Accession=PF00560.23; Description=Leucine Rich Repeat
  Pfam annotation: Domain name=LRR_1; Domain location=662-684; Score =16.4; E_value=0.1; Accession=PF00560.23; Description=Leucine Rich Repeat
  Pfam annotation: Domain name=LRR_1; Domain location=686-707; Score =17.9; E_value=0.036; Accession=PF00560.23; Description=Leucine Rich Repeat
  Pfam annotation: Domain name=LRR_1; Domain location=709-730; Score =13.2; E_value=0.94; Accession=PF00560.23; Description=Leucine Rich Repeat
  Pfam annotation: Domain name=LRR_1; Domain location=86-108; Score =14.1; E_value=0.52; Accession=PF00560.23; Description=Leucine Rich Repeat
  Pfam annotation: Domain name=Pkinase; Domain location=835-1108; Score= 139.1; E_value=1.2e-38; Accession=PF00069.15; Description=Protein kinase domain
  Pfam annotation: Domain name=Pkinase_Tyr; Domain location=835-1108; Score=69.6; E_value=9.9e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR _1::Pkinase::Pkinase_Tyr; Domain location=18-57::110-132::134 -156::158-180::182-204::206-228::230-252::254-276::278-300::302 -324::326-348::350-372::374-396::...
  Pfam module annotation: Domain location=398-420::422-444::446 -468::494-516::518-540::542-564::566-588::590-612::61-84::614 -636::638-660::662-684::686-707::709-730::86-108::835-1108::835-1108
MATSRHATIPSSASLTLQQTEANALLKWKTSLDNQSQALLSSWGGNTPCNWLGIACDHTKSVSSINLTHVGLSGMLQTLNFSSLPNILTLDMSNNSLKGSIPPQIRVLSKLTHLDLSDNHFSGQIPSEITQLVSLRVLDLAHNAFNGSIPQEIGALRNLRELIIEFVNLTGTIPNSIENLSFLSYLSLWNCNLTGAIPVSIGKLTNLSYLDLTHNNFYGHIPREIGKLSNLKYLWLGTNNFNGSIPQEIGKLQNLEILHVQENQIFGHIPVEIGKLVNLTELWLQDNGIFGSIPREIGKLLNLNNLFLSNNNLSGPIPQEIGMMTNLLQLDLSSNSFSGTIPSTIGNLRNLTHFYAYANHLSGSIPSEVGKLHSLVTIQLLDNNLSGPIPSSIGNLVNLDSIRLEKNKLSGSIPSTVGNLTKLTTLVLFSNKFSGNLPIEMNKLTNLEILQLSDNYFTGHLPHNICYSGKLTQFAAKVNFFTGPVPKSLKNCSGLTRVRLEQNQLTGNITDDFGVYPHLDYIDLSENNFYGHLSQNWGKCYNLTSLKISNNNLSGSIPPELSQATKLHVLHLSSNHLTGGIPEDFGNLTYLFHLSLNNNNLSGNVPIQIASLQDLATLDLGANYFASLIPNQLGNLVKLLHLNLSQNNFREGIPSEFGKLKHLQSLDLSRNFLSGTIPPMLGELKSLETLNLSHNNLSGDLSSLGEMVSLISVDISYNQLEGSLPNIQFFKNATIEALRNNKGLCGNVSGLEPCPKLGDKYQNHKTNKVILVFLPIGLGTLILALFAFGVSYYLCQSSKTKENQDEESLVRNLFAIWSFDGKLVYENIVEATEDFDNKHLIGVGGQGSVYKAKLHTGQILAVKKLHLVQNGELSNIKAFTSEIQALINIRHRNIVKLYGFCSHSQSSFLVYEFLEKGSIDKILKDDEQAIAFDWDPRINAIKGVANALSYMHHDCSPPIVHRDISSKNIVLDLEYVAHVSDFGAARLLNPNSTNWTSFVGTFGYAAPELAYTMEVNQKCDVYSFGVLALEILLGEHPGDFITSLLTCSSNAMASTLDIPSLMGKLDRRLPYPIKQMATEIALIAKTTIACLTESPHSRPTMEQVAKELGMSKSSLVY

SEQ ID NO: 121235 - protein, 727 aa, Glycine max
  Coding DNA Sequence Number=SeqID_4457
  Gene Ontology: Mol. function=protein dimerization activity; Cellular component=chromatin; Biological process=DNA integration
  Homolog annotation: Hit_ID=Q2R1C3; Match level="QueryCoverage=80%, HitCoverage=76%, E-value=1e-169, Identity=52%"; Hit description=HAT family dimerisation domain containing protein
  Pfam annotation: Domain name=DUF659; Domain location=193-358; Score =117.8; E_value=3.1e-32; Accession=PF04937.6; Description=Protein of unknown function (DUF 659)
  Pfam annotation: Domain name=hATC; Domain location=571-660; Score =51.4; E_value=3e-12; Accession=PF05699.5; Description=hAT family dimerisation domain
  Pfam module annotation: Pfam domain module=DUF659::hATC; Domain location=193-358::571-660
  Subcellular localization annotation: CTP_CleavageSite=53; ConfidenceScore=5.52e-01
MVLQAIFNGAFFSTTGSSSTALFIGNSASTLVAVDSRHHWFPSMLFLVCGCVCCAVKDVLYNRNKKLSKVHTLGLKHICSECGSGIATCPKVTNAYLVDLRRVCEETENRLKSKNVPLPTDKRTPTSPTLPPKRRKSSNIESAFNIEDRNHLRAEIARMFYSAGLSFHLARNPHFVSSYSFATNCNLSGFLPPSYNALRTSLLQQERSHIERLLQPIKSMWSLKGVTLVADGWTDAQRRPLINFVAISEEGPMFLKAIDGSKEYKDKHYMFDLLKDVIKEVGLQNVVQVITDNDPVCKAIGLLIEAEFPHIFWTPCVVHTLNLGVKNICAAKNVDGNENVFNECGWIAEVIGDASFIKVFIMTHSMRLAIFNEFSSLKLLSIAETRFASMIVMLKRLKLLKLCLQNMVISDQWNSYREDDVRKVAHVKELILNDIWWDKVDYILSFIDPIYSMIRICDTDVSNLHLVYEIWDSMIEKVKTTIYRHDEVLENEVSSFFEVIHEILNSRWSKSCNPLHCLAHSLNPRYYSDNWLNEVPNRVPPHRDDELSSQRNKCLKRYFPHVNVRTKVYEEFSKFSSCAGDFGSFDSIEDRWALDPKTWWVMHGSSTPILQKLALKLLVQPCSSSCCERNWSTYSFIHSLKRNKMDPKRAEDLVFVHSNLRLLSRKEEGVTISFVAEEDALNGACPTEEKSDCLEAGDVTNIALDPLFMFVFHLGVNGAAIAHVINL

SEQ ID NO: 121236 - protein, 125 aa, Glycine max
  Coding DNA Sequence Number=SeqID_4458
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q71EW8; Match level="QueryCoverage=76%, HitCoverage=12%, E-value=3e-41, Identity=85%"; Hit description =Methionine synthase
  Pfam annotation: Domain name=Meth_synt_2; Domain location=1-118; Score=-140.6; E_value=0.0022; Accession=PF01717.8; Description =Cobalamin-independent synthase, Catal
MRAVRNHQLCGKSIRSELNTHITTGKEASVTIKNSRCDDKLLSIFREGVKYGAGIGLGVYDIHSPRIPPNEEIADRINKMLAVLEKNILWVNPNYGLKTRKYTEVKPTLTNMVVATKITRNELAK

SEQ ID NO: 121237 - protein, 148 aa, Glycine max
  Coding DNA Sequence Number=SeqID_4459
MFYSWTPNRHAVKALGLAIRSHFEGPYHHYEAVPEDVQTRVTWTAQDEWQIKKVYETKVKKRLSDMLTKARDKRKRPHWIGEQAWVDLLIYWVTDKKFKDQSAQNKINRTSSRGGAVHTTGRKYHLDIAVGLEPSAMPSTENLQQRSV

SEQ ID NO: 121238 - protein, 515 aa, Glycine max
  Coding DNA Sequence Number=SeqID_4460
MVMKQRDEELSLFLEMRRREKENEKNNLLLLQNSEELDLSNLESNHGASMISKMVSSVPPRKNGIEEFLNSENDKSDYEWLLAPPDAPLFPTLEKESQISVKSEQETRNARPTALKPRVANIQAEPASRSHVISKHHASMPGLGSSTNGSRRPSSSGGPTSATSRSSTPFGRPTLPSTTKSSRPSTPTSRATLTSAKSTVPPVRSSTPTRSTARSSTPTTRPSLAPPKTSQRSATPTLRSSTPSRAFGANAPPTRPSSASKARPGPIVAKNPVQSRGSSPSVRSRPWEPSQIPGFSLDAPPNLKTSLSDRPASATRTRPGALNSRSSSVDASSNAKSRRQASTPSKGRTTTGLVHNNHTSMQVLSRARFTDGDDESPVVIGTKMVERVVNMRKLAPPKHEDHHSSRDNSYGKSSSGSSGFGTTLSKKSLDMAMRHMDIRRSIQGNLRPLVTSIPASSMYSVRSGSSSKSRTVSASDSPLATSSTTSSEPSVNTNSMSYDGSGVEENDFACERGNS

SEQ ID NO: 121239 - protein, 366 aa, Glycine max
  Coding DNA Sequence Number=SeqID_4461
  Gene Ontology: Mol. function=signal transducer activity; Cellular component=membrane; Biological process=signal transduction
  Homolog annotation: Hit_ID=Q397T9; Match level="QueryCoverage=100%, HitCoverage=70%, E-value=1e-147, Identity=78%"; Hit description =Methyl-accepting chemotaxis sensory transducer
MQSSNRALDEAYTRQLAAKTALSAASLNLTIVRTTLDRALLHPEAPDVSELVKKAEGYLAKADTAWRSYAAMPHGDDEGPLASRLDAARQALIGQALKPMIDAIRGRAARRSRPLADDRRAAVVGRAHAGDRRARCVPGRARQGRVRHCADLLRLDADGRDRGDRIRAGRVPRLRDRPAFRDHAAGESSAVAFPPPVGRRPHVGSALVVARRDGRTGQRRDRHAAQPRGHRAPGQPGFRGDFDGDAPDRGRQHRPVAAYRGTGVRIAGDGREHGAAHRDREAERGQRGGGAGLRGHRERDRHARRDRGRRGDRHDERDRPELAEGRRHHRHDRGDRVPDQHPRAECGGRGRACRRAGPRLRGGRGR

SEQ ID NO: 121240 - protein, 120 aa, Glycine max
  Coding DNA Sequence Number=SeqID_4462
MKMKANKTINELKVSDSNTYRLKNEERTKKEQRTVKNRGKSSHICSQKRLGSVTEALRLDSSSQKRKKGGASRSEASGGRFLSAPQLLSSPPFCTLRKIYGSVSDLIFIFFFLFPFTNIK

SEQ ID NO: 121241 - protein, 148 aa, Glycine max
  Coding DNA Sequence Number=SeqID_4463
DIVVKCPYELHRGVRPFAQETLFSDFIKCGTDQYIVPLGDVVPCRSPWVCTPDYLSWFYKVSHPYAISLKEGQPPCCPSLLDLRVMPMGKSQHQLIQQGLVFRCSLERQRKMAKAKDGGKKACRPWIFFINGVLCFLKINGRGMGKEE

SEQ ID NO: 121242 - protein, 244 aa, Glycine max
  Coding DNA Sequence Number=SeqID_4464
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=1e-35, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSKFRGLHVLAIRGLHTLTFQGLHVLTFRGLHVLAFRGQHVIAFAFVGLHALTFRGLHVIAFRGLHVLTFRGLHALALRGLHVLTFRGLHVLAFRGQHVIAFTFVGLHPLTFRGLHVIAFRGLHVLAFRGLHVLAFRGLHVLAFRSLHVLGFRRLHVLTFRGMHVLAFRGLHVLHFKGLHVLHFRGLHVLAFRGLHALTFKGRHILNFRGLHVLAFRGLPVLTFSGLHIHTLREFKVLCLLNA

SEQ ID NO: 121243 - protein, 77 aa, Glycine max
  Coding DNA Sequence Number=SeqID_4465
  Gene Ontology: Mol. function=transporter activity; Cellular component= integral to membrane; Biological process=transport
  Homolog annotation: Hit_ID=Q7XJT5; Match level="QueryCoverage=67%, HitCoverage=12%, E-value=8e-11, Identity=61%"; Hit description =Putative tetracycline transporter protein
MDKLYGLSHLFMAVFLHNFSMFMVVPAITDVTMAALCPGQDECSLAIYITGFQQALFSNKQHTKHTYGTSKNCYGTK

SEQ ID NO: 121244 - protein, 317 aa, Glycine max
  Coding DNA Sequence Number=SeqID_4466
  Homolog annotation: Hit_ID=Q1S060; Match level="QueryCoverage=89%, HitCoverage=95%, E-value=4e-14, Identity=23%"; Hit description =Arabidopsis conserved protein
  Pfam annotation: Domain name=DUF1514; Domain location=201-268; Score=- 2.3; E_value=0.06; Accession=PF07438.2; Description=Protein of unknown function (DUF1514)
  Pfam annotation: Domain name=DUF241; Domain location=72-312; Score =103.2; E_value=7.5e-28; Accession=PF03087.5; Description=Arabidopsis protein of unknown function
  Pfam module annotation: Pfam domain module=DUF1514::DUF241; Domain location=201-268::72-312
MVGVFRRSLSFPNKNPNRPSAPKPHISHHIRSISLPCRSHPLISEIKDEINGLRAWASTSKSNPQTHTTISHGLTLLKDTHETLQHILQLPQTLETLRSHPLWVEKLLEDFLRFVDAFGMFQTAIMSLKEEHSSAQMVIRKRDESKVVAYVKAKKKISKEMEKLVSVLRCVHVTQHQQHSMLQVPSFIVDAELRHVIADVMSVTVSVSVALFNGIGVSFSSRRITWTQMVKLSRNYGGRVNNNKEHEGIEELRNGVELVERLHQNLKKKGDEEVRLVLKKMRDLEECVCGIESVTEKVFRALINSRVALLNILTLTR

SEQ ID NO: 121245 - protein, 281 aa, Glycine max
  Coding DNA Sequence Number=SeqID_4467
  Pfam annotation: Domain name=DUF630; Domain location=1-60; Score =80.2; E_value=6.3e-21; Accession=PF04783.3; Description=Protein of unknown function (DUF630)
MGCNTSRLDRLPAVALCRDRCKFVDEALRQSYALADAHVAHMEALKTLGPALLCFFDGFDDSDETSVRIKETKVPVATKSPPPRSPSSLSSDSDDANVLLHSESETEDAEKEEFQLFTRARYDYAHSARYPPFSPPRGYSGSKPPSPPPPSGSAWDFLNFFEPYEKYHVPYFPSGGDADGAEKDKGKVEKRDEFKSKGENEEVKKKKGDSKEKKVVSEKEEVVSVSEQCSDSARVKSGKGFSEAMKEIQVLFEKASESGNPVLEMLDVGKLRYHRKFDLNP

SEQ ID NO: 121246 - protein, 102 aa, Glycine max
  Coding DNA Sequence Number=SeqID_4468
VLLKAHCNYCECLHNWSKGVATCTQHYCWGTQQTVKWRNCPSAIILPEKLTDNFRKKLLPEVFRKKLLPEDTGILPEEASSGNIPDDVLPEIVCEFFRKNNC

SEQ ID NO: 121247 - protein, 207 aa, Glycine max
  Coding DNA Sequence Number=SeqID_4469
MKTKMTIHVLESNMALQLEQATNINLRVLWKKRRKRSTMLQSPRKFVTPFTKCVSDLNWRLTGLIIPLVLFITFFSLHYSSSTSSNGFSAFYPVQQFLFNLPFKFISEEDPVVSKDELLRSKIAVCLVGGARRFELTGPSIIEMVLKEYPNSDVFLHSPLDKDTFKFSLLKFAPNVAAVRIFHPQPLPENESYVRVLTAHNSPNGIQ

SEQ ID NO: 121248 - protein, 319 aa, Glycine max
  Coding DNA Sequence Number=SeqID_4470
  Gene Ontology: Mol. function=DNA binding; Cellular component=nucleus; Biological process=regulation of transcription, DNA-dependent
  Homolog annotation: Hit_ID=Q9ZTC1; Match level="QueryCoverage=97%, HitCoverage=98%, E-value=1e-80, Identity=50%"; Hit description =Putative transcription factor
  Pfam annotation: Domain name=Myb_DNA-binding; Domain location=14-61; Score=38.8; E_value=1.8e-08; Accession=PF00249.21; Description=Myb -like DNA-binding domain
  Pfam annotation: Domain name=Myb_DNA-binding; Domain location=67-112; Score=45.3; E_value=2.1e-10; Accession=PF00249.21; Description=Myb -like DNA-binding domain
  Pfam module annotation: Pfam domain module=Myb_DNA-binding::Myb_DNA -binding; Domain location=14-61::67-112
MGRPPCCDKIGIKKGPWTPEEDIILVSYIQEQGPGNWRAVPTNTGLMRCSKSCRLRWTNYLRPGIKRGNFTEHEEKMIIHLQALLGNRWAAIASYLPQRTDNDIKNYWNTHLKKKLKQSGSDEGVDQEGHSSSSSSNSHPKGQWERRLQTDIQMAKKALCDALSLHKPATATATNLVVPDDATKPSSTSHQPYKHASSSYASSYENISRLMENWMKSPNSNSTNNSPGYYSSSFSNMVNNNTTTGSSSSEGAHSNTTTTTQDQGFDSLLTLNSSKHHGSSSQTQVPLTLLENWLFDDGAAQCHEDLMNMSLEESTAGLF

SEQ ID NO: 121249 - protein, 42 aa, Glycine max
  Coding DNA Sequence Number=SeqID_4471
MATLVVPNSNSPVEDAEALHKSFEASLNGGCDVHYFMPAFDN

SEQ ID NO: 121250 - protein, 220 aa, Glycine max
  Coding DNA Sequence Number=SeqID_4472
  Gene Ontology: Mol. function=calcium-dependent phospholipid binding; Cellular component=plasma membrane; Biological process=cell differentiation
  Homolog annotation: Hit_ID=O65848; Match level="QueryCoverage=99%, HitCoverage=64%, E-value=8e-89, Identity=75%"; Hit description =Annexin
  Pfam annotation: Domain name=Annexin; Domain location=141-206; Score =51.9; E_value=2.1e-12; Accession=PF00191.10; Description=Annexin
  Pfam annotation: Domain name=Annexin; Domain location=42-106; Score =49.9; E_value=8.3e-12; Accession=PF00191.10; Description=Annexin
  Pfam module annotation: Pfam domain module=Annexin::Annexin; Domain location=141-206::42-106
RQQIRRVYEEIFQEDLVKRLESEIKGDFEKAVYRWILEPADRDAVLANVAIKNGKNYNVIVEIATILSPEELLAVRRAYLNRYKHSLEEDVAAHTSGHLRQASPCAFTCLIHFSLGKKLLVGLVTSYRYVGDEINPKLAQTEAEILHDAVKEKKGSYEETIRVLTTRSRTQLVATFNCYREIHGTSISKKLVDEGSDEFQRALYTAIRGIKDPIKYYEKV

SEQ ID NO: 121251 - protein, 70 aa, Glycine max
  Coding DNA Sequence Number=SeqID_4473
MGLFSKHACTKQIASGIGEFAMPYWTRQPHWRFRHAWGVASQTGEFQDVGLADSFFSWQAKGKLPLPLAS

SEQ ID NO: 121252 - protein, 66 aa, Glycine max
  Coding DNA Sequence Number=SeqID_4474
MFLDLSVERIVTYLFVDWVASVNLESLKCWLHSKQGNLKKDAGPNVIPAFSSSCPDVTMMSSNGDY

SEQ ID NO: 121253 - protein, 73 aa, Glycine max
  Coding DNA Sequence Number=SeqID_4475
MFITEAYQTLHDWGPYPADQVLKELQDSLGFMIYDNFCNIWGMFHSEHGLMSFEHPSNKMKAMPRIDNFVFEE

SEQ ID NO: 121254 - protein, 153 aa, Glycine max
  Coding DNA Sequence Number=SeqID_4476
  Gene Ontology: Mol. function=serine-type peptidase activity; Cellular component=integral to membrane; Biological process=proteolysis
  Homolog annotation: Hit_ID=Q1SB50; Match level="QueryCoverage=87%, HitCoverage=78%, E-value=2e-42, Identity=59%"; Hit description =Peptidase S26A, signal peptidase I
  Pfam annotation: Domain name=Peptidase_S24; Domain location=33-115; Score=36.4; E_value=9.6e-08; Accession=PF00717.13; Description =Peptidase family S24
  Subcellular localization annotation: CTP_CleavageSite=16; ConfidenceScore=5.07e-01
MGTSSFLWNCTKKFITAGIVTVTVTDHFVTVIPVRGGSMSPTFNPKAGSHMGDVFDDYVLVEKFCLRNYKFSHGDVVVFRSPLNHKETHVKRIAALPGEWFGTHHNNDVIQIPLGHCWVEGDNTASSLDSNSFGPHLLYAKLLGMLHLTENIY

SEQ ID NO: 121255 - protein, 282 aa, Glycine max
  Coding DNA Sequence Number=SeqID_4477
  Gene Ontology: Mol. function=zinc ion binding; Cellular component =integral to membrane
  Homolog annotation: Hit_ID=Q8L8R1; Match level="QueryCoverage=86%, HitCoverage=91%, E-value=7e-81, Identity=60%"; Hit description=RNA -binding protein-like protein
  Pfam annotation: Domain name=zf-C3HC4; Domain location=183-220; Score= 16.8; E_value=0.0029; Accession=PF00097.15; Description=Zinc finger, C3HC4 type (RING finger)
MGFGLKRRKKRGEGEGKMRKSFKDSLKALEADIQFANTLVAGMPDFVAMSPPLFVKRSAIIASEYPSAGACFQMRLSYSPAAQFFLFLVKWTDCHLAGALGLLRILIYKAYEDGKTTISIYERKASLKEFYGVVFPSLLQLHRGITDVDDRKQKHLCATKYKHKDLTSKGKLPEIDMEREEECGICLEMNSMVVLPNCNHSMCMKCYEDWHARSQSCPFCRDSLKRVNSDDLWICISSSEINDLASINKENLKRLFMYIESLPLTARPHIQHVISSPPVIAN

SEQ ID NO: 121256 - protein, 213 aa, Glycine max
  Coding DNA Sequence Number=SeqID_4478
  Pfam annotation: Domain name=zf-CCHC; Domain location=90-107; Score =22.8; E_value=0.00017; Accession=PF00098.13; Description=Zinc knuckle
  Subcellular localization annotation: CTP_CleavageSite=59; ConfidenceScore=5.06e-01
MKEGIGHILDITPIGGKRNKSLKRLTLTSHTSMGRTMKSTSKSYGTHSYPKKDQGQSILGATTSKPKDDKRKTIEKQPPKASMQEKTSSIKCFKCLGRGHITSQCPTKKTMIMRSQDIHSSQDEATTSPSSSESEEAKWEESSEEIYPQEEGQPLMVKDEFKEVSVSSKRCSYVMQSYPPRALDRRLQEDWARDAREGPRILMSLRVDFGPMG

SEQ ID NO: 121257 - protein, 96 aa, Glycine max
  Coding DNA Sequence Number=SeqID_4479
MKKKLELQVFQYCEVWQTFWLSENWDSNVNVCDQIANSLMELEERFEDFILKLKEAEWDTHQLNLKFCKHSEQDIYFSHADIQQRETRYLWWPIGL

SEQ ID NO: 121258 - protein, 976 aa, Glycine max
  Coding DNA Sequence Number=SeqID_4480
  Gene Ontology: Mol. function=RNA-directed DNA polymerase activity; Cellular component=chromatin; Biological process=chromatin assembly or disassembly
  Pfam annotation: Domain name=RVP_2; Domain location=15-123; Score= -38.5; E_value=0.00099; Accession=PF08284.2; Description=Retroviral aspartyl protease
  Pfam annotation: Domain name=rve; Domain location=711-867; Score =110.5; E_value=4.7e-30; Accession=PF00665.16; Description=Integrase core domain
  Pfam module annotation: Pfam domain module=RVP_2::RVT_1::rve; Domain location=15-123::202-380::711-867
MAGVPATDTFRLYGFINKSRVTILIDSGSTHNFVQPRVAKFLNLPVEDTLPLRVMVGNGSVMTCNQLCLDTKLLIQDHAFTVTLHILPLSGAEVVLGVEWLRTLGPVITNYASFTMQFSYSGESINLHADVQSDPNPASANQVKCMLSNSSTSGLFHLSLLPADPPTPSSPPLHHIPAINTLLHKYHTLFQQPSSLPPSRHHDHHINLLPIANPINVRPYRYPHFQKTEIERQVSALLDAVQDRFPLPTIDELLDELGKASWFSKLDLWQGFHQILMAEEDTPKTAFRTHHGHYEYRVMPFGLCNAPSTFQATMNSLLRPFLRKFAAVFFYDILIYSETLSDHLHHLECVFNSLLQARYYLKQSKCFIGQRQLDYLGHVVSGSGVRPDPTKIQAIVEWIMPRSPKDLRALLGLARFYRKFVRGYAAIAAPLTKLLCKNAFQWSSESQTAFEKLKAVLTTAPILALPDFSIPFILETNASNVAMGGILQQNGHPIAYFSKPFCPRLQHASAYVRELHAIVTAVRKWRRYLLGHKFTIYIDHRSLRELMSQVVQTLEQQFYLAKLLGYDYEIQYKAGSSNIVADSLSPPHSEFMVQLKATLLANPEFQKLREAIRSHLHEYPDYFISADLIIFKGAIWVDSKNPFIISLLHEYHATPIGGHFGIKKTLHRLQSDFRWHNMVADVKAFVRRYAVCQQVKHLTRRSAGLLQPIPVPTGTWENISMDFVTHLPASHGFTAVMVMVDRFSKSVHLGALPTHFTAFKVATLFMDTVCKHHGFPRSIISDRDPIFISSFWRELFKMTGTTLRMSTAYHPQTDGQTEVMNRTLEQYLCSFVHHQPATWYKLLTLMEWSNNTSHHTSTGLTPYEVVYGKPPPSPPMYLQGLSRNDAVNTILRTREETHAILQRKLVKAQEAMKHFADQKRRDVVYEVDQLVYVKLRPHRQSSLRSQPTSKLTKRYFGPYPVMERIGNVAYRLKLPE

SEQ ID NO: 121259 - protein, 58 aa, Glycine max
  Coding DNA Sequence Number=SeqID_4481
MESKRNKQQPRRRKRSSRKREAKEQKQKQEGDAISRNPTSSVLYLTSSIAYGTFVFVN

SEQ ID NO: 121260 - protein, 444 aa, Glycine max
  Coding DNA Sequence Number=SeqID_4482
  Gene Ontology: Mol. function=nucleic acid binding; Cellular component= integral to membrane
  Homolog annotation: Hit_ID=Q54YB8; Match level="QueryCoverage=65%, HitCoverage=47%, E-value=7e-24, Identity=25%"; Hit description =DUF647 family protein
  Pfam annotation: Domain name=DUF647; Domain location=128-443; Score =170.1; E_value=5.5e-48; Accession=PF04884.5; Description=Protein of unknown function, DUF647
MKVEKMNRVRPRGFQILCSSEHSSFKDEDDAENGGGQVSSRVIQVERYSNGTAKRFLLDYTKIWAQKSNSSLCLLVHGKILVDSCTFYHHHLANHASTIPLVSRCVLGDDLQLQTFLVEEDTSTPKRFQDSYSPDESLSWLPDTIKDFILPAGFPGSVSDDYLDYMLLQFPTNVTGWICHTLVTSSLLKAVGIGSFSGTSATASASAIRWVSKDGIGAVGRLCLGGRFGSLFDDDPKQWRMYADFIGSAGSIFYLTTQVYPDYFLPLASLGNLTKAVARGLKDPSFCVIQNHFAISGNLGEVAAKEEIWEVVAQLIGLALGILILDTPSLVKSYGVLSLPWLGMQFLHLWLRYKSLSVLQFNTINLKRVLHSTVPGYIQTNSVLCCMIYFPSQMFNFQNGFISGCTYCNREENILTRSQFMKPKINFGLPLEKIDGVERSHFMV

SEQ ID NO: 121261 - protein, 118 aa, Glycine max
  Coding DNA Sequence Number=SeqID_4483
MSGNKPREINIKLICPSLSKVTQVVAWDDQRIDLGFVARAFGLDPSSLRLNSHFIGRGVDLVASSVTWKSLLSFFSSKGLPTGKDQRDALVVTGKLCKVGLKLKQLELLGGNVYFTCE

SEQ ID NO: 121262 - protein, 249 aa, Glycine max
  Coding DNA Sequence Number=SeqID_4484
  Gene Ontology: Mol. function=RNA-directed DNA polymerase activity; Cellular component=mitochondrion; Biological process=RNA-dependent DNA replication
MREEQLKAIKEEVDKLLNANFIKEVKYSTWLTNVVMVKKANDKWRICTNYTDLNRVYVDDMVVKSQSIAQHVADPEEVFGELRKYDTRLNPEKMYFWDAKPDQYPKSLEAEWPGVPLLMYLSIADEAISSTLVQEEGKHQLPIYFISRILDDAKKRYQMIEKVLRKLELVGRIVAWSVETSEFDIHYEPCSPMKTQFMADFLAEFAGNDKTTPDRRTLYVGNGTRIILEGPDNITLEQALKLNFRASNN

SEQ ID NO: 121263 - protein, 368 aa, Glycine max
  Coding DNA Sequence Number=SeqID_4485
MGFRSLLKVSPRGSMSNSSPGLLDPRMLALTEGGHQVHIASGLYHLTCKVKEWTGMRMDNVGGDVSGKHHEVWNNDGDNHEVVLVDGVDTLEVPICKVIGGKLRCSGWVPILLGVVAYAVVAGVFVYLSIPLFFYLLRGSYATPLGVLQVLLLLVGLGTSFLLVALLSSLSGFILESGHFFHLDEHRMQCYLEVKILDLDGCAPKSIHEFSERLFVCLSQAGQGHAMKSVGRVLHIEAFNEGVEVVYGLRGSSESKRHPDAHLNMLSHRTAQVDEEMLTSSPPCLKCKQSVFRPGDVWHEPPTDHGQPLTFSAPSHGIALSPQCGKSVSRVFFALGTSGMNLQLIMLPDEDVFERSLMSEVRPSANHG

SEQ ID NO: 121264 - protein, 180 aa, Glycine max
  Coding DNA Sequence Number=SeqID_4486
GQETLGTSGGVLLPKTKLDQSRPNPGIVSHCELCLIYGIWPLVIDYQGLKNEIRKLRGLLVIDYQGIVMVTQLIHDRVEMECLEGAWETLEGNMSALWSGYYPRLTPYRLVEPVQVIEVTSSEEDPEEDPEELPPEPAVDALDFLEGDEDPLPEVDSPEEVMSASEADSTEDSGPREMAT

SEQ ID NO: 121265 - protein, 263 aa, Glycine max
  Coding DNA Sequence Number=SeqID_4487
  Homolog annotation: Hit_ID=Q00WW9; Match level="QueryCoverage=47%, HitCoverage=39%, E-value=2e-23, Identity=43%"; Hit description =Homology to unknown gene
  Subcellular localization annotation: CTP_CleavageSite=23; ConfidenceScore=5.08e-01
MAASSRGFSTTQFDFKLRVTRLNAALLPKSPVLELGPRKRRKLCFDADRVRLGNGAIRCCCSDSVTPIRRTSGPGKGGDKNEERRFDTKKPPHIHRVRVQASPAAMPFASPPYEKFFPRCTPRNSGPQSRDTPPKRDTGIANEKDWGISLLNENVNESGTNEDGSTWYRESGEELGENGYKCRWTRMGGQSHDGSSEWKETWWEKSDWTGYKELGVEKSGRNSEGDTWWETWQENLHQDEWSNIARIERSAQKQAKSGTENAG

SEQ ID NO: 121266 - protein, 283 aa, Glycine max
  Coding DNA Sequence Number=SeqID_4488
  Homolog annotation: Hit_ID=Q6Z3F8; Match level="QueryCoverage=43%, HitCoverage=33%, E-value=2e-43, Identity=68%"; Hit description =Transducin / WD-40 repeat protein-like
MLRFHCYANSDAHYKLRVRGRGTNLFAEKKKKALARLAEKKLHGEEKKQVPGEEEAVPGEKKLCSGTGEKKNLLSSRAVPEMICVFYNFILKGKMVLSINCWVHQQYCWVHLATPLVQKYGFRKRKKKKTQRAATLLCIEVSHGGCSIRFGVEEKERAMQAASSGIGYGLKYQARCISDVKADTDHTSFLAGTLSLKEENEVHLIRLSSSGTELFCEGLFSHPNEIWDLVSCPFDQRIFSTVYSNGETYGAAIWQIPELYGELNSPQLERITSLDTDSGKIKW

SEQ ID NO: 121267 - protein, 229 aa, Glycine max
  Coding DNA Sequence Number=SeqID_4489
  Gene Ontology: Mol. function=nucleotide binding
  Homolog annotation: Hit_ID=Q40474; Match level="QueryCoverage=96%, HitCoverage=36%, E-value=1e-71, Identity=71%"; Hit description=Axi 1 protein
  Pfam annotation: Domain name=DUF246; Domain location=62-229; Score =43.9; E_value=3.4e-17; Accession=PF03138.5; Description=Plant protein family
MARVMEESWDAISGVLEIQSTSMDAAIPATSFKVRIIVGSVVRSDAISSSDYTAESVFDDHNKWRLESTKNWVITDAVVAARILNATLVVPKLDQRSFWKDSSNFSEIFDVDWFISFLSKDVKIIKQLPTKGSRKALSAYNMRVPRKCNERCYINRILPVLLKKHAVQLSKFDYRLANRLDTEYQKLRCRVNYHALRFTNPILAMGEKLVHRMRMRSKHYIALHLRYTD

SEQ ID NO: 121268 - protein, 35 aa, Glycine max
  Coding DNA Sequence Number=SeqID_4490
MALRVMLVWGRGIDMIAPWLGVTGRNNRNGVRVGG

SEQ ID NO: 121269 - protein, 210 aa, Glycine max
  Coding DNA Sequence Number=SeqID_4491
  Gene Ontology: Mol. function=translation elongation factor activity
  Homolog annotation: Hit_ID=Q00WW9; Match level="QueryCoverage=71%, HitCoverage=35%, E-value=1e-31, Identity=46%"; Hit description =Homology to unknown gene
WEKYDAKGWTEKGAHKYGRLNEQSWWEKWGEHYDGRGSVLKWTDKWAETELGTKWGDKWEERFFKGIGSRHGETWHVSPSSERWSRTWGEEHFGNGYVFYSIPQNAFLKCCVSILYAASLIGFAFVCNRKVHKYGNSTTGESWDIVVDEETYYEAEPHYGWADVVGDSSQLLSIEPRERPPGVFPNLDFGSPPSPEAHDDSLEEDLPPSQ

SEQ ID NO: 121270 - protein, 696 aa, Glycine max
  Coding DNA Sequence Number=SeqID_4492
  Gene Ontology: Mol. function=transferase activity; Cellular component= mitochondrion; Biological process=metabolic process
  Homolog annotation: Hit_ID=Q8L844; Match level="QueryCoverage=91%, HitCoverage=90%, E-value=0.0, Identity=70%"; Hit description=Crp1 protein-like
  Pfam annotation: Domain name=PPR; Domain location=186-220; Score =47.5; E_value=4.4e-11; Accession=PF01535.11; Description=PPR repeat
  Pfam annotation: Domain name=PPR; Domain location=258-292; Score =12.4; E_value=0.25; Accession=PF01535.11; Description=PPR repeat
  Pfam annotation: Domain name=PPR; Domain location=293-327; Score =24.6; E_value=0.00036; Accession=PF01535.11; Description=PPR repeat
  Pfam annotation: Domain name=PPR; Domain location=328-362; Score =41.5; E_value=2.8e-09; Accession=PF01535.11; Description=PPR repeat
  Pfam annotation: Domain name=PPR; Domain location=363-397; Score =40.7; E_value=5.1e-09; Accession=PF01535.11; Description=PPR repeat
  Pfam annotation: Domain name=PPR; Domain location=398-432; Score =28.4; E_value=2.5e-05; Accession=PF01535.11; Description=PPR repeat
  Pfam annotation: Domain name=PPR; Domain location=433-467; Score =35.6; E_value=1.7e-07; Accession=PF01535.11; Description=PPR repeat
  Pfam annotation: Domain name=PPR; Domain location=468-502; Score =51.6; E_value=2.7e-12; Accession=PF01535.11; Description=PPR repeat
  Pfam annotation: Domain name=PPR; Domain location=503-537; Score =27.8; E_value=3.8e-05; Accession=PF01535.11; Description=PPR repeat
  Pfam annotation: Domain name=PPR; Domain location=538-572; Score =36.4; E_value=9.9e-08; Accession=PF01535.11; Description=PPR repeat
  Pfam annotation: Domain name=PPR; Domain location=573-607; Score =33.8; E_value=5.9e-07; Accession=PF01535.11; Description=PPR repeat
  Pfam annotation: Domain name=PPR; Domain location=608-642; Score =29.1; E_value=1.5e-05; Accession=PF01535.11; Description=PPR repeat
  Pfam annotation: Domain name=PPR; Domain location=643-677; Score =37.7; E_value=4e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=186-220::258 -292::293-327::328-362::363-397::398-432::433-467::468-502::503 -537::538-572::573-607::608-642::643-677
MFLLPPQLTTAPFPSISIHVTHFHFPTTHHRHNHNHNHNHVLPPPQSTANPITAKPIILEEGPDDILSFHNRRYDFTPLLTFLSNPSTTSDSDSNSTPPTSLGSTEFQLAESYRAVPAPLWHALLKSLCSSSSSIALAYAVVSWLQKHNLCFSYELLYSILINALGRSEKLYEAFLLSQRQVLTPLTYNALIGACARNGDVEKALNLMSKMRRDGYQPDFVNYSSIIQYLTRSNKIDSPILQKLYTEIETDKIEIDGHLMNDIILGFSKAGDPTRAMRFLAMAQSNGLNPKPSTLVAVILALGNSGRTHEAEALFEEIRENGSEPRTRAYNALLKGYVKTGSLKDAEFVVSEMEKAGVKPDEQTYSLLIDAYAHAGRWESARIVLKEMEASNVEPNSYVYSRILASYRDKGEWQKSFQVLKDMKSNGVQPDRHFYNVMIDTFGKYNCLDHAMATFERMLSEGIRPDTVTWNTLINCHCKSGRHNMAEELFGEMQQRGYSPCITTYNIMINSMGEQQRWEQVSLFLSKMQSQGLLPNSITYTTLVDVYGKSGRFSDAIECLEVLKSTGFKPTSTMYNALINAYAQRGLSELAVNAFRLMTTEGLTPSLLALNSLINAFGEDRRDAEAFAVLQYMKENNIEPDVVTYTTLMKALIRVEKFQKVPAVYEEMVTSGCTPDRKARAMLRSALRYMKQTLKS

SEQ ID NO: 121271 - protein, 433 aa, Glycine max
  Coding DNA Sequence Number=SeqID_4493
  Gene Ontology: Mol. function=carboxypeptidase A activity; Cellular component=extracellular space; Biological process=proteolysis
  Homolog annotation: Hit_ID=Q9FGZ7; Match level="QueryCoverage=81%, HitCoverage=81%, E-value=1e-150, Identity=73%"; Hit description =Arabidopsis thaliana genomic DNA, chromosome 5, TAC clone:K5J14
  Pfam annotation: Domain name=Peptidase_M14; Domain location=56-347; Score=77.9; E_value=3.1e-20; Accession=PF00246.14; Description=Zinc carboxypeptidase
MALSIFQFLLFSISLCFLASSFQDLLLLSVNAQSHNLTQPSVTPINYDLYHSSDNLMEEIRALVHRHPDKLTTETIKAGNKGYGAEVTVVTYCKEKKGNDERSKLRILISFGQHGRELITTELALRILSILSEEKILPSMDQASLNSALDKLVIKVVPMENLNGRKVVEAGDLCERRNGRGVDLNRNWSVDWGKKEKDYDPYEENPGIAPFSEPESQIMRKLAISFEPHLWVNVHSGMEALFMPYDHKNSTPDGLPMQRMRSLLEEVNQLHCQERCMIGSGGGSVGYFAHGTATDFMYDIVGVPMAFTFEIYGDGTASSRDCFKMFNPIDLATYNRVLSDWSATFFTIFKLVPQKLGDSKASILKLDKLVSIDEYLDGYLMERRNRYGKKMECYYCSCSVLEFQKLHSGTVGAYISGMTQTYCPKAPVVKGLC

SEQ ID NO: 121272 - protein, 55 aa, Glycine max
  Coding DNA Sequence Number=SeqID_4494
  Homolog annotation: Hit_ID=Q7X9C1; Match level="QueryCoverage=97%, HitCoverage=5%, E-value=4e-13, Identity=66%"; Hit description=NIN -like protein 1
MMGDGGVISSAATMMEAPPPDGTTTTSMDFDYMGELFLDGCWMEASADGSDFLLQ

SEQ ID NO: 121273 - protein, 765 aa, Glycine max
  Coding DNA Sequence Number=SeqID_4495
  Gene Ontology: Mol. function=DNA binding; Biological process =regulation of transcription
  Homolog annotation: Hit_ID=Q7X9C1; Match level="QueryCoverage=98%, HitCoverage=83%, E-value=0.0, Identity=73%"; Hit description=NIN -like protein 1
  Pfam annotation: Domain name=PB1; Domain location=671-754; Score =88.8; E_value=1.7e-23; Accession=PF00564.15; Description=PB1 domain
  Pfam annotation: Domain name=RWP-RK; Domain location=449-500; Score =99.6; E_value=9.1e-27; Accession=PF02042.6; Description=RWP-RK domain
  Pfam module annotation: Pfam domain module=PB1::RWP-RK; Domain location=671-754::449-500
MEKLIRALMWIKDYNRSKDMLIQIWVPVHKEGSPILAADDLLFSLESKSLNLAKYREISVTYKFSAEESDSKELAWGLPGRVFRDKVPEWTPDVRFFKIDEYPRVDHAQEYDVRGTLAVPIFEQGSKTCLGVIEVVMTTQQINYGPELESVCKALEAVDLRSSKQLSIQNVKACNRSYEAALPEIHEVLRSACEMHKLPLAQTWVPCVQQGKEGCRHSEDNYLLCISPVEHACYVGDPSIRSFHEACTEHHLLKGEGVAGGAFMTNQPCFSDDITSLSKKDYPMSHHARLFGLRAAVAIRLRSIYNSTDDFVLEFFLPVDCNDIEEQRKMLTSLSNIIQRVCRSLRVIREKELEEANLSVNEVIALADSGFTRDEICSEPQQKGMVASLDTEEKSSETMGRKFSEPRQQQESPILKGNLDCVRECSTSVEGNLSSPGTSKTGERRRVKAEKTITLQVLRQYFAGSLKDAAKNIGVCTTTLKRICRQHGIKRWPSRKIKKVGHSLQKLQLVIDSVQGASGAFQINSFYSNFPDLASPNLSGTGFFSTLNQSDNPNSTSTQPEHGSLSPEGASKSPSSSSSQSSISSHSCSSMSELQQQHTTNIASDKDPATVGEYSADVVLKLIRNEAKLKSLSQDRAKLLPRSLSQETLGEHPKTQYQLPLLKTSSSKVDSHRVKVTYGDEKTRFRMLKNWVYEDLLQEIGRKFNVSDMSKFDVKYLDDDCEWILLTCDADLEECIDVCQSSESGTIKLSLQPSSHSVRSSLEFR

SEQ ID NO: 121274 - protein, 1260 aa, Glycine max
  Coding DNA Sequence Number=SeqID_4496
  Gene Ontology: Mol. function=hedgehog receptor activity; Cellular component=integral to membrane; Biological process=cholesterol transport
  Homolog annotation: Hit_ID=UPI000034F451; Match level="QueryCoverage =86%, HitCoverage=85%, E-value=0.0, Identity=63%"; Hit description =hedgehog receptor
  Pfam annotation: Domain name=Patched; Domain location=436-1242; Score= -150.2; E_value=9.8e-10; Accession=PF02460.9; Description=Patched family
MIFVEYDMVYFITWLRLCLFYWLESDLEVFLILSLVEADDLSTRLLLTSNTNTTGERHSEDYCAMYDICGTRSDGKVVNCPHGSPAVKPDDLLSSKIQSLCPTITGNVCCTEAQFETLRTQVQQVSGNSTVGGIDYFVTDAFGEGLYESCKEVKFGTMNSRALQFIGAGAQNFKVLNCRNITNILALQNFRCALLVSLMLTLGLLLADWFAFIGRKAAPHGLGSPYAITFRPNATESSDMKPMNVSTYSCGDISLGCSCGDCPSSSVCSSSASTTTNKKDSCSVKIGTLMVKCVDLILAVLYVILICVFLGWGLYHRIRERKPTYRTKSMSNVISDGALYSHSREKDENVPMQIHMMEDAQQNRNRVRLSAVQGYMTNFYRKYGSYVARHPIMVLASSLAIVLLLCLGLIQFKVETRPEKLWVGPGSKAAQEKQFFDTHLAPFYRIEQLILATVPDNVNSTSPRIVTEDNIRFLFEIQKKVDAIRANYSGLTVSLQDICMKPLDKDCATQSVLQYFKMDPKNFDDYGGVEHLNYCFEANQMVDKCIEHYSSADRCMSAFKAPLDPSTVLGGFSGNDYSEASAFIVTYPVNNAINKEGNGTRKAVAWEKTFIQLVKDELLLMVQSRNLTLAFSSESSVEEELKRESTADAITILVSYLVMFAYISLTLGDTLHPSSFYISSKVMLGLSGVILVMLSVLGSVGFFSVLGVKSTLIIMEVIPFLVLAVGVDNMCILVHAVKRQKLELPLEGRISNALVEVGPSITLASVSEVLAFAVGSFISMPAIRVFSMFAALAVLLDFLLQVTAFVALIVLDSLRAEDKRVDCFPCIKVHADPDTGTGRRKPGLLARYMKEVHAPILSIWGVKIVVIAIFVGFALASIALSTRIEPGLEQEIVLPRDSYLQGYFNNVSEYLRIGPPVYFVVKNYNYSSESTHTNQLCSISHCNSDSLLNEIVRAALVPDTSYIAKPAASWLDDFLVWVSPEAFGCCRKFTNGSYCPPDDQPPCCAPGESSCVSVGTCKDCTTCFRHSDLHNDRPSTTQFREKLPWFLSSLPSADCAKGGHGAYTSSVELKGYDNGIIQASSFRTYHTPLNKQVDYVNSMRAAREFSSRVSDSLKKIEIFPYSVFYMFFEQYLHIWKTALINLAIAIGFDGHSEYPVECALGGQPCYVASGDRDQRAKEALGTMGASVFSGITLTKLVGVIVLCFSKTEVFVIYYFRMYLSLVLLGFLHGLVFLPVLLSVFGPPSRCSIIEQGEDRSSTSS

SEQ ID NO: 121275 - protein, 208 aa, Glycine max
  Coding DNA Sequence Number=SeqID_4497
  Gene Ontology: Mol. function=tetracycline:hydrogen antiporter activity; Cellular component=integral to membrane; Biological process=tetracycline transport
  Homolog annotation: Hit_ID=Q9FH08; Match level="QueryCoverage=92%, HitCoverage=94%, E-value=3e-48, Identity=52%"; Hit description =Similarity to tetracycline transporter protein
  Subcellular localization annotation: CTP_CleavageSite=31; ConfidenceScore=5.09e-01
MDFLLQADNIPESGRSTAFGILSGIASAAFVCGTLSARFLSTALTFQVSTLIAVIGALYMQFFLRDSAIDDKHLYTPIIHKKIQLYLRSMENWKVRSIFFKALRSIEDLTSFLNSSLTITQAAIVAFFNSLADVGLHGSLLYFLKAQFHFDKNQFADLMVISGIAGTVSQLLLMPILAPILGEARLLSVGLFFHCIHMFLYSIAWSSL

SEQ ID NO: 121276 - protein, 82 aa, Glycine max
  Coding DNA Sequence Number=SeqID_4498
  Homolog annotation: Hit_ID=Q851B2; Match level="QueryCoverage=92%, HitCoverage=21%, E-value=9e-12, Identity=40%"; Hit description =Putative ATP synthase subunit
MWRHMKERSLTNKGNRSKQEIKSIIGTKLIVQKTFEMKEDSKSGEWSDAVEVWKATHMRSNGTWCIPKGEKIMVKKKFILKS

SEQ ID NO: 121277 - protein, 145 aa, Glycine max
  Coding DNA Sequence Number=SeqID_4499
  Gene Ontology: Mol. function=RNA-directed DNA polymerase activity; Cellular component=intracellular; Biological process=RNA-dependent DNA replication
  Homolog annotation: Hit_ID=Q1SY67; Match level="QueryCoverage=78%, HitCoverage=13%, E-value=3e-33, Identity=59%"; Hit description =Peptidase aspartic, active site
MLDMLNEMLFLKGYRPLILYFSIPCPWPHYNHVSVKCLDHIAAKVLIDNGSSLNVMPKSMLDKLPFNASHLRSSSMVLRAFDDSRQDIRGEIDLPIQIGPHICQITFQVMDINPTYSYLLGRPWIHSVGVVPSTLHQRLKFVVEG

SEQ ID NO: 121278 - protein, 151 aa, Glycine max
  Coding DNA Sequence Number=SeqID_4500
MKMKANKTRNELKVWDSKTYQLKNEECTKKGQRTAKNGGKYSRNCSRKHLGSVMEAPQLGFSSRKHVFSPKTVEMHSIGARDTLQQPPPPRLFIEKMGRRLPPSSHRRTGILRKPQKPFFNKTGEELAAQLAQILWRWVLSLPKRSTIVLE

SEQ ID NO: 121279 - protein, 125 aa, Glycine max
  Coding DNA Sequence Number=SeqID_4501
  Gene Ontology: Mol. function=RNA-directed DNA polymerase activity; Cellular component=intracellular; Biological process=RNA-dependent DNA replication
MAPEDKEKTTFVTLWGMFCCKVMSFGLKNAGATYRRAMVALFHDTMHKEIEVYADDMISMSKTEEEHLVNLWKSGKLLGFIVCQKGIEVDPDKVTATCEPLFKLLCKNQSVQWNDDCQVAFGRTN

SEQ ID NO: 121280 - protein, 173 aa, Glycine max
  Coding DNA Sequence Number=SeqID_4502
MPAGLCYSDPGITPLRHPVDPEKSNKALGFPALITGHCQFYGVPVTPTKLICPPINRSFIEKYYMPRQAQQPRQDQQQQSALDAPPQPLQQPPSLESISAHMQRMELYMQHLANQQAANHRGQDPNPYPWPTPEQFEATVAWTRDRHNFQAGAGLTKAQGMRTKLRKRVTWKI

SEQ ID NO: 121281 - protein, 194 aa, Glycine max
  Coding DNA Sequence Number=SeqID_4503
MGRRVQIMRTSMTMLTQIWMTLLLSNIFPSDHNSDILLPKCQLVYAILTQVSVHVARLISDAIYQFAGITPLRHPVDPEKSNKALGFPALITGHCQFYGVPVTPTKLICPPINRSFIEKYYMPRQAQQPRQDQQQQSALDAPPQPLQQPPSLESISAHMQRMELYMQHLANQQAANHRGQVQLNDNFYQYTLHR

SEQ ID NO: 121282 - protein, 159 aa, Glycine max
  Coding DNA Sequence Number=SeqID_4504
MKVDMEALKDQVASMMEAMLSMKRIMESNTVAIAVASATVEADPTHSHATNQAHQPTPDMVGQGGEVLGSTGGPLIGYNRNAYPYGLPPNYMPPTVHMPNENANHVVPVTFEGQQPQPIGGAHEEPQEPAQGDFDLYPTFIAEGPTFNVVPQPNITGAP

SEQ ID NO: 121283 - protein, 200 aa, Glycine max
  Coding DNA Sequence Number=SeqID_4505
  Gene Ontology: Mol. function=methylmalonate-semialdehyde dehydrogenase (acylating) activity; Cellular component=integral to membrane; Biological process=valine metabolic process
  Homolog annotation: Hit_ID=Q8ZK61; Match level="QueryCoverage=60%, HitCoverage=24%, E-value=6e-47, Identity=75%"; Hit description =Putative NAD-dependent aldehyde dehydrogenase
MAPLQHDRARIDAHRAIRCGNHASDGGNSHAAALTLSLTARPANLPVADYGRRQHRHCHQARTLHQDLTHQRGNDMTIVGNFIGGKITHSASNETIPVYDPATGKVIRELTQSTAAEVAQAIEVAHAAFPEWSKTAPLRRARVMFNFKALMEKHRDELAALIVSEHGKVWSDALGELTRGIEVIEFACGIPHLIKGETHR

SEQ ID NO: 121284 - protein, 317 aa, Glycine max
  Coding DNA Sequence Number=SeqID_4506
  Gene Ontology: Mol. function=nucleic acid binding; Cellular component= intracellular; Biological process=chromatin modification
  Homolog annotation: Hit_ID=Q5UDB6; Match level="QueryCoverage=95%, HitCoverage=59%, E-value=4e-26, Identity=34%"; Hit description =INDETERMINATE-related protein 9
RDSFITHRAFCDALAQESAREAPNLSSAIGNQLYGNSNNMSLGLSQIPSIHDQNPQPSELMRLSGAPRAGQFDHILPPNIASSSPFRPSMQTPPFFMQEPNQTYHDSNKPFQGLIQLSDLNNNNAPSGSNFFNLPFLSNRANKNNNYSEEQQQFNTAEESNFFSESTMNIGTDHQANSTTTAPSLFSTNSLQNTNISHMSATALLQKAAQMGSTSSSNHNIINNNTTNNNPSASSILRSLASKSDQRQLGGGAGNYATIFNNSVQEMMDISGFEAYDHHGGMNKEQKLGVGGSDRLTRDFLGVAQQQQQQQREGFNL

SEQ ID NO: 121285 - protein, 170 aa, Glycine max
  Coding DNA Sequence Number=SeqID_4507
  Gene Ontology: Mol. function=electron carrier activity; Cellular component=chloroplast; Biological process=electron transport
  Homolog annotation: Hit_ID=P17340; Match level="QueryCoverage=92%, HitCoverage=94%, E-value=7e-44, Identity=60%"; Hit description =Plastocyanin, chloroplast precursor
  Pfam annotation: Domain name=Copper-bind; Domain location=69-159; Score=165.0; E_value=2e-46; Accession=PF00127.11; Description=Copper binding proteins, plastocyanina
  Subcellular localization annotation: CTP_CleavageSite=54; ConfidenceScore=5.72e-01
MATVTSAAVSIPSFTGLKASAGKVSAAAVKVSAPQATRFCGIKASLKDVGVAVVATAASAVLASNAMAIEVLLGTDDGSLVFSPNSFSVAPGEKIVFKNNAGFPHNVVFDEDEIPSGVDAGKISMSEEDLLNAAGETYSVTLDAKGTYSFYCSPHQGAEPNSSFLLGPMG

SEQ ID NO: 121286 - protein, 191 aa, Glycine max
  Coding DNA Sequence Number=SeqID_4508
  Homolog annotation: Hit_ID=Q2R1C8; Match level="QueryCoverage=56%, HitCoverage=24%, E-value=2e-07, Identity=25%"; Hit description=F-box domain containing protein
  Pfam annotation: Domain name=DUF295; Domain location=100-159; Score =40.6; E_value=5.5e-09; Accession=PF03478.8; Description=Protein of unknown function (DUF295)
MEIVLKDVYHHHQYWAHETKREDEEEEWGELPPELLESISKTLTIYGDYLRLRSQNPSPWLMLSRRVFFDLSDHAWEESNLVYRTVGFEVFKMNWGFLTCQRVETLGERLFFVGGNSSLSFCASEFDACSSDCIYFTDDYSESNEDDACGKHDLGVFSLRDKSIEPLPCFDHNSCSRLGWPLSIWVSPNPC

SEQ ID NO: 121287 - protein, 66 aa, Glycine max
  Coding DNA Sequence Number=SeqID_4509
MSIRELLRLLGVKNVELDENMSKRGKVPHIIGSGVKNVELDEKWLPTSQAGLGMVEVHIQFPKFVT

SEQ ID NO: 121288 - protein, 79 aa, Glycine max
  Coding DNA Sequence Number=SeqID_4510
MREELATQLAQASSARPGELGGFLQKQPPSGGTSWNAQVGLVAIFTVDAIGFDVLMMIMMRLKFKTILQDYKSQHQDDH

SEQ ID NO: 121289 - protein, 243 aa, Glycine max
  Coding DNA Sequence Number=SeqID_4511
  Gene Ontology: Mol. function=nucleic acid binding
MMDNQLTQVMIITTLEEFEYLSNSDDEGDTNSKIEYPQYNPRSCFGQVHLKVGMEFDTIKMFIKAARNYTIFHGRDLKWVKVDTIRARAHCKQIECPWEKFCSWSEVIRSFQIKTFLEEHICGKVLKNKQATMKWVAKRGADKLRVHPNLNHVEAHEHIREHYGVYIDERKMFKTIKEARSLVEGNACKQGFKAGCRPFIGLDGCFLNGYYGDHLLAPVGQDGLLPAMQEVMPDVKHTYCAKH

SEQ ID NO: 121290 - protein, 75 aa, Glycine max
  Coding DNA Sequence Number=SeqID_4512
MAHNHYVYNSMAEKEGKFSFTLAHPNFYQGRGREDRMRVLTRQPLQPWDLNAEDCNHQIAYRAMPAKMKNIQNLC

SEQ ID NO: 121291 - protein, 94 aa, Glycine max
  Coding DNA Sequence Number=SeqID_4513
MITRSNLVEQLREYQIRSKHDWASVSFFSSTSSNITTSRTCILLGIILKLGGGEKWLQVVIRFIGVGEDWYVIKIDVVTIYWSSCLGSMAKFQV

SEQ ID NO: 121292 - protein, 345 aa, Glycine max
  Coding DNA Sequence Number=SeqID_4514
  Gene Ontology: Cellular component=integral to peroxisomal membrane; Biological process=peroxisome organization and biogenesis
  Homolog annotation: Hit_ID=Q2QQS3; Match level="QueryCoverage=99%, HitCoverage=67%, E-value=1e-107, Identity=54%"; Hit description =LILLIM08, putative, expressed
  Pfam annotation: Domain name=Aa_trans; Domain location=1-330; Score =45.9; E_value=1.3e-10; Accession=PF01490.8; Description =Transmembrane amino acid transporter protein
MGKLLALFPIMYLSGGTCVTLIMIGAGTMKIFFQMVFGTPSPLTTIEWYLVFTCTAILLAQLPNLNSIAGVSLIGAITAVSYCVLICIVSVVQGRLHHVSYEPRRGHSESEASMILSAWNALGIIAFAFRGHNLVLEIQGTMPSDAKQPSRLAMWKGVMFAYIVIALCLFPLAIGGYWAYGNLIPTNGGMLGALQKYHEHDTSKFIIALISLLVVINSLSSFQIYAMPVFDNLEFRYTSKMNRPCPRWLRIAFRGLFGCLAFFIAVALPFLPSLAGLIGGVALPITLAYPCFMWIQIKKPQKCSTNWYINWTLGVVGMILSVLVVIGAIWGIVAQGIEIHFFNPR

SEQ ID NO: 121293 - protein, 536 aa, Glycine max
  Coding DNA Sequence Number=SeqID_4515
  Gene Ontology: Mol. function=oxidoreductase activity; Cellular component=cellulose and pectin-containing cell wall; Biological process=lignin catabolic process
  Homolog annotation: Hit_ID=Q6Z4A1; Match level="QueryCoverage=99%, HitCoverage=97%, E-value=0.0, Identity=69%"; Hit description =Putative PS60
  Pfam annotation: Domain name=Cu-oxidase; Domain location=164-302; Score=225.9; E_value=8.9e-65; Accession=PF00394.12; Description =Multicopper oxidase
  Pfam annotation: Domain name=Cu-oxidase_2; Domain location=382-522; Score=156.7; E_value=6e-44; Accession=PF07731.4; Description =Multicopper oxidase
  Pfam annotation: Domain name=Cu-oxidase_3; Domain location=38-154; Score=178.1; E_value=2.1e-50; Accession=PF07732.5; Description =Multicopper oxidase
  Pfam module annotation: Pfam domain module=Cu-oxidase::Cu-oxidase _2::Cu-oxidase_3; Domain location=164-302::382-522::38-154
MPLKLAGVATVGSLLLCVAISLFHIAGAEDPYRFFNWNITYGDIYPLGVRQTGILINGQFPGPDIHSVTNDNLIINVFNSLDEPFLLSWNGIQQRRNSFEDGVFGTTCPIPAGKNFTYILQVKDQIGTFYYFPSLAFHKAAGGFGGIRILSRPRIPVPFPDPAGDYTVLIGDWYKSNHTTLKARLDRGKKLPFPDGILINGRGPNGVSFNVEQGKTYRLRISNVGLQHSLNFRIQNHKMKLVEVEGTHTLQTMYSSLDVHVGQSYSVLVTADQPAQDYYIVVSTRFSYKVLTTTGVLRYSNSAGPVSGPPPGGPTIQIDWSLNQARSIRTNLTASGPRPNPQGSYHYGMINTTKTIILASSAGQVNGKQRYAINSVSYVVPDTPLKLADYFKISGVFRPGSISDRPTGGGIYLDTSVLQADYRNFVEIVFQNNENIVQSYHLDGYSFFVVGMDGGQWTTASRNQYNLRDAVARCTTQVYPFSWTAIYIALDNVGMWNLRSEFWARQYLGQQLYLRVYTTSTSIRDEFPVPKNAILC

SEQ ID NO: 121294 - protein, 162 aa, Glycine max
  Coding DNA Sequence Number=SeqID_4516
  Gene Ontology: Cellular component=integral to peroxisomal membrane; Biological process=peroxisome organization and biogenesis
  Homolog annotation: Hit_ID=Q9SXF7; Match level="QueryCoverage=96%, HitCoverage=32%, E-value=2e-43, Identity=52%"; Hit description=Amino acid transporter-like protein 1
MEEVVEVKVSARPRETQSSLQGISTPSEDGVKSPFATRFLSTPLASPMKKAIENMQGYLGEVGRFTKLDPQDDWLPITESRKGNAYYAAFHVLSSGIGFQALVLPLAFTTLGWTWGVICLCVAFTWQLYTLWLLIQLHESDSGLRHSRYLRLAMAAFDWLNI

SEQ ID NO: 121295 - protein, 696 aa, Glycine max
  Coding DNA Sequence Number=SeqID_4517
  Gene Ontology: Mol. function=nucleoside-triphosphatase activity; Cellular component=integral to membrane; Biological process=protein catabolic process
  Homolog annotation: Hit_ID=Q9BAE0; Match level="QueryCoverage=99%, HitCoverage=100%, E-value=0.0, Identity=77%"; Hit description=Cell division protease ftsH homolog, chloroplast precursor
  Pfam annotation: Domain name=AAA; Domain location=277-464; Score =333.4; E_value=3.9e-97; Accession=PF00004.19; Description=ATPase family associated with various cellular activities (AAA)
  Pfam annotation: Domain name=AAA_2; Domain location=274-405; Score= -36.8; E_value=0.0058; Accession=PF07724.4; Description=ATPase family associated with various
  Pfam annotation: Domain name=AAA_3; Domain location=277-408; Score= -22.1; E_value=0.086; Accession=PF07726.2; Description=ATPase family associated with various
  Pfam annotation: Domain name=AAA_5; Domain location=277-412; Score =3.4; E_value=0.00098; Accession=PF07728.4; Description=ATPase family associated with various
  Pfam annotation: Domain name=ABC_tran; Domain location=271-401; Score= -60.1; E_value=0.036; Accession=PF00005.17; Description=ABC transporter
  Pfam annotation: Domain name=FtsH_ext; Domain location=114-251; Score= 139.9; E_value=6.9e-39; Accession=PF06480.5; Description=FtsH Extracellular
  Pfam annotation: Domain name=Peptidase_M41; Domain location=471-685; Score=444.9; E_value=1.1e-130; Accession=PF01434.8; Description =Peptidase family M41
  Pfam module annotation: Pfam domain module=AAA::AAA_2::AAA_3::AAA _5::ABC_tran::FtsH_ext::Peptidase_M41; Domain location=277-464::274 -405::277-408::277-412::271-401::114-251::471-685
  Subcellular localization annotation: CTP_CleavageSite=47; ConfidenceScore=5.73e-01
MAFATSALVCSNLLGRKVLVTSKSSTPLPFLFKRSILKAQNSEQVKSASSRAALAALIVSSASLSVTPEALAADNLTPPPVIEAQQSQPSSPFSQNLLLTAPKPQSSSDLPEGTNWRYSDFLNAVKKGKVERVRFSKDGSALQLTAVDGRRASVIVPNDPDLIDILAMNGVDISVAEGESPNSLFNIVGNLLFPLLAFAGLFFLFRRAQGGPGGPGGMGGPMDFGRNKSKFQEVPETGVSFADVAGADQAKLELQEVVDFLKNPDKYTALGAKIPKGCLLVGPPGTGKTLLARAVAGEAGVPFFSCAASEFVELFVGVGASRVRDLFEKAKGKAPCIVFIDEIDAVGRQRGAGLGGGNDEREQTINQLLTEMDGFSGNSGVIVLAATNRPDVLDSALLRPGRFDRQVTVDRPDVAGRVKILQVHSRGKALAKDVDFEKIARRTPGFTGADLQNLMNEAAILAARRDLKEISKDEISDALERIIAGPEKKNAVVSDEKKKLVAYHEAGHALVGALMPEYDPVAKISIIPRGQAGGLTFFAPSEERLESGLYSRSYLENQMAVALGGRVAEEVIFGQENVTTGASNDFMQVSRVARQMVERFGFSKKIGQVAIGGPGGNPFLGQQMSSQKDYSMATADVVDAEVRELVERAYSRATHIITTHIDILHKLAQLLIEKETVDGEEFMSLFIDGKAELYVA

SEQ ID NO: 121296 - protein, 569 aa, Glycine max
  Coding DNA Sequence Number=SeqID_4518
  Gene Ontology: Mol. function=transferase activity; Cellular component= mitochondrion; Biological process=protein amino acid phosphorylation
  Homolog annotation: Hit_ID=Q1SMD3; Match level="QueryCoverage=81%, HitCoverage=91%, E-value=3e-50, Identity=27%"; Hit description=TonB box, N-terminal; Tetratricopeptide-like helical
  Pfam annotation: Domain name=PPR; Domain location=108-142; Score=1.6; E_value=4.8; Accession=PF01535.11; Description=PPR repeat
  Pfam annotation: Domain name=PPR; Domain location=143-177; Score =19.3; E_value=0.014; Accession=PF01535.11; Description=PPR repeat
  Pfam annotation: Domain name=PPR; Domain location=178-212; Score =45.7; E_value=1.5e-10; Accession=PF01535.11; Description=PPR repeat
  Pfam annotation: Domain name=PPR; Domain location=213-247; Score =24.2; E_value=0.00046; Accession=PF01535.11; Description=PPR repeat
  Pfam annotation: Domain name=PPR; Domain location=249-283; Score =44.7; E_value=3.1e-10; Accession=PF01535.11; Description=PPR repeat
  Pfam annotation: Domain name=PPR; Domain location=284-318; Score =45.3; E_value=2.1e-10; Accession=PF01535.11; Description=PPR repeat
  Pfam annotation: Domain name=PPR; Domain location=319-353; Score =28.0; E_value=3.3e-05; Accession=PF01535.11; Description=PPR repeat
  Pfam annotation: Domain name=PPR; Domain location=354-388; Score =27.9; E_value=3.6e-05; Accession=PF01535.11; Description=PPR repeat
  Pfam annotation: Domain name=PPR; Domain location=389-423; Score =44.4; E_value=3.9e-10; Accession=PF01535.11; Description=PPR repeat
  Pfam annotation: Domain name=PPR; Domain location=424-458; Score =39.7; E_value=1e-08; Accession=PF01535.11; Description=PPR repeat
  Pfam annotation: Domain name=PPR; Domain location=73-107; Score=17.5; E_value=0.049; Accession=PF01535.11; Description=PPR repeat
  Pfam module annotation: Pfam domain module=PPR::PPR::PPR::PPR::PPR::PP R::PPR::PPR::PPR::PPR::PPR; Domain location=108-142::143-177::178 -212::213-247::249-283::284-318::319-353::354-388::389-423::424 -458::73-107
MGSIRGAEAWFVKIAYTVCVRANLLDPLVGYFSNHLTPSLVYEVVDKLSIIPHFGFKFVEFSRHKLHMSHSYLTYSLLLRSLCRSNLHHTAKVVYDWMRCDGQIPDNRLLGFLVSSYAIVGRLDVSRELLADVQCNNVGVNAVVYNDLFNVLIRQNKVVDAVVLFRELIRLRYKPVTYTVNILIRGLCRVGEIDEAFKLLKDLRSFGCLPDVITYNTLIHGLCLINEVDRARSLLREVCLNGEFAPDVVSYTMIISGYCKLRKMEEGSLLFDEMINSGTAPNTFTFNALIDGFGKLGDMASALALYSKMLVQGCLPDVATFTSLINGHFRVRQVHQAMDMWHKMNEKNIGASLYTYSVLVSGLCNNNRLHKARDILRLLNESDIVPQPFIYNPVIDGYCKSGNVDEANKIVAEMEVNRCKPDKLTFTILIIGHCMKGRMPEAIGFFDKMLAVGCAPDEITVNNLRSCLLKAGMPGEAARVKEVLAQNLTLGTTSSKKSYHETTYCYGKVQTSGLTRHSTIMPRVLGAGVSSLWINGMLSSDRVSLVSGDYQYLHLHCHSLQVSADYFWT

SEQ ID NO: 121297 - protein, 320 aa, Glycine max
  Coding DNA Sequence Number=SeqID_4519
  Gene Ontology: Mol. function=DNA topoisomerase (ATP-hydrolyzing) activity; Cellular component=chromosome; Biological process=DNA topological change
  Homolog annotation: Hit_ID=Q6ESQ5; Match level="QueryCoverage=97%, HitCoverage=83%, E-value=3e-58, Identity=37%"; Hit description =Putative bZIP protein
  Pfam annotation: Domain name=DUF632; Domain location=1-211; Score =96.7; E_value=6.9e-26; Accession=PF04782.3; Description=Protein of unknown function (DUF632)
AEEKLRMLHQKKCKQLRRMKQKDANAQKIDSVQTFVGILSTKMKISIQVVDKISITISKLREEELWPQINRFFLKFLGMWKDMQECYKCQYQQIVEAKTLDASSLNTKPGNAHIDATIKLKSEVQKWNLSFLDWIHAQKSHVKALNGWLVRCLLYEPEEVPDDSTPFSPSKIGAPPVFVICHKWSQAVDNLSEKNIIEAVNGFMLRVNELWEKYILDLQQKLTLDKEFERKVKMLEREEQKMHKVMRAHEKKMVTVGREESDALLRGDAVHHADVVDTTNLQSGLKQIFGAMEKFTDSTVRLYEELCQQIKQEEKPTKIN

SEQ ID NO: 121298 - protein, 108 aa, Glycine max
  Coding DNA Sequence Number=SeqID_4520
  Homolog annotation: Hit_ID=Q93XF8; Match level="QueryCoverage=31%, HitCoverage=9%, E-value=1e-07, Identity=73%"; Hit description =Kinesin heavy chain
MQRTLYNHSSIAENLLWWFYALAVVKFTLLCKTCWYTFTFDKVFNHGASQQDAFIEISQLVQSALHGYKLFEDKLAPWQLEPKCGPLSKPSKLNCGASIGVVSLMLCF

SEQ ID NO: 121299 - protein, 122 aa, Glycine max
  Coding DNA Sequence Number=SeqID_4521
MNEGVSKESRSMVDNGLENLGLIMTIREGYNNGGDIEKYLNHVIVVEVDVDASYSERGSVECHVDMVVPTYWPGSNTKYFRQVFEFIKLLESSHVDGNKVALSLIQRKTYGSKVALSRIGQA

SEQ ID NO: 121300 - protein, 86 aa, Glycine max
  Coding DNA Sequence Number=SeqID_4522
  Subcellular localization annotation: CTP_CleavageSite=48; ConfidenceScore=5.71e-01
MAMAFPPAKFSAGKCKALQLSLAHQWAKRASTAKRNFSALSATKESSRASASWPRAKREISALSTVDVFSQAQRTTGAKPESTYSH

SEQ ID NO: 121301 - protein, 210 aa, Glycine max
  Coding DNA Sequence Number=SeqID_4523
  Gene Ontology: Mol. function=pepsin A activity; Cellular component =cellulose and pectin-containing cell wall; Biological process =proteolysis
  Homolog annotation: Hit_ID=Q9LI73; Match level="QueryCoverage=99%, HitCoverage=49%, E-value=8e-59, Identity=54%"; Hit description =Chloroplast nucleoid DNA binding protein-like; nucellin-like protein
  Subcellular localization annotation: CTP_CleavageSite=55; ConfidenceScore=5.26e-01
MGLGRGPISFTSQLARKLSNTKTTNTFSYCLLDYTLSPPPTSYLTIGPTPNDVVSRNSFTYTPLLTNPFSPSFYYISIQSVSVDGVRLPISLSRRAAYGKILAAFRRRVRLPAVESAAALGFDLCVNVSGVARPKLPRLRFRLAGKAVLSPPVGNYFIEPAEGVKCLAVQPVRPDSGFSVIGNLMQQGYLFEFDLDRSRIGFTRHGCAVR

SEQ ID NO: 121302 - protein, 147 aa, Glycine max
  Coding DNA Sequence Number=SeqID_4524
  Gene Ontology: Mol. function=pepsin A activity; Biological process =proteolysis
  Homolog annotation: Hit_ID=Q9LI73; Match level="QueryCoverage=59%, HitCoverage=19%, E-value=7e-27, Identity=63%"; Hit description =Chloroplast nucleoid DNA binding protein-like; nucellin-like protein
  Subcellular localization annotation: CTP_CleavageSite=87; ConfidenceScore=5.25e-01
MSSHPSLFSLSFFLLLSLPQHSFSSTEEYLKLPLLPRTPLPSPSHLLAADLRRLSANSPLTSGAPTGSGQYFASLRLGSPPQRLLLVADTGSDLIWVKCSGCRRNCSSTAFLPRHSASFSPHHCYDSPCQLVPHPPSPRNHLCNNHT

SEQ ID NO: 121303 - protein, 558 aa, Glycine max
  Coding DNA Sequence Number=SeqID_4525
MVGLIIRTNVDHEALGFMDDLTHVDADHEALGFTNSLTHGDAGHEDFGFMDSLTHVYQHKEDDLGVEALIVEEHHKLKCFFSVSASNDLPNLEVLIIKGAAELEELIEYEQGKGDEIGKVKIELPKLKLLLFTCLLNLGQRIELLTVKHPFVHNCPKLYLTSTVDIHDQEFCDIVCNEFKDFENFPWWELYGLINPIISSIRASTISGTGELLSSQALFRFMKNERRNLLGMFLVQRSWWTDNQLVDHIFQTNKSHLEKLKVPLEFLRQSVWTFPMHPCLEFFAKVTPLVLSSISDFGILQHFMVPVKPPKPEQQQKEQDPTPENTSPFQMNTEDPSTSKSKPSSSQVNDKNQSVLRSIAEMIHQHKQIVRGAPVSEPDEFHQLNRESERTSQLQSSEKKMSHISSPNMTENMEEIGKESIQEEPVSEETTVKTSSSGVDSITLSSGVATHNESSGRDILAKDSQVVEQDDKLNESKTRITPCKMIKIQEGWNLMDKKEGIYIVLPVFQEGEAGVGEGRVERESRQQQRTSFQTSIHAPKKISQNCKKELKNSFIIYR

SEQ ID NO: 121304 - protein, 180 aa, Glycine max
  Coding DNA Sequence Number=SeqID_4526
AVTSWYFWPPGIIESRNVFITFWIGLDILKAKKGILFRNVILYFGLTILKAITEGHPAALLVHPANFQNGKNALQPFCQTSSVDTCGRRTAEEPSSVELHGRTSSARVNGRRFFRGLPQKKSHTSSSLHFSNSDHAIGVGLIAFSVKMTNKAKGKGKEVAGKGSTGKCKGAFDDDKTDGG

SEQ ID NO: 121305 - protein, 369 aa, Glycine max
  Coding DNA Sequence Number=SeqID_4527
  Gene Ontology: Mol. function=transcription regulator activity; Cellular component=nucleus; Biological process=regulation of transcription
  Homolog annotation: Hit_ID=Q9S7Y1; Match level="QueryCoverage=67%, HitCoverage=67%, E-value=5e-70, Identity=58%"; Hit description =Putative DNA-binding protein; 36199-34606
  Pfam annotation: Domain name=HLH; Domain location=175-224; Score =44.9; E_value=2.8e-10; Accession=PF00010.16; Description=Helix-loop -helix DNA-binding domain
ELEDQGQCSSPPIINNNIQSYQEHLLLQQQMQQNSDIFGGGGGSKGLMFPPEVVSSILQQQPWSIPPVPSFNPNPVHYNNTNPVHHHEQASSFLVPPPTTTPSPYASFFSSRRVVPSLHFAYEGPSSHHDHHHLRIISDTLGPMVQPGSAAPFGLQAELGRMTAQEIMEAKALAASKSHSEAERRRRERINNHLAKLRSLLPNTTKTDKASLLAEVIQQVKELKRQTSLIVEMSTVPTESDELTVDAIDEDGKFVIKASLCCEDRSDLLPDLIKTLKALRLRTLRAEITSLGGRVKNVLVITGDEEENSNTNNGEQSMQQQYCISSIQEALKAVMEKSGGGDESASGNVKRQRTTTTNNKINILEQSSL

SEQ ID NO: 121306 - protein, 73 aa, Glycine max
  Coding DNA Sequence Number=SeqID_4528
MFQAKEENVKVVDDSLNETNWPSKMHLLSEAFISLSGWEALEEDKSEICMPNVQSAHPVRTLSLFALSAPILI

SEQ ID NO: 121307 - protein, 673 aa, Glycine max
  Coding DNA Sequence Number=SeqID_4529
  Gene Ontology: Mol. function=protein phosphatase type 2A regulator activity; Cellular component=protein phosphatase type 2A complex; Biological process=signal transduction
  Homolog annotation: Hit_ID=Q10SP2; Match level="QueryCoverage=86%, HitCoverage=83%, E-value=1e-143, Identity=44%"; Hit description =Expressed protein
  Pfam annotation: Domain name=WD40; Domain location=227-265; Score =37.2; E_value=5.7e-08; Accession=PF00400.22; Description=WD domain, G-beta repeat
  Pfam annotation: Domain name=WD40; Domain location=303-340; Score =39.7; E_value=9.8e-09; Accession=PF00400.22; Description=WD domain, G-beta repeat
  Pfam annotation: Domain name=WD40; Domain location=358-397; Score =27.0; E_value=6.7e-05; Accession=PF00400.22; Description=WD domain, G-beta repeat
  Pfam annotation: Domain name=WD40; Domain location=400-438; Score =0.3; E_value=34; Accession=PF00400.22; Description=WD domain, G-beta repeat
  Pfam annotation: Domain name=WD40; Domain location=450-489; Score =7.4; E_value=5; Accession=PF00400.22; Description=WD domain, G-beta repeat
  Pfam annotation: Domain name=WD40; Domain location=491-530; Score =9.5; E_value=2.8; Accession=PF00400.22; Description=WD domain, G -beta repeat
  Pfam annotation: Domain name=WD40; Domain location=629-668; Score =12.0; E_value=1.5; Accession=PF00400.22; Description=WD domain, G -beta repeat
  Pfam module annotation: Pfam domain module=WD40::WD40::WD40::WD40::WD4 0::WD40::WD40; Domain location=227-265::303-340::358-397::400 -438::450-489::491-530::629-668
MEEEEDQFYETREELCSVSDVGSDCSESDESSSGNNGHVTRYQGEELGDQPCGIDRITATSGAVLRTSFAVEEGLPSTSNQIVLDSLSDEASGSQENCENLACMIRNLDDGTQYIVDKLGQDGAPSTLRVLGSNQLISLEEFQRNIGPSSFVRRHLQRDTENTRLLRVGKRKMKRGWLRKLDSIACFVHNHGLDETKYKDCDSVDRSGVQRVRVHSYRKRVKELSSLYTEQEFKAHKGVILTMKFSLDGKYLASGGEDGMVRVWKVVEDERSNKEKLVKTEKLRRSSEATCVIVPPKTFRISSKPLHEFQGHSGDILDLAWSKRGFLLSSSVDKTVRLWHVGIDRCLRVFSHNNYGELLLPWLISDFDNVVTCVNFNPVNDNFFISGSIDGKVRIWEVVHCRVSDYIDIREIVTAVCFRPDGKGTIVGTMASNCRFYDIVDNHLQLDVQLCLRGKKKTSGKKITGFQFSPSDPSKLLVASADSHVCILSGVDVIYKFKGLRSAGQMHASFTTDGKHIISVSEDSHVCIWNYTGQDRSTSKAKKIWSSESFLSHNAAIAVPWCGIESMPGTLLSPSLGEDVNQKCSLPSPDCFFLSRGFLSELIPKVSATWPEETLVDSSCQTQTVVSPTMCKSEYKFLRSACKGMSNSHLWGQVIVTAGWDGYIRVYQNYGLP

SEQ ID NO: 121308 - protein, 52 aa, Glycine max
  Coding DNA Sequence Number=SeqID_4530
MYIISYTRFTSKGVKLFTKSGEGIMGRRKIEMAEVKDSSAKQVTFSFWAPKC

SEQ ID NO: 121309 - protein, 616 aa, Glycine max
  Coding DNA Sequence Number=SeqID_4531
  Gene Ontology: Mol. function=methyltransferase activity; Cellular component=cellulose and pectin-containing cell wall; Biological process=metabolic process
  Homolog annotation: Hit_ID=Q6EP94; Match level="QueryCoverage=95%, HitCoverage=96%, E-value=0.0, Identity=56%"; Hit description =Dehydration-responsive family protein-like
  Pfam annotation: Domain name=DUF248; Domain location=101-604; Score =1167.3; E_value=0; Accession=PF03141.7; Description=Putative methyltransferase
  Pfam annotation: Domain name=Methyltransf_11; Domain location=218 -306; Score=10.0; E_value=0.0056; Accession=PF08241.2; Description =Methyltransferase domain
  Pfam module annotation: Pfam domain module=DUF248::Methyltransf_11; Domain location=101-604::218-306
MGKDGSPKHYGQFDSKRNRLTWILGVSGLCILSYIMGAWKNTPSPNSQSEILSKVDCNVGSTTSGMSSSATNLNFESHHQIDVNDSGGAQEFPPCDMSFSEYTPCQDPVRGRKFDRNMLKYRERHCPAKEELLNCLIPAPPKYKTPFKWPQSRDYAWYDNIPHKELSIEKAIQNWIQVEGDRFRFPGGGTMFPRGADAYIDDINELIPLTSGTIRTAIDTGCGVASWGAYLLKRDIIAMSFAPRDTHEAQVQFALERGVPAMIGIMASQRIPYPARAFDMAHCSRCLIPWHKFVDRVLRPGGYWILSGPPIRWKKYWRGWERTEEDLKQEQDAIEEVAKRICWTKVVEKDDLSIWQKPKNHVGCAQTKQIYKTPHMCQSDNPDMAWYQNMEKCITPLPEVNSADKMAGGALEKWPKRAFAVPPRISSGSIPSIDTEKFQKDNEVWRERIAHYKHLVPLSQGRYRNVMDMNAYLGGFAAALIKFPVWVMNVVPPNSDHDTLGAIYERGFIGTYHDWCEAFSTYPRTYDLIHASNVFGIYQDRCNITQILLEMDRILRPEGTVIFRETVELLVKIKSITDGMKWKSNIIDHESGPFNPEKILVAEKAYWTGEAKEKQN

SEQ ID NO: 121310 - protein, 475 aa, Glycine max
  Coding DNA Sequence Number=SeqID_4532
  Gene Ontology: Mol. function=protein serine/threonine kinase activity; Cellular component=membrane; Biological process=protein amino acid phosphorylation
  Homolog annotation: Hit_ID=Q9AWA6; Match level="QueryCoverage=91%, HitCoverage=97%, E-value=0.0, Identity=83%"; Hit description =Serine/threonine/tyrosine kinase
  Pfam annotation: Domain name=Pkinase; Domain location=135-419; Score =201.9; E_value=1.5e-57; Accession=PF00069.15; Description=Protein kinase domain
  Pfam annotation: Domain name=Pkinase_Tyr; Domain location=135-419; Score=222.7; E_value=8.2e-64; Accession=PF07714.7; Description =Protein tyrosine kinase
  Pfam module annotation: Pfam domain module=Pkinase::Pkinase_Tyr; Domain location=135-419::135-419
MLESGAKFPGIIDLNKNNNNYYDFSQGFYHKLGEGTNMSIDSVGSLQTSNGGGSVAMSIDNSSVGSNDSHTRMLDHQGLRRRANDNYSVAHSANRRGRVTHALSDDALAQALMDNSSPTEGLDNFDEWTIDLRKLNMGEPFAQGAFGKLYRGTYNGEDVAIKILERPENDPAKAQLMEQQFQQEVTMLATLKHSNIVRFIGACRKPMVWCIVTEYAKGGSVRQFLMKRQNRSVPLKLAVKQALDVARGMAYVHGLGFIHRDLKSDNLLIFGDKSIKIADFGVARIEVQTEGMTPETGTYRWMAPASPGAAVKLCLGDLLVMGSNPETASLHMQGEMIQHRPYTQKVDVYSFGIVLWELITGMLPFQNMTAVQAAFAVVNRNVRPIIPNDCLAVLRDIMTRCWDPNPDVRPPFAEIVGMLENAENEIMTTVRKARFRQHKMRSWAKTFALYVRLLAPKLTTTPGIDILPGLVQRGA

SEQ ID NO: 121311 - protein, 1280 aa, Glycine max
  Coding DNA Sequence Number=SeqID_4533
  Gene Ontology: Mol. function=protein serine/threonine kinase activity; Cellular component=integral to membrane; Biological process=protein amino acid phosphorylation
  Homolog annotation: Hit_ID=Q1S8T0; Match level="QueryCoverage=93%, HitCoverage=91%, E-value=1e-151, Identity=46%"; Hit description =Protein kinase
  Pfam annotation: Domain name=Adeno_E3_CR2; Domain location=219-264; Score=12.5; E_value=0.026; Accession=PF02439.6; Description =Adenovirus E3 region protein CR2
  Pfam annotation: Domain name=LRR_1; Domain location=858-880; Score =11.0; E_value=2.5; Accession=PF00560.23; Description=Leucine Rich Repeat
  Pfam annotation: Domain name=LRR_1; Domain location=882-904; Score =8.9; E_value=6.3; Accession=PF00560.23; Description=Leucine Rich Repeat
  Pfam annotation: Domain name=LRR_1; Domain location=906-928; Score =12.1; E_value=1.5; Accession=PF00560.23; Description=Leucine Rich Repeat
  Pfam annotation: Domain name=LRR_1; Domain location=930-952; Score =4.1; E_value=49; Accession=PF00560.23; Description=Leucine Rich Repeat
  Pfam annotation: Domain name=LRR_1; Domain location=954-976; Score =16.2; E_value=0.12; Accession=PF00560.23; Description=Leucine Rich Repeat
  Pfam annotation: Domain name=LRR_1; Domain location=979-1001; Score =1.5; E_value=1.5e+02; Accession=PF00560.23; Description=Leucine Rich Repeat
  Pfam annotation: Domain name=Pkinase; Domain location=289-555; Score =123.5; E_value=6e-34; Accession=PF00069.15; Description=Protein kinase domain
  Pfam annotation: Domain name=Pkinase_Tyr; Domain location=285-555; Score=84.1; E_value=4.4e-22; Accession=PF07714.7; Description =Protein tyrosine kinase
  Pfam annotation: Domain name=zf-CCHC; Domain location=750-767; Score =25.3; E_value=6.6e-05; Accession=PF00098.13; Description=Zinc knuckle
  Pfam module annotation: Pfam domain module=Adeno_E3_CR2::LRR_1::LRR _1::LRR_1::LRR_1::LRR_1::LRR_1::Pkinase::Pkinase_Tyr::zf-CCHC; Domain location=219-264::858-880::882-904::906-928::930-952::954-976::979 -1001::289-555::285-555::750-767
NLSLLLLALVFLPLKLVISGNQCTDKCGGVSIQFPFYLRNSKLNHTAEYPPGFDLLCTENKKTLILELPNVPTKLAVRKIDYKSQQIQIYDPANCLPSQLLQLSSASISPFQFPSYDYAFKTRRNFSFFRCDSMSSSCPILLLSSYLDVIRFPEILSCTKVKDVLSANWMDQYSLYDPTVTIEWSKPDCKHCETQNQKCKWKNSTKVETECFVCSTNTTPTSTIVLIAAGGIVGLMLLVLTVTCIVCVYHYYEKKGEDQARIEKFLEDYRAMKPTRFTYADIKRITNGFSESLGEGAHGVVFKGMLSREILVAVKILNDTVGDGKDFINEVGTIGKIHHVNVVRLLGFCADGFHRALVYDFFPNGSLQRFLAPPDKKDAFLGWEKLQQIALGVARGIEYLHLGCDHRILHFDINPHNVLLDDNLVPKITDFGLSKLCPKNQSTVSMTAARGTLGYIAPEVFSRNFGNVSYKSDIYSYGMLLLEMVGGRKNIDAEESFQVLYPEWIHNLLEGRDVQISVEDEGDVEIAKKLAIVGLWCIQWNPVNRPSMKTVVQMLEGVGDELIAPPTPFDISGSSRTNDDVPTSRQNFKGEEIPTNLSEKEKKDLLNKAHSALILSMGDKVMREISKEKTAATIWLKLENLYMTKSLVNRLFLKQKLYTLKMPSGKALEDHLNDFNKIFLIWKKIEIKLGDEDHALLLLKSLPSEFDSLSDTLIWQGLTVIGESLDYFILKGIKEEVSGKRSKSKEGKKRKCFSCGSEEHLKKECHEYKKKKRHGDQRSHNGDAAVVSEGYESDEVMRVSEVSIKPEWVLDSGCTFQCVLTWIGSAHMRKAMEGRKYSIAVNNFGGHLPNSLGNLSTQLSQLYLGNNQMFGKIPSEIGNLVNLFVLSILYNHFEGIIPSAFGKLQKMQALELSGNKLSGVIPTSIGHFSRLFYLGLGENMLEGNILPSIGTCQKLQYLNLSHNNLRGAIPLEIFNLSSLTDALAVSQNSLSGSIPKEVGKLKHIDLLDVSENHQSGDIPGTIGECLMLPLFARNHSILFGITPRSSTFRPVPKPPVPTEGVFRNLVQILTCSSTDYNEHPRTLNLDQRLNIIIDVASALHYLHHECEQPIIHCDLKPSNVLLDDDMVAHVNDFGIARLLSTINGTPSKQTSTIGIKGTVGNKYEMGSDVSINGDMYSFGILVLEMLTGRKLTDEIFEDGQNLHNFVENSFPDNILQILDPSLVPNHGEAKFEEENGVETREEFKSAAEMDTRNKSEHFSTADMKKGIITFRIDDRIEIKK

SEQ ID NO: 121312 - protein, 515 aa, Glycine max
  Coding DNA Sequence Number=SeqID_4534
  Gene Ontology: Mol. function=lipid-A-disaccharide synthase activity; Biological process=lipid A biosynthetic process
  Homolog annotation: Hit_ID=Q5JMX5; Match level="QueryCoverage=77%, HitCoverage=90%, E-value=1e-108, Identity=53%"; Hit description =Putative Lipid-A-disaccharide synthase
  Pfam annotation: Domain name=LpxB; Domain location=101-489; Score =154.4; E_value=2.9e-43; Accession=PF02684.6; Description=Lipid-A -disaccharide synthetase
MIIVMFTVVTINIISALTSDGSGDNDENHVGGDNNDHEGNYNGDGGGSNDDNHHDDGQAYPAHCYALKVDPSNFVGSKIFTEKEMQPKPKPEHPESAMVLSFIVESSSDDRDGCKRWGTEGLPCCRVKMTSEGLQSLFPIEDISVMGLWELLPHLYRIRVKLNETVKAAALFEPHVVLTIDSKGFSFRFLKQLRARYRQKKLHSPAHFHYVAPSFWAWKGGETRLRGLAEFVDHLLCILPNEDKICRLNGLCATFVGHPVLEDVLELNLRNNSSIHEWKAEGNGEDFRIKHAVPAGATIISLLPGSRMQEVSRMLPIFSNTVELMKDMVPQLMTIIHVAPNEHVENFIADAVHRWPVPVVLIPGGTTQLRYDAFSASRAALCTSGTVAVELQLARLPCVVAYRAHILTEWYIWYKAKIQYISLTNILLDKAIIPEALFQSCKPLNLALLLKDLLHDDGCREEQIIAAQKILKLLWPSERIKLNLLQQNLKTCADYTPSAVAALTILNHGKPMTSI

SEQ ID NO: 121313 - protein, 367 aa, Glycine max
  Coding DNA Sequence Number=SeqID_4535
  Homolog annotation: Hit_ID=Q10NM0; Match level="QueryCoverage=95%, HitCoverage=30%, E-value=1e-104, Identity=66%"; Hit description=SH3 domain containing protein, expressed
MALELSSPFLPLMIFRLVMLSKSERKAYLGLKVVIKTTLQKGGNTVAPEFMIAGTDNTASEAPIYHPKQSTICCLECSEKTPSGSWESSISALCCTRFSNLKTRVDCRISFADPVAVRHALEIVSEIATMDPYAVAMALGKHVQPGGALQDVLHLHDVLARVSLARLCCTISRARALDERSDIRSQFNSVLYQLLLDPSERVCFEAILCVLGKYDNAERTEERAAGWYRLTREILKLPDASSKESSKDKQKTKRPQLLIKLVMRRLESSFRSFSRPVLHAAARVVQEMGKSRAAAFALGIQDVEEGAHVNTFAEATDYNDSDESTHPESIRRTSSVSNLTAGRDTVSGMLASLMEVVRTTVACECVY

SEQ ID NO: 121314 - protein, 286 aa, Glycine max
  Coding DNA Sequence Number=SeqID_4536
  Homolog annotation: Hit_ID=Q10NM0; Match level="QueryCoverage=23%, HitCoverage=6%, E-value=1e-27, Identity=89%"; Hit description=SH3 domain containing protein, expressed
  Subcellular localization annotation: CTP_CleavageSite=38; ConfidenceScore=5.49e-01
MDLITADPTPAPSSSSTAAASSAPTAPASLPSALGKPPAEKKSKRAALMQIQNDTISAAKAALHPVRTNIMPQRQKKKPVSYSQLARSIHELAATSDQKSSQRQLVHHVFPKLAVYNSVDPSLAPSLLMLNQQCEDRSVLRYVYYYLARILSDTGPQGLSTGGGIPTPNWDALADIDAVGGVTRADVVPRIVEQLTAAATNAETECEWLLTFIFDGFNHFKHKVAYLHPYPCICKEAVSGFEPMTNKSPRHNFTAAPGLALIVAMLSLNCSSRVQRYMKSRVNIIS

SEQ ID NO: 121315 - protein, 252 aa, Glycine max
  Coding DNA Sequence Number=SeqID_4537
MTLFSGKFHVQEINYKRYEIRLTDAGVVEDIACSIPRYFFNLYNFTYIGGLNYSAYGPLSFSGYPQYAVFLNCTTPVTDDPRYVAVKVNGNCDSSSVGHIYAILVTDDDDRFGFTLTDIKVGCRLKVATFANWKYNNREVNVSYSDINKWLHHGIWMSWFFPVICRDRCGKGVSCYIDQTTRETRCADSYCQIFGIQTYKCGIRNQILEYMRQILGYTVGIGKLVECKMVMELSMDKAVVEEFMEEINAVKL

SEQ ID NO: 121316 - protein, 518 aa, Glycine max
  Coding DNA Sequence Number=SeqID_4538
  Homolog annotation: Hit_ID=Q10NM0; Match level="QueryCoverage=99%, HitCoverage=51%, E-value=0.0, Identity=64%"; Hit description=SH3 domain containing protein, expressed
  Pfam annotation: Domain name=SH3_1; Domain location=456-503; Score =0.1; E_value=0.019; Accession=PF00018.18; Description=SH3 domain
ASPDMAVTLLQIARIFATKVPGKVDADVLQLLWKTCLVGAGPDGKHKALEAVTIVLDLPPPQPGSMLGLTSVDRVSASDPKSALALQRLVQAAVWFLGENANYAASEYAWESATPPGTALMMLDADKMVAAASSRNPTLAGALTRLQRCAFNGSWEIRIIAAQALTTMAIRSGEPFRLQIYEFLHTLGQGGLQSQFSDMHLSNGEDQGASGTGLGVLLSPMIKVLDEMYRAQDDLINAKLIDIYRTRHNISASTGLSDPAVATGISDLVYESQPPAAEPDTLDDDLVNAWAANLGDDGLWGNNAPAMNRVNEFLAGAGTDAPEVDEENMISRPSVSYDDMWAKTLLESSELEEDDAKSLGSSSPDSTGSVETSISSHFGGMSYPSLFSSRPQTTDKAPASRGFTYEGYGSPIREEPPSYSSSVIQRHESFENPLAGNGSHSFGSQDDEQVSSANPQHGSALYDFTAGGDDELSLTAGEEVEIEYEVDGWFYENQLLIAYFAVQVKKKRPGRDGKMAGL

SEQ ID NO: 121317 - protein, 482 aa, Glycine max
  Coding DNA Sequence Number=SeqID_4539
  Gene Ontology: Mol. function=oxidoreductase activity; Cellular component=membrane; Biological process=electron transport
  Homolog annotation: Hit_ID=Q2MJ20; Match level="QueryCoverage=93%, HitCoverage=94%, E-value=0.0, Identity=81%"; Hit description =Cytochrome P450 monooxygenase CYP716A12
  Pfam annotation: Domain name=p450; Domain location=39-479; Score =129.9; E_value=6.9e-36; Accession=PF00067.12; Description=Cytochrome P450
MDHNNLYLSLLLLFVSFVTLSLFFLFYKHRSPFVAPNLPPGATGYPVIGESLEFLSTGWKGHPEKFIFDRMIRYSSQLFKTSIFGEPAVIFCGATCNKFLFSNENKLVAAWWPNSVNKVFPSTLQSNSKEESKKMRKLLPQFLKPEALQRYVGIMDTIAQNHFASLWDNKTELTVYPLAKRYTFLLACRLFMSVEDVNHVAKFENPFHLLASGIISVPIDLPGTPFNKAIKAANAIRKELLKIIRQRKVDLAEGKASPTQDILSHMLLTCNENGQFMNELDIADKILGLLIGGHDTASAACTFIVKYLAELPHIYDSVYQEQMEIAKSKLPGELLNWDDINRMKYSWNVACEVMRIAPPLQGGFREAINDFIFNGFSIPKGWKLYWSANSTHKNPEYFPEPEKFDPTRFEGQGPAPFTFVPFGGGPRMCPGKEYARLEILVFMHNLVKRFKWEKLIPDEKIIVDPLPVPAKNLPIRLHPHKP

SEQ ID NO: 121318 - protein, 93 aa, Glycine max
  Coding DNA Sequence Number=SeqID_4540
MIQTNYGVDKLKPKFNRLRQMHRDFSTLLARTGVTWEMESNKVNAPDEVWDELIKEGITRISRNMVLSMTMISSVAYSIQAQQLGIHPCLMNE

SEQ ID NO: 121319 - protein, 147 aa, Glycine max
  Coding DNA Sequence Number=SeqID_4541
MEGDFLTKGIHINVFDDEKDDIKGLRHKRKEIFSSGERRRKEGKTSNKEMLDKIVSIWSDSMSQRTTTSRAREERYKGKTSQASQATSPISDPYSAKACMELLDNMQDVPTSAYFKLMEKFTSEHWRQMFIVMDAERRKQLIESLTE

SEQ ID NO: 121320 - protein, 152 aa, Glycine max
  Coding DNA Sequence Number=SeqID_4542
  Homolog annotation: Hit_ID=Q2HTK4; Match level="QueryCoverage=36%, HitCoverage=6%, E-value=5e-18, Identity=75%"; Hit description =Protein kinase; U box
MNEWEEDPSRIVVKRIFILTPLLVLYQVDVMSKLRHPNLMTLIGACPDSWALVYEYLPNGSLENRLACKNNTPSFSCKLEFALLLKLLLLLQLLLWMSYCGVLHTWLHKAAKNPMYLNYIKINGQTLGAADSDNTFGWDNKHVGARIMLSKV

SEQ ID NO: 121321 - protein, 119 aa, Glycine max
  Coding DNA Sequence Number=SeqID_4543
MSEPIWSDGGDCNVLLCVAVRLGRGREWVAVAAESGSRASSSRSACVRTEKQALRRRWRHELTEKERYLRRKVVEWVDEMFSVFCQRRREACCWTSGLNNLRGIGLECKRSNNQFKNVL

SEQ ID NO: 121322 - protein, 66 aa, Glycine max
  Coding DNA Sequence Number=SeqID_4544
  Gene Ontology: Mol. function=DNA binding; Biological process =regulation of transcription
MPKSIHWTYAVTAQTSWLVDKSRIATKIKCASGACDHGKVIWKSNPTKACPNCQHAIDNGDKLHAF

SEQ ID NO: 121323 - protein, 130 aa, Glycine max
  Coding DNA Sequence Number=SeqID_4545
  Homolog annotation: Hit_ID=Q1SXD5; Match level="QueryCoverage=90%, HitCoverage=83%, E-value=3e-24, Identity=45%"; Hit description=Cupin, RmlC-type
  Pfam annotation: Domain name=Cupin_3; Domain location=54-127; Score =103.2; E_value=7.7e-28; Accession=PF05899.3; Description=Protein of unknown function (DUF861)
MTTVIEKLGICPIKIERNPPESKLTQLGVRQWPKINNPEKVAAIDNWFGDVKKLQYTGFLSWKWGCPPSKFPWTYEAKETCYLLEGKVKVFPSGSNESVEIAAGDLVVFPKGMSCTWDVSVGVDKHYNFE

SEQ ID NO: 121324 - protein, 51 aa, Glycine max
  Coding DNA Sequence Number=SeqID_4546
  Homolog annotation: Hit_ID=Q1T453; Match level="QueryCoverage=69%, HitCoverage=4%, E-value=5e-07, Identity=72%"; Hit description=ATP -dependent DNA ligase; BRCT
MNKGTCCRLMYFLFLSGLTKKLQEEVDEFSNTYYLDLHVGDMKQEIAFATS

SEQ ID NO: 121325 - protein, 189 aa, Glycine max
  Coding DNA Sequence Number=SeqID_4547
  Gene Ontology: Mol. function=protein serine/threonine kinase activity; Cellular component=chloroplast; Biological process=protein amino acid phosphorylation
  Homolog annotation: Hit_ID=Q9LFD4; Match level="QueryCoverage=84%, HitCoverage=36%, E-value=4e-42, Identity=55%"; Hit description =Protein kinase-like protein
  Pfam annotation: Domain name=Pkinase_Tyr; Domain location=66-189; Score=-112.6; E_value=1.5e-05; Accession=PF07714.7; Description =Protein tyrosine kinase
MGICFSIEDQNHLSISDSNAKPKPAVGHESGAPLASMNIKDLREGAGYSNVDIFTYEELRLATKHFRPDFILGEGGFGVVYKGVIDHSVRSGYKSTEVAIKELNREGFQGDREWLAEVNYLGQFSHPNLVKLIGYCCEDDHRLLVYEYMASGSLEKHLFRSRKPSLSFKMVYSVLHLPVLPLCPSLPFM

SEQ ID NO: 121326 - protein, 84 aa, Glycine max
  Coding DNA Sequence Number=SeqID_4548
MTYMYDDLRRVFHGQTARGQYEGDSLHDASSTASRRGLSDGSQTSLRQGLVMMGHKFLFQHLVKTGDAGEDERGRWVKTGKGWL

SEQ ID NO: 121327 - protein, 384 aa, Glycine max
  Coding DNA Sequence Number=SeqID_4549
  Gene Ontology: Mol. function=DNA binding; Cellular component=nucleus; Biological process=regulation of transcription
  Homolog annotation: Hit_ID=Q6ZI65; Match level="QueryCoverage=97%, HitCoverage=85%, E-value=2e-64, Identity=40%"; Hit description=No apical meristem (NAM)-like protein
  Pfam annotation: Domain name=NAM; Domain location=6-146; Score=124.7; E_value=2.6e-34; Accession=PF02365.6; Description=No apical meristem (NAM) protein
QEWPGLPKGVKFDPSDQEIIWHLLAKVGVGDSKSHPFIDEFITTLEVDDGICYTHPQNLPGVRQDGSASHFFHRAIKAYNTGTRKRRKILGQDFGDVRWHKTGRTKPVVLSGVQKGCKKIMVLYVSNVRGGKAEKTNWVMHQYHLGTEEDEKDGEYIISKVFYQQQQVKLGDKNDQDVPEASEITGPHPGLSVGEEGTIEKVDPVTPKLVTPEPPCNGRWCADLDLGQETHNVPQPPRMDCLDEIQADCQVLANESSMVETQHNEGMDDKENNAEDGQKWWDSESQNLLDSQQLVEALSLCDDLLQSQSPSRDGKHEDHKNQPGLSVYAQLGPEHLKKDIEECQNLALNPANIENDTPSEFQLSQLEFGSQDSFISWGYSKAVN

SEQ ID NO: 121328 - protein, 90 aa, Glycine max
  Coding DNA Sequence Number=SeqID_4550
  Gene Ontology: Mol. function=protein serine/threonine kinase activity; Cellular component=membrane; Biological process=protein amino acid phosphorylation
  Homolog annotation: Hit_ID=Q337X4; Match level="QueryCoverage=83%, HitCoverage=20%, E-value=2e-32, Identity=86%"; Hit description =Protein kinase APK1B, chloroplast, putative, expressed
MKIALHAARGLAFLHGAERPIIYRDFKTSNILLDADFNAKLSDFGLAKDGPMGDQTHVSTRVMGTYGYAAPEYVMTECEGVTLGNKVAAL

SEQ ID NO: 121329 - protein, 88 aa, Glycine max
  Coding DNA Sequence Number=SeqID_4551
MEEMIVFRERMCKEPLKKLVEQEAKIESGRSRDRSRADRPSQSKFIHYTPLMKSRGRALKEACSTMTPHVIKIENEKRVGSIVRLRRQ

SEQ ID NO: 121330 - protein, 48 aa, Glycine max
  Coding DNA Sequence Number=SeqID_4552
MKMDSASMTGSKRRISSNRGIGGVLREQRARLYIIRRLFDYADQLASG

SEQ ID NO: 121331 - protein, 165 aa, Glycine max
  Coding DNA Sequence Number=SeqID_4553
MSFFGGGFECSCIGRMLSLEIHPIGKSYNDDPFPHHSRSNAANDHVSIVLAGDEAATIGGMAHPNAGIATLIGGVTTIEGGLLPSSSVCLNPMEDEIESPLPNPPYNVIDLDSEATTSQVIPCRPFVPPPPLPWKPIKAKKKYPPITLSGYSWVHEEVGSYTSSS

SEQ ID NO: 121332 - protein, 384 aa, Glycine max
  Coding DNA Sequence Number=SeqID_4554
  Gene Ontology: Mol. function=proteasome activator activity; Cellular component=proteasome complex (sensu Eukaryota); Biological process =cell adhesion
  Homolog annotation: Hit_ID=Q1S3L7; Match level="QueryCoverage=91%, HitCoverage=100%, E-value=1e-120, Identity=68%"; Hit description =Adhesion regulating molecule
  Pfam annotation: Domain name=ARM_1; Domain location=46-360; Score =259.3; E_value=7.8e-75; Accession=PF04683.4; Description=Adhesion regulating molecule conserved region
  Subcellular localization annotation: CTP_CleavageSite=19; ConfidenceScore=5.15e-01
MEVKAFIAFHSPETNGNFRQNMPPQFCLQSGAMSSSSADVFPAIQEVMLEFRAGKMFLEEKRVVPDTRKGLVRIARGEEGLVHFQWLDRTQNVVEDVSFVFPPQFCTLGHHHLSGCTIRGKGPQLIRSLAKKVNQTSGRVYILKFNSDDRKFFFWMQESNADGDSQLCSSVNDYINRPLGTGACTCTELLGEEEPDGSLPLQISEDMTEDDISSRAANLGIPNLGVEATSDVTSSGPVKLEDLQRILSNIGPADSIVDPDGGLGLGDILKPDLIMPLMDMLPLEQRLAPYLPEGKWSPEEILELLQSPPFRQQVDSFTYVLRTGQIDLSQFGIDPSKYKFTVLSFLEALEDSVSKSVESEEARQDDQDLRSQSCNRHDPMDESQ

SEQ ID NO: 121333 - protein, 44 aa, Glycine max
  Coding DNA Sequence Number=SeqID_4555
MALQLRAKTKLQMTTRFTGAKVDPVGVSRCVFALSRIGEGNYVA

SEQ ID NO: 121334 - protein, 58 aa, Glycine max
  Coding DNA Sequence Number=SeqID_4556
MLEIVLIFGHPLVLDYLDNPTRIDRVLIEKDLLADAYSDCPEASILDEKEFLLLKGQV

SEQ ID NO: 121335 - protein, 272 aa, Glycine max
  Coding DNA Sequence Number=SeqID_4557
  Gene Ontology: Mol. function=protein serine/threonine kinase activity; Cellular component=chloroplast; Biological process =regulation of photosynthesis, light reaction
  Homolog annotation: Hit_ID=Q9S713; Match level="QueryCoverage=72%, HitCoverage=33%, E-value=1e-67, Identity=61%"; Hit description =Serine/threonine-protein kinase SNT7, chloroplast precursor
  Subcellular localization annotation: CTP_CleavageSite=57; ConfidenceScore=5.22e-01
MATIGIGVGVTKLQQPHRPKSKSLFLGQRLRISPFWGEPQCSERRLFGVSNPPRVVQVFALGGGEWLDTVHNLFVGVGVGLPCSVMQCGDVIYRSTLPKSNGLTLTVPGVILALGTLSYLWATPGVAPGFFDMFVLAFVERLFRPTYKKACGIRGFTTSHAARQFLYNIVYRVVDLMILVVVTEKLGEGSFGVVYRVSLANKPSSKEGDLVLKKATEYGAVEIWMNERSSSKKAAEYWLIWRFEGDATLADLMQSRDFPYNVGTLFNRLGCT

SEQ ID NO: 121336 - protein, 76 aa, Glycine max
  Coding DNA Sequence Number=SeqID_4558
  Gene Ontology: Mol. function=pseudouridylate synthase activity; Biological process=tRNA processing
  Homolog annotation: Hit_ID=Q1S3L9; Match level="QueryCoverage=64%, HitCoverage=12%, E-value=2e-10, Identity=70%"; Hit description=TRNA pseudouridine synthase
MVRVLVATSIREAAAGAEDDALIKLMDATCRRATAPPAPPDGLCLVDVGYNVEMLLVISPFIKSMSNDKHIARVLH

SEQ ID NO: 121337 - protein, 179 aa, Glycine max
  Coding DNA Sequence Number=SeqID_4559
  Gene Ontology: Mol. function=sequence-specific DNA binding; Cellular component=nucleus; Biological process=regulation of transcription, DNA-dependent
  Homolog annotation: Hit_ID=Q2A9V4; Match level="QueryCoverage=95%, HitCoverage=44%, E-value=3e-16, Identity=29%"; Hit description=GATA zinc finger containing protein
  Pfam annotation: Domain name=GATA; Domain location=7-42; Score=56.1; E_value=1.1e-13; Accession=PF00320.17; Description=GATA zinc finger
MVKQGPCSHCKINFTPLWRNGPVDKPVLCNACGTRYKKGDLDNYLPKNVHPQLHHNNFKNVNGESHFNAEESLSNHIPPITTSNGDNYKSSSDVHHISAQDFEKKIPSRKRSSVVYKPMTPMEKFQKQLLSLYRSERQPEESLLVDNVNNFIPENEIGLGAILLKTDDAASTDPGSANR

SEQ ID NO: 121338 - protein, 393 aa, Glycine max
  Coding DNA Sequence Number=SeqID_4560
  Gene Ontology: Mol. function=protein kinase activity; Cellular component=integral to membrane; Biological process=protein amino acid phosphorylation
  Homolog annotation: Hit_ID=Q1S3M0; Match level="QueryCoverage=91%, HitCoverage=58%, E-value=1e-154, Identity=75%"; Hit description =Protein kinase
  Pfam annotation: Domain name=Pkinase; Domain location=95-366; Score =28.2; E_value=3e-10; Accession=PF00069.15; Description=Protein kinase domain
  Pfam annotation: Domain name=Pkinase_Tyr; Domain location=94-366; Score=-5.4; E_value=3.9e-12; Accession=PF07714.7; Description =Protein tyrosine kinase
  Pfam module annotation: Pfam domain module=Pkinase::Pkinase_Tyr; Domain location=95-366::94-366
  Subcellular localization annotation: CTP_CleavageSite=66; ConfidenceScore=5.04e-01
MTLKHSINVLNNEHAVIMIAAVVLFILHRRRNQGSATSVENPPSGCNKGRLREVGSESMRSTRSISSNHSRRGDHTKLSFLRDDRQRFDLHELLRASAEILGSGCFSSSYKAALLNGPTIVVKRFKQMNNVGKEEFQEHMRRLGRLSHPNLLPPLAYYYRKEEKLVVTDYVQNGSLAVRLHGHQSIGEPSLDWPIRLKIVKGIAKGLEYLYKDMPSLIAPHGNLKSSNVLLTESFEPLLTDYGLVPVINQDLAQDIMVIYKSPEYLQQGRITKKTDVWCLGILILEILTGKFPANFLQQGKGSEVSLASWIHSVVPEEWTSAVFDQEMGATKNSEGEMGKLLKIALNCCEGDVDKRWDLKEAVEKIQEVKQRDHDQENFFTSYASEADMKSST

SEQ ID NO: 121339 - protein, 331 aa, Glycine max
  Coding DNA Sequence Number=SeqID_4561
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=94%, HitCoverage=39%, E-value=1e-117, Identity=70%"; Hit description =Protein kinase; UspA
  Pfam annotation: Domain name=Usp; Domain location=13-165; Score=33.5; E_value=7.3e-07; Accession=PF00582.16; Description=Universal stress protein family
MSRLIQEKKLGAGRVVAVAIENNKTSQYAAKWAVDNLLPKDQALLLLHVRQRVSSIPTPTGNLVSLEGNDDVARAYMQQMDNESKELFASFRVFCNRKSIQCKEILLEDMDISKGLIEGISKYSVELLVLGAASRSGLVRRFRTSDVPSLVSKGAPPFCTVYIIAKGKISSVKTATAPLTAKPPARNNTMQPQQSLQTPERMDTQITRNPIPPRPSSEKPSYIVRQLSSDEDEIISPFTRSGRGNYISYESSIPDSDISFVSSGRPSVDRMFPSMYDDMDSGTNRLSTGSDFDVRSFGSSFSGAKSIDHGDYSFSSQDSGTSMSSSMFSAS

SEQ ID NO: 121340 - protein, 157 aa, Glycine max
  Coding DNA Sequence Number=SeqID_4562
MACSLSASYSLAKREMSPLSPFRCGLNWEHCLHPLSLTKFMHSCIHSFHIFYKSSAHNNPNGLAKRAYRTERVHLLRMNTHLPDELSMAKQGLFAKPGLIRQVCEVLIFTFSLSQDVGLASHPLSATLLGLGRGRIWKKDELCICVKRGVIQRSAPL

SEQ ID NO: 121341 - protein, 109 aa, Glycine max
  Coding DNA Sequence Number=SeqID_4563
MVPVMWLHRINMARLKPMKAHSGDGYYSRMNKECFEVEEKGKVDATIINIQKRTGLCEPQSASLVLQMEARLIAMRWDQGLFGCCLARQKDVRESSLVVLSRIKTSSMA

SEQ ID NO: 121342 - protein, 148 aa, Glycine max
  Coding DNA Sequence Number=SeqID_4564
MVFAKTRHCIRNGITWLARACYFLLLWCALSLLCSKFRLNYSYFGALARYIDHRLRQTPSSTLRLVQFAATADKGKAAFRPLVAGGGLHRLKAASYISGVYVGLVDEADLWPASERPLETTSCHPSSVVSSYARLSLSLSIVWSKLVH

SEQ ID NO: 121343 - protein, 64 aa, Glycine max
  Coding DNA Sequence Number=SeqID_4565
MEKKGRRRRMGLNDAKACVRKAEEVIGLLLCFFAHCHMKAFSLPEGQSNDGVEGYKALPMEELG

SEQ ID NO: 121344 - protein, 94 aa, Glycine max
  Coding DNA Sequence Number=SeqID_4566
  Homolog annotation: Hit_ID=Q8H251; Match level="QueryCoverage=31%, HitCoverage=6%, E-value=8e-07, Identity=93%"; Hit description=Amt2 -like protein
  Subcellular localization annotation: CTP_CleavageSite=48; ConfidenceScore=5.09e-01
MASLVYFWFTFAAIMMILLAGSVLGRMNIKVGTRLKSDRERFPSNNVLLMLAGVMMQSYPARALDRKLQVDWARDAREGPRVLMSLRVDFGPMD

SEQ ID NO: 121345 - protein, 84 aa, Glycine max
  Coding DNA Sequence Number=SeqID_4567
MEIYFDSNPNAFLSGVSSNLNKYFPMLWIMGAYIKMPGEWNIICIMPMFLQAYFGGSVESVSLIQRVMKPCSTESNVEEEAHEC

SEQ ID NO: 121346 - protein, 337 aa, Glycine max
  Coding DNA Sequence Number=SeqID_4568
  Gene Ontology: Mol. function=RNA-directed DNA polymerase activity; Biological process=RNA-dependent DNA replication
  Subcellular localization annotation: CTP_CleavageSite=10; ConfidenceScore=5.03e-01
MATQPLPFSSASSIVPSSNNPHNDELRFLSDPKFERHGEILLLVFVLLFSVFLLSPTRIEVASYSTLTELLGRYVFDLLNRLEKVLNGVIDERQGAFLNGRNLMHGVMVVNEVIDEAKRKKKNCPIFMNMLQMLGLSGMMKEVMAKNMFTSYLIREKQVKVNLLQYVDDILFLGKATLRNALTIKSMKRRFELVSGLKVNFYKSCFEALGVERDKVCCPNEHGGLGIKQVKLYNVALMAKWRLTLFGGRDSLWVEVLKSKYGEETLASKFPRLFIISNQQNELLGNVGQWKEGEWEWTLSWRQNMFEWEKSQLEELQLLTNTNLVKDCGDGWWCEEE

SEQ ID NO: 121347 - protein, 161 aa, Glycine max
  Coding DNA Sequence Number=SeqID_4569
  Gene Ontology: Mol. function=RNA-directed DNA polymerase activity; Cellular component=chromatin; Biological process=chromatin assembly or disassembly
MVEHDTRRTTIDRLEEAIAALSERHSDLANKVEAMCECLSHLTTPSPSVTQPSYPSRPSVKLDVPRFDGYDPLGWIFKISQFFEYQGTPKEERIMVASFYLDGPALSWFQWMFRNGFITSWPALLQAIEARFAPSFYDDPRGTLFKLVQRSSVTEYLTEFE

SEQ ID NO: 121348 - protein, 177 aa, Glycine max
  Coding DNA Sequence Number=SeqID_4570
  Pfam annotation: Domain name=bZIP_1; Domain location=83-143; Score =8.5; E_value=0.018; Accession=PF00170.11; Description=bZIP transcription factor
  Subcellular localization annotation: CTP_CleavageSite=46; ConfidenceScore=5.05e-01
MANQTFTNLLTNDKQFAALQLPPKAPTSNKNKPNVSEGHEILFQARNVMKTDENPSLVFHGDEQVLQHPNSPNKVEDLAQATNPKTEAQLKRVYSAKYRLRKQARLQNLKNLAESLEAEVSMNQSQLHFWQTIRDKLVEENEMMRAQYDIASNLVAEKEAVNCALMEEIQRLRNSLV

SEQ ID NO: 121349 - protein, 622 aa, Glycine max
  Coding DNA Sequence Number=SeqID_4571
  Gene Ontology: Mol. function=chromatin binding; Cellular component =chromatin; Biological process=chromatin assembly or disassembly
  Homolog annotation: Hit_ID=Q1SAV4; Match level="QueryCoverage=56%, HitCoverage=99%, E-value=1e-103, Identity=48%"; Hit description =Integrase, catalytic region
  Pfam annotation: Domain name=Chromo; Domain location=531-582; Score =22.9; E_value=0.0011; Accession=PF00385.14; Description='chromo' (CHRromatin Organisation MOdifier
  Pfam annotation: Domain name=rve; Domain location=264-430; Score =42.0; E_value=2.1e-09; Accession=PF00665.16; Description=Integrase core domain
  Pfam module annotation: Pfam domain module=Chromo::RVT_1::rve; Domain location=531-582::1-152::264-430
MCIDYRALNAITIRDRFPLPTIDELLDELGKASWFSKLDLWQGFHQILVVEEDIPKTSFRTHHGHYEYRVMPFGLCNAPSTFQAAMNALLRPFLRKFAVVFFDDILIYSTTFNDHLHHLECVFSSFLQARYYLKQSKCLIGQRQLDYLGHVISGSGVRPNPTKIQAIVEWAMPRSPKDLHAFLGLTGFYRKFIRGYATMATPLTKLLYSLSYFGVKKTLHRLQSNFQWRNMLQDIKTSIRNCTVCQQIKHLTRKNVGLLQPILIPTGVWEDLSMDFVTHLPTSHGFTTVMVVVDRFSKGVHFGDLHTHFTAFKVATLFMDTVCKLHGFLRSIIFDRDPIFISSFWRELFKMSGMTLRMSTAYHPQTDGQTEHTGTGMTPYEVIYDKPLPPLSNYLQGSSRNDAVDAELSTREEIHTALRRKLLKAQEAMKHFADQKRRDVAYEVDQLVYVKLRPHRQSSLRHQPLTKLAKHYFGPFRVLEHIGNVAYRLQLPEGSKIHSVFHCSLLRPHHGPLDLHHTPLPPDARDHHPLLEPIAILDSGFDPSTQPPTRMVLVQWMGLAPEDSTWEKWTDVCNAHHLEHKVVFPGADDVSSSNMNEAPPPATHEPRPRRSITRPRHLEEYV

SEQ ID NO: 121350 - protein, 346 aa, Glycine max
  Coding DNA Sequence Number=SeqID_4572
  Gene Ontology: Mol. function=DNA binding; Cellular component=nucleus; Biological process=regulation of transcription
  Homolog annotation: Hit_ID=Q1SC80; Match level="QueryCoverage=77%, HitCoverage=80%, E-value=3e-59, Identity=50%"; Hit description=Myb -like DNA-binding domain, SHAQKYF class, putative
  Pfam annotation: Domain name=Myb_DNA-binding; Domain location=63-114; Score=37.4; E_value=4.9e-08; Accession=PF00249.21; Description=Myb -like DNA-binding domain
MGESSGSQCSKTSPSNIDEDDEGESEANEDQSKQNNNGGSSSNSTVEENEKKIRPYVRSKMPRLRWTPDLHLRFIHAVQRLGGQERATPKLVLQLMNIKSLSIAHVKSHLQMFRSKKVDDRNQVFADHNSLVETGDKNIYNLSQLSMLQGYNPSQSSSFSYTNNYPSYGFGDASFGVYEKLLQRPFDWSNAISSREGSSIFGEQSKIREPKDEFLSFGAHDHSLSTPTRLSHVDHTPPINIMQQIAQNLMPINPTTNQPELKTLKRKASDHTTLDLDLSLKLNSKINDAEEGTLNNHEVDSTNLSLSLCSQLSSSSNPSSRLIKEAQQDRCDEQGKIMASTLDLTI

SEQ ID NO: 121351 - protein, 95 aa, Glycine max
  Coding DNA Sequence Number=SeqID_4573
MPKNARYNWPVRACHYTMVKVYSKLKCCKTTKFLELQWQLISVLCMLRRPCWLMLGCSFHTRVGVRDASSLGPLLLYVLVLGPRGYCRTPNEEYE

SEQ ID NO: 121352 - protein, 135 aa, Glycine max
  Coding DNA Sequence Number=SeqID_4574
  Subcellular localization annotation: CTP_CleavageSite=37; ConfidenceScore=5.37e-01
MWITESLRGRLRHSLPLRNAGASRNVGSSPVAGKCASTAAKNSTTNTSESESESVGGMVTKGENRKNQTAKSVGDLVGLWARIEQHGRKPGWKDAFFIASTCRRCCYYYYVVFMVTVGSISRSEINGCDLMEEGK

SEQ ID NO: 121353 - protein, 57 aa, Glycine max
  Coding DNA Sequence Number=SeqID_4575
MGVWCGLLQVQMIRCLETFLVFLNLLLKARTSKCAHEDDKDIKNSLKCMCMAHDPME

SEQ ID NO: 121354 - protein, 572 aa, Glycine max
  Coding DNA Sequence Number=SeqID_4576
  Gene Ontology: Mol. function=biotin carboxylase activity; Cellular component=mitochondrial inner membrane; Biological process=metabolic process
  Homolog annotation: Hit_ID=O81273; Match level="QueryCoverage=99%, HitCoverage=100%, E-value=0.0, Identity=89%"; Hit description=Biotin carboxylase precursor
  Pfam annotation: Domain name=ATP-grasp; Domain location=185-353; Score=-41.2; E_value=9.6e-05; Accession=PF02222.12; Description=ATP -grasp domain
  Pfam annotation: Domain name=Biotin_carb_C; Domain location=406-508; Score=199.5; E_value=8e-57; Accession=PF02785.9; Description=Biotin carboxylase C-terminal domain
  Pfam annotation: Domain name=CPSase_L_D2; Domain location=185-399; Score=400.3; E_value=2.8e-117; Accession=PF02786.7; Description =Carbamoyl-phosphate synthase L chain, ATP binding domain
  Pfam annotation: Domain name=CPSase_L_chain; Domain location=71-183; Score=149.4; E_value=9.7e-42; Accession=PF00289.12; Description =Carbamoyl-phosphate synthase L chain, N-terminal domain
  Pfam annotation: Domain name=Dala_Dala_lig_C; Domain location=185 -374; Score=-74.8; E_value=7.7e-05; Accession=PF07478.3; Description =D-ala D-ala ligase C-terminus
  Pfam annotation: Domain name=GARS_A; Domain location=184-362; Score= -114.9; E_value=0.03; Accession=PF01071.10; Description =Phosphoribosylglycinamide synthetase,
  Pfam annotation: Domain name=RimK; Domain location=183-386; Score= -30.7; E_value=6.1e-05; Accession=PF08443.2; Description=RimK-like ATP-grasp domain
  Pfam module annotation: Pfam domain module=ATP-grasp::Biotin_carb _C::CPSase_L_D2::CPSase_L_chain::Dala_Dala_lig_C::GARS_A::RimK; Domain location=185-353::406-508::185-399::71-183::185-374::184 -362::183-386
  Subcellular localization annotation: CTP_CleavageSite=76; ConfidenceScore=5.62e-01
MEVTLSACKSISSPSVPVAALFAGKAGTKSSQCSFLAGANKVRFPRQVGQVSHVRKQRQTRHCGALHATCSGDKILIANRGEIAVRVIRTAHELGIPCVAVYSTIDKDALHVKLADEAVCIGEAPSSQSYLLIPNVLSAAISRRCTMLHPGYGFLAENAVFVEMCREHGINFIGPNPDSIRVMGDKATARETMKKAGVPTVPGSDGLLQSTEEAIRLANEIGFPVMIKATAGGGGRGMRLAKEPDEFVKLLQQAKSEAAAAFGNDGVYLEKYIQNPRHIEFQVLADKYGNVVHFGERDCSIQRRNQKLLEEAPSPALTPELRKAMGDAAVAAAASIGYIGVGTIEFLLDERGSFYFMEMNTRIQVEHPVTEMISSTDLIEEQIRVAMGEKLRYKQEDIVLRGHSIECRINAEDAFKGFRPGPAYLPSGGPFVRMDSHVYPDYVVPPSYDSLLGKLIVWAPTREKAIERMKRALDDTIITGVPTTIDYHKLILDIEDFRNGKVDTAFIPKHEEELAMKCLSLASEELAHSDTWMMGGIEKGQMVMTLEFGARALPPQKMVLANRVNELAGSTA

SEQ ID NO: 121355 - protein, 276 aa, Glycine max
  Coding DNA Sequence Number=SeqID_4577
  Gene Ontology: Mol. function=protein serine/threonine kinase activity; Cellular component=ubiquitin ligase complex; Biological process=protein amino acid phosphorylation
  Homolog annotation: Hit_ID=Q1S3M6; Match level="QueryCoverage=79%, HitCoverage=27%, E-value=1e-113, Identity=89%"; Hit description =Protein kinase; UspA
  Pfam annotation: Domain name=Pkinase; Domain location=2-215; Score= -19.3; E_value=2.1e-07; Accession=PF00069.15; Description=Protein kinase domain
  Pfam annotation: Domain name=Pkinase_Tyr; Domain location=1-209; Score=-80.0; E_value=1.5e-07; Accession=PF07714.7; Description =Protein tyrosine kinase
  Pfam module annotation: Pfam domain module=Pkinase::Pkinase_Tyr; Domain location=2-215::1-209
MVLLLGACPEFGCLVYEYMANGSLDDCLFRRGNKPALPWQLRFRIAAEIATGLLFLHQTKPEPLVHRDLKPGNILLDRNYVSKISDVGLARLVPPTVADTVTQYRMTSTAGTFCYIDPEYQQTGMLGIKSDIYSLGIMLLQMITAKPPMGLTHHVGRAIEKGTFADMLDPAVEDWPVEHALHFAKLALACAEMRRKDRPDLGKVVLPELNKLRDFAEENMPMMMMFGMSTGFTPRNNYNYSSSTFSSVQDSMSESQSMSGMSGYESRSSSSSPGRM

SEQ ID NO: 121356 - protein, 115 aa, Glycine max
  Coding DNA Sequence Number=SeqID_4578
  Gene Ontology: Mol. function=protein binding
  Homolog annotation: Hit_ID=Q5ZDH7; Match level="QueryCoverage=63%, HitCoverage=11%, E-value=1e-13, Identity=51%"; Hit description =Senescence-induced receptor-like serine/threonine kinase-like
CAEEVAGGRKIRNGVAVLLAGGDWEETEGLLVPVAEAQRLRHDSGGAAAEVAVGEPRRVELVGGVRGTSTVDVVGGRYNESEGLLRSEKNWQLGDPNRVNYTKLVRFGSLVTLRE

SEQ ID NO: 121357 - protein, 168 aa, Glycine max
  Coding DNA Sequence Number=SeqID_4579
  Gene Ontology: Mol. function=catalytic activity; Biological process =metabolic process
MNAKRRKYMFGVLPKRKILMRHGKSQGNQDTATYITTPDHNIWSTTRGMAKVIRIDKHFRRVMGSDGCSLDWRIQFYVSPYAHSRSMLHELIQCFLKKRINGVRKELVLIDVCKPLKKVKRIKKSGGILVEVNFKYERLGIFCYVCGMMWHVEESGQKFLAMKEDDGA

SEQ ID NO: 121358 - protein, 168 aa, Glycine max
  Coding DNA Sequence Number=SeqID_4580
  Gene Ontology: Mol. function=RNA-directed DNA polymerase activity; Biological process=RNA-dependent DNA replication
  Subcellular localization annotation: CTP_CleavageSite=72; ConfidenceScore=5.40e-01
MASLTEKRGVTPRTSSNISLPFLHSFGASLGISMTSSLKMTKLATMNIQIGSFKDSEKPLLIFPNFRVFNTIASKFDHSSILLKLHHFTNKTYQKQFCFKNSWFSHHDLPQTVEQGWSNPIHNDLISKLNNCLFEINTRGCQIPTEFVSKLIYIKERWKFYVSFMMRS

SEQ ID NO: 121359 - protein, 42 aa, Glycine max
  Coding DNA Sequence Number=SeqID_4581
MSEIGRFGGLGMEERRKEEGAAQGFMENVIFIKQDTWPSVLL

SEQ ID NO: 121360 - protein, 332 aa, Glycine max
  Coding DNA Sequence Number=SeqID_4582
  Gene Ontology: Mol. function=protein binding
  Homolog annotation: Hit_ID=Q5ZDH7; Match level="QueryCoverage=93%, HitCoverage=47%, E-value=2e-72, Identity=46%"; Hit description =Senescence-induced receptor-like serine/threonine kinase-like
  Pfam annotation: Domain name=LRRNT_2; Domain location=200-241; Score =17.1; E_value=0.014; Accession=PF08263.3; Description=Leucine rich repeat N-terminal domain
ELFAADPASYDAAAIGKNDSVLVNYGRLSCGSKQWGPGFSNDSDRFGRSWQSDSDFRTGRSKVRAMSTRSRISGTEQKPNYFPEKLYQTAATAEEGGGVLEYELSVDAKLDYLVWLHFAEIEERVRRVGERVFDVYINDDNLTRVDIYKQVGGFAAFTWHHTVKNLSSSVLSVKLVGVVGAPLICGIENYALVPSDPSTVPEQVVAMKALKDSLRVPERMGWNGDPCAPTNWDAWEGVTCRTSKNNTALVISQIDLGSQGLKGSISDQISLLSDLVSLNLSSNLLVGEIPSGLGQKSLIHLYQFGATIRDLSNNQLTGPIPDSMASSSLQLV

SEQ ID NO: 121361 - protein, 524 aa, Glycine max
  Coding DNA Sequence Number=SeqID_4583
  Gene Ontology: Mol. function=protein dimerization activity; Cellular component=nucleus; Biological process=regulation of transcription, DNA-dependent
  Homolog annotation: Hit_ID=Q1SM92; Match level="QueryCoverage=79%, HitCoverage=37%, E-value=1e-138, Identity=64%"; Hit description =Transcriptional factor B3; Auxin response factor; Aux/IAA_ARF _dimerisation
  Subcellular localization annotation: CTP_CleavageSite=38; ConfidenceScore=5.43e-01
MPSSQKNFHYSHLSQQPALLSEMSGHVGLPPTVTTNPLSASGGSILTGVGQSVITDDVPSCSTSPSTNNRASVLPPVVSSQIHRSTTIGDDMAQSAVTISGASTLETMSSNANIVQPKYEVKASLNISKNQNQGNVAPQTYLNGVVQTDYLDSSSSTTSLYHFRSDTHMHQNTNPFSYNPQLVYCRDNSQNVEVQADARNNVLIGNNVNGQMGMPSNLDSLLTKGTVGLGKELSNKFASGGLLRDLENNKGVPPEISSSMVSQTFEVPDMSFNSIDSTIDGSSFLNRGPWDLPPPPPPQQQQVQRIRTYTKVYKRGAVGRSIDITRYSGYEDLKQDLALRFGIEGQLEDLQRIGWKLVYVDHENDVLLVGDDPWEEFVNCVRCIKILSPQEVQQMSLDGDFGNGGLPYPAGSSSDGHIHQCCPKGCGVGRQMILSCCSRLGNICGYNLLGEICLCHVQANLKSQKKKKVEKFAALNLRLTFKVVNLVMNEILGPHAHGTSQQRCVKPYACDDVEKLSRSSLGSV

SEQ ID NO: 121362 - protein, 74 aa, Glycine max
  Coding DNA Sequence Number=SeqID_4584
MFGERTSAMSPLELAVGEAVAGGGVDNGSGGVRKQQVAAEAEDEGGDRYGSVGKREAERGIKAVEGSGIAEKIR

SEQ ID NO: 121363 - protein, 288 aa, Glycine max
  Coding DNA Sequence Number=SeqID_4585
  Gene Ontology: Mol. function=protein dimerization activity; Cellular component=nucleus; Biological process=regulation of transcription, DNA-dependent
  Homolog annotation: Hit_ID=Q1SM92; Match level="QueryCoverage=100%, HitCoverage=25%, E-value=1e-92, Identity=61%"; Hit description =Transcriptional factor B3; Auxin response factor; Aux/IAA_ARF _dimerisation
MGTIIGVSDLDSVRWKNSLWRNLQVGWDESTAEERQSRVSVWEIEPVTTPYFICPPPFFRSKIPRLLGMPDDEPDFNNLFKSTVPWLGDDMCVKGPQALPGLSLVQWMNIQQNPALASSLQPNCGPSMSGLVLQNLPGADIANPLGFSTSQISQSNNVSVDAQNILQTSQQLDHIQKPPCPSSALGAVTQPLQQLGDITQQPRNLTNQTLPHDQAHTQLLNPQRVVQTNNIHQQQQSSIQKQQLLRSLSQNRAQKHQQTTLGLNERQIVFQSPMPDHFNQQLQMSDNQ

SEQ ID NO: 121364 - protein, 59 aa, Glycine max
  Coding DNA Sequence Number=SeqID_4586
MNLRFVFKKLDAASLDLNSKRTESYPFLSCLAGLKWFWAGGGLREAVLVVCGDLAIPAF

SEQ ID NO: 121365 - protein, 319 aa, Glycine max
  Coding DNA Sequence Number=SeqID_4587
  Gene Ontology: Mol. function=protein dimerization activity; Cellular component=nucleus; Biological process=regulation of transcription, DNA-dependent
  Homolog annotation: Hit_ID=Q1SM92; Match level="QueryCoverage=96%, HitCoverage=28%, E-value=1e-143, Identity=80%"; Hit description =Transcriptional factor B3; Auxin response factor; Aux/IAA_ARF _dimerisation
  Pfam annotation: Domain name=Auxin_resp; Domain location=258-319; Score=85.0; E_value=2.4e-22; Accession=PF06507.4; Description=Auxin response factor
  Pfam annotation: Domain name=B3; Domain location=131-236; Score =105.0; E_value=2.2e-28; Accession=PF02362.12; Description=B3 DNA binding domain
  Pfam module annotation: Pfam domain module=Auxin_resp::B3; Domain location=258-319::131-236
MKAQPPDGAAAVAPNAGEGGEKKTINAELWQACAGPLLNLPSPGTHVVYFPQGHSEQVAASLKKDVDAQVPNYTNLPSKIPCLLHNVTLHADPDTDEVYAQMTLQPVPSFDTDALLRSDIFLRSSKPQPEFFCKQLTASDTSTHGGFSVPRRAAEKIFPPLDYSVQPPAQELVARDLHDNVWRFRHIYRGQPKRHLLTTGWSLFIGGKRLLAGDSVLFVRDEKQQLLLGIRRANRQPSNLSSSVLSSDSMHIGVLAAAAQAVANNSPFTVFYNPRASPSEFVIPLAKYSKAVYSHHISPGMRFRMMFETEDSGTRRKWK

SEQ ID NO: 121366 - protein, 137 aa, Glycine max
  Coding DNA Sequence Number=SeqID_4588
MKPCLRFYLLERDTAFNHILQQSQVRPLPSPHDHLTIEKGKAMLVAPLGRSFTVRVFHAHKGGKICWVNIHEWYAKERLESHCEKFRADAKGLKFGKVWDRESRSMVGSQMGCEGKHDIGTLLHTIEVAMDGMRRKG

SEQ ID NO: 121367 - protein, 133 aa, Glycine max
  Coding DNA Sequence Number=SeqID_4589
  Homolog annotation: Hit_ID=Q1RZD5; Match level="QueryCoverage=50%, HitCoverage=14%, E-value=5e-07, Identity=43%"; Hit description=Zinc finger, C2H2-type
MRRHCHKDDNFKRESEEGNYIKKIFEIPMQRSEKIQFNNNFNMFGGSHNLFSYFASTHIYKDKVIQLARPNVVHCGGKRKVAIFASDHSEHLHKKAKQEWSWELCHITTTSKKCLIDHIQGKKHIAETSMGTK

SEQ ID NO: 121368 - protein, 61 aa, Glycine max
  Coding DNA Sequence Number=SeqID_4590
MAINQTLEFVEFGRKLSVVAVCEESVKGEKWKGKRRVIGYRSHSIRSTAITSSTSHIDSCI

SEQ ID NO: 121369 - protein, 130 aa, Glycine max
  Coding DNA Sequence Number=SeqID_4591
  Homolog annotation: Hit_ID=Q5VNG4; Match level="QueryCoverage=56%, HitCoverage=14%, E-value=4e-25, Identity=70%"; Hit description =Putative auxin-independent growth promoter
MEHRYAYPWWKEKIINSDLKRKDGLCPLTPEETALTLKALDIDQNIQNYTTAGKIYSGERRMASLAKEYPKLVNINTQGREETIKKLKILAKHCKLQPLLQMLYRQHPKWEKLDLLRIERQLGKAGLGKR

SEQ ID NO: 121370 - protein, 116 aa, Glycine max
  Coding DNA Sequence Number=SeqID_4592
  Homolog annotation: Hit_ID=Q1SM96; Match level="QueryCoverage=60%, HitCoverage=5%, E-value=8e-11, Identity=52%"; Hit description=DDT
MEDYDSYIAQSDRGENGVIVASRAFPHDEFRPRGGKVLSRVAAVAAARNGSSTSSYDIAVTRNVKKKQKRKGLRELFTTDYIVNSVLRKDGPTLGQEFDFLPSDSCGTMVLDRGKR

SEQ ID NO: 121371 - protein, 208 aa, Glycine max
  Coding DNA Sequence Number=SeqID_4593
MPPLIPPPLSSGDEVFDDVINQMIQTLVQLMRTLEKIPEEKVSGIRIIPNGEIALRKMSMIISSIIQQMSGLTTVWENKDGENSRLQESHEVWQEDGGFQEAVENWLGGPSDHESAPVGRIRGFYFLEDDNVYSVELRELLNRQGHANINWELQETTISSASVEQDLEQHSRDQIVGQEEVTVSPLNLPSLPIPPPLPIWDLHHHRDN

SEQ ID NO: 121372 - protein, 43 aa, Glycine max
  Coding DNA Sequence Number=SeqID_4594
  Homolog annotation: Hit_ID=Q9M6R5; Match level="QueryCoverage=61%, HitCoverage=4%, E-value=4e-07, Identity=81%"; Hit description =Meiotic asynaptic mutant 1
MKLLYYDDVTPADYDPPFFKGCTNEEATMTCLHVGFSTPLDQI

SEQ ID NO: 121373 - protein, 585 aa, Glycine max
  Coding DNA Sequence Number=SeqID_4595
  Gene Ontology: Mol. function=protein serine/threonine kinase activity; Cellular component=nucleus; Biological process=protein amino acid phosphorylation
  Homolog annotation: Hit_ID=Q1SH95; Match level="QueryCoverage=58%, HitCoverage=97%, E-value=1e-118, Identity=63%"; Hit description =Protein kinase
  Pfam annotation: Domain name=DUF313; Domain location=443-558; Score =43.5; E_value=7.3e-10; Accession=PF03754.4; Description=Domain of unknown function (DUF313)
  Pfam annotation: Domain name=Pkinase; Domain location=3-262; Score =213.8; E_value=3.9e-61; Accession=PF00069.15; Description=Protein kinase domain
  Pfam annotation: Domain name=Pkinase_Tyr; Domain location=3-262; Score=14.9; E_value=2.2e-13; Accession=PF07714.7; Description =Protein tyrosine kinase
  Pfam module annotation: Pfam domain module=DUF313::Pkinase::Pkinase _Tyr; Domain location=443-558::3-262::3-262
  Subcellular localization annotation: CTP_CleavageSite=36; ConfidenceScore=5.43e-01
MNWVRGESLGSGSFATVNIAIPTNTSTQFLSSTAVKSSHVQTSSMLKNEKEILDRLGASPYVINCFGDDHTVENGEEYYNIFLEYAAGGSLADQVKKHGGRLPESYVRRCTRSLVEGLKHIHDNGYVHCDVKLQNILVFQNGDVKIADFGLAKEKGEKPGKLECRGTPLFMSPESVNDNEYESPADIWALGCAVVEMVTGKPAWDVRGSNIWSLLIRIGAGEELPKIPEELSEEGKDFLLKCFVKDPMKRWSAEMLLNHPFVNGETVSFQKVNEPLPLPSPSPSPRTHFDLTHWASTLTASLPSSPDSDEWRMWEFGSSCSPENRLRRLVTVQTPANWSESDGWTSISITDWKSLEKMSCKPFKPSILHLAISKDAPQLYREEELIQLKNFSNLLSSVESKPKTHNTGQMMTRKRQIEEMPKEERVTPAMIKKPRSIILVQNRPSPDLPAEFKNRVSELSGHDLKFLMHKRLFCSDVKPNSNRLSMPINEIKCEFLTEAEITKLDERDGPNGKGRLVGVEVTVLDPCLREFTLPLKKWSMQRTDTYNLVTNWNSIVSTNKFEEDQELQIWSFRVGNKLYLILNKL

SEQ ID NO: 121374 - protein, 400 aa, Glycine max
  Coding DNA Sequence Number=SeqID_4596
  Homolog annotation: Hit_ID=Q75GU4; Match level="QueryCoverage=32%, HitCoverage=27%, E-value=7e-23, Identity=46%"; Hit description =Expressed protein
MRFKRFMDLSESATSYDSGALKSSAELSMEKLQREERDLWRHHYSDFRNCSYDYKAIGREAIARENPVVKATKIVKGSLPRCSLVNNDRFRFNLGVALAVGSIQLHLIILELLNMNDFGVVVDRASTALNLLSVALELLFEECVDGAGREANEDSCEPMLQGLISSSMNNYSNTAFVKAFVGKILWDLSLRETVKRVLEKVFRMSLNTVNESLEDYSSPMFRGDQNETETIQRLNLHKASTNRKHLLWLVERMIELRVVDVAVREWSEQVDFTVDLLANAVSVGTILASRQVMNELYYSTSEKQARRRLAADTGFRCYEELVKVGGDLSEIQMDGHNEHGLDSLPQEEFLSLLGSARTSPPVHQFLVNTLGEVGVKRISNVLSGAGKELERIVLDHLQVQ

SEQ ID NO: 121375 - protein, 108 aa, Glycine max
  Coding DNA Sequence Number=SeqID_4597
MGYAHEPEIYPKAHENPRAFSCIFGPIFLESSIQCHWEVGGLEDSLPGGVRVSDAGEEATGLLEAGGGEVVAQGPNKEEDEGAVIVRSELHEHLEKDLNENSHPRRKT

SEQ ID NO: 121376 - protein, 82 aa, Glycine max
  Coding DNA Sequence Number=SeqID_4598
  Homolog annotation: Hit_ID=Q6ZGV8; Match level="QueryCoverage=51%, HitCoverage=3%, E-value=2e-09, Identity=58%"; Hit description =Eukaryotic translation initiation factor 3 subunit (EIF-3)-like
MSHFYDVYIFRMNGGQWSTSSRHYLLDLLRVTPRDANYIGPGSRFCILRPELITAYCQAQAAEALKSKEKNFQEADNLATES

SEQ ID NO: 121377 - protein, 97 aa, Glycine max
  Coding DNA Sequence Number=SeqID_4599
MVWRLLSLSSFCILLPFIFQEAKESIDEEDLRPTSSNGAYITTIVMLPSARQLDVLAHAKGFVEDVDKFIEAMDWISGGGFLCREEAELGEGWVELH

SEQ ID NO: 121378 - protein, 287 aa, Glycine max
  Coding DNA Sequence Number=SeqID_4600
  Gene Ontology: Mol. function=nucleoside-triphosphatase activity; Cellular component=chloroplast; Biological process=transport
  Homolog annotation: Hit_ID=Q1SM97; Match level="QueryCoverage=94%, HitCoverage=95%, E-value=9e-95, Identity=66%"; Hit description=FeS assembly ATPase SufC
  Pfam annotation: Domain name=ABC_tran; Domain location=68-239; Score=- 3.2; E_value=3.3e-07; Accession=PF00005.17; Description=ABC transporter
  Subcellular localization annotation: CTP_CleavageSite=33; ConfidenceScore=5.22e-01
MALSLLIHCSPTVNPLRRSPKPTLRRVNHRVCVASAATPLLQVNDLRAKIVESNVDILHGVNLTVNQGEVHAIMGKNGSGKSTFAKVLVGHPDYEVTGGSVVFKGENLLEMEPEERSLAGLFMSFQSPVEIPGVSNDLFLAMAYNARMKKLGREEVGPIEFLPYLMEKLQLVNMKADFLNRNVTKGSVAVNASAMKSCSLRDVANAVNRILTPEKSLLMITHYRRILDLLNPTHVHVMVLVLSIQVKDELEEVDFLKKDKGKIARTGDISVVEAIESDGYEAVSALT

SEQ ID NO: 121379 - protein, 97 aa, Glycine max
  Coding DNA Sequence Number=SeqID_4601
  Pfam annotation: Domain name=F-box; Domain location=5-53; Score=18.6; E_value=0.023; Accession=PF00646.23; Description=F-box domain
MDVEVEIDRLPIDLLAYIFVLFTSFTDLAQASGVCKKWKQGVKESLARRHNLSFAGWKMDDDSTSRLVFHAYNLTKLDMYAVVTIVYDKSKKLLAES

SEQ ID NO: 121380 - protein, 999 aa, Glycine max
  Coding DNA Sequence Number=SeqID_4602
  Gene Ontology: Mol. function=sequence-specific DNA binding; Cellular component=nucleus; Biological process=regulation of transcription, DNA-dependent
  Homolog annotation: Hit_ID=Q1SM96; Match level="QueryCoverage=95%, HitCoverage=80%, E-value=0.0, Identity=71%"; Hit description=DDT
  Pfam annotation: Domain name=DDT; Domain location=231-287; Score =23.9; E_value=0.00059; Accession=PF02791.7; Description=DDT domain
MTVWRETNPDAGDLPFGFGVSGQEVPLISNSIGQKPVRKNNRSWKTVNRNGMPKNKTQNKRNKSQDKRKLTMQRRVGELNLNVTQNQSPKEKCELALDSAISEEGVDRFSMLFDDEELELRELQEGTNLFMCSDHLAGSGMVGCSLCKDVLVKFPADIVKMKKPIHLQPWDSSPEIVKKLFKYYMVTDPKSSIASCGLHTGQCRGKVAMLEKISTFPSPSHSLPPFESSIAAMDKKVFHFIYTYAIIVDICPFTLDEFVQAFHDKDSMLLGKIHVALLTLLLSDIEVEITNGFSPHLNKSCNFLALLHSVESQEYSLDFWRRSLNSLTWIEILRQVLVASGFGSKQGSLRREVLNKELNLLVNYGLCPGTLKSELFNILSERGNIGCKVAEMAKSMQIAELNLASTTEGLESLICSTLSSDITLFEKISSTAYRLRMSSVTKDGDESDSDTEDSGSVDDEFNVADTCSSGDDFESDSINSSKRKLKRANSHKNNMLKVYTEIDESHPGEAWLLGLMESEYSDLNIEEKLNALASLTDLVSSGSSIRMKDSTKVTADCNSGIQLRGSGAKIKRSAVKKPGPLWNQKVHLNSDPCAVDSSSLISRFHTHEASFGKGKVSFISHPIQSVFLGSDRRYNRYWLFLGPCNVDDPGHRRIYFESSEDGHWEVIDTEEALCALLSVLDDRGKREALLIESLERRRTSLCRSMSRINANSTGMGSMSHSDQSELDMVKDDSYSPASDVDNLNLTETAEDSLPSAGAVVIEAGKKGEEQIQKWIRVQEYDSWIWNSFYLDLNVVKYGKRSYLDSLARCKSCHDLYWRDERHCKICHMTFELDFDLEERYAIHIATCREKEDSNTFPDHKVLSSQIQSLKAAVYAIESVMPEDAMVGAWRKSAHKLWVKRLRRTSTLVELLQVLTDFVGAINKDWLYQCKFLDGVVEEIIASFASMPHTPSALALWSTWCLAIGALLRLLKGMRIEMKELPVPLLDQRFMCWLHLVLNF

SEQ ID NO: 121381 - protein, 38 aa, Glycine max
  Coding DNA Sequence Number=SeqID_4603
MDECEGEYADIDDPMDFIGKEFLQLLCKNNDFGCFVNQ

SEQ ID NO: 121382 - protein, 107 aa, Glycine max
  Coding DNA Sequence Number=SeqID_4604
  Gene Ontology: Cellular component=integral to membrane
  Homolog annotation: Hit_ID=Q8LNN5; Match level="QueryCoverage=69%, HitCoverage=31%, E-value=4e-09, Identity=42%"; Hit description =Putative transmembrane protein
MGSEGVPSMVVEVMSMATVELTDASSWWHKIDDSPAWQDRISYTLVVLYGSTGLDTIESGLSPYQYFGEWGSVCSFYLLSERAEVEARGENSTVYKVDVCDQLLNDV

SEQ ID NO: 121383 - protein, 214 aa, Glycine max
  Coding DNA Sequence Number=SeqID_4605
  Gene Ontology: Mol. function=RNA-directed DNA polymerase activity; Biological process=RNA-dependent DNA replication
MVNQGQWRSHPGNQFNKDQGEPSNRPQNQEISLYERTTKLEETLAQFMQITMSNHKSTESGIKNLEIYVGQLAKQIVDNSSSTFGANTKKNPKEECKAIMTRSRKATMMENEGTISDNKKRGKRKRKKNEKNREKEGERKTKSELAREKKKEVVPCSGKEVPYPLVPSKKDKERHLARFIDILKKLKIAIPFGEALQQMPLYSKFLNDLLTKRS

SEQ ID NO: 121384 - protein, 70 aa, Glycine max
  Coding DNA Sequence Number=SeqID_4606
MKVVTDGVSLSEAYALMSLQNQKALFKAEVGKKEEVEYERERERLSRGEKKSKRPKALNFQEDSRFRSDF

SEQ ID NO: 121385 - protein, 347 aa, Glycine max
  Coding DNA Sequence Number=SeqID_4607
MASRKRKSTASRTQEPYDTTSFISEAAYERYSQHIHSRNILLERNINLFVTEYDEFRRELVRRNWHRALTQHPDGHIDVALVKEFYSNLYDLEEKSPRQPGERYIAYTRFYNTRPDPQELVSKLYIPGRSFVLNADGAPWKLLRKDLTTLAWIWMWAHSSLDRFIAYHCPITPPGLDFRHLSLPYASPRELFKICRHSSHGSGTIKSSAPFSSTPVHSTSASPAPAPTPASVLVSTSAQSSDIIVPMLQSLHQGLCLVAWPRVQPSPLGGGEASTTQEPQPQLQPGVMQEATPETTPQDEEGTEVTDYAADMAAAQSTWDPWPDIAQETSQPAQDAPSSPQDEHAPA

SEQ ID NO: 121386 - protein, 902 aa, Glycine max
  Coding DNA Sequence Number=SeqID_4608
  Gene Ontology: Mol. function=protein binding; Cellular component =thylakoid; Biological process=ethylene mediated signaling pathway
  Homolog annotation: Hit_ID=Q1SC84; Match level="QueryCoverage=98%, HitCoverage=98%, E-value=0.0, Identity=60%"; Hit description=TPR Domain, putative
  Pfam annotation: Domain name=BTB; Domain location=246-353; Score= -10.5; E_value=0.036; Accession=PF00651.21; Description=BTBPOZ domain
  Pfam annotation: Domain name=TPR_1; Domain location=583-616; Score =16.6; E_value=0.056; Accession=PF00515.18; Description =Tetratricopeptide repeat
  Pfam annotation: Domain name=TPR_1; Domain location=709-742; Score =3.7; E_value=1.9; Accession=PF00515.18; Description=Tetratricopeptide repeat
  Pfam annotation: Domain name=TPR_1; Domain location=783-816; Score =21.1; E_value=0.0041; Accession=PF00515.18; Description =Tetratricopeptide repeat
  Pfam annotation: Domain name=TPR_2; Domain location=454-487; Score =5.4; E_value=7.8; Accession=PF07719.7; Description=Tetratricopeptide repeat
  Pfam annotation: Domain name=TPR_2; Domain location=583-616; Score =21.7; E_value=0.0027; Accession=PF07719.7; Description =Tetratricopeptide repeat
  Pfam annotation: Domain name=TPR_2; Domain location=675-708; Score =5.2; E_value=8.2; Accession=PF07719.7; Description=Tetratricopeptide repeat
  Pfam annotation: Domain name=TPR_2; Domain location=709-742; Score =17.8; E_value=0.04; Accession=PF07719.7; Description=Tetratricopeptid e repeat
  Pfam annotation: Domain name=TPR_2; Domain location=783-814; Score =3.2; E_value=14; Accession=PF07719.7; Description=Tetratricopeptide repeat
  Pfam annotation: Domain name=TPR_2; Domain location=815-848; Score =12.0; E_value=1.3; Accession=PF07719.7; Description=Tetratricopeptide repeat
  Pfam module annotation: Pfam domain module=BTB::TPR_1::TPR_1::TPR _1::TPR_2::TPR_2::TPR_2::TPR_2::TPR_2::TPR_2; Domain location=246 -353::583-616::709-742::783-816::454-487::583-616::675-708::709 -742::783-814::815-848
MQHKIFATMRSLKIMDGCKGTQVYAINPSGAGGADGPTGGGIGEKLLQQLHDHIKGQTLRTKSVRNLQATNHTTPSEVVLSDGSLLPYGLSMTDLLEPKIEPSLMSVDFVETLAGVHRRTGDCPQFDRSEVYLEQCAVFQGLADPKLFRRSLRAARQHAVHVHAKVVLAAWLRHERREDELIGSSSSDCSGRNLECPRATLTPGYDPESVFDSCACTRAHAGNRDIDDDAMTIVVDEQCSTSEEEEEEEEEDGDMSFFVGDDEIKCNRFNIASLSRPFKTMLYGGFVESLKEKINFSGNCFSVEALRAADVFSRTKRLSHLEPRVVLELLSLANRFCCDEMKNACDVHLASLVCDIDDALLLVEYGLEETAYLLVAACLQVFLRELPGSLQSSSVVKMFCSPEGRDRLALAGHVSFVLYYFLSQIAMEEEMRSNTTVMLLERLVECATDGWEKQIAFHLLGVVMLERKEYKDAQHWFQAAVDAGHVYSLVGVARAKYKRGHTYSAYKLMNSLISDHKPVGWMYQERSLYCVGKEKLMDLMSATELDPTLSFPYKFRAVSFLQENKIGPAIAEINKIIGFRVSPDCLELRAWFLIAMEDYEGALRDVRAILTLDPNYMMFYGHMHGDQLVELLQPAVQQWSQADCWMQLYDRWSSVDDIGSLAVVHQMLANDPGKSLLHFRQSLLLLRLNCPKSAMRSLRLARNYSTSDHERLVYEGWILYDTGHREEALAKAEESISIQRSFEAYFLKAYALADSNLDSESSKYVISLLEEALRCPSDGLRKGQALNNLGSVYVDCDKLDLAADCYMNALNIKHTRAHQGLARVYHLKNHRKAAYDEMTKLIEKARGNASAYEKRSEYCDRDMAKSDLGMASQLDPLRTYPYRYRAAGLRNVSINWFASITS

SEQ ID NO: 121387 - protein, 165 aa, Glycine max
  Coding DNA Sequence Number=SeqID_4609
  Gene Ontology: Mol. function=DNA binding; Biological process=DNA integration
  Homolog annotation: Hit_ID=Q1SKC8; Match level="QueryCoverage=81%, HitCoverage=33%, E-value=7e-38, Identity=55%"; Hit description =Integrase, catalytic region
MEHKAYWALKFLNFDEVAPREQRKIQLLELEEIRLTAYESSRLYKERVKVYHDKKLLKKDFRPRQQMVLINSRLKLFPGKLKSKWSGPFTIKEVRPYGAVELFDPQSKTPDRTWVVNANDSSYDERVTTRAKRTNPYSLADGVSLSQTLALSPKTSMEFYLLELG

SEQ ID NO: 121388 - protein, 104 aa, Glycine max
  Coding DNA Sequence Number=SeqID_4610
MDRKRPRKLNLNAPLLSTRRLGSPNVADTSCSSYSVGPIQNTSERVPFSWEKAPGKPKETERSDNTQDGNTPRLRLPPGHWLPPKEAAQEDVDRGDDAFHDQGD

SEQ ID NO: 121389 - protein, 140 aa, Glycine max
  Coding DNA Sequence Number=SeqID_4611
ALDYVQKKSENAHSNTNDGLRLKLAESNGYQSPTYMINRFLPDATALAASSALHFSTNFEEKGCDTCNYQECYTRHSYASSPKGCGLELLFPWRMKHKLCSMKSPVLPCSTNLHKHQRNSKQKKHRSSTTYIPCTNMKDI

SEQ ID NO: 121390 - protein, 149 aa, Glycine max
  Coding DNA Sequence Number=SeqID_4612
MYKKMEIPRERPKSCSCSLVVFQENRHKFGGMPTYELCSASIRTRRWSLSDPRSEPVERQPKLVDDLKEVLIGGKLKQKTKFGRLVPLIVDEELIRCLVCNKDIFSWKVRVMLRINPKFISHKLSLNFEARPVAQKWRKFGDDKRRPIK

SEQ ID NO: 121391 - protein, 115 aa, Glycine max
  Coding DNA Sequence Number=SeqID_4613
MLVATPRIFPPLGSAPVSLALARPRWARCDIYAHAPLIASLLNHDSILQPSRILDLSDVEASFMMMNQAILMIPKAQVIDSRLIQDFKIKHQESNPRFKIQGKKSRSDKSRLHIG

SEQ ID NO: 121392 - protein, 677 aa, Glycine max
  Coding DNA Sequence Number=SeqID_4614
  Gene Ontology: Mol. function=protein serine/threonine kinase activity; Cellular component=cell surface; Biological process =protein amino acid phosphorylation
  Homolog annotation: Hit_ID=Q5DMV1; Match level="QueryCoverage=92%, HitCoverage=93%, E-value=0.0, Identity=54%"; Hit description =Receptor lectin protein kinase-like
  Pfam annotation: Domain name=Lectin_legB; Domain location=20-269; Score=317.2; E_value=3e-92; Accession=PF00139.10; Description=Legume lectin domain
  Pfam annotation: Domain name=Pkinase; Domain location=355-621; Score =169.1; E_value=1.1e-47; Accession=PF00069.15; Description=Protein kinase domain
  Pfam annotation: Domain name=Pkinase_Tyr; Domain location=355-621; Score=106.3; E_value=8.7e-29; Accession=PF07714.7; Description =Protein tyrosine kinase
  Pfam module annotation: Pfam domain module=Lectin_legB::Pkinase::Pkina se_Tyr; Domain location=20-269::355-621::355-621
MAPKNLFGLLIFLILLVTCTAFSFQFHGFHNSERNLTREGDSNVTPQGILQLTKRENNIVGHAFYNKPIKILEKTNSSVPQTKFSSFSTCFVFSIVSPNSGLGGFGLAFTIAPTTQFPEAEGGHFLGLFNNSNDMNTSNHILVVEFDTVNGYKDNTDTVGNHVGVNINGMQSKIAEPAAYFEEGMDAKKEEFSMEKEDAVCAWIEYDGETEILNVTIAPLKVSKPSKPLISQAIHDIKFVMKETMFFGFSASTGKRKASSHYILGWSVSVNGGIAPPLNFSLLPKPPPKEKDASSFPWVKVAVAMLSALTFTLLCLLFIVTRYKRYMMFETLEDWELDCPHRFRYRDLHIATKGFIESQLIGVGGFGAVYKGVLPSTGTEVAVKRIMRSPMQGMREFAAEIESLGRLRHKNLVNLQGWCKHKNDLILIYDYIPNGSLDSLLFNDNIALDWDQRFNIIKGVAAGLLYLHEEWEQVVIHRDVKSSNILIDGEFNARLGDFGLARLYSHDQVSHTTSVVGTIGYIAPELTRTGKASASSDVYAFGVLLLEVVAGTRPVGSSGQFLLVDWVLENCQLGQILEVVDPKLGSAYDEEEMELVLKLGLLCSQYKAEYRPSMKQVARYLNFDDSLPDISDWRYYDSQSSTNSLSFLEAMSTGKIASSYSLSSIGSRSTLPIKTGR

SEQ ID NO: 121393 - protein, 73 aa, Glycine max
  Coding DNA Sequence Number=SeqID_4615
MALTLRVNISERLIGILGTGLNFGRARGDCEDRFYSPAKARRALHTMENDKLRRVHSDVTASRSVRDKSGRVG

SEQ ID NO: 121394 - protein, 178 aa, Glycine max
  Coding DNA Sequence Number=SeqID_4616
  Gene Ontology: Mol. function=chromatin binding; Cellular component =chromatin; Biological process=chromatin assembly or disassembly
  Homolog annotation: Hit_ID=Q1SAV4; Match level="QueryCoverage=97%, HitCoverage=53%, E-value=1e-49, Identity=48%"; Hit description =Integrase, catalytic region
  Pfam annotation: Domain name=rve; Domain location=9-131; Score=2.0; E_ value=0.004; Accession=PF00665.16; Description=Integrase core domain
  Subcellular localization annotation: CTP_CleavageSite=70; ConfidenceScore=5.13e-01
MRLLQPFPVPMSPWTDLSMDFITTLPPSQGYSVILVVVDRFTKGTHFGALTSYFSSHKLLTKCGTNLRMSTSYHSQTNRLNEVLNYTLEQYLHCFIHEALTKWFSYLSLVEWYYNTSVYSFIGVTSFEATYDKPPPAIPQYLLGSSNMDVVDYLLSSQQDLCNILHYRLLKTQRAMKI

SEQ ID NO: 121395 - protein, 52 aa, Glycine max
  Coding DNA Sequence Number=SeqID_4617
MVLDCHDIQYSVINIESLATDLLLHQQHRGGKRVVANLDETSGCEKGENNIG

SEQ ID NO: 121396 - protein, 247 aa, Glycine max
  Coding DNA Sequence Number=SeqID_4618
  Gene Ontology: Mol. function=RNA-directed DNA polymerase activity; Cellular component=chromatin; Biological process=chromatin assembly or disassembly
MVEWLIPTTTRSLRGFLGLTGFYCKFIRQYASITALLRTLLQKDNFHWTNDPSAAFIRLKQAMTQAPMLALSDFATPFTLETDAFGHAMGTVLIQHGHPLAFFSKVFCPCLQRSSTYVRELHAITTTIRKWRQYLLGHSFIILTYHKSLKDLMRQYKSSKSNVIVDALSRLSLIPTASYFFLSIPHFTFLDDLYDSLTSSSLFQKQHELVMTSLDSHPEFTMLLPSEVTWVSRRHYTVSNKTSTGSP

SEQ ID NO: 121397 - protein, 118 aa, Glycine max
  Coding DNA Sequence Number=SeqID_4619
MEILAQASYGEVINNIGEQSREKTCMGQLRDRDTTLNGAFEATYNEMASRHRVLVVKALEKSKKSREKASQRTFVNRWIFSKFGLQLQKTLVHDLTVGIFEKISGVCAKLPFLRAFLT

SEQ ID NO: 121398 - protein, 65 aa, Glycine max
  Coding DNA Sequence Number=SeqID_4620
MLQSCEIDTGLKEHSNWMIPKAYTPKSPSGPLPPDSVINSSGSYSESHHNSSHINSLPLKGLAVV

SEQ ID NO: 121399 - protein, 263 aa, Glycine max
  Coding DNA Sequence Number=SeqID_4621
  Gene Ontology: Mol. function=disulfide oxidoreductase activity; Cellular component=extracellular space; Biological process=antigen processing and presentation of exogenous peptide antigen via MHC class II
  Homolog annotation: Hit_ID=Q10MT8; Match level="QueryCoverage=82%, HitCoverage=70%, E-value=2e-35, Identity=35%"; Hit description=Gamma interferon inducible lysosomal thiol reductase family protein, expressed
  Pfam annotation: Domain name=GILT; Domain location=50-161; Score =80.1; E_value=6.9e-21; Accession=PF03227.6; Description=Gamma interferon inducible lysosomal thiol reductase (GILT)
MVFPKLVITIALILVLFLFICESQGASYASASHNAGHGADINTSLAHQKVNLSVYYDSLCKTCAKFIIEDLRDIFGNNLISIVNLQLVPWANAYVNNTNKSISCQNGPDECELNSLESCALNLWSKVDIQYQFVNCFEFLAIKGTIKEWKEECLNQLGLPKEPFLNCFNMGNGTEPLKTAEPPVLTVLHRFPVRFEGLSEPDDKLLGKTYINQIAQLDPPPSFVPWVVVNNQPVEKDYANFAHYVCKAYRGVVVPGVCNTLLK

SEQ ID NO: 121400 - protein, 523 aa, Glycine max
  Coding DNA Sequence Number=SeqID_4622
  Gene Ontology: Mol. function=transcription factor activity; Cellular component=nucleus; Biological process=regulation of transcription, DNA-dependent
  Homolog annotation: Hit_ID=Q00LP4; Match level="QueryCoverage=54%, HitCoverage=92%, E-value=1e-48, Identity=39%"; Hit description=GRAS5
  Pfam annotation: Domain name=GRAS; Domain location=122-427; Score =37.6; E_value=4.6e-10; Accession=PF03514.5; Description=GRAS family transcription factor
MMHPEILESSSWSSIYEVNSSTIGHQFEHYGFEVDAHVGVSVFNSLFNTPENTSSETSINTLPSIMFTNEYDHFLHYQIEKDTLQLPKLMDVYGLSMDCDDFDPILRDHQESEGDWSPTPSLDSDLSSNQKALTLPQQGMEIENQVSLPHMLEALGEAIYQGKKALKEVILRCMRQKVSPLYEPLERVAFYLCQDMETRQDDFYLKQEASKNFEAAFKAFYQGLPHGKVAHFVANLAILEALPHDSEVIHIVDFDMGEGSQWPPLIESIATLRKTLKLTAIKRGEEGSEVVSSPWKFEEIKRVLHEHARSRDLKLMVEEKEMEEVVSELKKINKSVGSGKRDFYAFNCMVGLPHMGRGSSRRHATEFLNLIKSCGSRGIVTFGDARVCEKLENDLEFVSFFERHLLHYKALLESIESHFPNHFTDARSAMECLFVAPNISSLAWLQKWEEIKEESESYFQADIGLEGLRLSNAILMEVGEMLSGSEQGSYQARIEGQNDNQLTLEWKGTPLVRVSTWRKIKGQ

SEQ ID NO: 121401 - protein, 71 aa, Glycine max
  Coding DNA Sequence Number=SeqID_4623
MSSSSSSSPTETTTTSQHAIQPPPLHHGNNGCTTGTIGGPSYYVSSLPYIVVGEEEEGDDVALIWKPVLAW

SEQ ID NO: 121402 - protein, 154 aa, Glycine max
  Coding DNA Sequence Number=SeqID_4624
  Gene Ontology: Mol. function=protein binding; Biological process =protein amino acid phosphorylation
  Homolog annotation: Hit_ID=Q1T2W9; Match level="QueryCoverage=96%, HitCoverage=15%, E-value=3e-34, Identity=53%"; Hit description =Leucine-rich repeat; Leucine-rich repeat, cysteine-containing type
  Pfam annotation: Domain name=LRR_1; Domain location=33-55; Score=0.1; E_value=2.7e+02; Accession=PF00560.23; Description=Leucine Rich Repeat
  Pfam annotation: Domain name=LRR_1; Domain location=57-79; Score =14.4; E_value=0.41; Accession=PF00560.23; Description=Leucine Rich Repeat
  Pfam annotation: Domain name=LRR_1; Domain location=81-103; Score =9.9; E_value=3.9; Accession=PF00560.23; Description=Leucine Rich Repeat
  Pfam annotation: Domain name=LRR_1; Domain location=9-31; Score=5.3; E_value=29; Accession=PF00560.23; Description=Leucine Rich Repeat
  Pfam module annotation: Pfam domain module=LRR_1::LRR_1::LRR_1::LRR _1; Domain location=33-55::57-79::81-103::9-31
MELVKVLTIFTSIDFSSNHFEGPIPKDLMNFKTICVLNSSNNALSGEISSSIVNLKELESLDLSQNSLSGEITMQLASLSFLSYLNLSFNHLVGKIPTGNDRLYSIDWKKNDGKELRVMPQQECARLTCTIDWNLITVELGMIFGHGIVFAHYS

SEQ ID NO: 121403 - protein, 192 aa, Glycine max
  Coding DNA Sequence Number=SeqID_4625
  Gene Ontology: Mol. function=chromatin binding; Cellular component =chromatin; Biological process=chromatin assembly or disassembly
  Homolog annotation: Hit_ID=Q1SAV4; Match level="QueryCoverage=81%, HitCoverage=39%, E-value=2e-36, Identity=52%"; Hit description =Integrase, catalytic region
  Pfam annotation: Domain name=Chromo; Domain location=106-154; Score =9.8; E_value=0.067; Accession=PF00385.14; Description='chromo' (CHRromatin Organisation MOdifier
MKLIADSKCRDAMFNRGDWVMVKLRPYRQSIVTGVRGGYSKLAKRFYGPFQIVERIGPMAYKLLLLEGACIHPVFHCSLLKPFHDTPGGDPQLPLPSTVVANQPLIASLAILDTRHSSDSTASKWEVLVQWDGLFLDDTSWEDWEQLRSDYHLEDKVFSKAEGDDSNQGVQAATRNRPKRNTTVPTYLRDFV

SEQ ID NO: 121404 - protein, 84 aa, Glycine max
  Coding DNA Sequence Number=SeqID_4626
  Gene Ontology: Mol. function=RNA-directed DNA polymerase activity; Cellular component=chromatin; Biological process=RNA-dependent DNA replication
MELNDLLKKAMGCPFCNRVAPIPMLEVSVSTVKGSSKSGIVGFRGPLKRVKCCCLNEGCYNQSIPANESAVEARQTQETVEGSG

SEQ ID NO: 121405 - protein, 132 aa, Glycine max
  Coding DNA Sequence Number=SeqID_4627
MKMRPYLTNNSSIRCNPSIAPRDQSEHNRDINFHNRVTRLPFHLEHLKKKVPPRARARARVEGEGSNRRRMNEEEKNEEKEAFSSLCFGNGREESKSLITSCVIHRLLKEGIFFPLIVSTCSCKVPMSLLIF

SEQ ID NO: 121406 - protein, 46 aa, Glycine max
  Coding DNA Sequence Number=SeqID_4628
GGGDKDYKEVPPPPLFKPAGGHINQAVTFNRSYYKVISSMEKWLSH

SEQ ID NO: 121407 - protein, 88 aa, Glycine max
  Coding DNA Sequence Number=SeqID_4629
  Subcellular localization annotation: CTP_CleavageSite=38; ConfidenceScore=5.15e-01
MSSAPFHRRIALATCVVLSAVPLSSALAQQPPRGEQARAEMMERGERGNRGDERSLSDAVRRVQRTTGGHILGAERVPFDGRDINTGE

SEQ ID NO: 121408 - protein, 84 aa, Glycine max
  Coding DNA Sequence Number=SeqID_4630
MWLQSRKRSPVCDKDELRQKEKEEERPGSLKANHNALPKSIPTLSETLSFPSFLRPAKDIPQSISGKDELHKHELHNMVTITEA

SEQ ID NO: 121409 - protein, 108 aa, Glycine max
  Coding DNA Sequence Number=SeqID_4631
  Homolog annotation: Hit_ID=Q1STZ2; Match level="QueryCoverage=83%, HitCoverage=19%, E-value=8e-11, Identity=37%"; Hit description=IMP dehydrogenase/GMP reductase
MGTNQTGKRFYQVKVKGLDTTSIKELGRLMEPLQMQAFRKTYGMILDLTIAEVSIEATASLTQYYDQPLRCFTFGDFQLVPTIEEFEEILGCPLGGRKPYLFSGCLPS

SEQ ID NO: 121410 - protein, 104 aa, Glycine max
  Coding DNA Sequence Number=SeqID_4632
  Subcellular localization annotation: CTP_CleavageSite=7; ConfidenceScore=5.01e-01
MPISPCRCIGIAPTRRPVGPKKSNRALGFPALVTGLCQSYRVPVPPARSCHRDIGIAPIKTPSGPGEVQQGPGVSSSGYGPLDRACKTPSGPEEVQQGLGVVKL

SEQ ID NO: 121411 - protein, 68 aa, Glycine max
  Coding DNA Sequence Number=SeqID_4633
MVDNEERFAGAERREREATPGLRPQSNSRAIFDPAFPLGAGPITHSMRWAFIFAPHTIIFPLPDFVLL

SEQ ID NO: 121412 - protein, 282 aa, Glycine max
  Coding DNA Sequence Number=SeqID_4634
  Gene Ontology: Mol. function=RNA-directed DNA polymerase activity; Biological process=RNA-dependent DNA replication
MDQEDKEMINDSFEYGFKDSLEVICGVILILPTEHVEDYQNRNLLSDYAREDYFDDPSLSLKAVWVTEVSCFTPHRNVAVFDPPTDDMRCHMKPLHLTNMLEDQIINKILVDVGVAFNILPRSMLRRLGRTVEDLIPHNIVVSDFCGKPSDSEGIHGVGEVSSMVHQKLFFWNDDANLEMVEADHSSYGIYVAFASEGDQAMAITAPFEVKDSFYVNKSVTTSSKAYANFIARLSAYIADGKKQMATTTIKVKKEKMDTDLPRLGRELVEHRLSIREGKKPV

SEQ ID NO: 121413 - protein, 226 aa, Glycine max
  Coding DNA Sequence Number=SeqID_4635
MPLLILKKHKTLPTPIEGTMKSNKGIQLILIPGHEEKFRKSRAVRKQYAALQIQKVKGGFPKVERREKWCSCGLLVLKIMGNLWMMEIEGIDLENWKAECGYKGMRQLYGATPKSKDHGVFFHGLGESVFEHKESKGKYATSTKIWKDTDWVLPLMGPQRKMTMKSSLRLRKHGIMLSNVITTLAMPKNVIQALVGFLKQTRTTLIFGGGGGWHEPQMGQEGKNHP

SEQ ID NO: 121414 - protein, 74 aa, Glycine max
  Coding DNA Sequence Number=SeqID_4636
MEIEVFITAVHSWREKKQESLNSHSMGFGTHPTCLAGVSERERQFCFAELLPTPIQCSYLSQPITRALFFTLYF

SEQ ID NO: 121415 - protein, 341 aa, Glycine max
  Coding DNA Sequence Number=SeqID_4637
  Homolog annotation: Hit_ID=Q1PE30; Match level="QueryCoverage=19%, HitCoverage=12%, E-value=5e-08, Identity=57%"; Hit description =Protein kinase family protein
MEASALSQRIMEGSQWKLALLLNFHPSHLRMTGIHLLHPVKKIEVGTEANNGNKWKLEEERRMEKARLAEETEQGQNGSGYIGGTRREITNLTKAPPSLPKRTWTWQQRVQVPVKGADRCVHFGLPKLIQVTMVYHDGYGGVEIPPTKPLAPQIVTRAVTSGKNSCSDTGRDFIRASFAANFFARYNDNMVSAFWCSIVVVAEAIGDLRDAFVAFPRYRTSLAIGFGCSRDQSQGIELDVHKKNLEAATERGGKQPWETAACPLHVILEVARSLGDPYESASGCRDIGVAIRGNYQWQSVGFCGGAMTMLERKLATEQRRCARLALHGEVINFNGIHGKAK

SEQ ID NO: 121416 - protein, 252 aa, Glycine max
  Coding DNA Sequence Number=SeqID_4638
  Homolog annotation: Hit_ID=Q69SJ2; Match level="QueryCoverage=42%, HitCoverage=78%, E-value=2e-27, Identity=54%"; Hit description =Vacuolar protein sorting 55 protein-like
  Pfam annotation: Domain name=Vps55; Domain location=119-252; Score =122.9; E_value=9e-34; Accession=PF04133.4; Description=Vacuolar protein sorting 55
  Pfam annotation: Domain name=WD40; Domain location=90-129; Score =24.2; E_value=0.00047; Accession=PF00400.22; Description=WD domain, G-beta repeat
  Pfam module annotation: Pfam domain module=Vps55::WD40; Domain location=119-252::90-129
  Subcellular localization annotation: CTP_CleavageSite=31; ConfidenceScore=5.11e-01
MASSTQPHGTPISIAFAFASLSSRAMIFLLKASLNHGLKSLFNLEDKVDFPAKGLSLAFIWNGIKVIQRFVATVELDNNKVLILDIRVPITPFMGLSKHRTCVNAMSWSPDFGRHLCSISDDARVFIWEVMDTGFRSGNGCDVEPVMWQILACAIYNNWWPMLSALMYVLVPMPCLFFGGGSTQFLMSRDGGGWIDAAKFLTGASAVGSIAIPIILKHAHMIETGAMLIELVSFFIFICTVLCFHQAGLDDD

SEQ ID NO: 121417 - protein, 351 aa, Glycine max
  Coding DNA Sequence Number=SeqID_4639
  Gene Ontology: Mol. function=binding; Cellular component=membrane; Biological process=multicellular organismal development
  Homolog annotation: Hit_ID=Q96301; Match level="QueryCoverage=92%, HitCoverage=35%, E-value=1e-165, Identity=82%"; Hit description =Probable UDP-N-acetylglucosamine--peptide N- acetylglucosaminyltransf erase SPINDLY
MQSSRIEDWGRRFMRLYPQYTSWDNSKDPERPLVIGYVSPDYFTHSVSYFIETPLVYHDYSNFKVIVYSAVVKADSKTIRFREKVLNKGGIWKDIYGIDEKRVANMVREDQVDILVELTGHTASNKLGMMACRPAPIQVTWIGYPNTTGLPTIDYRITDSLADPPETKQKHVEELVRLPECFLCYTPSPEAGPICPTPALSNGFVTFGSFNNLAKITPKVLQVWARILCAIPNSRLVVKCKPFCSDSVRQRFLSTLEQLGLEPLRVDLLPLILLNHDHMQAYSLMDISLDTFPYAGTTTTCESLYMGVPCVTMAGSVHAHNVGVSLLSKVEMGNRMENKSKSTTPLGRVLS

SEQ ID NO: 121418 - protein, 491 aa, Glycine max
  Coding DNA Sequence Number=SeqID_4640
  Gene Ontology: Mol. function=transferase activity, transferring glycosyl groups; Cellular component=nucleus; Biological process =multicellular organismal development
  Homolog annotation: Hit_ID=Q96301; Match level="QueryCoverage=94%, HitCoverage=49%, E-value=0.0, Identity=53%"; Hit description =Probable UDP-N-acetylglucosamine--peptide N- acetylglucosaminyltransf erase SPINDLY
  Pfam annotation: Domain name=Sel1; Domain location=213-244; Score =12.5; E_value=0.43; Accession=PF08238.2; Description=Sel1 repeat
  Pfam annotation: Domain name=Sel1; Domain location=318-349; Score =8.8; E_value=1.3; Accession=PF08238.2; Description=Sel1 repeat
  Pfam annotation: Domain name=Sel1; Domain location=352-383; Score =9.9; E_value=0.93; Accession=PF08238.2; Description=Sel1 repeat
  Pfam annotation: Domain name=TPR_1; Domain location=179-212; Score =5.9; E_value=1.1; Accession=PF00515.18; Description=Tetratricopeptide repeat
  Pfam annotation: Domain name=TPR_1; Domain location=213-246; Score =34.9; E_value=2.8e-07; Accession=PF00515.18; Description =Tetratricopeptide repeat
  Pfam annotation: Domain name=TPR_1; Domain location=247-280; Score =43.3; E_value=8.2e-10; Accession=PF00515.18; Description =Tetratricopeptide repeat
  Pfam annotation: Domain name=TPR_1; Domain location=318-351; Score =28.5; E_value=2.4e-05; Accession=PF00515.18; Description =Tetratricopeptide repeat
  Pfam annotation: Domain name=TPR_1; Domain location=352-385; Score =46.2; E_value=1.1e-10; Accession=PF00515.18; Description =Tetratricopeptide repeat
  Pfam annotation: Domain name=TPR_1; Domain location=386-419; Score =25.7; E_value=0.00016; Accession=PF00515.18; Description =Tetratricopeptide repeat
  Pfam annotation: Domain name=TPR_1; Domain location=436-469; Score =28.5; E_value=2.3e-05; Accession=PF00515.18; Description =Tetratricopeptide repeat
  Pfam annotation: Domain name=TPR_1; Domain location=74-107; Score =27.3; E_value=5.4e-05; Accession=PF00515.18; Description =Tetratricopeptide repeat
  Pfam annotation: Domain name=TPR_2; Domain location=179-212; Score =2.6; E_value=16; Accession=PF07719.7; Description=Tetratricopeptide repeat
  Pfam annotation: Domain name=TPR_2; Domain location=213-246; Score =22.3; E_value=0.0017; Accession=PF07719.7; Description =Tetratricopeptide repeat
  Pfam annotation: Domain name=TPR_2; Domain location=247-280; Score =31.8; E_value=2.4e-06; Accession=PF07719.7; Description =Tetratricopeptide repeat
  Pfam annotation: Domain name=TPR_2; Domain location=318-351; Score =18.6; E_value=0.022; Accession=PF07719.7; Description=Tetratricopepti de repeat
  Pfam annotation: Domain name=TPR_2; Domain location=352-385; Score =36.7; E_value=8.2e-08; Accession=PF07719.7; Description =Tetratricopeptide repeat
  Pfam annotation: Domain name=TPR_2; Domain location=386-419; Score =19.6; E_value=0.011; Accession=PF07719.7; Description=Tetratricopepti de repeat
  Pfam annotation: Domain name=TPR_2; Domain location=40-73; Score=6.4; E_value=5.9; Accession=PF07719.7; Description=Tetratricopeptide repeat
  Pfam annotation: Domain name=TPR_2; Domain location=436-469; Score =25.4; E_value=0.00021; Accession=PF07719.7; Description =Tetratricopeptide repeat
  Pfam annotation: Domain name=TPR_2; Domain location=74-107; Score =19.4; E_value=0.013; Accession=PF07719.7; Description=Tetratricopepti de repeat
  Pfam annotation: Domain name=TPR_4; Domain location=213-238; Score =1.2; E_value=27; Accession=PF07721.5; Description=Tetratricopeptide repeat
  Pfam annotation: Domain name=TPR_4; Domain location=247-272; Score =2.7; E_value=18; Accession=PF07721.5; Description=Tetratricopeptide repeat
  Pfam annotation: Domain name=TPR_4; Domain location=386-411; Score =8.7; E_value=3.5; Accession=PF07721.5; Description=Tetratricopeptide repeat
  Pfam annotation: Domain name=TPR_4; Domain location=436-461; Score =5.4; E_value=8.5; Accession=PF07721.5; Description=Tetratricopeptide repeat
  Pfam module annotation: Pfam domain module=Sel1::Sel1::Sel1::TPR _1::TPR_1::TPR_1::TPR_1::TPR_1::TPR_1::TPR_1::TPR_1::TPR_2::TPR _2::TPR_2::TPR_2::TPR_2::TPR_2::TPR_2::TPR_2::TPR_2::TPR_4::TPR _4::TPR_4::TPR_4; Domain ...
  Pfam module annotation: Pfam domain module=location=213-244::318 -349::352-383::179-212::213-246::247-280::318-351::352-385::386 -419::436-469::74-107::179-212::213-246::247-280::318-351::352 -385::386-419::40-73::436-469::...
  Pfam module annotation: =74-107::213-238::247-272::386-411::436-461
MAGADINSDGNGSERELAGNSYNGFAEAPEASVSASGCEGNDSVSYANVLRSRNKFVDALSIYERVLESDGANVEALIGKGICLQMQNKGRLAYESFSEAIKVDPQNACALTHCGILHKDEGRLVEAAEPYPCICKEVVSGFEPMTNKSPRHNFTAAPGLALRALQVDPSYKAAAECLAIVLTDIGTNIKLAGNTQDGIQKYFEALKVDPHYAPAYYNLGVVYSEMMQYDTALSFYEKAASERPIYAEAYCNMGVIFKNRGDLESAITCYERCLTVSPNFEIAKNNMAIALTDLGTKGDINQGVTLYKKALYYNWHYADAMYNLGVAYGEMLKFDMAIVFYELAFHFNPHCAEACNNLGVIYKDRENLDKAVECYQLALSIKPNFSQSLNNLGVVYTVQGKVDAAASMIEKAIIANPTYAEAYNNLGCANLGMATYWHNFRLGVLYRDAGDIARAINAYEQCLKIDPDSRNAGQSVEAMFSCWRVTFQFGI

SEQ ID NO: 121419 - protein, 47 aa, Glycine max
  Coding DNA Sequence Number=SeqID_4641
MRLALEPIDKEDDNARDEEVGTNNDWEGYEGERDVADEAIVREVEGD

SEQ ID NO: 121420 - protein, 53 aa, Glycine max
  Coding DNA Sequence Number=SeqID_4642
  Homolog annotation: Hit_ID=Q84TU7; Match level="QueryCoverage=83%, HitCoverage=28%, E-value=5e-16, Identity=80%"; Hit description=FPh1
MAIVDDVVPYKFGEKSSKCLSSTGFQDVTFKAYNGLGHYTIPEEMDEICLDFC

SEQ ID NO: 121421 - protein, 410 aa, Glycine max
  Coding DNA Sequence Number=SeqID_4643
  Homolog annotation: Hit_ID=Q9FFZ9; Match level="QueryCoverage=85%, HitCoverage=83%, E-value=1e-118, Identity=59%"; Hit description =Arabidopsis thaliana genomic DNA, chromosome 5, P1 clone:MBL20
  Pfam annotation: Domain name=DUF1022; Domain location=15-403; Score =650.8; E_value=1.1e-192; Accession=PF06258.2; Description=Protein of unknown function (DUF1022)
MPEILDGAIRRAVVIGNGFAGAENQCIGLVRALGFSNRHSLYRVTRPRGGINRWLKWLPVSIHKRLDSVIRMICGKSRFQTPHKIGISNVLDADAHHIATMARETFHKDGPLLVIASGRDTISVASSIKRLAPENVFLVQIQHPRFQLNRFDLVITPRHDYFPLTPHAQRQIPWFLRRWVTPWEPPGHNVVLTVGALHQADSAALRVAASAWHNELATLPKPLLVVNVGGPTGNCPYDVDLVKKLVVMLQNVLWSCGSIRISFSRRTPEKISKILVKEFATNPKVQIWDGEGSNPHMGHLAWADAFVITADSVSMLSEACSTGKPVYVIGAERCTWKFADFQNSLQKQGVARPFTGNENVSCQLCCNVMCWVLSDIEVSSLLPDCVPVVVAEAASQVVAALAQRGWTIRA

SEQ ID NO: 121422 - protein, 172 aa, Glycine max
  Coding DNA Sequence Number=SeqID_4644
  Gene Ontology: Mol. function=nucleic acid binding; Cellular component= mitochondrion; Biological process=biological_process
  Homolog annotation: Hit_ID=Q9FFZ6; Match level="QueryCoverage=58%, HitCoverage=70%, E-value=1e-31, Identity=67%"; Hit description =Similarity to RNA-binding protein
  Pfam annotation: Domain name=RRM_1; Domain location=73-144; Score =110.0; E_value=6.9e-30; Accession=PF00076.12; Description=RNA recognition motif. (a.k.a. RRM, R
MAEKAHLWFGLWVYIEPVYSMNEYGDAIHTLTCFPSSLQLNSMAAVRKIIEVNRNKILSPSLLSFRRGIAYKLFVGGLSFYTTENALSEAFSNYGQVIEAKIVTDRVSDRSKGFGFVTFASQDEAENAIEDMKGKTLNGRVIFVDYAKPNINTRGEIPIARGPPEPTSTPDT

SEQ ID NO: 121423 - protein, 335 aa, Glycine max
  Coding DNA Sequence Number=SeqID_4645
  Homolog annotation: Hit_ID=Q6EPW3; Match level="QueryCoverage=78%, HitCoverage=83%, E-value=4e-30, Identity=34%"; Hit description=F-box protein-like
  Pfam annotation: Domain name=F-box; Domain location=21-68; Score =19.4; E_value=0.013; Accession=PF00646.23; Description=F-box domain
MACTDKTATVTDEASGGGATTIFAVHPDIIQTHILTCLDGRALASVASTCSQLHALSDHEPLWENICHSTWPSTNSPRVRHVISTFPCASRSFFSDSFPSFAAREGSNIDRAPELISAVDIFHRRRVVLSRVVETETESGWFRCSPFRIDVLDQKEAVATAMEYPLSDGACEILGEDLRLSWIVVNPKGKRAVNVSSGTAVSVERHWLSGEVKVRFATVVDGGERGTPAEVALCSVTVTFGNEMQVREACLQMEDMDGMFLNGRESLGILKRALEGKRGTLLKDGKEEGRSRYLEFMNRKMERKEKKQRDERRLDMLCLALAVLSFAAFSTLFLF

SEQ ID NO: 121424 - protein, 249 aa, Glycine max
  Coding DNA Sequence Number=SeqID_4646
  Homolog annotation: Hit_ID=Q9FFZ3; Match level="QueryCoverage=40%, HitCoverage=60%, E-value=3e-17, Identity=51%"; Hit description =Arabidopsis thaliana genomic DNA, chromosome 5, P1 clone:MBL20
MGNGYRRRVSPITLEMFRVLDLVIMDKGARYRDDVGVVQMVQDIWQGTQLLAIDATAAMGLLRSVLIGDELTEKEKKTLKRTLTDMASIVPIGVLMLLPLNLFIYCICVWGASTLPKKCYISVYQGKMDNVDFLQVTAVGHAAMLAAIKRYVPALRAARLYAASWVRDIGPDLRPDDYKKDDDMTDETNGEKKTTKGKESSTLEDLAVAARGGMETLRPALQRVYMTRASAYRDALKSFIEGYQEGVQQ

SEQ ID NO: 121425 - protein, 353 aa, Glycine max
  Coding DNA Sequence Number=SeqID_4647
MSTEITGNLKDMLVDVLSISRAYDTIKYVGLHREFLVHFGPQAAACGEKVEQGSEGVAFWVNIAQRQLQQAIDKERIWSRLTTSESIEVLEKDLAIFGFFVALGRSTQSFLSANGFNTLDDPIEDFIRYLIGGSILYYPQLSSISSYQLYVEVVCEELGWLPFYPGIISTTKQLHMHKNKQECPPNDEVAPQALDVCSHWMESFIKYSTWLESPSNVKAAKFLSKGHKKLVECMEELGMIKDKTLEVNTKESVERQRSTLHSTAKVSDSFNEALKKVEEAMLRLENLLQELYKEAEFLEASFRAKADSLPQGVNVDQSHTRVGKNDEYVKRKNRKNATMNRSKRSKMISVNLP

SEQ ID NO: 121426 - protein, 187 aa, Glycine max
  Coding DNA Sequence Number=SeqID_4648
  Gene Ontology: Mol. function=GTPase activity; Cellular component =intracellular; Biological process=translational initiation
  Homolog annotation: Hit_ID=Q8RWP3; Match level="QueryCoverage=50%, HitCoverage=13%, E-value=4e-42, Identity=85%"; Hit description=GTP -binding protein LepA homolog
EGEDDVKSLCPGRHTCYNGRDKGSRSRKGELTPKPILSSDCRLQLACMKSESLVIAGQPYDGEFVPGPCTHRPSHYGSWQREVLYGSAIAAMDYFADEIGVLSPSQLQVEELYAGEVGYLSASIRTVADARVGDTVTHYGRKADNSLPGYEEATPMVSCGLFPVDADQFPDLCDALEKLQLNDAALK

SEQ ID NO: 121427 - protein, 198 aa, Glycine max
  Coding DNA Sequence Number=SeqID_4649
  Gene Ontology: Mol. function=translation initiation factor activity; Cellular component=intracellular; Biological process=steroid metabolic process
  Homolog annotation: Hit_ID=Q8LN57; Match level="QueryCoverage=58%, HitCoverage=20%, E-value=8e-34, Identity=44%"; Hit description =Putative oxysterol binding protein
  Pfam annotation: Domain name=EFG_C; Domain location=1-56; Score=21.1; E_value=5.9e-06; Accession=PF00679.14; Description=Elongation factor G C-terminus
MKFIAENRASITYELPLAEMVGDFFDQLKSRSKGYASMEYTFVGYTESNLIKLDIRINGDCVEPLATIVHNNKIHDVVEDKKGRTVATLFGTWDKSLHYVIGGNSRKGKGSSYVSTKPHVLWKRSLTPEYQTRYNEMQQQARKVQEKGWKPRWFAKEKGSNSYRYVGGYWETREKGNLESCPDIFGQVSTHTNFNPTS

SEQ ID NO: 121428 - protein, 221 aa, Glycine max
  Coding DNA Sequence Number=SeqID_4650
  Gene Ontology: Mol. function=oxysterol binding; Cellular component =cytoplasm; Biological process=steroid metabolic process
  Homolog annotation: Hit_ID=Q8LN57; Match level="QueryCoverage=73%, HitCoverage=20%, E-value=5e-57, Identity=65%"; Hit description =Putative oxysterol binding protein
MDYFANEIGVLSPSQLQVEELYAGVIHDLVEDKKGRTVATLFGTWEESLHYVIGGNSGKGKESSYVSSKPHVLWKRSPTPEYQTRYNLTQFAMTLNEITPGLKEKLPPTDSRLRPDQRCLENGQHEMTNFGKLRLEQSQRHERCKRRVGNQGGLPRKKAATLTVILEGTGRPGKRGTGNLVLTFLAKSQPILILTQLHKFSTLLPTYSPYYHTPFDHSIYS

SEQ ID NO: 121429 - protein, 246 aa, Glycine max
  Coding DNA Sequence Number=SeqID_4651
  Gene Ontology: Mol. function=serine-type peptidase activity; Cellular component=lysosome; Biological process=proteolysis
  Homolog annotation: Hit_ID=Q9FLH1; Match level="QueryCoverage=85%, HitCoverage=40%, E-value=9e-66, Identity=52%"; Hit description =Lysosomal Pro-X carboxypeptidase
MVNGTFMYFVIRVVVGRHYISAGALVYWLQMALGSAAMTDYPTPSVFLAPLPAYPVRKMCEAIDNLSAVNETFTKLYAAANIFYNYTGTATCFFLDNTTAPLGGWDWQACTELIMPLGANNEGSMFPPYKWKLRDVEFYCKRVYHIQPRPHWITTEFGGHDIKRVLKRSGSNIIFFNGLRDPWSGGGVLKNISETIVAIVAKEGAHHVDLRFSTTEDPEWLKDIRKREIKIIANWISQYYQDLLNQ

SEQ ID NO: 121430 - protein, 170 aa, Glycine max
  Coding DNA Sequence Number=SeqID_4652
  Gene Ontology: Mol. function=serine-type peptidase activity; Cellular component=lysosome; Biological process=proteolysis
  Homolog annotation: Hit_ID=Q67WZ5; Match level="QueryCoverage=95%, HitCoverage=30%, E-value=1e-47, Identity=57%"; Hit description =Putative prolylcarboxypeptidase isoform 1
  Pfam annotation: Domain name=Peptidase_S28; Domain location=3-170; Score=-210.6; E_value=0.008; Accession=PF05577.2; Description=Serine carboxypeptidase S28
SYQTFQQRYLINDTYWGGAKNNAPIFVYMGNEGDIEWFAQNTGFMFETAPYFKALLVFIEHRYYGKSFPFGGNEEVADANTTTVGYMSSTQALADYATLIIDLKNNLSATDSPVVVVGGSYGGMLAAWFRMKYPHVAIGALASSAPILQFLDLVSPYTYTDIITQDYKVA

SEQ ID NO: 121431 - protein, 294 aa, Glycine max
  Coding DNA Sequence Number=SeqID_4653
  Gene Ontology: Mol. function=serine-type peptidase activity; Cellular component=lysosome; Biological process=proteolysis
  Homolog annotation: Hit_ID=Q67WZ5; Match level="QueryCoverage=63%, HitCoverage=34%, E-value=5e-57, Identity=58%"; Hit description =Putative prolylcarboxypeptidase isoform 1
  Pfam annotation: Domain name=Peptidase_S28; Domain location=58-294; Score=-126.8; E_value=3.2e-07; Accession=PF05577.2; Description =Serine carboxypeptidase S28
  Subcellular localization annotation: CTP_CleavageSite=42; ConfidenceScore=5.24e-01
MATSFQFIICFCLFSLLRFTVTFAHVIPRFPSSMLHPALDLGSSSAQNGLYTTKFFTQILGHFSYNPQSYQTFQQRYLINDTYWGGAKNNAPIFVYMGNEGDIEWIAQITGFMFDTAPYFKALLVFIEHRYYGKSFPFGGNEEVANANSSTLGYLSSTQALADYATLIIDLKKNLSATDSPVIVIGGSYGGMLAAWFRLKYPHVAIGALSSSAPILQFLDLVSPYTWTNIFTQDFKGVEEYFRNYSCYSSKRRSSSCGPKVLNYGRSKMAKGYKETRDKNHSKNWTSQYYQDLY

SEQ ID NO: 121432 - protein, 396 aa, Glycine max
  Coding DNA Sequence Number=SeqID_4654
  Gene Ontology: Mol. function=serine-type peptidase activity; Cellular component=lysosome; Biological process=proteolysis
  Homolog annotation: Hit_ID=Q67WZ5; Match level="QueryCoverage=90%, HitCoverage=70%, E-value=1e-104, Identity=51%"; Hit description =Putative prolylcarboxypeptidase isoform 1
  Pfam annotation: Domain name=Peptidase_S28; Domain location=60-393; Score=83.8; E_value=5.2e-22; Accession=PF05577.2; Description=Serine carboxypeptidase S28
  Subcellular localization annotation: CTP_CleavageSite=38; ConfidenceScore=5.62e-01
MAIGFQFIIITLFSLFSAPSLTFAFVPILPRFPSSAVSAELKQRSHSSQNGLYRTKFFTQILDHFNFNPQSNHTFQQRYLINDTFWGGAKNNAPIFVYTGNEGNIEWFTQNTGFMFENAPSFQALLVFIEHRFYGKSIPFGGNKTVAYANTSTLGYLSSTQALADYATLIIDLKKNLSATDSPVVVFGGSYGGMLAAWFRMKYPHVAIGALASSAPILHFMGLVSPDIFNNIITQDFRSESENCYKVIKGSWDLIDDTANKPGGMELLRKTFRICKSDDFGPGSLEGWLRAAWIYTAMTDYPTPSNFLNPLPAYPVKKMCEAIDSSVTGNNRLAKLHAAASVYYNYTGKARCFDLDDNSDPHDLGGWQWQIVSASFSITQPDIINLELPGSCIVQH

SEQ ID NO: 121433 - protein, 521 aa, Glycine max
  Coding DNA Sequence Number=SeqID_4655
MSVSWRYSNLIPILIHGLYTLRTIFSIGMDKLHTIKIETRSRAQTPASSAVAVKARLKDVSNALMTSKELLRIINRMWGHEDRPSSSMSLISALHTELERARLQVNQLIQEQRSDQNEINYLMKCFAEEKAAWKKKEEEIVEAAIESVAGELDVERKLRRRLESLNKKLGRELADTKTSLLKVVKELESEKRAREIIEQVCDELARDADEDKSDIEKQKRVSTKVCEEVEKEKEIMQLTDRLREERAQKKLSEAKYQLEEKNAAVDKLRNQLEAFLGGKQVREKSRSSTHLSDEEIAAYLSRSRLGSHLIEDKEDDRGEVDNGVECEEESAESDLHSIELNMDNNNKSYKWTYPPESRFDTRRYPIEEEVKGSRRSTSGKASRKSTSLQRSISDGMEWGVQADKIQNSGDGIDWESFYELEKQAQGKGYADEMQGYKSVKGLRDQILAGSRLASSRGYASPTRQFSQPWPSRDLANNFQERPATAQGNGLKSRLGEARGEGQNVRKSKRSIPVCFCYHDGW

SEQ ID NO: 121434 - protein, 50 aa, Glycine max
  Coding DNA Sequence Number=SeqID_4656
MTILAHIPFHGKNGVANVTTLVVEHDVVDRQLESQELGYIVIVVENGVNA

SEQ ID NO: 121435 - protein, 160 aa, Glycine max
  Coding DNA Sequence Number=SeqID_4657
MGRQGTRTHGPGNSFSGSEFLLGPDAGAGRRNLVHLPERCGELPGGDRSLAGLVTGLRRRVFGGGQCPERRSRAHELPRGHGRTGSAPLSDENSPLEAVVVEHGGGGGGRGGTASFSDLPRNHVHGGWVWVLAQHEYEKEEKEKGNVLAKIGWSGIIGTP

SEQ ID NO: 121436 - protein, 58 aa, Glycine max
  Coding DNA Sequence Number=SeqID_4658
MATSTSALNKRSLTPLVTRGPVGHRHMKLVRPTLSRIEPDISDLWLEGKVALITGGAS

SEQ ID NO: 121437 - protein, 388 aa, Glycine max
  Coding DNA Sequence Number=SeqID_4659
  Gene Ontology: Mol. function=oxidoreductase activity; Cellular component=membrane; Biological process=metabolic process
  Homolog annotation: Hit_ID=O50038; Match level="QueryCoverage=69%, HitCoverage=94%, E-value=2e-61, Identity=49%"; Hit description=Short chain alcohol dehydrogenase
  Pfam annotation: Domain name=Epimerase; Domain location=43-283; Score= -41.5; E_value=0.0019; Accession=PF01370.11; Description=NAD dependent epimerasedehydratase family
  Pfam annotation: Domain name=KR; Domain location=42-205; Score=-63.4; E_value=0.0011; Accession=PF08659.1; Description=KR domain
  Pfam annotation: Domain name=adh_short; Domain location=41-210; Score= 85.6; E_value=1.6e-22; Accession=PF00106.15; Description=short chain dehydrogenase
  Pfam module annotation: Pfam domain module=Epimerase::KR::adh_short; Domain location=43-283::42-205::41-210
MQLKAFPCYPIRLEETFKGALHTHFNDYEHLPFQACRLEGKVALITGGASGIGEATARLFLCHGAKVIIADIQDNLGHSLCQNLNSSDNNISYVHCDVTNDNDVQNAVNAAVSRHGKLDILFSNAGTVGRVSPSITAFDNADLKRVFEVNVFGAFYAAKHAAKVMIPEKRGSIVLTSSVASVTHAVSPHAYTASKHAVVGLMKNLCVELGNHGIRVNCVSPYAVATPLMTRGTRMKKEMVEKVYSEAGNLKGVVLKEEDLAEAALFLASDESKYVSGVNLVVDGGYSVTNVSVKEAVRKFSAEGLKGDKVGCASARRLIREIRKLMGIGKKDQIGAYFQRRNRCTYKLTDFACGLDGDFLMMELQPSFLSQLLISDALGVSTPGLVAV

SEQ ID NO: 121438 - protein, 128 aa, Glycine max
  Coding DNA Sequence Number=SeqID_4660
MVHLLKITKNYMLNLEKQQPPNGIGKPHCQNACFQGEVTHLEAVGLAVVGADDALMVDIGTQPSQVEEKKPRDIEMVVELVGSFESCYCYWKWKHHLSLDLGHSGGLLESSAIEESKNSPWDATKYEI

SEQ ID NO: 121439 - protein, 461 aa, Glycine max
  Coding DNA Sequence Number=SeqID_4661
  Gene Ontology: Mol. function=calcium ion binding
  Homolog annotation: Hit_ID=Q2QXG8; Match level="QueryCoverage=99%, HitCoverage=100%, E-value=1e-130, Identity=51%"; Hit description=TLD family protein, expressed
  Pfam annotation: Domain name=TLD; Domain location=281-425; Score =223.5; E_value=4.8e-64; Accession=PF07534.6; Description=TLD
MGNAQSPSNNDPRYVSATRAFTQKELEDLRSRFNNLANQSQSNGKYIPPSVFQSYFGFHGPLGERMFDLVTQERKDQKLTFEDLVVAKATYEKGTKDEIEEFIFRLLDVSGDNFVGRSDLETVMIAIFNDILRIKGSDDRSSSHEDIVNIFLNAANFSKQDGGGTEGTMSFEDFRSWCTHLPSVRKLLGSLLLPPDSGEVVDAMIRRINFMCLQKIMWDDKNAMELDTLGFQIWCTGRPGYQIPKLLTSKAIDSNIILLRKEYTWHIGGALSHQDLEDWNLLYHSSVNGLSFNTFLGNISNHAGPTVLIIKDKEGYIYGGYASQPWERHADFYGDLKCFLFQLNPVASIFRPTGANNNLQWCAINFSSEDIPNGIGFGGRVNHLGLFISANFDQGHTFSCTTFGSPCLSKTNRILPEVIECWGVTQDATQDKNDAVKGTILERFKEDRNMLKMVGLANSSE

SEQ ID NO: 121440 - protein, 146 aa, Glycine max
  Coding DNA Sequence Number=SeqID_4662
MTIPNQEPPKSHITKPNHESRTPKSHITTPNHKSILGYDGFEKGEVLEDVGSDRDWSWRWRREVGHISLQSLLALVMMRTRSQEEKCVTDTLPNIQIICFQLRLPTGANCTLVSGGGSHIQHLKKLEYLSSAVMLVIASGNNTFIH

SEQ ID NO: 121441 - protein, 103 aa, Glycine max
  Coding DNA Sequence Number=SeqID_4663
  Gene Ontology: Mol. function=RNA-directed DNA polymerase activity; Biological process=RNA-dependent DNA replication
MTVKANGDITSESEIDEEEEKEVEEELEEEAMQGDMLMVRRLLGSQMQPLDDTQRETIFHTRKSYQCCKYQVEACLTIGRYHDRVLCDMVPMEANHILLGRPW

SEQ ID NO: 121442 - protein, 185 aa, Glycine max
  Coding DNA Sequence Number=SeqID_4664
  Gene Ontology: Mol. function=transcription factor activity; Biological process=regulation of transcription, DNA-dependent
  Homolog annotation: Hit_ID=Q2T058; Match level="QueryCoverage=94%, HitCoverage=53%, E-value=7e-44, Identity=49%"; Hit description =Transcriptional regulator, LysR family, putative
  Pfam annotation: Domain name=LysR_substrate; Domain location=1-184; Score=26.0; E_value=1.5e-05; Accession=PF03466.10; Description=LysR substrate binding domain
MQRLAPGLSFQLRYSERKVALNDLLAGRIDFALGFTETDGESYPEIDEVSWLEDEYVAICSPAFSVKYGELTLENYLRARHLVVTPWNEQRGVIDYQLDKLGLQRDIAIRTPSLLGAPFIVADSELVMSMPRYAAQKLRQAAALAIHPLPFPVPPYQIKIYLHRKNGRPEACRWLRQQLQALAAL

SEQ ID NO: 121443 - protein, 181 aa, Glycine max
  Coding DNA Sequence Number=SeqID_4665
  Gene Ontology: Mol. function=small conjugating protein ligase activity; Cellular component=ubiquitin conjugating enzyme complex; Biological process=protein modification process
  Homolog annotation: Hit_ID=Q6PQ37; Match level="QueryCoverage=55%, HitCoverage=69%, E-value=1e-38, Identity=74%"; Hit description =Ubiquitin-conjugating enzyme family protein
MRKDVSMRLVLIEEASTDDRDRENMCDYGNTLPYYSKSLLCHFLFLGYSNINFCKHTAIPLFLRYFEFRYFDQIHNTPSSMTLGSSGSSVVVPRNFRLLEELEKGEKGIGDGTVSYGMDDGDDIYMRSWTGTIIGPYNTVHEGRIYQLKLFCDKDYPEKPPSVRFHSRINMTCVNHETGVV

SEQ ID NO: 121444 - protein, 357 aa, Glycine max
  Coding DNA Sequence Number=SeqID_4666
  Gene Ontology: Mol. function=transferase activity; Cellular component= nucleus; Biological process=regulation of transcription, DNA-dependent
  Homolog annotation: Hit_ID=Q0PY49; Match level="QueryCoverage=72%, HitCoverage=96%, E-value=6e-84, Identity=61%"; Hit description=CCR4 associated factor 1-related protein
  Pfam annotation: Domain name=CAF1; Domain location=11-249; Score =387.7; E_value=1.8e-113; Accession=PF04857.10; Description=CAF1 family ribonuclease
MAQSHGSILTRSVWSSNLESEFDLIRSVIDSFPLISMDTEFPGVVVRPDAGDPSFRHRQPVAHYAVLKANVDRLHLIQIGLTLSDNAGNLPTLGTSNAFIWEFNFKDFDVARDAHAHDSVELLRRQGIDFEKNRDFGIDSFRFAELMMSSGLVCDDAVSWVTFHSAYDFGYLVKLMTHRTLPEELREFLRLVRVFFGDRVFDVKHLMRFCSNLHGGLDRVCQSLKVERVIGKSHQAGSDSLLTLHAFQNIRENYFDKADGLVQYAGVFCKVSCIWLFPVKRYYIVEDHRLHEVSSLINGRWQKVQIPPYKHTMAAYGGAIADLLSQLSIAVGKKATMPFCHSGQWRHHLTTTLNKES

SEQ ID NO: 121445 - protein, 131 aa, Glycine max
  Coding DNA Sequence Number=SeqID_4667
MEIIESRIIDHESLMEFLKKGPEKSVIRIHGEAIRGEVLEHDTESEPDTKINKYDRTVEMVMVGNKGCMHDYEAEATLDQGYMEFDCAVTTTAAGHKLVSGGHYLQSHYGCAQVRYDVVLLAFCLRRMEEG

SEQ ID NO: 121446 - protein, 64 aa, Glycine max
  Coding DNA Sequence Number=SeqID_4668
ISIRPLNSKDTGDQREASALRDELDMLQEENEVLLEKLRQAEEKRQEVEARTRELEKQVVFFLE

SEQ ID NO: 121447 - protein, 183 aa, Glycine max
  Coding DNA Sequence Number=SeqID_4669
MGVDNNLLAKPRRRANFRLCNVSCYTSEVLEIQSDAPTLHVLFVPGNPGVILFYKDFVEFLYELLEGTASVTVMLTSHVSLWPNSYWPCFSLKKVLAAALSYLTASLGLLPVQALRFLVRKSLGKSWSANAVEAACSHLSQAPDWIFMRERKAQLAFLFGVDDHWGPLHLLEESVSASTGEHV

SEQ ID NO: 121448 - protein, 94 aa, Glycine max
  Coding DNA Sequence Number=SeqID_4670
MEILMKMKQKCTSARVREGTWCWRWEEATARSERGIDQSTKPDEEASEELQNINNFQISYTYMSEGYCSKRVTAFLLVIFVSLELSKEMMLRQI

SEQ ID NO: 121449 - protein, 497 aa, Glycine max
  Coding DNA Sequence Number=SeqID_4671
MYDRIEEDMLWDFGLDIVPKYIGEDMVLLLGLIEEKARRLMEVDEEGRDALFYSLERWNPTVRVRNRLTWVQAWGIPLMAWDAQHMKTIVAGIGDAVDVDDDVEELRKMDRARILIKTPWPALIQHTVTVHIQGEEFMVHIIEETGAYSNTCRCRRGIEYSSSEDILSEESELGASCMMGVSEEMAVQIGSSEEEMVRAIAIHKAPMEKTRARGDLLEMALAAQKGSPETKAVRSRELEMVTEEEAEIGSDEAELERLLSSECAKHHDQVDNTYDTERSTCILTTGGVNQTAETARGNAGGVVTVLPDLGEEIENGSTTAPLAVDIHKNGRVHAEETVEVLEPFLKQSEVARVKEGAEICGLGFTPHTPINPKVQLQQSFLKIQAEKTPIINVYSKKRWRKKQTEPKSPDRYLLKHVDQQGSPPNQDKKRGDNLYAKQQQKEDVYNTSVELKQHNNIDKEAERLWQLAQEMGIAYPKEQTSQVQRLVHMEERDIMET

SEQ ID NO: 121450 - protein, 340 aa, Glycine max
  Coding DNA Sequence Number=SeqID_4672
  Gene Ontology: Mol. function=DNA binding; Biological process=DNA integration
  Pfam annotation: Domain name=Transposase_23; Domain location=189-259; Score=8.5; E_value=0.00013; Accession=PF03017.5; Description =TNP1ENSPM transposase
MKAQAIQKQNTAPHVLSRGGYDYLEQKLLAEKTKKKLQEAAQSGSVDGVIDPPLPGEMTTEAAKEIAEKIDLFEEQATQGSFVPHGRQDVLAAAIGRPEHPGRVRAVGAGVTIKQYFGPAPRTSRSVSSLPPDELQQLTQQIRDQLEESITKKVTRQAPPEPLVGPGPSGPRVSTKGSCVGPSGNDPEMGDSDRCGLYIEADPARLVAMARVYEGSTLVHNTPLLPGQVKVSVDEVKDADAPVPVPTAEVSLVGQALHTFLAWPTHLIKSLSHQVVVSPPKPPPKPDPEVDDPLYLMTLTIPELFLRPYQVRWDATVFEVVNPNFHLYIKHEDLSEIAHG

SEQ ID NO: 121451 - protein, 40 aa, Glycine max
  Coding DNA Sequence Number=SeqID_4673
MEEARREALAAQQHWFRRSNKPSGNRLQDVVIDYRLPVLV

SEQ ID NO: 121452 - protein, 168 aa, Glycine max
  Coding DNA Sequence Number=SeqID_4674
  Homolog annotation: Hit_ID=Q8GXE9; Match level="QueryCoverage=19%, HitCoverage=12%, E-value=1e-08, Identity=72%"; Hit description=HVA22- like protein j
MKITSHHIITQRICSLRLLHLTITKSPNWLMATTVSDDETSLTGTPIPCLQLRVSLTLSNAVLRNQAQVYWILVKRQRKKDIVSRNRNCRKVSAEIVDSVGIGNVGGFHHSMSYTSYIFLDFRLILGYAYPGFECYKSVEQNRGDNGELRFWCQYWYGNPRFFGNNMS

SEQ ID NO: 121453 - protein, 266 aa, Glycine max
  Coding DNA Sequence Number=SeqID_4675
  Homolog annotation: Hit_ID=Q1SLH6; Match level="QueryCoverage=44%, HitCoverage=8%, E-value=5e-29, Identity=55%"; Hit description =Peptidase M41; AAA ATPase
MWVALTWRIWHHRNRLIFSNEEFHGPAILKLGFCVEVIYFCWLWLKNMERILKYLITYGPAILKLGFCVEGDKVFCGWDLSCSSSQCFVHSTAISRIYLEDKVLFEGEILLGKRIRVSHGLNKKLCYYVFLMVCMPWDDPQVIPANMTLEVSELFTRELTRYIEETEELAMNALRNNRHILDLIVRELLERSRITGLTNSPKCLKLFHRGLGMALYLTPPPIQEPFGLKEVEEKLKEMSPVMFEDFVKPFQINPDEVLSSLLLNVV

SEQ ID NO: 121454 - protein, 95 aa, Glycine max
  Coding DNA Sequence Number=SeqID_4676
MHEDCRGVSKAYQHKEFIKNEMHHWPIAEENEQFKFNQQLHYVPLPGVNIYGEEQDTSRVTDIVADHYAVMVPSALIKLQLLHLWEEMKSVTVTN

SEQ ID NO: 121455 - protein, 91 aa, Glycine max
  Coding DNA Sequence Number=SeqID_4677
MESELAWIKFMAEVEALGVQPLQKDRWVSRCPMCMLEEEDASHLFFKCDRIIPMWWECLSWLGVSIVLPQTPNKYFLRHSYCCLEGVVQNR

SEQ ID NO: 121456 - protein, 258 aa, Glycine max
  Coding DNA Sequence Number=SeqID_4678
  Gene Ontology: Mol. function=RNA-directed DNA polymerase activity; Biological process=RNA-dependent DNA replication
  Homolog annotation: Hit_ID=Q1T5K4; Match level="QueryCoverage=50%, HitCoverage=16%, E-value=4e-11, Identity=28%"; Hit description=RNA -directed DNA polymerase
KLYEGIKIGKDEVDISLLRINFAKSKFGAIGISHHWIENVTNYLSCKVLANPFLYLGIPIGANPRHNGLEEGGHQIGEAAAMDIAKFNCNFLGKWRWNLFHHKGELWARVLDSKYESWRREGGWFKGGIEWKIGCGTKIKLWEDGPRFPEKSLRAVILVEDELINEDGEITRKKTETGTEEDDNEAVDLILGVAWLATLGEVKVNWKSQTMKFVQQGQVVEVKGDPVFSEPKGLPPNKEVDHCIPMKAGIDPVTICPY

SEQ ID NO: 121457 - protein, 239 aa, Glycine max
  Coding DNA Sequence Number=SeqID_4679
  Homolog annotation: Hit_ID=Q10P18; Match level="QueryCoverage=33%, HitCoverage=30%, E-value=3e-12, Identity=47%"; Hit description =TB2/DP1, HVA22 family protein, expressed
GHCSTFHSTGEFYRCSYWMVGTGYVYNTVLRPYVSSHENDIEKKFREWRARAWDLAIFYWKNCTELGQATTFQILDYLAAQSKKFSSKSYSEKKDKLGPTPSAPPLSSLRETLFENNQNKFPGRKNKVESCEHVDPESVEHSTEKPGNGGEEVVVEEAEAGGGEAAEEVGSGGAALGGGHGLKVGPGGLLNEAVADGNFLAGVHGGGGGVHGGVGRREHVSEGSVGGGEGGHKGYKFEA

SEQ ID NO: 121458 - protein, 221 aa, Glycine max
  Coding DNA Sequence Number=SeqID_4680
  Gene Ontology: Mol. function=tyrosine decarboxylase activity; Cellular component=cytoplasm; Biological process=antibiotic biosynthetic process
  Homolog annotation: Hit_ID=Q9FNH8; Match level="QueryCoverage=99%, HitCoverage=98%, E-value=6e-86, Identity=75%"; Hit description =Lysine decarboxylase-like protein
  Pfam annotation: Domain name=Lysine_decarbox; Domain location=53-194; Score=219.0; E_value=1e-62; Accession=PF03641.4; Description=Lysine decarboxylase family
MEETNSRFKRICVFCGSSSGKKPTYQEAAVQLGRELVERRIDLVYGGGSVGLMGLVSQAVHDGGRHVLGVIPTSLMPREITGDPIGEVRAVSSMHQRKAEMARQADAFIALPGGYGTLEELLEVITWAQLGIHSKPVFRLNGSKVGLLNVDGFYNSLLSFIDKAVDEGFISPKARRIIVSAPTAKQLMLELEEHVPEQDEFASKLVWEERLNYVTESEVAM

SEQ ID NO: 121459 - protein, 67 aa, Glycine max
  Coding DNA Sequence Number=SeqID_4681
  Subcellular localization annotation: CTP_CleavageSite=45; ConfidenceScore=5.35e-01
MGVVNGSCNLHSNRKLQLQLPFRPAAGQLATTSGVFRATWRFSSKLATRSDSLLYYPCKGRRKEPPH

SEQ ID NO: 121460 - protein, 213 aa, Glycine max
  Coding DNA Sequence Number=SeqID_4682
ACSSTVYPGRGFVLNAEGLPWKLLWKDLTTLAQTWSVLSYSNLAPTSHTSDLNLDRAKLVYELVMKMNMNLGSLISGQISLIAQSNSSLLGFPALITALCKARGVTSNSLTFKSLSPTINLAYIKNNCWNLDDPSARLTGASSMGGKCAESPPTFIERETLENQRKPVIKNIPDSRVIFTLEEGISTSHVDKSGAFAPTYPPSKKKSDLRSSS

SEQ ID NO: 121461 - protein, 193 aa, Glycine max
  Coding DNA Sequence Number=SeqID_4683
  Gene Ontology: Mol. function=nucleoside-triphosphatase activity; Cellular component=integral to membrane; Biological process =proteolysis
  Homolog annotation: Hit_ID=Q1SLH6; Match level="QueryCoverage=69%, HitCoverage=13%, E-value=4e-64, Identity=87%"; Hit description =Peptidase M41; AAA ATPase
MAPPWPPFNNTALRSPLRCDPTLGVSASSTHPCGPTSPGHSKIFQQDIIDVLDKQLLEGMGVLLTEEEQQKCEQRLSFEKKRLLAVHEAGHVVLAHLFPRFDWHAFSQLLPGGKETAISVFYPREDMVDQGYTTFGYMMMQMVVAHGGRCAERIIFGDDITDGGSDDLEKITKRDFVAQIQKYMIDTSLPFRV

SEQ ID NO: 121462 - protein, 198 aa, Glycine max
  Coding DNA Sequence Number=SeqID_4684
  Gene Ontology: Mol. function=pepsin A activity; Cellular component =cellulose and pectin-containing cell wall; Biological process =proteolysis
  Homolog annotation: Hit_ID=Q6QJL5; Match level="QueryCoverage=71%, HitCoverage=40%, E-value=2e-35, Identity=47%"; Hit description =Aspartic protease
MKVHPKLSGGRDRNVNVFVQRRQHAFELSPRTECGVKTEIPPTPSVPSFNGSNPSTNNPAFKEYYYLTLRKVIVDGNGGTIVDTGSTFTFMERPDAEAQSGLSPCFDITGFKTVTFPELTFQFKGGAQMTQPLVNYFSLVRDSEVVCLTVVSNGGIGPAITSGPAIILGNYQQQNFYIEYDLENERFGFGPRSFKRKA

SEQ ID NO: 121463 - protein, 54 aa, Glycine max
  Coding DNA Sequence Number=SeqID_4685
MPTYGTRCHEDGNKIWDGLAFKMNLWVSGQWAAERDVHKSEKWRTMTGLLQWTN

SEQ ID NO: 121464 - protein, 115 aa, Glycine max
  Coding DNA Sequence Number=SeqID_4686
MGEKELWAVFKKWGDAREVFIARNRNRNGRRYGFVRLKGVENAETRETAGQSISGREQKLIKTIKSKPQSKEEAATTKVRDRDKDKGKGVANQSTTTGGQQHSIRNVTGSRTYAR

SEQ ID NO: 121465 - protein, 227 aa, Glycine max
  Coding DNA Sequence Number=SeqID_4687
  Gene Ontology: Biological process=protein transport
  Homolog annotation: Hit_ID=Q8S8Z8; Match level="QueryCoverage=86%, HitCoverage=97%, E-value=4e-78, Identity=72%"; Hit description =Syringolide-induced protein B13-1-9
  Pfam annotation: Domain name=Hin1; Domain location=60-203; Score =183.6; E_value=4.7e-52; Accession=PF07320.4; Description=Harpin -induced protein 1 (Hin1)
MADKQPHLNGAYYGPAIPPAEQPHYRPSRERSCCCCLFGILWKILVALIVLVGLAVLIFWLVVQPRSFKFHVTKANLTQFDYYTNNNTLHYNMVLNFTARNPNKKLSIYYDKVEALAFYEDVRFANYSVITHMNSFRQYKKTTSHMSAVFSGQQVLPLDNDLVSELNQDKSGGVYEIDVKLYFRIRFRLGDVKTRRFKPEVKCDIRVPLRTNGSVTLFQTTKCDVDY

SEQ ID NO: 121466 - protein, 95 aa, Glycine max
  Coding DNA Sequence Number=SeqID_4688
MDWPARPMVRAVLSNGGNGGAMAVLRGENLKKLHRIAVAWRFYNDGAMAVMVRGNAGQNAALDQERHPVRSSHRAPSSDDPTARTPDPVATRTDT

SEQ ID NO: 121467 - protein, 217 aa, Glycine max
  Coding DNA Sequence Number=SeqID_4689
  Gene Ontology: Mol. function=DNA binding; Biological process=DNA integration
  Homolog annotation: Hit_ID=Q1SAZ0; Match level="QueryCoverage=52%, HitCoverage=11%, E-value=4e-18, Identity=38%"; Hit description =Integrase, catalytic region
MGKMKVDSRPETNALAVEATTCKSSTIRKSSSNLCGSPAHLKGSKKFGPKSGPTAHEAKKTSLCKEQVDELIRLLKSSTLSSIPSGSMAQTEIKRLELQMVVFSAIAGEGSSMLSKHIDLKNVLHDQTSGKMIGSAKMMDGLYYFEDAFGNKVAQGLSGISSTSVRDQIMLWHSRLGHPSFQYLSCVLAKSHRTPYSSQSYVSKPFHLTHSDVWGPS

SEQ ID NO: 121468 - protein, 152 aa, Glycine max
  Coding DNA Sequence Number=SeqID_4690
  Gene Ontology: Mol. function=nucleoside-triphosphatase activity; Cellular component=integral to membrane; Biological process =proteolysis
  Homolog annotation: Hit_ID=Q1SLH6; Match level="QueryCoverage=65%, HitCoverage=10%, E-value=2e-41, Identity=84%"; Hit description =Peptidase M41; AAA ATPase
  Pfam annotation: Domain name=AAA; Domain location=24-144; Score=42.6; E_value=1.3e-09; Accession=PF00004.19; Description=ATPase family associated with various cellular activities (AAA)
MPDVLRKPHDQKLSWKHACGKWKGLCLYNIMTAVIARLSLFSSIIRKEKTGVDRVSLRQAIIFICATNRPDELDLEFVRAGRIDRRLYIGLPDAKQRVQIFGVHSSGKQLAEDVDFDELVFRTVGFSGADIRNLVNESAIMSGRPGILYLEI

SEQ ID NO: 121469 - protein, 145 aa, Glycine max
  Coding DNA Sequence Number=SeqID_4691
  Gene Ontology: Mol. function=transferase activity, transferring hexosyl groups; Biological process=carbohydrate biosynthetic process
  Homolog annotation: Hit_ID=Q10MP3; Match level="QueryCoverage=72%, HitCoverage=33%, E-value=4e-33, Identity=72%"; Hit description =Glycosyl transferase family 8 protein, putative, expressed
IRVHVYNPLDARFEKVSEVLSSVVEGLFEGLSDGGGDQVANDLWIETRKWKKMFSGHWECWRIEWTATMEPRRYSTSRVMAMWTREGSQTEVKTKEAHLPLAALRNGAVGQREAEEAVEMVGGADVGAMGTKPERREKTTERNPC

SEQ ID NO: 121470 - protein, 64 aa, Glycine max
  Coding DNA Sequence Number=SeqID_4692
  Gene Ontology: Mol. function=RNA-directed DNA polymerase activity; Cellular component=intracellular; Biological process=RNA-dependent DNA replication
MKPHQEETKIVNLGVDYQDIFAWSYHDMPSLNPDMVQHRLPLNPVARYPEWLANIVPVPKKDGK

SEQ ID NO: 121471 - protein, 311 aa, Glycine max
  Coding DNA Sequence Number=SeqID_4693
  Homolog annotation: Hit_ID=Q8S8Z8; Match level="QueryCoverage=74%, HitCoverage=88%, E-value=1e-68, Identity=79%"; Hit description =Syringolide-induced protein B13-1-9
  Pfam annotation: Domain name=Hin1; Domain location=62-202; Score =141.8; E_value=1.8e-39; Accession=PF07320.4; Description=Harpin -induced protein 1 (Hin1)
MADKQPHLNGAYYGPAIPPAEQPRYRPHSHRGRSCCCCLFGILWKILVALIVLVGLAVLIFWLVVQPRSFKFHVTEADLTQFDYYTNNNTLHYNMVLNFTARNPNKKLNIYYDKVEALAFYEDVRFASYDVITHMNSFRQYKKSSSPMSAVFTGQQLLMLNNDQVSEFNQDRNTGVYDIYVKLYFRMRNLEVTFDLGLQVTGYGVPEPEPNPEVELHIDVINPITLVLVQLRGLFIVEHQQFLSRENGAHGAGDLLVLAEGVHVGFRDVELEGTGLNHQPEYEDCEANGDDECNENLPQDSEEAAAAACSM

SEQ ID NO: 121472 - protein, 239 aa, Glycine max
  Coding DNA Sequence Number=SeqID_4694
MGSRFRLAVAERAQADLVEKLPLMSALQTQKRMLSCTITPRWKVHIGAVWCIEEKAFESASEVGCQCHVHCHVDRQKTSKVMGSLVENVTEAVAVAVACDASCCGIGAVLMQDHQPIAYFRKALSHGTLSKSVYEEEIMALALSGQHWKHYLLERSFEVYTGHKSLALATTTSHNNRPAMLVVQINEEVSNDPVLNRIKETLQLDPSSMHEYILREGLIFFKGDIDAFFQFSSDSHDAY

SEQ ID NO: 121473 - protein, 464 aa, Glycine max
  Coding DNA Sequence Number=SeqID_4695
  Gene Ontology: Mol. function=nucleic acid binding; Cellular component= chromatin; Biological process=DNA integration
MCTRAKSGIVKPRLNPTLLLAHAEPKNVKTALSNPTWKQAMQVEYDALLCNGTWSLVELPPSRSAIGCKWVFRVKGNPDGSINKYKAWLVAKGFHQQMEKDYNETFSPVIKPVTVRILLTLAVTNKSIKSLVTNLNSEFALKDLGDLDYFLGIEVNHRPNGSLMLTQSKYIRDLLSKTAMDEANSISSPMVGGCKLTKTGSEDFFDPTLYRFVVGALHYATITHPKISFSDNKVFQFMSQPTEQDWVAVKRIPGYLKGTLHFGLKLEPNFSTKHYSVHAFCDADWASDLDDRSSTSGAVVFLGPNLVSWSSTEAEYRSLALATAEVTWIQSLLTELKVPHAPPVIFCDNMSTVSLAQPSPTLSHQTYQAGFVLCQREGTVQRAEYRSLALATAEVTWIQSLLTELKVPHAPPVIFCDNMSTVSLAQPSSTLSHQTYRAGFVLCQREGSQQTVSSCPCSSSRPES

SEQ ID NO: 121474 - protein, 163 aa, Glycine max
  Coding DNA Sequence Number=SeqID_4696
  Gene Ontology: Mol. function=nucleic acid binding; Cellular component= mitochondrion; Biological process=DNA integration
MGKPTEQHWMEVKRILRYLRGSLNFGLNMQPNFSVSHYSIHAYCDADWASDPDDRRSSSSAAIFIGPNLVSWWSKKQSVVARSSTKAEYRSLALATAEVSWIQSLLVELKVPHAPPVIFCDNLSTASLAHNPVSHSRTQHIELDLFFVQEKVIGKHLQVVHVS

SEQ ID NO: 121475 - protein, 330 aa, Glycine max
  Coding DNA Sequence Number=SeqID_4697
  Gene Ontology: Mol. function=nucleoside-triphosphatase activity; Cellular component=integral to membrane; Biological process =proteolysis
  Homolog annotation: Hit_ID=Q1SLH6; Match level="QueryCoverage=64%, HitCoverage=21%, E-value=1e-101, Identity=83%"; Hit description =Peptidase M41; AAA ATPase
  Pfam annotation: Domain name=AAA; Domain location=214-325; Score= -24.8; E_value=0.016; Accession=PF00004.19; Description=ATPase family associated with various cellular activities (AAA)
MGTLSKALGRSALGALDGVFVVWKVCWRGWRPLENEAEFAVKVRIRILILISNTLQHMKVAAVVFTEDLKRLYVTMKEGFPLEFVVDIPLDPYMFEIITSSGVEVDLLQKRQIHYFMKVVIALVPGILILWLIRESVMLLHITNKRFLYKKYNQLYDMAHAENFIMPVGDVGETKSMYKEVVLGGDVWDLLDELMIYMGNPMQFYERDVQFVRGVLLSGPPGTGKTLFARTLAKESGLPFVFASGAEFTDSEKSGAARINEMFSIARRNDVLGPLSDLVKISGSEFCINYLLLHKVTTNFNFFRGRPIIIQIEGKTNASGIIVGTSASGT

SEQ ID NO: 121476 - protein, 885 aa, Glycine max
  Coding DNA Sequence Number=SeqID_4698
  Gene Ontology: Mol. function=protein serine/threonine kinase activity; Cellular component=integral to membrane; Biological process=protein amino acid phosphorylation
  Homolog annotation: Hit_ID=Q2HSI2; Match level="QueryCoverage=99%, HitCoverage=94%, E-value=0.0, Identity=56%"; Hit description=Protein kinase
  Pfam annotation: Domain name=APH; Domain location=541-721; Score= -14.6; E_value=0.063; Accession=PF01636.13; Description =Phosphotransferase enzyme family
  Pfam annotation: Domain name=LRRNT_2; Domain location=276-316; Score =24.9; E_value=0.00028; Accession=PF08263.3; Description=Leucine rich repeat N-terminal domain
  Pfam annotation: Domain name=LRR_1; Domain location=117-139; Score =4.6; E_value=40; Accession=PF00560.23; Description=Leucine Rich Repeat
  Pfam annotation: Domain name=LRR_1; Domain location=141-163; Score =14.8; E_value=0.32; Accession=PF00560.23; Description=Leucine Rich Repeat
  Pfam annotation: Domain name=LRR_1; Domain location=190-212; Score =13.8; E_value=0.63; Accession=PF00560.23; Description=Leucine Rich Repeat
  Pfam annotation: Domain name=LRR_1; Domain location=214-236; Score =16.3; E_value=0.11; Accession=PF00560.23; Description=Leucine Rich Repeat
  Pfam annotation: Domain name=LRR_1; Domain location=237-258; Score =8.5; E_value=7.4; Accession=PF00560.23; Description=Leucine Rich Repeat
  Pfam annotation: Domain name=LRR_1; Domain location=320-342; Score =4.0; E_value=51; Accession=PF00560.23; Description=Leucine Rich Repeat
  Pfam annotation: Domain name=LRR_1; Domain location=344-366; Score =9.9; E_value=4; Accession=PF00560.23; Description=Leucine Rich Repeat
  Pfam annotation: Domain name=LRR_1; Domain location=368-389; Score =11.1; E_value=2.4; Accession=PF00560.23; Description=Leucine Rich Repeat
  Pfam annotation: Domain name=LRR_1; Domain location=41-62; Score=8.2; E_value=8.2; Accession=PF00560.23; Description=Leucine Rich Repeat
  Pfam annotation: Domain name=LRR_1; Domain location=64-86; Score =13.3; E_value=0.89; Accession=PF00560.23; Description=Leucine Rich Repeat
  Pfam annotation: Domain name=LRR_1; Domain location=88-115; Score =5.9; E_value=22; Accession=PF00560.23; Description=Leucine Rich Repeat
  Pfam annotation: Domain name=Pkinase; Domain location=538-815; Score =157.5; E_value=3.4e-44; Accession=PF00069.15; Description=Protein kinase domain
  Pfam annotation: Domain name=Pkinase_Tyr; Domain location=538-815; Score=135.7; E_value=1.3e-37; Accession=PF07714.7; Description =Protein tyrosine kinase
  Pfam module annotation: Pfam domain module=APH::LRRNT_2::LRR_1::LRR _1::LRR_1::LRR_1::LRR_1::LRR_1::LRR_1::LRR_1::LRR_1::LRR_1::LRR _1::Pkinase::Pkinase_Tyr; Domain location=541-721::276-316::117 -139::141-163::190-212::...
  Pfam module annotation: Domain location=214-236::237-258::320 -342::344-366::368-389::41-62::64-86::88-115::538-815::538-815
  Subcellular localization annotation: CTP_CleavageSite=66; ConfidenceScore=5.04e-01
GDDPCGWKYIFCDSNKRVNQIQPKGLNLSGPLPQNLNQLTMLFNLGLQNNRLNGPLPSFRGLSKLKYAYLDNNNFDSIPSDFFDGLQSLEVLALDHNNLNASTGGWQLPETLQESTQLTNFSCMGCNLTGPIPQFLGSMNSLSFLKLSNNYLTGDIPRSLNDSALQVLWLNNQQGERLSGGIDVVASMVSLTSLWLHGNAFTGTIPENIGALSSLKELNLNGNNLVGLVPRGLGDMKLGKLDLNNNHFMGPIPDFKAATVSYDVNNFCVSKPGVPCAFEVMALLGFLGGLNYPLNLVDSWTGNDPCGGNWLGIKCNADGKVIMINLPNLNLSGSLSPSVANLGSLVEIRLGGNDISGVVPGNWTSLASLKSLDLSGNNIYPPLPDFKTGLKPVVVGNPLLNGGAKTTPSGNNNPSTGSGNVDPSGNTNSNSSSSDSHETKKSKRKQLVSIVAPIAGVAAAAFLLIPLYAYCFRRRNGGFQAPTSLVIHPRDPSDSDSAVKIAVANNTNGSISTLTGSGSGTGNLRISVQVLRKVTENFAPENELGRGGFGVVYKGELDDGTKIAVKRMEAGVISSKALDEFQSEIAVLSKVRHRHLVSLLGYSTEGNERILVYEYMPQGALSKHLFHWKSHDLEPLSWKRRLNIALDVARGMEYLHTLAHQSFIHRDLKPSNILLADDFKAKVSDFGLVKLAPEGEKASVVTRLAGTFGYLAPEYAVTGKITTKADVFSFGVVLMELLTGLMALDEDRPEESQYLAAWFWHIKSDKKKLMAAIDPALDVKEETFESVSIIAELAGHCTAREPSQRPDMGHAVNVLAPLVEKWKPFDDDTEEYSGIDYSLPLNQMVKGWQEAEGKDLSYMDLEDSKSSIPARPTGFADSFTSADGR

SEQ ID NO: 121477 - protein, 486 aa, Glycine max
  Coding DNA Sequence Number=SeqID_4699
  Gene Ontology: Mol. function=malate transporter activity; Biological process=response to aluminum ion
  Homolog annotation: Hit_ID=Q14UU8; Match level="QueryCoverage=87%, HitCoverage=87%, E-value=2e-91, Identity=42%"; Hit description =Putative aluminum activated malate transporter
  Pfam annotation: Domain name=UPF0005; Domain location=41-418; Score =507.5; E_value=1.5e-149; Accession=PF01027.11; Description =Uncharacterised protein family UPF0005
MDIESTTQANKGGFLSHLGNCLQDLPWNFKSKVINITRSITKIGKDDPRRVIHSLKVAVALTSVSLVYYSRPLYDGFGVAGMWAVLTVVVVFEFSVGATLSKGLNRGFATLLAGALGVGGQHLATAFGGRAEPIVLGILVFILAAGATFFRFFPKIKQRYDYGIVVFILTFCLVAVSGYRVEELFELAHQRLSTILLGAAACMVISIFICPVWAGEDFHKLVASNIEKLANYLQGFETEYFHCSEDTKKCEKSVLEGYKSVLNSKASEESLANLARWEPGHGRFRLRHPWEQYLKIGALTRECAYKIETINNYLNPEIQVSLEFKCKVQEPCTKMTSESNKALKAISSSIKKMTHPSTAKVHIENSKTAVEDLKVALEIVSLEDTDLLSIIPVATVASILEEITKSVEKIYESVSELSHLAHFKSVVEPNVSPEKPPLLHRGIIKPVVDIDNTVDHVEITIPEITTDSPEKEKAPTTKPSEHLICK

SEQ ID NO: 121478 - protein, 73 aa, Glycine max
  Coding DNA Sequence Number=SeqID_4700
MVTATTVVTTIMIIAIIVIIAATTIVVITTFIATVANNNGDYVGGDDDGHGYDHGDDGGCNDGDGCDDDFDVN

SEQ ID NO: 121479 - protein, 247 aa, Glycine max
  Coding DNA Sequence Number=SeqID_4701
  Homolog annotation: Hit_ID=Q1SLA3; Match level="QueryCoverage=45%, HitCoverage=13%, E-value=9e-15, Identity=34%"; Hit description=RNA -directed DNA polymerase
MGMKSYKASGSNDFQSIFNKNVLGDDVWKFMKETFETSMFNPLVAETLIMLILKFDVPKHFKDFRPISLFNFYSKERQIDNAIVLPEVVHSMSKSRKNALLDFGFPGRIVSFIMCRNLPHDGTTKAKLIEVKAHSSPRDKTSGSCHQRLFKENVRKTKRDYIQLLKKLTNSCTRDTKQENNVGNDHGCYSVVPRLRFSSFFLFFLSFSFFSQLLNPQTPPPTWLFIGKNHFGAGEARPDKLELTQAS

SEQ ID NO: 121480 - protein, 59 aa, Glycine max
  Coding DNA Sequence Number=SeqID_4702
MEEIYLEVHENPRAFFSSSSPILLESSIQYPWEDPLPLEKDLTSNLEVLDTLDFFPQHL

SEQ ID NO: 121481 - protein, 94 aa, Glycine max
  Coding DNA Sequence Number=SeqID_4703
MGWHSPKDDEEWWGEWGSMKNVTVMTGKNMSLSHPPRDQKCQTETGLWGEPNSRPLHGKTNEEGTQGPNGISQPLLQREANIGVRLEALLCCVC

SEQ ID NO: 121482 - protein, 93 aa, Glycine max
  Coding DNA Sequence Number=SeqID_4704
MKVLVTNTSTPYHRGGMMNASGHVYAMRDKCVYLRTQELGRPSLLTNNALGIMVHLQSLPWCPMHAIKKHPTSPSQGTTAFDQGVALAPMYPQ

SEQ ID NO: 121483 - protein, 67 aa, Glycine max
  Coding DNA Sequence Number=SeqID_4705
MDFVGESVMVEWAFSVGWAPDWEEIRQWPSNCTGVGDIAAVTAWASPSFFLAPPILVLLLPTLVEAA

SEQ ID NO: 121484 - protein, 769 aa, Glycine max
  Coding DNA Sequence Number=SeqID_4706
  Gene Ontology: Mol. function=nucleic acid binding; Cellular component= beta-galactosidase complex; Biological process=DNA integration
  Pfam annotation: Domain name=rve; Domain location=484-683; Score= -10.7; E_value=0.046; Accession=PF00665.16; Description=Integrase core domain
MLGREDDKRKSGEGAGKETTGVSPYYMHPPDNPGKLITPIQLKGDNYEEWARAIRNALRAKKKLAFVDRTITETKDDSTDIEDWWMVNSMLVAWILNTIEPSLRSTITYMESVRNLWEDFQQRFSIGNGARVYQLKTDLAGCKQMGQTVVVYYVKVKVMWDELISYEPTPTCKCGGCKCNIAKELEKKREEEKVHQFLMRLDDAIYGTICSNILSMDPLPNLSRAYAIIVQEERHINIARSKEERGDAVGFVMQVGTEVKAVVVRTKEKGTTCNHYRKTGHDAKDYFQVIGYPDWWEDKPRSTRKSVGCGWGNSYVGRGRGVIKLLSEVRNIMLCPVGLPDGKQTNVVKEGIMHLGENIYLRNVLYVPNMNCTLIYVAKLMRDLSCTVTFTNKLCVMHDQALRTLIGLGEECDGVFLFQTTIPVHANKAKTMNVSKLWHERLGHPSKRILTYLPEANGGDPIDFCDICYKAKQTRDMFQESQNKAYKSFSLIHCDLWGPYKVPASCGASYFLTIFNDFSRVVWVYLLLEKREVAQTVKKFRAMIERQFEKQVKDPTNNKELESHLIDCAFFDDPNENQRDKESEEWITNVTARGRLGSYEHEREEQGCGIEVTISEENSDGSGQEKGVAEQEERLGRGQRQHKPSVLLQDYVTYTAWCPKGSTHTQTPSESKPSGKTPYPIANYVTCAKFSPRYRSFLTAITMGHEPTSFSVAVKDKRWREAMKKELEALESNITWTLETLPPGKKAIGCKWAYKIKYHSDGSIECYKA

SEQ ID NO: 121485 - protein, 237 aa, Glycine max
  Coding DNA Sequence Number=SeqID_4707
  Gene Ontology: Mol. function=phospholipase C activity; Cellular component=cytoplasm; Biological process=intracellular signaling cascade
  Homolog annotation: Hit_ID=Q84K11; Match level="QueryCoverage=75%, HitCoverage=27%, E-value=2e-50, Identity=58%"; Hit description=Type 5 protein serine/threonine phosphatase 62 kDa isoform
  Pfam annotation: Domain name=PPP5; Domain location=142-237; Score= -14.0; E_value=0.0027; Accession=PF08321.2; Description=PPP5
  Pfam annotation: Domain name=TPR_1; Domain location=11-44; Score =28.5; E_value=2.4e-05; Accession=PF00515.18; Description =Tetratricopeptide repeat
  Pfam annotation: Domain name=TPR_1; Domain location=45-78; Score =34.3; E_value=4.3e-07; Accession=PF00515.18; Description =Tetratricopeptide repeat
  Pfam annotation: Domain name=TPR_2; Domain location=11-44; Score =23.0; E_value=0.001; Accession=PF07719.7; Description=Tetratricopepti de repeat
  Pfam annotation: Domain name=TPR_2; Domain location=45-78; Score =27.2; E_value=5.7e-05; Accession=PF07719.7; Description =Tetratricopeptide repeat
  Pfam module annotation: Pfam domain module=PPP5::TPR_1::TPR_1::TPR _2::TPR_2; Domain location=142-237::11-44::45-78::11-44::45-78
METEKSNVSKAEEFKLLANEVFNARKYSQAIDLYTQAIELNSQNAVYFSNRAFAHLRLEEYGSAIQDATKAIEIDPKYSKARRCSSWTGEIQGSTERFSAASRTNIFHPEDLNTANRATYLTADQRAEVKKMCPNDPDATKKLKECEKAVMKLKFEEAIAAPESERRSIAESIDFRTIGPQFFGVNRSGHSSSDSSSYGSSGDVVQDIKDHNSSCNCGWFAVAPWGLLVEWPQYWYI

SEQ ID NO: 121486 - protein, 288 aa, Glycine max
  Coding DNA Sequence Number=SeqID_4708
MRKTATRTWDKVEALVIDEISVVDSKLFDGLEFVARKLKDLSSVGETEKSTVGEKSTVGEKSTVDKKLKSEPKSVNEKRLKSLQKECFVYRAIDSGDDCWKKQFEHGVTPDVVTICEGARNIQNSRIDYSCPLKANIESSILQKRSCTTPASNEIIEVRRKEWLSSSQWLKCSLRTRRMMIPRRSEDTWGLLLARRETTTMGSELDKVVGGDCMGAKNGGDGGGGGRGCDGGGMAGGGGMIVVAISVGDGVGLSGRGGGGGNDRVSGGVHGRGSNGAGLGGMGAEHED

SEQ ID NO: 121487 - protein, 205 aa, Glycine max
  Coding DNA Sequence Number=SeqID_4709
  Gene Ontology: Mol. function=nucleic acid binding; Cellular component= oxygen evolving complex; Biological process=DNA integration
  Homolog annotation: Hit_ID=Q1S0A6; Match level="QueryCoverage=93%, HitCoverage=18%, E-value=1e-59, Identity=47%"; Hit description=Zinc finger, CCHC-type; Peptidase aspartic, catalytic; Polynucleotidyl transferase, Ribonuclease H fold
MATVRTLLAVAAAKQWELHQMDVHNAFLHGDLDEEVFMQLPPRFSTTDKSKPHSDYSLFTYADSGMQLSVLVYVDDLVIASNDSRAVTQLKKYLNMCFYMKDLGTLKYFLGIEVAHGLEGIFLCQRKYALDIVTEVDLLGAKPAVSLMEQNHRLTHPQEDHWEAALRVVHYLKGNPGQGILLRADSDLHLTTYCDSDWASCPLTR

SEQ ID NO: 121488 - protein, 107 aa, Glycine max
  Coding DNA Sequence Number=SeqID_4710
MSMTRQAVCRSYPPGQCRPCGRHYDWSNQTSSRQQGYPQKESDQCFETLDSNQMFPHQRILDENSVEDDKDGGIGVGDAPVALGRDVLCAAAEVDKPLRFLDDSTIW

SEQ ID NO: 121489 - protein, 32 aa, Glycine max
  Coding DNA Sequence Number=SeqID_4711
MVAVEDDGKIACQALWKECERKGSTGGKLGQK

SEQ ID NO: 121490 - protein, 296 aa, Glycine max
  Coding DNA Sequence Number=SeqID_4712
  Gene Ontology: Mol. function=ubiquitin-protein ligase activity; Cellular component=ubiquitin ligase complex; Biological process =protein ubiquitination
  Homolog annotation: Hit_ID=Q3HLY8; Match level="QueryCoverage=97%, HitCoverage=74%, E-value=4e-53, Identity=38%"; Hit description=U-box protein
  Pfam annotation: Domain name=U-box; Domain location=5-81; Score=75.4; E_value=1.8e-19; Accession=PF04564.6; Description=U-box domain
MDEIEVPKYFICPISLQIMKDPVTTITGITYDRDSIEHWLFTNKSTTCPITRQPLPKHSDLTPNHTLLRLIQFWCTQNCIHRVPTPKPPLNKLQVLKLLKDIKDPNLQLKTIKELKLLATRNERNNINKCLLLQAGVPKAMILFMLTCFRKSQFDKALEEALSLLQLVDVPEEEIKLLLAEKNDQILDSLTRVLGSDEMENSIAVKSHALMLLNTFMQEASSSVMESGTNQQDTKAAFHAMLIACHWGRNRIMMVESGAVFELIEIELLTPEKRTTELTMEILFRLCSCAEVSLLC

SEQ ID NO: 121491 - protein, 739 aa, Glycine max
  Coding DNA Sequence Number=SeqID_4713
  Gene Ontology: Mol. function=hydrolase activity
  Homolog annotation: Hit_ID=Q9SK32; Match level="QueryCoverage=61%, HitCoverage=88%, E-value=1e-133, Identity=54%"; Hit description =Expressed protein
  Pfam annotation: Domain name=DUF1723; Domain location=78-127; Score =90.0; E_value=7.1e-24; Accession=PF08330.1; Description=Protein of unknown function (DUF1723)
MEVRAVDPYTTNPGPIDGSVLYDQDKHVSTAVWDGQERGALRCHEHTSKLDQWTLTHKQIELVDNAGFGYLRSIPAISLDNPLISALVERWRRETNTFHLNVGEMTVTLKDVALLLGLAIDGEPVIGITYTACGSVCEKYLGRSPESGYTSGGMVKLSWLKEYFSRCPEDAPIEVIEQHTRAYLLYLVGSTIFSTTTGNKVPVMYLPLFENFDRCGQYAWGAAALAFLYRALGNASLKTQSTISGCLTLLQCWSYFHLNIGRPKLNLELMHDRFPFVLRWKGKQSGPTANRDVVFYRKALDSLKPCDVEWLPYRNMDSMVIPEHIKSTLILGRSKTMLICFDKAERHLPNRCLRQYGMLQSIPDDVERWERKSRGVDGGVDLSGKMESELNDWMDRQVSIVDGDEGVDESEYMEWYLRITRKFIGRPISLSSEFQRTNAGLRDIAHIADTFSTKGLDPQQIESISRIRYIAHECLRDQFGGPVMASGSTQVELGKRVRGKERVRRKGGTGKRLRKDGVVQYNAVSEDEQAQYYGTAIEVGQLHLSHIERELNHAQLCTVDNEVSVVQLIHANADGENMQLCDPHIEVDESDLGYAAGEENNEDPDDVAAEFSHEELKHRAGEEIKQELNHLTGEENIEELNAANEIHFVQPSELCDVSHDIDSTLADAAAEVNHSQLGDSSVINPQQSSPTDNLVNSQLSHINPESELPSAKGAMEVSQHSSIETREDISQNGDCTVAV

SEQ ID NO: 121492 - protein, 132 aa, Glycine max
  Coding DNA Sequence Number=SeqID_4714
  Subcellular localization annotation: CTP_CleavageSite=35; ConfidenceScore=5.20e-01
MGLTWATPKPKGSPFVNSTPTLFACCCPQTNYKAVLSAKSSDDDGGSRIVFSSIHSMQISCHLLPVPLLYHLSLPGGGPKFVWDSSTSSLAVEWKGKGREGKVQGGVVVLVWFRRLKWDGRKMKVLKFWTSS

SEQ ID NO: 121493 - protein, 229 aa, Glycine max
  Coding DNA Sequence Number=SeqID_4715
  Homolog annotation: Hit_ID=Q6F3B5; Match level="QueryCoverage=81%, HitCoverage=14%, E-value=2e-53, Identity=54%"; Hit description =Expressed protein
MMMMDPPMTPLGQMLLEEITPVVMLLSTPSVEQVSLKNGLSFLQTLTPFCSFNNIDVPVRTASDQPYRLHKFKLRLFYASDVRKPDLKVAKEQVKQVITEAGEKEFSESCSDVSEINHELSSSSEYQHTPSWFRFLNKELVRVASFSDHEAFDHPVICLVAVSSKDEQPISRFVDLCNANKLPSLLNDGAMDPKISKHYLLVHDNQDGPADRIQMSFWQGFRLHVALSV

SEQ ID NO: 121494 - protein, 540 aa, Glycine max
  Coding DNA Sequence Number=SeqID_4716
  Gene Ontology: Mol. function=protein binding; Cellular component=cis -Golgi network; Biological process=ER to Golgi vesicle-mediated transport
  Homolog annotation: Hit_ID=Q6F3B5; Match level="QueryCoverage=83%, HitCoverage=41%, E-value=1e-138, Identity=48%"; Hit description =Expressed protein
MAFVVDFLDIRSTFGASDCSLLCINSSLDAPIKHQDNPWASYITDASPTHSQDFGCFLNIDDINEVSATRKGFKNQIKNLWWRKGKEDGADSLNGPTYDFNSIESQIRVLGDYAFMLRDYELALSNYRLISTDYKIDKAWKRYAGVQEMMGLTYFILDQSRKEAEYCMENAFNTYLDILHSAVMLEQASYCYLLSKPSMLHKYGFHLVLSGEQYKKCDQIKHAIRTYRSALSVFRGTTWSYINDHVHFHIGQWYASLGMYDVAVKHMMEILACSHQSKTTQELFLGDFLQIVEKTGRTFEVTKLQLPVINISSLKIIFEDYRTFGTSSAANTREGLWHSLEEEMLPSFSSAKTNWLELQSKLISKKHSQSNVCVAGEAVNVNIEFKNPLQISIPISGVTLVCKYSASTGDIRSDENESSVEKDNEVDHFRNMSSDNSSFMVSEVDFLLGGGETTMLKTNTTPNSSAGKEHLCPFLANSQLQAIIPHSHSTIVVLGLGCSMPLSGIYNYATNLLSAVSQMLESHLNCSLKEVCLVQHRLEI

SEQ ID NO: 121495 - protein, 89 aa, Glycine max
  Coding DNA Sequence Number=SeqID_4717
MKMFVDPKNANTATLTEVAETLQYMVSPQGRNTWTVDDFVPYVDKIIILSEEQERIIECVSHGPAPEHEFAPQEFHILPSSVETQGIGR

SEQ ID NO: 121496 - protein, 103 aa, Glycine max
  Coding DNA Sequence Number=SeqID_4718
MYRDINETRLPCIDNKRKNENEKLSKKTEWGCDKSIYGGWIKEVGIRGIIVEHEFPSCLSEVSISHASPAELMGVYAGEKRMRGGVSEVRGRGNRISEGKVVE

SEQ ID NO: 121497 - protein, 76 aa, Glycine max
  Coding DNA Sequence Number=SeqID_4719
MAHQMHMMMEIGYMAIIALLGMSEESRALICQEFIRKLQTWYLHYVDLFYTEEGLFVNSDPIAPMRSGCPFLTWVM

SEQ ID NO: 121498 - protein, 108 aa, Glycine max
  Coding DNA Sequence Number=SeqID_4720
  Homolog annotation: Hit_ID=Q2R4C3; Match level="QueryCoverage=39%, HitCoverage=6%, E-value=6e-08, Identity=60%"; Hit description=Gpi16 subunit, GPI transamidase component family protein, expressed
MALPRNPTFPLSLLLLLVFLLSATSAQQQQEEEFTEELLMKPLPDRKVLAHFHFQSEAPLAADESSFARHHHLFPKSISQLINSDVREDFRIDSEFKQLELGVACTLD

SEQ ID NO: 121499 - protein, 212 aa, Glycine max
  Coding DNA Sequence Number=SeqID_4721
  Gene Ontology: Mol. function=transporter activity; Cellular component= mitochondrial inner membrane; Biological process=transport
  Homolog annotation: Hit_ID=Q8LCT8; Match level="QueryCoverage=45%, HitCoverage=23%, E-value=1e-37, Identity=79%"; Hit description =Putative carrier protein
  Pfam annotation: Domain name=Mito_carr; Domain location=5-75; Score =21.2; E_value=4.1e-05; Accession=PF00153.17; Description =Mitochondrial carrier protein
  Pfam annotation: Domain name=Mito_carr; Domain location=79-182; Score= 20.1; E_value=5.1e-05; Accession=PF00153.17; Description =Mitochondrial carrier protein
  Pfam module annotation: Pfam domain module=Mito_carr::Mito_carr; Domain location=5-75::79-182
MALLTLHRNLVFSHKLRRMRTRIKLDHMAIAVIGKEEGIQGYWKGNLPQVIRVVPYSAVQLFAYEIYKKIFRGENGRLSVAGRLAAGAFAGMTSTFITYPLDVLRLRLAVEPGYWTMSELSFRHLSLHLHAILWTQRRQMQLKGTPYKTVLDALSAAVIKSPYWCFEFILLYTLFGTVETRFWKDTRTDYRGTEKTCDMFLPSVWSTLKSEE

SEQ ID NO: 121500 - protein, 90 aa, Glycine max
  Coding DNA Sequence Number=SeqID_4722
  Homolog annotation: Hit_ID=O23661; Match level="QueryCoverage=56%, HitCoverage=8%, E-value=3e-13, Identity=70%"; Hit description=Auxin response factor 3
MLYMDWALYRTYRLDVACPFYLESKCSRIVADGEEEDTGAMVKSTTPHMFYKTLRASDTSTHGGFSLPHRAAEDCFPSLISMNYDALIFV

SEQ ID NO: 121501 - protein, 250 aa, Glycine max
  Coding DNA Sequence Number=SeqID_4723
  Gene Ontology: Mol. function=two-component sensor activity; Biological process=two-component signal transduction system (phosphorelay)
  Homolog annotation: Hit_ID=Q8W419; Match level="QueryCoverage=42%, HitCoverage=78%, E-value=1e-22, Identity=44%"; Hit description=Twin LOV protein 1
  Pfam annotation: Domain name=PAS_3; Domain location=135-228; Score =5.1; E_value=0.031; Accession=PF08447.1; Description=PAS fold
MDKWQRRSPQTRSPQCGCSHGSASQFDTKTISGRRRKKKNDRVQIDAKKCYYNSPDLLSTFKSKSCKCGDMLAKPISPRSCDVLNGFVKSSATFVITDDRKLVPDSTRSSNSSNVSSLPSNSFTITDPSIPGHPIVFANPSFLKLTGYSLREVLGWPAAIFSGPLTSQKFVIEIHEIVREEGNAQVILLNYHIDDMPFWMLFCVSPVFSSDGGAVVHFVVVQVPLQKKEGSGVRDFGFGFGPIRALCCST

SEQ ID NO: 121502 - protein, 73 aa, Glycine max
  Coding DNA Sequence Number=SeqID_4724
MNEENEEEPGVHQHVDCSNAFNTSQARSVAYDIGFVAGIMRSDTNTSIRGMTSFVLFDGERSGQYKDKKKDLV

SEQ ID NO: 121503 - protein, 59 aa, Glycine max
  Coding DNA Sequence Number=SeqID_4725
MEKMVEERREFPKEEFSGFGGLEPAYLRFARLARVPVSTLSARCALSTGGALSAPLDWA

SEQ ID NO: 121504 - protein, 87 aa, Glycine max
  Coding DNA Sequence Number=SeqID_4726
MKTHILLIVPISCYGRGGQLEVRRIGGWYKGQEMAKLVNGCSMVHLADTKQNYILQCTFQCQQAAQGCYILNLDLAKKLGERFYNSL

SEQ ID NO: 121505 - protein, 60 aa, Glycine max
  Coding DNA Sequence Number=SeqID_4727
MGFAEVEGWAPPNACKLEVVGGGRVGEGDICTSITIESSFQTSKVQPWMDVKEMMIFQES

SEQ ID NO: 121506 - protein, 62 aa, Glycine max
  Coding DNA Sequence Number=SeqID_4728
MVSNDDVSSQFPQFSTQIGLDEIVIDEIGRSLTKRKSQVAFAVKEDTHLISSWLNILTDPIV

SEQ ID NO: 121507 - protein, 40 aa, Glycine max
  Coding DNA Sequence Number=SeqID_4729
MESKSERGCREEKSLLLDYVRETSLRGLSLGLLILRSNFK

SEQ ID NO: 121508 - protein, 75 aa, Glycine max
  Coding DNA Sequence Number=SeqID_4730
  Gene Ontology: Mol. function=ATP binding; Cellular component =mitochondrion
  Homolog annotation: Hit_ID=Q2PMM5; Match level="QueryCoverage=100%, HitCoverage=4%, E-value=6e-29, Identity=71%"; Hit description =Protein ycf2
SILRELKKHYLVERFYTSALSQGIFLDKDSVFSFFRMVYSYLKEVDNKFFQNGLFVPLLEVSRNVCDRVNSSTNE

SEQ ID NO: 121509 - protein, 44 aa, Glycine max
  Coding DNA Sequence Number=SeqID_4731
MARPHCSCSLYHLLLALAVAFSQSLSCCHSHSLTLALSLTHSQK

SEQ ID NO: 121510 - protein, 199 aa, Glycine max
  Coding DNA Sequence Number=SeqID_4732
  Gene Ontology: Mol. function=nucleic acid binding; Cellular component= mitochondrion; Biological process=DNA integration
  Homolog annotation: Hit_ID=Q1SRN1; Match level="QueryCoverage=85%, HitCoverage=12%, E-value=2e-33, Identity=48%"; Hit description =Integrase, catalytic region
MPFTKFEPHKDNPFLVFRNPYNLRDPRPLSLPPGCIPIGCKLVFRVKENPKSTVNRHRPHLVAKGFNQQFGSDYTETFSPVSKPVTVRLILTLANTHGWPLKQLDFNNAFLNEILEEKVYMTSLLALNLMTTTVVQFCQASAICLFIYSKGTATAYVLVYVDDIVHTGSNSAVCTLADPSLSVQHCLFPQRSWQPRLLS

SEQ ID NO: 121511 - protein, 208 aa, Glycine max
  Coding DNA Sequence Number=SeqID_4733
  Gene Ontology: Mol. function=nucleic acid binding; Cellular component= mitochondrion; Biological process=DNA integration
MFSRYNYQLLPGQRVLLKFLVLGGNCLSIPKLQGSIHPLPGKAYAGDLRQLVLELRNPSDFPVKRELWLGYQNIGLKNEHEKLEVALREPSAYKEVKLHVLGAGMQNWIVSKKYGVSAQIVTIDLRCGVLHYKFGQQCLHPRDFSSGMSQALIFNLSAGSGNDSLLFGPPGYEVRVKKHTGPRGRMSVIWVRCPISITEDSEGQRNTH

SEQ ID NO: 121512 - protein, 467 aa, Glycine max
  Coding DNA Sequence Number=SeqID_4734
  Homolog annotation: Hit_ID=Q6F3B5; Match level="QueryCoverage=99%, HitCoverage=35%, E-value=2e-87, Identity=38%"; Hit description =Expressed protein
MKISHPRFLIIGKQENRKSEFPACLRKRTDAVLSDVYANPNIMSDTVFLFPEGTSVQGEAPFLWPLWFRAAVPGDISLYMSIYYEMGDASSVIKYRTLRLHYNLQVLPSLDVSFQISPSRLRLQEFLVQLDVVNKTSSESFQVYQLSSVGHRWEISLLQAPDTIFPSQSLKAGQAISCFFTLKLAEFIVCPQNSSRFSTLEDNISTLPVRSDVRLVPQSSEDLVYDINSAPLFNFHHYERLQQKVTYEGDLNTVDFVLISRPFKSNDDPGFSNPPHVMSHHACHFSTASTGPISWLVDGPQTLHHDFSASFCEISLKMHIYNSSGSTVFVRIDTLDSAGNGGHMNSVNVVQSATSDNRAGWHDITPVNELKVTSNVLGTQPGKALSLESVPSYIWSGSSSTNLHIDAMSSAEIPLQICVFSPGTYDLSNYVLNWKHPSNGQGDSDETKQHSGKCQGYKYYLTVLQST

SEQ ID NO: 121513 - protein, 184 aa, Glycine max
  Coding DNA Sequence Number=SeqID_4735
  Gene Ontology: Mol. function=protein transporter activity; Cellular component=membrane; Biological process=intracellular protein transport
  Homolog annotation: Hit_ID=Q9ZSD5; Match level="QueryCoverage=95%, HitCoverage=60%, E-value=4e-47, Identity=51%"; Hit description =Syntaxin-related protein Nt-syr1
  Pfam annotation: Domain name=Syntaxin; Domain location=29-136; Score =39.6; E_value=1.1e-08; Accession=PF00804.15; Description=Syntaxin
MNDLLSGLFSKGKQEEHVIEITEGGGIMELEKFLEEVESVKEDLKELERLHLSLDATNQNGKALHSPKGVRELRSRMDLDVALSLTKAKHVKGRLAALHRANQATLSLPDCGPGSYSDRTRTALVGALTKNLRQSMASFNKLREQISYEYRDTVQRRYYAVTGENPDQETIDLLISTVFEKFYG

SEQ ID NO: 121514 - protein, 369 aa, Glycine max
  Coding DNA Sequence Number=SeqID_4736
  Gene Ontology: Mol. function=transcription factor activity; Cellular component=nucleus; Biological process=regulation of transcription, DNA-dependent
  Homolog annotation: Hit_ID=Q9M9X4; Match level="QueryCoverage=61%, HitCoverage=70%, E-value=2e-37, Identity=46%"; Hit description =Nuclear transcription factor Y subunit A-2
  Pfam annotation: Domain name=CBFB_NFYA; Domain location=164-220; Score=130.3; E_value=5.4e-36; Accession=PF02045.6; Description=CCAAT- binding transcription factor (CBF-BNF-YA) subunit B
MQTVYLKEHEGNAHNFVGTLSSAASAPWWSAFGSQSVHQGESCGQVKPFSLELPNCIDQLAATKPLARGADQVLGKGHITQFTIFPDVSSSDDCKMSDDAQKLQTTMSLQSSLTDPQSRFEIGFSLPTICAKYPYTDQFYGLFSAYAPQISGRIMLPLNMTSDDEPIYVNAKQYHGIIRRRQSRAKAVLDHKLTKRRKPYMHESRHLHAMRRPRGCGGRFLNTKNSVDGNGKIGNEVHKTVGEQLQSSGSQSSEFLQSEVGTFNSSKETNGSSPNISGSEVTSMYSRGGLDSFSLNHLGSAVHSFADMIDGGRGMIIPTKWVAAAGWACCSIAPGPSSMRPDEEASFQLRVLTVTSFARQLILGLMYLQ

SEQ ID NO: 121515 - protein, 116 aa, Glycine max
  Coding DNA Sequence Number=SeqID_4737
  Gene Ontology: Mol. function=protein transporter activity; Cellular component=membrane; Biological process=intracellular protein transport
  Homolog annotation: Hit_ID=Q9ZSD5; Match level="QueryCoverage=83%, HitCoverage=32%, E-value=9e-33, Identity=69%"; Hit description =Syntaxin-related protein Nt-syr1
  Pfam annotation: Domain name=SNARE; Domain location=27-89; Score =77.6; E_value=4e-20; Accession=PF05739.9; Description=SNARE domain
ESETFLQKAIQQQGRASVMDTIQEIRERHGTMKEIERSLHELHQVFMDMAVLIQHQGEHLDDIESHVELANSFVSKGVQHLQVVRNHQKNTRNFTCFAVLLFIIVLVIILPIVFRN

SEQ ID NO: 121516 - protein, 72 aa, Glycine max
  Coding DNA Sequence Number=SeqID_4738
MYGPPCYEELWLDAIEMSDLAHVGQGWGRVYPVWSLRVAHVDLMGWSILARLGNLDALSTVSSRSKCSNGII

SEQ ID NO: 121517 - protein, 70 aa, Glycine max
  Coding DNA Sequence Number=SeqID_4739
MGAKYLEVVKRGSHPNNGWFPDEIRRKGESGRASVSKSRLKREISALSAAGAFSQAKRETGAKPNSPYSR

SEQ ID NO: 121518 - protein, 144 aa, Glycine max
  Coding DNA Sequence Number=SeqID_4740
  Gene Ontology: Mol. function=transcription factor activity; Biological process=regulation of transcription, DNA-dependent
  Homolog annotation: Hit_ID=Q3KK21; Match level="QueryCoverage=96%, HitCoverage=45%, E-value=1e-35, Identity=54%"; Hit description =Transcriptional Regulator, LysR family
  Pfam annotation: Domain name=HTH_1; Domain location=7-66; Score=68.7; E_value=1.9e-17; Accession=PF00126.17; Description=Bacterial regulatory helix-turn-helix protein, lysR family
MPQKIDFNLIYALNLLLEEGSVSGAAEKMNLSAPAMSRILGRIRRQFDDPIMVRAGKHLVPTPRALELKRQLGEIIEQAAALIAPNESFEPGKLTRTFTIRANDIFIGALAGGLLETLRDMAPLSGLKFIAESDGEDDALRSGK

SEQ ID NO: 121519 - protein, 236 aa, Glycine max
  Coding DNA Sequence Number=SeqID_4741
  Gene Ontology: Mol. function=tetracycline:hydrogen antiporter activity; Cellular component=integral to membrane; Biological process=tetracycline transport
  Homolog annotation: Hit_ID=Q4KKE4; Match level="QueryCoverage=95%, HitCoverage=43%, E-value=1e-42, Identity=42%"; Hit description =Multidrug efflux MFS transporter, putative
MARQRRRNQRPNLAGVVRRVFGGDGQRRGGKRQQVRAGGYTGRHAAELRCRQLADHLLCHRLCDRFRVHALFLADLFAAPGGVDDVRHLPGRWTADALVGRTVWRAAGGAQPAGLRRRRVAADADDGGVAFYAAADQGAGAGRLWLGLRLERHAGRHCRRLCLSLGLERLLLLEPAADGDRRRVHRLRPAAGSVAAGAPAAVQLARPAARRHGARHADDGHLTGGAPRLAELTADL

SEQ ID NO: 121520 - protein, 78 aa, Glycine max
  Coding DNA Sequence Number=SeqID_4742
SQRHRSDEHALIPDLAPDGAVPNHAGIVEFVVDDRGAGNAGEGCEVGRVGYCVGLAVTLSSAGLRHKVFFRINRRLKF

SEQ ID NO: 121521 - protein, 69 aa, Glycine max
  Coding DNA Sequence Number=SeqID_4743
MSAQATWLSKLFVGSKSQAKMKSKRVIFEEFQSVTGSAMHNHKPGEAVQEPEEEQRARREKRDKVELER

SEQ ID NO: 121522 - protein, 371 aa, Glycine max
  Coding DNA Sequence Number=SeqID_4744
  Gene Ontology: Mol. function=sequence-specific DNA binding; Cellular component=nucleus; Biological process=regulation of transcription, DNA-dependent
  Homolog annotation: Hit_ID=Q7XJK8; Match level="QueryCoverage=48%, HitCoverage=68%, E-value=2e-11, Identity=25%"; Hit description=MADS -box transcription factor PHERES2
MVEDLTTLCDIDACAFILGPGDDVPNVWPSHDKAKEMLDKFENAPLSTRLKKNITPQVYIERANNKVENQLVELRKKNDEIDMSDLMHQIHDDGRSLSDFDASDISRLLSYVEEKLKGVRVKTGFSEQQLPPKPPTPQVSCPLQNDKIDSWDNIDEQVLQQQSFIDDLKEDGKINSGFDNNLGSNIGLPPPNTHVGDVDFEPFNQGYVDMMLPPENFGGLANESGLGFGVLPRDYFIGSNGNNDSELLYGSYYSEIGGNDIWSSYGNFGGKIVGSDDVMLPFNNNSQGNINETCLGIGQHDENQGGSINNVGLWNHQITLGASNDGVALERSNPNFVGTTSGENLNLGFPSHANLASSGERSDIELQEFSP

SEQ ID NO: 121523 - protein, 101 aa, Glycine max
  Coding DNA Sequence Number=SeqID_4745
MDDVTGLIIGPLFVLAEACFLAGGLRELARNIELRVGKGGMILPLAIGAVVEGLPTTSQTPLSGHFCPVEAVKYPKCRVIPLGAYPSDALTPFSARIAAIA

SEQ ID NO: 121524 - protein, 86 aa, Glycine max
  Coding DNA Sequence Number=SeqID_4746
  Subcellular localization annotation: CTP_CleavageSite=67; ConfidenceScore=5.47e-01
MTLWVSSSSPQTFIVFVGATTLPCMTPSLLKMGQGSGGSGLRVQHECSRWRRREEVSDAIRVAKRVREKTKGYCVREENLKFLPIR

SEQ ID NO: 121525 - protein, 85 aa, Glycine max
  Coding DNA Sequence Number=SeqID_4747
  Subcellular localization annotation: CTP_CleavageSite=26; ConfidenceScore=5.28e-01
MALPPCVTFIATDFGVSKEPSFGVLVAAGGASGYLALLAPTVVGCPCTSSFTSSFFFLNKGINVFLHFSLKATCLQRKKCCTWDP

SEQ ID NO: 121526 - protein, 47 aa, Glycine max
  Coding DNA Sequence Number=SeqID_4748
MCLTHVSSYVLLSSTSRILDQDKSLRTMCLTHTSSYVLLSSTSQRLG

SEQ ID NO: 121527 - protein, 757 aa, Glycine max
  Coding DNA Sequence Number=SeqID_4749
  Gene Ontology: Cellular component=mitochondrion
  Homolog annotation: Hit_ID=Q10G00; Match level="QueryCoverage=90%, HitCoverage=96%, E-value=1e-165, Identity=46%"; Hit description =Expressed protein
  Subcellular localization annotation: CTP_CleavageSite=45; ConfidenceScore=5.05e-01
PPTLSLSLSSYNKSLTNGIFSFSLHAAAHALIDQVTSLAFFVVPRSELRDSDSEKTSNGGEDDEVAAMAASPLEEVPSEAARAEAPGLRSAAERCTSVARNFTKEAEFDVDGGGAAVVHWDEEFPTLCNLNGYKDNVFHPWEIAFTLFNGLNQRPKNKVPAIGTALLNIAEFASSTDQNDFDLNIPLTLTGGSGELSPLLCISISLTEVSVAQESVEPIQRSIVPGPSPSAKSGETALVEKDELSAIKAGIRKVMILTEFVSSKKSKKGCREEEGSEGRCSRSEDGEYNYPLDSESIDDSEEGETDEGKEDSSIRKSFSYGTLASANAGGFFHSNMRVNCNDEDWVYYSHRKSDVGCSRMEDSTTSSSDPYLQSSKRSILPWRKRKLSFRSPKAYKGEPLLKKSYAEEGGDDIDFDRRQLSSDESLSLTWYKTEDDLSAHRSSISEFGDGSFAVGSWEQKEVMSRDGHMKLQTQVFFASIDQRSERAAGESACTALVAVIADWFQNNRDLMPIKSQFDSLIREGSSEWRNLCENDAYRERFPDKHFDLETVIQAKIRPLTVAPGKSFIGFFHPEGMDEGRFDFLYGAMSFDNIWDEISRAGQECPSNGCNQAYILKFDSNTMMYKMPNVAHSSDNKTSNDQQTVAEILDPNNSQTQQVNSKEVDSVAGEEEQLRSETEEVICRGKEACKEYIKSFLAAIPIRELEADAKKGLISSASLYHRLLQIEFHYTQLLGETSMAEPETLALAITEASTITKL

SEQ ID NO: 121528 - protein, 151 aa, Glycine max
  Coding DNA Sequence Number=SeqID_4750
MDITSAFAGQVADLEGLKELHFDQNRTSDQRSGVFDPMKKLQQDVVGEYRYATKRDYLGNVMSMQVFMLEGCFLMARTSWMKPCTSVMEDVTLDEDSYLADIVGNNIFDDPFEELQLDAIMTLEIEFEECERGVAEGEEAFKDGVNGVQEG

SEQ ID NO: 121529 - protein, 93 aa, Glycine max
  Coding DNA Sequence Number=SeqID_4751
  Pfam annotation: Domain name=zf-CCHC; Domain location=65-82; Score =22.9; E_value=0.00017; Accession=PF00098.13; Description=Zinc knuckle
MPPKEHLDELNFVLIELGDIDVKMKDEDLAMILLAFLPLSYENYKKKKKKKKGKDGKKRKIDSKEICNYCKELGHWKQDCPKKAKKNYVVALV

SEQ ID NO: 121530 - protein, 253 aa, Glycine max
  Coding DNA Sequence Number=SeqID_4752
MGVVALMCPTQDSLFKGFQKELLCAEFKIPCSTLLFDDEVSHVKKENKDEVPMEECKTLILSSNLNDEINSYCTFICASNHAKSFVLMPKEELYIKDQWERQFGEEVDVNEDQGNHWEKKILHHLISRSNVLIEIQPVLILDLHDTCDMLNAYDLHDIVLGDGAKSLSFEINAHYLELCDLEESSSMCFLVLVFDLGGWIGKDDFNSRSNSFKEGGDDEDQLRSTDLEEEHGFDGPIIIACAKQMVNKGQSKM

SEQ ID NO: 121531 - protein, 153 aa, Glycine max
  Coding DNA Sequence Number=SeqID_4753
MPSRKYMPDENEPTNENPMKNSQRDHSTLKDVNPRAKICPDAHHPNLKMLHTSLTTSYSAFYSQTYTILGPTLPLSLSDLHGLTQHMDDNGEDMSHGGIGHDALTSHGYNSSLVRNAKCGFVPTVCHPPSLEQGDRDPPTSKNLSPQQWRKRR

SEQ ID NO: 121532 - protein, 90 aa, Glycine max
  Coding DNA Sequence Number=SeqID_4754
MKTNQNIRDIGNFVQRELGKDEDFKEKEGFFPKAANDVLTEKDQAPKKVEVPTNENLVPKKERDKKKEILTSPLIWRLMRMCWIKWPQNN

SEQ ID NO: 121533 - protein, 221 aa, Glycine max
  Coding DNA Sequence Number=SeqID_4755
ILSFLSVRVVVWVRGCSTLGIMIGSLRVVRTLKPRLSFLFACLYPFVDVHESEIVVRKWMMDRDTLGCSGRRGSKNLGELGSGDYLAFGSLIQHGGQCTIYPYVEIALDYHPRDFVRPSRPRRIGGNDWSQWSGGLTLATTNFKGRSWSINRGCLDGSDTTIEVYKDVGDFNDNEDLTSSEIAFYREVIDEEILEGKMLSYDEECNSSGDESDPFEDMTSP

SEQ ID NO: 121534 - protein, 109 aa, Glycine max
  Coding DNA Sequence Number=SeqID_4756
MYMHSAPLFVWCQRHPTLYKNRHSIVTIYSDRGKFKETSEKRKLPRRCELARNQMENACGVTFAGANISVAIGNVEEGGLPDLDGTTTQLMSVLEARDNNVIGSDGTKL

SEQ ID NO: 121535 - protein, 105 aa, Glycine max
  Coding DNA Sequence Number=SeqID_4757
MEEDKLLQVFGDKRETFGWNIHDMKGLDPTLCIHKINTKDGSLPKHEITIITLEWGLNRSITVLALSLEMTIVSHLEARQGGTLCWEREVIKEQTIACAPYLCRK

SEQ ID NO: 121536 - protein, 125 aa, Glycine max
  Coding DNA Sequence Number=SeqID_4758
MAQKLILNNTQKVVYNRLTLRLGDERVVFNLSNTLKQSSSFASCSFIESVDIDDAPMEGAFLGVGMLDPLKRVLIDEYLDWELNPEVEEILMFLHSQHGPGPPSYERLEWGNVPKLKPLIEKPPD

SEQ ID NO: 121537 - protein, 67 aa, Glycine max
  Coding DNA Sequence Number=SeqID_4759
  Subcellular localization annotation: CTP_CleavageSite=42; ConfidenceScore=5.15e-01
MHDLSGRLVIDSTSKFVRLPRSVRMMPQTKFFPPPSLCVLCRATAILSFHCRHSDCLHHHCVVFAIK

SEQ ID NO: 121538 - protein, 512 aa, Glycine max
  Coding DNA Sequence Number=SeqID_4760
  Homolog annotation: Hit_ID=Q658I5; Match level="QueryCoverage=94%, HitCoverage=86%, E-value=1e-151, Identity=60%"; Hit description =LMBR1 integral membrane family protein-like
  Pfam annotation: Domain name=LMBR1; Domain location=11-512; Score =383.5; E_value=3.3e-112; Accession=PF04791.6; Description=LMBR1-like membrane protein
  Pfam annotation: Domain name=MFS_1; Domain location=8-507; Score= -53.8; E_value=0.092; Accession=PF07690.6; Description=Major Facilitator Superfamily
  Pfam module annotation: Pfam domain module=LMBR1::MFS_1; Domain location=11-512::8-507
MGDFNLALVIVAVVVCVIVFLVNVYLLVNYQHPDDANQAYFPKFVVVLGLSVAAISILMLPADVANRQACRHAIYNGACSLTLPMKDLWLAVYILDAVLVFFVIPFAMFFYEGDQDKYEECGKEDQECFVVDGHHGYSVRPRSGACGGKLELEREWGLSHFQGVIGLFFVAMVVIMGSEILGVFATFVNIGWKWGSDAYQSFVLYKGNIFAVAHTPFFPTLSSNQCSAFSASPSSEKTWTMRTTFPEYVVALATIVGSVLFAIFGGVGIACLPLGLIFSFIRRPKAVITRSQYIKEATELGKKARELKKAAEALHQEERSGSKGRKFRKNVKEVEKELFQLEEDVKLLEEVYPQGEKAETTWALTVLGYLAKFVLGILGLIVSVAWVAHIIIYLLIDPPLSPFLNEVFIKLDDVWGLLGTAAFAFFCFYLLLAVIAGAMMLGLRLVFITIHPMKWGATLMNSFLFNVGLILLCSISVIQFCSTAFAYYAQATAAQEIFGHTLESLRGIKYLY

SEQ ID NO: 121539 - protein, 162 aa, Glycine max
  Coding DNA Sequence Number=SeqID_4761
MQNHEIHLGKSYSLEDYQREPELRTYYQKEAERGFNLDNLLMQFKDTIESIQRAFKSTEIQVGKLVEEVTQAVGRREEEFVEVEAQEESPVNKHDLKEEDEEKVQQREQCSQVHTQQENNLQVKTFPHQLIVKEERHEDHEVPIILGQPCLSTASCVLDMGK

SEQ ID NO: 121540 - protein, 94 aa, Glycine max
  Coding DNA Sequence Number=SeqID_4762
  Gene Ontology: Mol. function=protein dimerization activity
  Homolog annotation: Hit_ID=Q1SYN6; Match level="QueryCoverage=68%, HitCoverage=9%, E-value=4e-14, Identity=55%"; Hit description=Zinc finger, BED-type predicted
MKTFKDCVAKVGGINTKMGLRLDVVTRWNSTFFMLEIALLHQCAFISLEFEDRGYLNCPTNEEWDRGKENESVEIEKDSEAKSNMESNVVIGNA

SEQ ID NO: 121541 - protein, 149 aa, Glycine max
  Coding DNA Sequence Number=SeqID_4763
MACDQTKRLLSTNMDESHKLVKSMKSVNIGKKGLEKWNFDAENNRLTKLDVVSEGMLNQRIERLEWERIIARQEIIHEGNGEEQLRLLKDIQSQLQIIQSKTRSLKTIKATPKDDVSLASLQEAKYEMVYLPSPLTGEKLCPFHECLFL

SEQ ID NO: 121542 - protein, 176 aa, Glycine max
  Coding DNA Sequence Number=SeqID_4764
  Subcellular localization annotation: CTP_CleavageSite=9; ConfidenceScore=5.03e-01
MLSLSRPPNCARNSPPPIGDQPGSPKVFPTRKISMQQGQTDILIARFPNPNYGVKTLPHGFLVASLEDSFLSLLIDSTQASRKKMKGQIRVFVPYRNRKPSWKIPLQLKGSSLCGFSMENNDGLWWLMVAVGDGESAWNFRNGFGRKKEEEMTFFLSYTKGKAEVLKYECSRERKL

SEQ ID NO: 121543 - protein, 94 aa, Glycine max
  Coding DNA Sequence Number=SeqID_4765
MSPPTNFVFDGHRFHSEEHQRRFELIKDWSFLKETRVQLEEYDYHEFTEESTTWNWRQLEEPMPKYELEIVLKFYANAWPTEEGVPDKHSKEGG

SEQ ID NO: 121544 - protein, 173 aa, Glycine max
  Coding DNA Sequence Number=SeqID_4766
  Pfam annotation: Domain name=Toxin_2; Domain location=136-165; Score =16.7; E_value=0.044; Accession=PF00451.10; Description=Scorpion short toxin
MRTREGTSLVDQFKWRVHPLGYSKRTREGTSLVDLWLVKDFTRLKEISRTAGCLGTRCRHGHLIQHKSECPDIDKIDHKKRLKLKTTKLHLENEEICKEISNLLEYLEKLKNQVEGLQNEYTTLNKLHDCLNKERCNLSKECSQVHKNYQNLEAPGKKVKGKCACCFGSKFVL

SEQ ID NO: 121545 - protein, 463 aa, Glycine max
  Coding DNA Sequence Number=SeqID_4767
  Gene Ontology: Mol. function=ubiquitin thiolesterase activity; Cellular component=transcription factor TFIID complex; Biological process=ubiquitin-dependent protein catabolic process
  Homolog annotation: Hit_ID=Q9C585; Match level="QueryCoverage=87%, HitCoverage=44%, E-value=1e-101, Identity=48%"; Hit description =Ubiquitin-specific protease-like protein
  Pfam annotation: Domain name=UCH; Domain location=109-405; Score =62.3; E_value=1.6e-15; Accession=PF00443.19; Description=Ubiquitin carboxyl-terminal hydrolase
MTLTVISTDGNTSPSAITVTVLESGTLKDLIGALSASCSLRDDETLLVAEIYRNKIFRVFEDPSDLLVEIRDQDKLVAYRMQKCNEPSPLVVFLHEHLAENFGKERLENRLFGIPLVTRWSSISCGYDDVEREFLKLINPFLMRTEGVLDEYDKNDGVKKRVSEHDELGDATNSAAIVNDADSNSGTEDDIHSSTDFEFYLQGLERAKIIVNKPLPQVTMSSGRLPAVVVLWSDKMLKMYDTYLLDSLPEVFKPQLFAKRMQESVSIYKCLEAFLKEEPLGPEDMWYCPNCKNPQQASKKLDLWRLPEILVVHLKRFSFSRYFKNKLETFVDFPINDLDLSTYVAHGNNQSSNRYVLYAISCHYGGLGGGHYTAFVRYGYDKWYDFDDSRVESISEDMIKTPAAYQHGMLEAFQTFCLYMQLSDFLKIAALSGYQLGFTETSEEKCKEFKIVQLLEATGKKRG

SEQ ID NO: 121546 - protein, 164 aa, Glycine max
  Coding DNA Sequence Number=SeqID_4768
MAKIWSNMEPIHRQHEGTTRTTRPSPVPTEHKQSITSSDPYDKAPKLTLPATIFNMDPSKENPTPQTLWSNEVQIWTLHTRFIPSYPAYLRPSRKDLDMIGGILKLIYISYQATAYPLGLHISRCIDIKTVPNRVCLRLPIYDERKKSFKLYFNEDTHSKKQKI

SEQ ID NO: 121547 - protein, 145 aa, Glycine max
  Coding DNA Sequence Number=SeqID_4769
MMLGPRGITQCGMKPTELAIQVLRPTKVCHFDDANACFVKNLKDDFLKHLFWLPTIFCHHVFDICKMTMEKLEASVQHLHRLQQAKRPTMKQLGKSCLKKKPTLINFAPPEVVIKAEVKEKIGLAMDSFIEKQKAKNDEFRCVTP

SEQ ID NO: 121548 - protein, 617 aa, Glycine max
  Coding DNA Sequence Number=SeqID_4770
  Homolog annotation: Hit_ID=Q2R2E6; Match level="QueryCoverage=52%, HitCoverage=59%, E-value=3e-89, Identity=49%"; Hit description =Expressed protein
MVKKGNIVQYRERLDNTLALPDLTNEQTLKTLVKSQLQRSSEVEIEGCNEKEVETKTTELCNFLDMLRSASGDNGGGSGSTSHTDWKLKQDNEEFRVMYREGPEGTPIHTLLVEGYVDGPLDLSLCLSWETPLYKKWWPQFTIPSFKILVSDRLQRVQIGEQISLVRMKVPWPLATREAIVHYYLFEYYQDDLVVILLNTVHESKIDDLNKDAIPEAKDVVRIDLVGGYAMQKVTSERSYFRIIANLDLKLDFVPPTLLNFISRQLIGSGFRLYQKAVTSMMGNDKDKDFSKALEDSLYVRIREALLSTRKSKAMDGEELKQDASIVPTEELVQSEDGAKDVSCDDSSNQCANNYNGETLDAGSEEIVQIDEDVNKVLGVPIEEGDSLSVLMEKENGEIVDADNEEIVETVSEEIVETEKDVNKVHGIPVEEDDTKSVLKDRMNVYIRSDVRNAIETIERVISVVRKCGFHPLGSTLNSAGEEFPCMEKGGTVDSDSAKVIEVCLKNEDSAKVSSSNVVEENLEEPGTIQSFRHTGTNPNLKEVNYKKIVPASPEQNLSIPIETSQADSYSLKNGTILDQTICDNKQLNSDAVQDMTSYDLKKSTREMKYRYCCFMH

SEQ ID NO: 121549 - protein, 573 aa, Glycine max
  Coding DNA Sequence Number=SeqID_4771
  Gene Ontology: Mol. function=protein serine/threonine kinase activity; Cellular component=cytoplasm; Biological process=protein amino acid phosphorylation
  Homolog annotation: Hit_ID=P93838; Match level="QueryCoverage=99%, HitCoverage=97%, E-value=0.0, Identity=64%"; Hit description=Calcium- dependent calmodulin-independent protein kinase CDPK
  Pfam annotation: Domain name=Pkinase; Domain location=124-382; Score =374.8; E_value=1.3e-109; Accession=PF00069.15; Description=Protein kinase domain
  Pfam annotation: Domain name=Pkinase_Tyr; Domain location=124-377; Score=-29.3; E_value=1.1e-10; Accession=PF07714.7; Description =Protein tyrosine kinase
  Pfam annotation: Domain name=efhand; Domain location=429-457; Score =34.1; E_value=4.8e-07; Accession=PF00036.22; Description=EF hand
  Pfam annotation: Domain name=efhand; Domain location=465-493; Score =27.2; E_value=5.6e-05; Accession=PF00036.22; Description=EF hand
  Pfam annotation: Domain name=efhand; Domain location=501-529; Score =27.6; E_value=4.3e-05; Accession=PF00036.22; Description=EF hand
  Pfam annotation: Domain name=efhand; Domain location=535-563; Score =39.4; E_value=1.3e-08; Accession=PF00036.22; Description=EF hand
  Pfam module annotation: Pfam domain module=Pkinase::Pkinase _Tyr::efhand::efhand::efhand::efhand; Domain location=124-382::124 -377::429-457::465-493::501-529::535-563
MGNNCVGSKTSNDALFPYVLPGSFWWLHQTSVTEISDAPSLVTKIQDTNFLENVQENPPQVVKINHEEMKLKPTVPKHDKETNMPSEEQTRHMQKMPHKVKRLPIGLQAESILKRKNGNFKEYYNLGQELGKGQYGTTFLCTEKATGKNYACKSIPKVKLVMDDDVEDVRREIEIMHHLKGCPNVISIKGAYEDGVAVYVVMELCEGGELFDRIVEKGHYTERKAAKLARTIVSVIEGCHSLGVMHRDLKPENFLFVDGNEESTLKAIDFGLSVFFKPGEVFKDVVGSPYYIAPEVLRRHYGPEADVWSAGVIIYILLCGTPPFWGESEQEIFEEVLHGDLDFSSDPWFDISESAKDLVKKMLVRDPRKRITTHEVLRHPWIQVDGVAPDKPLDSAVLSRLKQFSVTNKLKKMALRVIAENLSEEEIYELKVMFKMIDTDNSGQITLEKLKAGLKMLGANLSEPEILDLMQAADVDNSGTIDYGEFIAATLHLNKVDREDHLVAAFSFFDRSGSGYITQDELQEACEEFGIENVCLEEMIQEADRNNDGRIDYNEFVAMMQRGNADLSKNGLK

SEQ ID NO: 121550 - protein, 201 aa, Glycine max
  Coding DNA Sequence Number=SeqID_4772
  Homolog annotation: Hit_ID=Q1T132; Match level="QueryCoverage=34%, HitCoverage=10%, E-value=1e-08, Identity=40%"; Hit description=IMP dehydrogenase/GMP reductase
MPLSRDGIVRPSPSSFHLPVGEMTIILNDVSRLLNPFIIECFIDRTNMSYTMANIRGSRCRDVIRQQSGSELVKEPIPHLCCNESNEWASKAYLLHFFYNTIFAQKSSTHVFEHLLTILASEKVLKYDWEKPLAARWLPLRGTDKVARANTLLDRLEMTDVVWSPYASHRELKSFNDQTLYSSYLSVGIYMWSYLSERVLR

SEQ ID NO: 121551 - protein, 68 aa, Glycine max
  Coding DNA Sequence Number=SeqID_4773
  Homolog annotation: Hit_ID=Q9LYH3; Match level="QueryCoverage=86%, HitCoverage=8%, E-value=5e-10, Identity=55%"; Hit description =Putative receptor-like kinase
MEEDSREAKRRTEQEAQRRNDANMKARIEAEEKDRAFSTLAYNDNRFRKYTILEIEATIEKFYQLQNW

SEQ ID NO: 121552 - protein, 35 aa, Glycine max
  Coding DNA Sequence Number=SeqID_4774
MPNQEHCLCRSWIALTLLQDEFRILEAKLITQQNM

SEQ ID NO: 121553 - protein, 150 aa, Glycine max
  Coding DNA Sequence Number=SeqID_4775
MGLIRQALKSAIFHLLAKPTRWLSERPLSATLLGFLERERSKFQRVLRDFAVKRSQRPELEAGAGSFNNGNWSDSKVLDSTGLSCRTITRNRDSLYTCSYLHLPLHTRHLFAEIAYQITQVPRVFNTRFLPFYTTCAIRCTCRKPNSNQL

SEQ ID NO: 121554 - protein, 80 aa, Glycine max
  Coding DNA Sequence Number=SeqID_4776
MAIFLVILNSEPWALFCRHQEVRQRDPLSGCSRDHGNGLPPLVLDRGEKIELLVDKTENLHHQGFEGLELWIISFMLQDH

SEQ ID NO: 121555 - protein, 38 aa, Glycine max
  Coding DNA Sequence Number=SeqID_4777
MATPSHITPTSPHMHPERGLEPNPHILPPAIPTSTKNI

SEQ ID NO: 121556 - protein, 313 aa, Glycine max
  Coding DNA Sequence Number=SeqID_4778
  Homolog annotation: Hit_ID=Q9SJ62; Match level="QueryCoverage=87%, HitCoverage=71%, E-value=2e-31, Identity=36%"; Hit description =Expressed protein
  Pfam annotation: Domain name=TPX2; Domain location=246-298; Score =70.7; E_value=4.8e-18; Accession=PF06886.2; Description=Targeting protein for Xklp2 (TPX2)
MESENRVAVEVEKRIIGVTTKVENIKKEVENDCNGAEIQTKNEVSKPTVDAKGPISAGDKVVIEASKTSANKNSKGAKETGGRASVASRSNKYAKDKPILKGPISISQKLRPSLSQSLSFPAKSAGEDAMQKSIDGYLVKPKVRHIQGNGIRGEGHIRHLNKSTNSEVNSLAKTNTGMPALKRSAFGRSTTVTAFTKSQTSEASLPVDQVSSTAKTAKANKEDDDSHSTTSSATPCLRSNGSGFSFRLEERAEKRKEFFSKIIAKEAEKTNLQVKSKENQEAEIKLLRKSMAFKATPMPSFYKEPPPKVELKK

SEQ ID NO: 121557 - protein, 101 aa, Glycine max
  Coding DNA Sequence Number=SeqID_4779
MVAMILWQEGKEVVVGLIICRIRQSSQWSCIAGPKLVPETITLKVDPNFYRSNKFYSLFQISFPIKLWSEKNYSTFKFQYEVNFLSCTQDLFLYSRVRKVL

SEQ ID NO: 121558 - protein, 337 aa, Glycine max
  Coding DNA Sequence Number=SeqID_4780
  Gene Ontology: Mol. function=zinc ion binding; Cellular component =cytoplasm; Biological process=regulation of progression through cell cycle
  Homolog annotation: Hit_ID=Q6Z9R0; Match level="QueryCoverage=97%, HitCoverage=88%, E-value=1e-100, Identity=52%"; Hit description =Putative zinc-finger protein
  Pfam annotation: Domain name=zf-ZPR1; Domain location=94-247; Score =169.0; E_value=1.2e-47; Accession=PF03367.4; Description=ZPR1 zinc -finger domain
FAPSSDPSLTIKFYERTPEQQASLGYLVDSTHIEGIHDETPEGGEAVTADQVRREPHGSIGATAGHRAIAQSNSSEIAEALFRYTAPEEVMTFPSSCGACAASYIPYFQEVIVMASTCDSCGYRNSELKPGGRIPEKGKRITLNVKNVNDLSRDVIKSDTASVKVPELDLELASGTLGGIVTTVEGLITKISESLERVHGFTFGDSLDEQRKGKWIDFKARLNKLLSLEEAWTLILDDALANSFVAPATDDLKEDNQLSWARVSTFCVTVLSNLHNWNHVTNGFNELYFSVWQFCHDISSVEEYERSWEQNEELGLNDIDTSSADVAYESTNTTKTE

SEQ ID NO: 121559 - protein, 406 aa, Glycine max
  Coding DNA Sequence Number=SeqID_4781
  Gene Ontology: Mol. function=zinc ion binding
  Homolog annotation: Hit_ID=Q2HT04; Match level="QueryCoverage=92%, HitCoverage=98%, E-value=1e-109, Identity=55%"; Hit description=Zinc finger, RING-type
  Pfam annotation: Domain name=zf-C3HC4; Domain location=59-99; Score =39.6; E_value=1.1e-08; Accession=PF00097.15; Description=Zinc finger, C3HC4 type (RING finger)
MNSFGFSLPSVSDAVGSGDREGLSFLKKVVEMEDKTESHMSSAAAFVEGGIQESCDDACSICLEEFGASDPSTVTTCKHEFHLQCILEWCQRSSQCPMCWQPISLKDPTSQELFEVVEQERSLRATPSRNAAIFHHPAFGDFELQHLRMSLNDADFEERIIQHLAAAAAMRRANQLGWREGQRARSSAHGHPQFLVFSNQPIAPSSVAGGENDPTAIPNRSPSTPITSVGNEASQQILHLQTQSSSSASGSPVMATNPRGIYSNERGSTACSSPANQDRAEPSELQSFSDSLRSRLNAVSMRYKESISKGTRGWKERLFSRSSSMSKLGSETRRREINSGIASVSRLMESLETSENNRVVGTSLSNHTEGCSIGGVSNQNNVEARGENSSHDDNTPAACSANSHLN

SEQ ID NO: 121560 - protein, 60 aa, Glycine max
  Coding DNA Sequence Number=SeqID_4782
MGTPGITSAFPLMRTFNKILYIRPPAKTLFNEIVTLQERDRVVTTCDPVDQPLMERGIIL

SEQ ID NO: 121561 - protein, 55 aa, Glycine max
  Coding DNA Sequence Number=SeqID_4783
MASLEVDLRSSGPMGFQGFGHELTDFVHNKANFRSGDDGILKAPHDLYTVGSERR

SEQ ID NO: 121562 - protein, 94 aa, Glycine max
  Coding DNA Sequence Number=SeqID_4784
  Gene Ontology: Mol. function=hydrolase activity, acting on ester bonds; Biological process=lipid metabolic process
  Homolog annotation: Hit_ID=Q8LDB1; Match level="QueryCoverage=98%, HitCoverage=36%, E-value=1e-19, Identity=43%"; Hit description=CPRD49
MNIKAIDLWSDIQKRDNWQDVFFIDRIHFSVEGNKIVLKEILKVLKEAEWEPTVHWKSMPNEFEEDSPYDPVAPDGRSTVNLSNWSFPDDVKWD

SEQ ID NO: 121563 - protein, 121 aa, Glycine max
  Coding DNA Sequence Number=SeqID_4785
  Homolog annotation: Hit_ID=Q40983; Match level="QueryCoverage=71%, HitCoverage=9%, E-value=6e-18, Identity=47%"; Hit description =Metalloendopeptidase
MACADDQSKFDAQQTQGLQKSLCGHPLFFGITTGLHSEIINSRLFTIVRGKVHKAVDACKNVLRGLHSNKITERELDRISTSIALITDVECQNSTSVAQPSLCFNDFGLQRLLITDVEIRR

SEQ ID NO: 121564 - protein, 82 aa, Glycine max
  Coding DNA Sequence Number=SeqID_4786
MIMRIKRRTQRRTAKKDTEEDWSSFRRKKTKKHILGKGTLAPEKNPHCVAVVFPENDAGGRQFLLPLWCCQRRSSSRPHDTE

SEQ ID NO: 121565 - protein, 84 aa, Glycine max
  Coding DNA Sequence Number=SeqID_4787
  Gene Ontology: Mol. function=hydrolase activity, acting on ester bonds; Biological process=lipid metabolic process
  Homolog annotation: Hit_ID=Q9AYM5; Match level="QueryCoverage=75%, HitCoverage=24%, E-value=4e-18, Identity=70%"; Hit description =CPRD49 protein
MSGPLLRPQFVMFGSSIVQYGLYDEGWMADLSHLYARKVDIVLRGYAGWNSRRALQVLDKIFPKGTVGWGVLTKEVKISSSKVW

SEQ ID NO: 121566 - protein, 212 aa, Glycine max
  Coding DNA Sequence Number=SeqID_4788
  Gene Ontology: Mol. function=hydrolase activity, acting on ester bonds; Biological process=lipid metabolic process
  Homolog annotation: Hit_ID=Q8LDB1; Match level="QueryCoverage=91%, HitCoverage=75%, E-value=3e-60, Identity=51%"; Hit description=CPRD49
  Pfam annotation: Domain name=Lipase_GDSL; Domain location=2-159; Score=53.3; E_value=7.9e-13; Accession=PF00657.12; Description=GDSL -like LipaseAcylhydrolase
MAYVINLILDKTLSTSLIQDAPVQPSLVIAYFGGNDSSTPHSSGLGPHVPLQEYIENLRKIVNHLKSLSENTRILLLSAPPINDATITPNSERSDGKPSRTNEACRIYSEACLDVCREMNIKAIDLWSAIKKRDNWQDVCFIDGIHLSSEGSKIVLKEILKVLKDAEWEPSLYWKSMPSEFDEDSPYDPIAPDGKSTINISNWAFPGNDKWE

SEQ ID NO: 121567 - protein, 174 aa, Glycine max
  Coding DNA Sequence Number=SeqID_4789
  Gene Ontology: Mol. function=trans-zeatin O-beta-D-glucosyltransferase activity; Cellular component=integral to membrane; Biological process=metabolic process
  Homolog annotation: Hit_ID=Q9ZSK5; Match level="QueryCoverage=82%, HitCoverage=32%, E-value=4e-25, Identity=46%"; Hit description =Zeatin O-glucosyltransferase
MDILADKASSPSNDILPAQLLVQYEGPYIELLEGGGKKLWALGPFNPAGIEKKMQKEDTHAWNGLISKSQIWLYMCFLGPQQVSQRSKSKRLQQCWRKASTSLSGCWEMLIKEASLMEMREKRHELPNEFEERVEGMGLVVRDWAPQLEIQSHLSTGGFISHCMWMKLLLIWRA

SEQ ID NO: 121568 - protein, 109 aa, Glycine max
  Coding DNA Sequence Number=SeqID_4790
  Gene Ontology: Mol. function=transferase activity, transferring glycosyl groups; Biological process=metabolic process
  Homolog annotation: Hit_ID=Q8S3B9; Match level="QueryCoverage=50%, HitCoverage=11%, E-value=2e-12, Identity=65%"; Hit description =Putative glucosyltransferase
MFGLGKFWKLHGSDFQEKAVFKKDKTSINRQKPPVHQPPKTTCSLIINNHSGSESITVVENVVRRLMETMEGDEMRWRVMRLKGALHRCMDASVVSRMEIDSFTVHVTK

SEQ ID NO: 121569 - protein, 112 aa, Glycine max
  Coding DNA Sequence Number=SeqID_4791
MERSMIDAANGGALGDITPAEARNLIEKMASNSQQFSARNDVIVLRGVHEVATDSSSSTENKKLEGKLDALVNLITIQIFVLHGSNLEPMSNLKLMLQTFIIDLLSNKTNNS

SEQ ID NO: 121570 - protein, 112 aa, Glycine max
  Coding DNA Sequence Number=SeqID_4792
MQDSHKDIYLGAYLNDVLNELYGKFSSSSKKTNWIEVKNCLQKGGIECDYYVMYWIKTKVLGGIKNDWIKKLKEEDFKCFGGKLMQKLEEKVEDWDSSLSAQDRSNAFPRLA

SEQ ID NO: 121571 - protein, 246 aa, Glycine max
  Coding DNA Sequence Number=SeqID_4793
MISTQSGLRRETPLEDFHPHPTAMTDTNTLQQLQNRIAKIERHHEKELKKLKADHDQLEACVRCPKGDKHSAHIFPELTQGESHPRCTVNNTDDLSLSHMHRPVRRITRRHLFLDYIMEVGIPLVWKPHNLERYDETTDLDEHLDAFLTQTNLNTNNNMTLYRVFPTSLKGASLTWYGGPPRVHRQLQYLRRMIKSWMSCVNEPRATSRWKKCLDSGMKSEKSDRSTGSTKEAPRPTYTIRTRGIS

SEQ ID NO: 121572 - protein, 146 aa, Glycine max
  Coding DNA Sequence Number=SeqID_4794
MLSSVGCGNLNKFERITGQCGLSSPQAWTNVVRAASVKLSKMDMSLACQACAVHTQYSCILVIRRVGTYWSHGSCVNKGGLSISGSLSEDTHCGAFDSEFSSSKRVRASPRTGGSTSHPHGKARPFAVAGEPVPITVIFPPSIYRV

SEQ ID NO: 121573 - protein, 392 aa, Glycine max
  Coding DNA Sequence Number=SeqID_4795
  Gene Ontology: Mol. function=structural constituent of ribosome; Cellular component=ribonucleoprotein complex; Biological process =response to antibiotic
  Homolog annotation: Hit_ID=Q9ST69; Match level="QueryCoverage=86%, HitCoverage=80%, E-value=1e-36, Identity=59%"; Hit description=30S ribosomal protein S5, chloroplast precursor
  Pfam annotation: Domain name=Ribosomal_S5; Domain location=143-209; Score=113.8; E_value=4.9e-31; Accession=PF00333.10; Description =Ribosomal protein S5, N-terminal domain
  Pfam annotation: Domain name=Ribosomal_S5_C; Domain location=311-384; Score=126.8; E_value=6e-35; Accession=PF03719.5; Description =Ribosomal protein S5, C-terminal domain
  Pfam module annotation: Pfam domain module=Ribosomal_S5::Ribosomal_S5_ C; Domain location=143-209::311-384
  Subcellular localization annotation: CTP_CleavageSite=51; ConfidenceScore=5.69e-01
MAAPSLSSALNSLSSLSLSTSSRFSLLPPPSLLSKPLPLLFATTTLKSKPSDDIDTSFFDNINPQDDITFNPPEPPEGFVAPPSFDDGPLETEDEIAAAYEELYGPGYSGVSVLGNDVYVMDAKVKKETGFGSGAKKEKVRDGFEERVVQVRRVTKVVKGGKQLRFRAVVVVGDKKGSVGVGVGKAKEVIAAVQKSAVNARRNIIKVPMTKYSTFPHSRIEPKVTVAYGCNCYEVSRIYWPLLELLSMTMEVLKGAWIFYSELSKHTSRVLTLVIGRVFDRVQFWNAKNSKGLKVLSFFLMRVGTFTRSRTDGDYGAAKVMLRPASPGTGVIAGGSVRIVLEMAGVENALGKQLGSNNALNNARATVVAVQKMKQFREVAEERGIPMEELWK

SEQ ID NO: 121574 - protein, 147 aa, Glycine max
  Coding DNA Sequence Number=SeqID_4796
AYTSNIHEQEQIKAKPCRIQILGSTLSYEVRTLQSLAVSGVRHASVSVSDTDTTPVLRSIFWTIQITLNLKLPSLRSATAEKIATRKHARLHDPARRVLRFRSPTSRRRVKNRAIRLEIEILARFIPDIEIQPRFWNKNETTSDSYR

SEQ ID NO: 121575 - protein, 1014 aa, Glycine max
  Coding DNA Sequence Number=SeqID_4797
  Homolog annotation: Hit_ID=Q8W417; Match level="QueryCoverage=44%, HitCoverage=54%, E-value=2e-34, Identity=28%"; Hit description=Cig3
MTTNSSLPSGVHKEKHILFEIGNSERQLWALIHSKGPVHSDVQVLYHNIRSSYEREILNNHTHSELQEVEYSLWKLHYKHIDEFRKIIKKSSGNAENKKSGTSKDGVVQIDNDNHIQAFKSFLLEAAEFYQTLIVKLRKHYGVPEEALFHKKGCVSTSFEPEPLQKCQYLCHRCLVCMGDLARYKQHFENLDTQKQNWSVSATHYLEATRIWPDSGNPQNQLAVLATYIGDDFLALYHCVRSLAVKEPFPDAWDNFILLLEKLRKLPSLMILQNRSSHLECVSSDVCFDFFKPSQRISKENGARPNDDSSNCNMFEGESNHFTDTKLWSLIVRTVSYLFITSSLEEFPIALASTIEVFDEMMELEDIKLKTVLESYGQMDLARKGPFRALQIVSILIFTLKNLIDKHEKDESKDKNDCQQLVLIQLALAAAFIFMGRFVERCQKSSPLNYCPLLPSVLVFVEWCASMLDEIEVYATDQKSETAISYFFYVLLELLNELNENTKETKKLVANSTPLWEDYELRGFVSIAFSHVSLDFSDGWEHIDNFESDTELRTQRMSEAAMRIANRSNNLQKWIISDELGRKFHSARSDDNHEKKETGNIESTDKRTSGDDPNQKTHKDNGEDGKCDTRDNPSSSSTNEEPFVVEEEEVILFRPLARYHSAPSYALFSPHEQISSPKDKDDKVLPSDDCLHRTTSLPMAQNPFQIDPWGFQGEIMNSRINKSFQVQEPSMKESNANTFSEGPISAGHPSLNAWVLDRGGLSTNRLHPIEELASSYLADLSINRTQNPVIGLVDEFSNFPSSSATYTAPVPSAPLLPDNAPWYTDVIVQSTMSAPLLQENPSPINGYSAWPSTYGPLGYDTSFLFYSNGYAPPPGRITSSEWLRWYRENPPPERVNNNMQPTHLNVPGNHENFLHHDTYRFNQFDQWGNPLSPNQYTYMKPPGPQPLQPGYPCAFGAGEHITNHFHNFQRPSPYGCGSVTEQRNEPLPLLEYLKEREWRLQQDPTLRGPTYMGN

SEQ ID NO: 121576 - protein, 511 aa, Glycine max
  Coding DNA Sequence Number=SeqID_4798
  Gene Ontology: Mol. function=transporter activity; Cellular component= integral to membrane; Biological process=phosphate transport
  Homolog annotation: Hit_ID=Q9S735; Match level="QueryCoverage=96%, HitCoverage=95%, E-value=1e-146, Identity=54%"; Hit description =Inorganic phosphate transporter 1-9 (AtPht1;9) (H(+)/Pi cotransporter)
  Pfam annotation: Domain name=MFS_1; Domain location=26-450; Score =97.0; E_value=5.5e-26; Accession=PF07690.6; Description=Major Facilitator Superfamily
  Pfam annotation: Domain name=Sugar_tr; Domain location=22-500; Score =97.1; E_value=5.1e-26; Accession=PF00083.14; Description=Sugar (and other) transporter
  Pfam module annotation: Pfam domain module=MFS_1::Sugar_tr; Domain location=26-450::22-500
MARLKVLSTLDTSRTQYYHFKAIIIAGMGLFTDAYDLFSITLIIKIIGRVYYDHREGEHRYETPPEVVSALVAVALLGTAVGQLVFGRLGDLKGRRRVYGFSLLLMVFSSLASGFSICRRKTCVLLTLGFFRFFLGLGIGGDYPLSSTIMSEFANKKTRGSFIAAVFSMQGFGILASSTVTMAVCSIFRAASKNSEADLAWRLILMLGSVPAAMTYYWRMMMPETARYTALVEQNVMQAAKDMEKVLDVTLSQIAEEHPLPPTPHPYPLLSREFLRRHGRDLFACSSTWFLVDIVFYSQVLFQSEIYKRYLDKKEEVDVYQETFHVAWIQAVIAVCSTIPGYFFSVYFIDKWGRVKIQMMGFFFMALAFFAIGIPYYSFWTTEDHNMNKGFMVLYGLAFFFANFGPNTTTFIVPAELFPARFRSTCHGISGAVGKVGAIIGSVGFLWASHKKKENGYPKGIGMEVTLIILGVVCLLGMLVTYLFTRETMGRSLEENEVESVNHEVEEHDNL

SEQ ID NO: 121577 - protein, 165 aa, Glycine max
  Coding DNA Sequence Number=SeqID_4799
  Gene Ontology: Mol. function=RNA-directed DNA polymerase activity; Cellular component=nucleus; Biological process=RNA-dependent DNA replication
MDLRADFFGFQLADWIRWNLELTSYEVQGISWPELWENSLTPGRVWRSNSGPEWVSHWLKLGIVVRFNYRWILMLWFKVFYLVAEGMLEVGVSSKRLEIRRLLDQTWQVEIIHVYREANCCADRLANLACGLQSPLVLYEQAPPCLSSLLLFDVRGVSLPRFIPL

SEQ ID NO: 121578 - protein, 319 aa, Glycine max
  Coding DNA Sequence Number=SeqID_4800
  Gene Ontology: Mol. function=nucleic acid binding; Biological process= RNA-dependent DNA replication
  Homolog annotation: Hit_ID=Q1SKJ3; Match level="QueryCoverage=57%, HitCoverage=25%, E-value=1e-19, Identity=30%"; Hit description=Zinc finger, CCHC-type; Endonuclease/exonuclease/phosphatase
MVKKVRMPRKGKEKDQGETSRDGFVGGPRFGVLGNQIDEERASINDNDKAITRNIGGIVIISKVVDGGRPTLAGRDPKIGHTKKESQRGLDQGHPYARGRNKGNMSRCSIRRGENINGVVKDMECVAETLSLSNGVFFGARGFLGGICVARRMDKVNVIINLKHLHFIHLRVRFENQDWWWFSLVYASPIKGVRGELRNYLHNISTSNPDRWWMMADDFNDILIQEEKKGGAPTYRLDKAFCNAHWHMAFPTASIKVLTRVSFSDHHPILVSMNDGCNFSNKSMFRFECAWIAYPFFKDLITESWKNQDDLVNDTTVSP

SEQ ID NO: 121579 - protein, 378 aa, Glycine max
  Coding DNA Sequence Number=SeqID_4801
  Gene Ontology: Mol. function=RNA-directed DNA polymerase activity; Biological process=RNA-dependent DNA replication
MKLASTSLYSRCSTRSKAKWLHDRDKITRYCHLKTSRRRRKKAIHMLRNDDGVWIEDEHKVHKLVNSYHQNLFVSHHIDKEMALGPDGYLVGFYQNSWNIIQKNFLKTMNRLWISPSEVLKINKTDICLILKEMLCSMNNMKGKKSLFGIKVDLAKAYDRMSWEFVNEVLIEAGFPLELINVIMIGISSVNTNGVWNPMRVGRTWPFVSHLMFADNLLLFGEATIYQMNIVMDVLNKFKEASSLGNYLGVPLLGKSPRRVDFNHLVDKRTMMLPKGNDGAAMCNLDLINYACLMKLCWAIRNGNNSLWIEVLKGKYTKRWSVNMNLEAKTYDSPLWKWIDENTRLKDVVSVAPSQLQGLKVLMRIIPILPPSPFAEAD

SEQ ID NO: 121580 - protein, 785 aa, Glycine max
  Coding DNA Sequence Number=SeqID_4802
  Homolog annotation: Hit_ID=Q75HJ9; Match level="QueryCoverage=89%, HitCoverage=89%, E-value=2e-93, Identity=31%"; Hit description =Expressed protein
MESSEEEEDFPSIESIIPQSKVDSLYQSQTEKGIRKLCCELLDLKDAVENLCGNMHSKFLAFLRISEEAVEVKHELIELQKHISAQGILVQDLMTGVCRELDEWNQSSNDVSEIQQEPELPELLEPLPNERNDKKILFLETIDVLLAEHKFEETLEALEALEALDAEEKNSAELKGSGNNSSDDVSSYKSALLERKAMLEDQLVGIAEQPSVSFPELKTALNGLTKLGKGPLAHQLMLKFYQSHLQKRIEALLPSSSLCPETFPSTLSKIVFSVISLTIKESALIFGDNPVYTNRIVQWAEWEIEYFVRVVKENAPSSETVSALRAASIGIQASLNYCSILESQGLKLSKLLLVLLRPSIEEVLESNFRRARRVVLDMAESAECCPLSPQFASSLSAIASSSNSMLVESGMRFMHIVEEILEQLTPMASLHFGGNVLNRILQLFDKYMDALIRALPGPSDDDNLPELKEVVLFRAETDSEQLAILGIAFTILDELLPNAVLSRWMLQSESKAKEPNSGVTENVSFNTNATVELKEWRKHLQHSFDKLRDHFCRQYIVTFIYSREGKTRLNAHIYLSDNRDDLYWDSGPLPSLPFQALFAKLQQLATVAGDVLLGKEKIQKMLLARLTETVVMWLSDEQEFWGVLEDKSAPLKPLGLQQLILDMHFTVEIARFAGYPSRHIHQIASAITARAIRTFSARGIDPQSALPEDEWFVETAKSAINKLLLGVSGSEASDTDEDHIIDHHDEVVSDSDTVSSLSSMESTESFASASMAELDSPSNLSDPDN

SEQ ID NO: 121581 - protein, 99 aa, Glycine max
  Coding DNA Sequence Number=SeqID_4803
  Homolog annotation: Hit_ID=Q6Z9R0; Match level="QueryCoverage=32%, HitCoverage=6%, E-value=3e-09, Identity=93%"; Hit description =Putative zinc-finger protein
MAYNDINAWQNLIVRNLERTAILRQNTAGFFGIPSPSSMLATFVSLSILGCCCCLQLKTLQLTWLMLNRQVVKAESATIKIPELDFEIPPEAQRGSLST

SEQ ID NO: 121582 - protein, 186 aa, Glycine max
  Coding DNA Sequence Number=SeqID_4804
  Homolog annotation: Hit_ID=Q66D02; Match level="QueryCoverage=85%, HitCoverage=88%, E-value=5e-37, Identity=45%"; Hit description =Putative exported protein precursor
  Pfam annotation: Domain name=YfaZ; Domain location=6-186; Score =166.0; E_value=9.4e-47; Accession=PF07437.2; Description=YfaZ precursor
MEWIVMFKQLVTGSVLGLALLSGGAQAIEGSVDVGEHSTNLNLGLGTASPGLFLKGNWLRSDHDGSTYGLGMGYNLDVGDFRVAPTAKALFTHPEDGRDGFTVALGAGAQYNFNSMWGLYGEYYYAPEAFSDRLDSYKEASGGLSFTPISLLNLRVGYQYIELNNKGDRKDNVLVDGPYVGASLRF

SEQ ID NO: 121583 - protein, 55 aa, Glycine max
  Coding DNA Sequence Number=SeqID_4805
MSLPLEEPWKFEIQFDKDEQREESSRMRCIVVQWCWVKGNDRCKLSMAGKEGVET

SEQ ID NO: 121584 - protein, 194 aa, Glycine max
  Coding DNA Sequence Number=SeqID_4806
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=7e-26, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTNALAFRGLHALSFRGLHVLTIRRLHALAFRGLHVLTFRGLHVLTFRGLHALTYRGLHGLHVLTFGGLHALAFRGLHLLTFRELHALAFRGLHILTYRGLHALAFRGLHVLAFRGLHALAFRGIHFLVLRGLRALAFRGLHVLAVRGLHALSFKGRHVLNFRGLHSLTFRGIHVLTFSGLHIRTLREFKVLCP

SEQ ID NO: 121585 - protein, 111 aa, Glycine max
  Coding DNA Sequence Number=SeqID_4807
  Gene Ontology: Cellular component=cellulose and pectin-containing cell wall
  Homolog annotation: Hit_ID=Q945T0; Match level="QueryCoverage=62%, HitCoverage=60%, E-value=3e-16, Identity=55%"; Hit description=RALF
  Pfam annotation: Domain name=RALF; Domain location=42-108; Score =109.8; E_value=7.9e-30; Accession=PF05498.2; Description=Rapid ALkalinization Factor (RALF)
MNFKPWLSFLLLALALAMVAEASSVHHEYGFHGAAVVHDLIGDDNEMLLDSETNRRTLAGRQQYISYGALNANNVPCGNRGRSYYNCQQRGRANPYNRGCTQITHCARDTS

SEQ ID NO: 121586 - protein, 286 aa, Glycine max
  Coding DNA Sequence Number=SeqID_4808
KERALRRPYRMRAKAKVMSEIEEVQEQMKANMEAMKEQMATMMEAMMSMKKIMEVNMATVITASTATEVDPTHPSGLNQINHTTIDMVGQGGKALRSEDGPHFVQVQNKHSFPPYGLPPNYTPPNVAYIPDENVDNSASIPIETQQPQFDHAHVSQPMGEIHEYHPQPQPLHLVLERLPLAMVEREKFDHIKERLRAVEGGGDYAFADMAELCLVPDIVIPLKFKVPDFDKYKGTTCPTNHLKIRHFGILIWNLPESILGKDLMVAFIRQYQYNSNMAPDRMQLQN

SEQ ID NO: 121587 - protein, 540 aa, Glycine max
  Coding DNA Sequence Number=SeqID_4809
  Gene Ontology: Mol. function=nucleic acid binding; Biological process= DNA integration
  Homolog annotation: Hit_ID=Q1S1G2; Match level="QueryCoverage=99%, HitCoverage=59%, E-value=1e-30, Identity=30%"; Hit description =Integrase, catalytic region; Zinc finger, CCHC-type; Peptidase aspartic, catalytic
  Pfam annotation: Domain name=zf-CCHC; Domain location=141-158; Score =9.7; E_value=0.025; Accession=PF00098.13; Description=Zinc knuckle
  Pfam module annotation: Pfam domain module=RVT_2::zf-CCHC; Domain location=485-540::141-158
MASIKQGDQSIINYFTKLRIIWDELESYRPDPTCSCDPKCICDALTSMIERKQQDRIMQFSNISKVFSYVVQQERQINSNELIGSISLINAAGNNSSNSRPSYTYCGKDNHIIDRCYRKNGPPQNDPSKRGKGNFGAKGNKVCTNCGLSNHTIDDCYKKHGYPPGHKFYKVQNPNINNVNTRREEGDGSPSDRNQETQNKDVRLTTQQYKALMSLLQQQAPAQSNSQINQIGTVTNKGSILLVTCSVSKTSQDEWILDYGATDHDMNQQKISTVEMVEGLYRLKMIPIKSKYKSDFVGSSISNFFAFSYKQFVCETCHHSKQKRLSFPSSESHSSCAFALIHVDIWDPCNSKAKTQSHLKNFVANVERQFETKVKVIRNVIFYEDCFPFIGQDKPDAITILPIPSSHAIDQPNGVSSELPVDHIMHVPNNVDSDPLTLEQSPNTTRRSLRQTHRLSKYKDFHVSYLFSTIASYSTASKDPIWVEAMNVEIKALELNDTWILTDMPQHKNVIGCKRVYKIKYKSDGSVERHKARLVAKGYT

SEQ ID NO: 121588 - protein, 250 aa, Glycine max
  Coding DNA Sequence Number=SeqID_4810
  Homolog annotation: Hit_ID=Q2HTS9; Match level="QueryCoverage=41%, HitCoverage=40%, E-value=5e-22, Identity=59%"; Hit description=DNA -binding WRKY; VQ
  Subcellular localization annotation: CTP_CleavageSite=72; ConfidenceScore=5.42e-01
MPASLVGTFPSLGKTTKRVKIPYPFFYSFFDSSPNPTLLFFCHPIGGRRTGTWGRGGGGGGGEEGQKTRLFVARSGRGRRVQEEPFLLDGFLFSSFGCVHNHTGAVFVEGTGTVEGVGYEGRDGAENERGEVEDAGRENLVVFPRRERRNDDVVERVDAEILAERVQRPRLRLVLRRWCRLGQRLSGTGWRIRIWSRASEGTMMSEIEQPPRSESENSNCGVAKEQDSRRRGGGGALGGTSESPWLTGRY

SEQ ID NO: 121589 - protein, 61 aa, Glycine max
  Coding DNA Sequence Number=SeqID_4811
MQSDKNSKENRNVLSNIKTKKHNVQCWKEALHEAVGIEVVLLNSLISTIFTGSSQTVIQSN

SEQ ID NO: 121590 - protein, 53 aa, Glycine max
  Coding DNA Sequence Number=SeqID_4812
MEFDPSDEEEGRGGEVGIRKVNDNSINILTYKNKFGPSPLQDLNLEGSIKTSV

SEQ ID NO: 121591 - protein, 237 aa, Glycine max
  Coding DNA Sequence Number=SeqID_4813
  Subcellular localization annotation: CTP_CleavageSite=35; ConfidenceScore=5.17e-01
MALHRLLKRKGGVDELNDDFPLASPATKIRRLVSTSSLYSSPSTTNQTCLSLFTNRFRLLPFQDAELPPILEEDEPLPNEERALVLFKPLVHSPSSFSLTLDSDLMKGIRNNQYLWSKQCERVTELESREEENDDELALVPWVPSPSYQFSAVDDSLNTNVELMEADEMGEGEGVGSMMMDIEQEDDTDTDTDTDAKTSTSSIHYPTTHDGITEGFQQHCLLPKLPHNTSTPITWTR

SEQ ID NO: 121592 - protein, 438 aa, Glycine max
  Coding DNA Sequence Number=SeqID_4814
  Gene Ontology: Mol. function=protein serine/threonine kinase activity; Cellular component=intracellular; Biological process =protein amino acid phosphorylation
  Homolog annotation: Hit_ID=Q1SH95; Match level="QueryCoverage=60%, HitCoverage=74%, E-value=1e-87, Identity=60%"; Hit description =Protein kinase
  Pfam annotation: Domain name=Pkinase; Domain location=10-271; Score =191.5; E_value=2e-54; Accession=PF00069.15; Description=Protein kinase domain
  Pfam annotation: Domain name=Pkinase_Tyr; Domain location=10-271; Score=1.8; E_value=1.4e-12; Accession=PF07714.7; Description=Protein tyrosine kinase
  Pfam module annotation: Pfam domain module=Pkinase::Pkinase_Tyr; Domain location=10-271::10-271
  Subcellular localization annotation: CTP_CleavageSite=12; ConfidenceScore=5.25e-01
MSSSSMKKNWVRGESLGSGSAATVNIVIPTNPSTHNFPSPTAVKSSLFLTSYSLKTEKDVLDILGPSPNIIKCYGNDCTVENGKRYYNVFLEYAAGGSLADQLKKYGGRFPEACVRQCTKSILEGLKHIHSKGYVHCDVKPQNILVFDNGVVKIADLGLAKRRGEINREYVCRGTPMYMSPESLTDNVYESPVDIWALGCTIVEMITGEHAWYVGSCENTWTLMNRIGIGEELPKIPQELSQQGKDFLGKCLVKDPNKRWTAHMLLNHPFIKNPLPQPLPRKTDRPACMPKGIPCTHQAKMGEGKDFLDKCPGKDPKKGLTAEMPLNHPFVRKPLPPTLPSHVVATLLHGSLTRLCETKWWNNLCQHGTRRKTKQIKSSCVVFHDMEGVQLSSIIGKDSNINHPRIFSYAELYIGSRGFSEEEVLGSGGFGKVYRAVN

SEQ ID NO: 121593 - protein, 337 aa, Glycine max
  Coding DNA Sequence Number=SeqID_4815
  Gene Ontology: Mol. function=hydrolase activity, hydrolyzing O -glycosyl compounds; Biological process=carbohydrate metabolic process
  Homolog annotation: Hit_ID=Q105A2; Match level="QueryCoverage=90%, HitCoverage=46%, E-value=1e-100, Identity=54%"; Hit description =Isoamylase isoform 1
MPLFDNNLWDGANAFGAPIEGDLLTTGAPLSSPPLIDLISNDPILCGVKLIAEAWDAGGLYQVGTFPHWGIWSEWNGKYRDTVRQFIKGTDGFAGAFAECLCGSPNLYQGYLPSHGGGRKPWHSINFICAHDGFTLADLVTYNNKNNLSNGEDNNDGENHNNSWNCGQVIEFWLVGYLAVSQIFGLLIQEGEFVSTSVKKLRKPQMRNFFLSLMVSQLNYFRWDKKEESSSDFFRFCRLMTKFHRVTLPDCPGYRWEPLVDTSKPSPYDFLTPDLPGRDIAIQQYAQFLDANMYPMLSYSSIILLRIPDENPASLLLSAIYIILFLVCWKRNRLISK

SEQ ID NO: 121594 - protein, 127 aa, Glycine max
  Coding DNA Sequence Number=SeqID_4816
MDGGRGTCPRFAMVEGAGVVVGGGESGWTEGGNLCCISMFMLKSTKSLKDLSENSSVFLIGRLISMLLARNLSFIVFSQVGLLKMQQFLYSLFGYTRRSKDSQESYLTKSVESIDCGQGIFNDGLRL

SEQ ID NO: 121595 - protein, 122 aa, Glycine max
  Coding DNA Sequence Number=SeqID_4817
  Subcellular localization annotation: CTP_CleavageSite=63; ConfidenceScore=5.34e-01
MLQNEFNWSLTWLYLDKLLHKHLSKKKIIRRTFQTTTTSMGPTSTHATSSAGTLTVESVQQLVLSALSALAFEFPEHLNNVRTYNDTKIFKLLMALGKVIAREPKVGRLLPLQFSLPSLFCL

SEQ ID NO: 121596 - protein, 67 aa, Glycine max
  Coding DNA Sequence Number=SeqID_4818
MGTISSSCYSWFSGFDPDSCLLFGKNYGALKFQFKMFVKGKGLWGHLDGTSTAPADNTLEAWQIKDA

SEQ ID NO: 121597 - protein, 144 aa, Glycine max
  Coding DNA Sequence Number=SeqID_4819
  Gene Ontology: Mol. function=phosphotransferase activity, alcohol group as acceptor; Cellular component=cytoplasm; Biological process =carbohydrate phosphorylation
  Homolog annotation: Hit_ID=Q1SMB1; Match level="QueryCoverage=51%, HitCoverage=16%, E-value=8e-19, Identity=60%"; Hit description =Mevalonate and galactokinase
MQTKDYKLVYRPKVLEYNESGEPKATRILLALSGLKQALMNNPGYNKRVAECREAAQILLEAVAKCQTLHLQKGVNKLSKRMEVMRLSLDAMVRLLPCDLKVTSSNPRTVFLFVGARLHTFTLPKPHYVGALCTGSLSLLKDAW

SEQ ID NO: 121598 - protein, 351 aa, Glycine max
  Coding DNA Sequence Number=SeqID_4820
  Homolog annotation: Hit_ID=Q874Y4; Match level="QueryCoverage=51%, HitCoverage=14%, E-value=2e-08, Identity=24%"; Hit description =Similar to spindle pole body protein pcp1 from Schizosaccharomyces pombe
MGPMLMMEWNGIQNLMWERKYPVAMMLTNSMVVKYVVAQVPQDVHDAKPSNTVKCLIMDWKWHKDHCIARDVDSAPIERSRRDVGFLKNSYEEEESIRSSCPLSLEFHPEESTSFKSPIEVSQDPTNKVLYLEDEVAKSRNEILLLQSELDEWKNRANFAREKFRSLKRESNYQLLVLKNEKESIAEAETRARNVIHSLHKKLNHLQNVVQESIAEKRKLEEDIQSLESECADLKKQLQEEHKYAQRLTMESDKSREAAKIAMREVEAVRQELQEEREHAQRLKENFHRDVIFSESRATFAEAKLSDLYRKIRMSDYKEYKVIVNCHNQNGDLEYLCILCLGVQGTRESKV

SEQ ID NO: 121599 - protein, 199 aa, Glycine max
  Coding DNA Sequence Number=SeqID_4821
  Homolog annotation: Hit_ID=Q9FPS8; Match level="QueryCoverage=23%, HitCoverage=4%, E-value=1e-11, Identity=63%"; Hit description =Ubiquitin-specific protease 16
  Pfam annotation: Domain name=zf-MYND; Domain location=99-136; Score =57.3; E_value=5.1e-14; Accession=PF01753.9; Description=MYND finger
MVDLNWLFVLLGLGEKGAPISDNTKAWHQILLLTIVIGIWWLLCHFADDREVNPNINEVDDELGEMEHPNDELDHFFDEDDHRAAVVVGDEARGRHGGCSICGDFSTTRCARCKAARYCSGKCQIIHWRLGHKYECSESGTAADEARPTHDHGTSKLVEKSEMGLANENKGMKGENNDRLTTKIWGSYKKKWWIIKRMN

SEQ ID NO: 121600 - protein, 510 aa, Glycine max
  Coding DNA Sequence Number=SeqID_4822
MTPKKSETIRILVINNIEEAKKVFLEDWFIPGKWVNFQSLMEKGFAIKDRKGKGGEGTKMQDGVSIQGTINGKKYCEPHIYVKTYPQPSIQHSDSQIGIKRLSFKDKFHAKDKKNLIPYGMFFTQIIRNRGMDVSVLEPSVGVVQLKSAIFVKMGIVDNFPKYTKKHAKRNVKKELKEESQSVARQMEGDVIEEEVGIIASVEALSMEEHKKKLVEDARLGALAGMVSEEILKDVILESLKTLFVEESVIEASLNESEDNNIEIDIGIALVRPRPVSKANKRAVPASTITFKSVPVEHDVNIRYYPGFRGHIVREWQTCNKEGFPSTDAFFYPSYDTLPKEEEYAFGTYSNRELVIKKFPPRQTTAPNPTSLIFEHRPQNKKATSNEISFSTPLDLQQFMGLLCTFNVVLPWDCTKSRETFQMEDIQLEAPEESLNFQDWEHPDYGLELRMDIFAYREEIISRKASFRRIQRHNTYFLGLIHLSSDFDDFGDEFLRKLDEEVAKQKGEEK

SEQ ID NO: 121601 - protein, 117 aa, Glycine max
  Coding DNA Sequence Number=SeqID_4823
  Gene Ontology: Mol. function=phosphotransferase activity, alcohol group as acceptor; Cellular component=cytoplasm; Biological process =carbohydrate phosphorylation
  Homolog annotation: Hit_ID=Q1SMB1; Match level="QueryCoverage=68%, HitCoverage=18%, E-value=5e-34, Identity=87%"; Hit description =Mevalonate and galactokinase
  Pfam annotation: Domain name=GHMP_kinases_C; Domain location=24-90; Score=20.1; E_value=0.0081; Accession=PF08544.3; Description=GHMP kinases C terminal
MGTPKHFSFCRFLFYGSIFSSEPFLTCFPKASFQALGCEPLIQLYEILLRAPGVLGARFSGAGFRGCCLAFVEADLATEAASFVRSEYLKVQPELASQISKDTAVLICESGDCARVI

SEQ ID NO: 121602 - protein, 487 aa, Glycine max
  Coding DNA Sequence Number=SeqID_4824
  Gene Ontology: Mol. function=hydrolase activity; Cellular component =integral to membrane; Biological process=nucleotide metabolic process
  Homolog annotation: Hit_ID=Q1SMB3; Match level="QueryCoverage=99%, HitCoverage=100%, E-value=0.0, Identity=74%"; Hit description=Type I phosphodiesterase/nucleotide pyrophosphatase
  Pfam annotation: Domain name=Phosphodiest; Domain location=97-426; Score=439.0; E_value=6.5e-129; Accession=PF01663.12; Description =Type I phosphodiesterase  nucleotide pyrophosphatase
  Pfam annotation: Domain name=Sulfatase; Domain location=95-469; Score= -44.2; E_value=0.0067; Accession=PF00884.13; Description=Sulfatase
  Pfam module annotation: Pfam domain module=Phosphodiest::Sulfatase; Domain location=97-426::95-469
  Subcellular localization annotation: CTP_CleavageSite=87; ConfidenceScore=5.40e-01
MGSNPLSALTSTKPTPIPTQDHDDQDSPSSKCLLSFNTDSCSSTPSSSSHKALFITLILITSIALSTSFAFAFLYFSSKPPPSPLLVARPLSKLKRPVVLLVSSDGFRFGYQFKTPTPHISRLIANGTEAEAGLIPVFPSLTFPNHYSIATGLYPAYHGIINNHFTDPLSGEPFYMGNSHDPKWWLGEPLWETVVKNGLKAATYFWPGSEVNKGPWSCPFNYCRHYNSSVAFEDRVDAVLGYFDLPSDQIPDFMTLYFEDPDHQGHKVGADDPQITEAVARIDRMMGRLIRGLEERGVFEDVSVIMVGDHGMVGTCDKKLIFLDDLAPWIDVPKDWVVTHTPVLAIRPPSGNDPADVVAKMNEGLSSGKVDNGKFLRVYLKEDLPSRLHYAASDRIAPIIGLIEEGFKVEQKRTKRQECGGSHGYDNAVFSMRTIFIGHGPRFARGRKIPSFENVEIYNLITSILKIKGAPNNGSASFAESVLLSAA

SEQ ID NO: 121603 - protein, 288 aa, Glycine max
  Coding DNA Sequence Number=SeqID_4825
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=96%, HitCoverage=55%, E-value=8e-96, Identity=64%"; Hit description =Pyridine nucleotide-disulphide oxidoreductase, class I; FAD -dependent pyridine ...
  Homolog annotation: Hit description=nucleotide-disulphide oxidoreductase
MGEFEGQIVHTCKYKSGNKFCGKNVLVVGCGNSGMEVCLDLCNHNARPSLVVRDTVHILPQQMLGKSTFGLSMFLLKWFPIRFVDQFLLLMSHLMLGDTDQFGLRRPKLGPLELKNLYGKTPVLDVGTLTQIKNGKIKVCRGIKRLARNAVEFVDGKVENFDAIILATGYKSNVPSWLKERFQQKLDNTGLFTLIIDGINNGIYVIIGILIGLEIYYEQGSDMFSEKDGFPRKPFPNGWKGENGLYAVGFTKRGLLGASIDAKRIAEDIEHSWKAEATHVLEFPCPLA

SEQ ID NO: 121604 - protein, 66 aa, Glycine max
  Coding DNA Sequence Number=SeqID_4826
MADIQFYDEDLGQTLISNCGTRCWGAPASIMMPKLVFERKEWNENKIRVEFIYPGCKLRLELTHCL

SEQ ID NO: 121605 - protein, 141 aa, Glycine max
  Coding DNA Sequence Number=SeqID_4827
MEEVLKRHGWELAAPSCLALDAEERCDRGAVECKRESTEWSSMFDVRCIGKGGFKFERKERMAKCHAQSCTGFTTFDEKTKHRFVALVGFKTDIKLERGCLNDEQFQRIPFVGIAHSNCQGTPVEPAQCYFKDSRRGKMHA

SEQ ID NO: 121606 - protein, 560 aa, Glycine max
  Coding DNA Sequence Number=SeqID_4828
  Gene Ontology: Mol. function=solute:hydrogen antiporter activity; Cellular component=integral to membrane; Biological process =regulation of pH
  Homolog annotation: Hit_ID=Q9ZUN3; Match level="QueryCoverage=94%, HitCoverage=96%, E-value=0.0, Identity=69%"; Hit description =Putative potassium/proton antiporter
  Pfam annotation: Domain name=Na_H_Exchanger; Domain location=168-512; Score=271.1; E_value=2.2e-78; Accession=PF00999.11; Description =Sodiumhydrogen exchanger family
MRFTSPALLSLLILCHLLLSLPSFTFSLLADDADPETELLLAGDNATAFLNASLARYDDGSFANMIDRALEREFPDNEQNEGTDPGGFNNSVAEQQAVLETVARVKPKKNDSKEEKSFQFHDVFNLDNENRAEDMPTLIDRKDNVFIISNLKSKYPVLQLDLRLISDLVVVIVSATCGGIAFACAGQPVMTGYLLAGSIIGPGGLSFVSEMVQVETVAQFGVIFLLFALGLEFSTTKLRVVRAVAILGGLLQIFLFMCLCGITASLCGGKSSEGIFVGAFLSMSSTAVVLKFLMERNSVNALHGQVIIGTLILQDCAVGLLFALIPVLGGTSGVLQGVVSMTKSLVILIAFLAILTILSHTCVPWLLKLMISLSSQTNELYQLASVAFCLLVAWCSDKLGLSLELGSFAAGVMISTTDLGQHTLEQVEPIRNFFAALFLASIGMLIHVHFLWNHVDILLAAVILVIIIKTIVATSVVKGFGYNNKTSVLGKLYLLLLGTTALSLVTTPLLFKLIPAVVHLGVLLRWFPPDSAAEIAFKGDSFRADSAKRIPLMVQGSHDS

SEQ ID NO: 121607 - protein, 535 aa, Glycine max
  Coding DNA Sequence Number=SeqID_4829
  Gene Ontology: Mol. function=sugar porter activity; Cellular component=integral to membrane; Biological process=carbohydrate transport
  Homolog annotation: Hit_ID=Q68BJ8; Match level="QueryCoverage=88%, HitCoverage=87%, E-value=1e-143, Identity=55%"; Hit description =Sorbitol transporter
  Pfam annotation: Domain name=MFS_1; Domain location=73-489; Score =120.2; E_value=6e-33; Accession=PF07690.6; Description=Major Facilitator Superfamily
  Pfam annotation: Domain name=Sugar_tr; Domain location=69-530; Score =415.2; E_value=9.4e-122; Accession=PF00083.14; Description=Sugar (and other) transporter
  Pfam module annotation: Pfam domain module=MFS_1::Sugar_tr; Domain location=73-489::69-530
MEENSALEHHCYYPLPASAAKADHPNHNDGEKEETCAEEGSSQHQPNTSQNCVSYQSNKPRLNRYALGGAILASTNSILLGYDIGVMSGASLLIRQDLKITSVQVEILVGCLNVCSLIGSLASGKTSDWIGRRYTIMVAAATFLIGAILMGLAPSFPFLMAGRVVAGIGVGYSLMISPVYVAELSPALTRGFLTSLPEVFISVGILLGYVSNYAFSGLPNGINWRLMLGLAALPSIAVALGVLAMPESPRWLVVKGRFEEAKQVLIRTSENKGEAELRLAEIQEAAAASASITNMDKATTSDGSFNGQGVWKELLVTPTSPVLRILVVAIGVNFFMQASGNDAVMYYSPEVFKEAGIKDEKQLFGVTIIMGIAKTCFVLISALFLDPVGRRPMLLLGSCGMAISLFVLGLGCTLLKLSGDNKDEWVIALCVVAVCATVSFFSIGLGPTTWVYSSEIFPLRLRAQGSSLAISVNRLMSGIVSMTFLSVSEAITFGGMFFVLCGVMVCATLFFYFFLPETKGKSLEEIEALFEDQAH

SEQ ID NO: 121608 - protein, 88 aa, Glycine max
  Coding DNA Sequence Number=SeqID_4830
MHLRDQGKIQQRIQLSTPGSLLNNKEKNKKKDCKNTSGEDVSFTSRISQSLTDSSQSLKPAPASSFGLYRSSHSKISQNSLELGPFSL

SEQ ID NO: 121609 - protein, 112 aa, Glycine max
  Coding DNA Sequence Number=SeqID_4831
WATGDGVLMPGLVEMGCLLCAIARSPPSTTYDGVVPQDMSRGSGDLGDVRWGAIAQNQAWPISTQPGHSKPVRTCDVPKQASSWQSTNKGTKVHEARRLVWRLASYLSWVVI

SEQ ID NO: 121610 - protein, 142 aa, Glycine max
  Coding DNA Sequence Number=SeqID_4832
TTEGAGDDVSLCASTSSFSPWLTKGAGNHKVRTIEGAGDDVSLCASTGSFAPWLTKGAGNHKRKNVYADNHLGISACPLTSRVSIDRNCLCGELPMYLCLPPNYTEKLLVYLRMSPVFTGQYDRQQGRQRKSPRVNGLVGCD

SEQ ID NO: 121611 - protein, 66 aa, Glycine max
  Coding DNA Sequence Number=SeqID_4833
MTDIVCAENYLCISARHLASRVSMTDTAEDDVNLRVLTGSLAAIDKGCRREDDVSLCMLSCFESYG

SEQ ID NO: 121612 - protein, 42 aa, Glycine max
  Coding DNA Sequence Number=SeqID_4834
MGELINIPIRKPMQSMRNIRDILLLNSLIDSCFMPKHRVGKG

SEQ ID NO: 121613 - protein, 61 aa, Glycine max
  Coding DNA Sequence Number=SeqID_4835
MDPMDSECLSVVSYDVVPCIDRSEYLALERRGGKAFLPPQVVEDILEEQMVWHSTHSDSYM

SEQ ID NO: 121614 - protein, 141 aa, Glycine max
  Coding DNA Sequence Number=SeqID_4836
MENMPLVTNSEIRDNMPKCGGDHTDWNKGEEEGLWSIFQSLEKWNPKLVPEGTWKEGGHDVIIINIYSPCDLEAKKRQWEALKSVRATSRESLWFIIGDYNCIRRSCERQGESLVDYGSGERMELDKFIVDMELKDISLVG

SEQ ID NO: 121615 - protein, 315 aa, Glycine max
  Coding DNA Sequence Number=SeqID_4837
  Gene Ontology: Mol. function=zinc ion binding; Cellular component =nucleus; Biological process=regulation of transcription
  Homolog annotation: Hit_ID=Q0GLE0; Match level="QueryCoverage=47%, HitCoverage=99%, E-value=4e-55, Identity=70%"; Hit description=Dof12
  Pfam annotation: Domain name=zf-Dof; Domain location=48-110; Score =140.5; E_value=4.5e-39; Accession=PF02701.6; Description=Dof domain, zinc finger
MFGGKCEKMVAVTPQTASNKWTQTQQIDDHKAPMGRIMEKPSQDLLQQQQQALKCPRCDSSNTKFCYYNNYSLSQPRHFCKACKRYWTRGGTLRNVPVGGGCRKNKRMKRPTNGDSSSANSPSSSTPSASSNPPSQPHIDNIIVSGSATNHINNINPLFYGGDVMNNVPFPKFNLLQSQLNALGLGFSSGVRENGFSTTSNNNFFSAYNSIFGSSSSSTCAPSTPVMASLLSSTLLQQNFMGGGGGGVKGRDHDQGDNTFHGLAPLQGLRVEGDSNNNIGSKEVKGEGQNRFEWSNNNNNNNNNGGGGQNQMEHV

SEQ ID NO: 121616 - protein, 102 aa, Glycine max
  Coding DNA Sequence Number=SeqID_4838
MKSRKETIEIEIALIDKKNSYITRALAARLPTEGGLASHSHERLYTSKANRRKGWMTSSTRKLNFHANFVLSVGFCTKRAFGLHYELFRALSLSCALSAGTR

SEQ ID NO: 121617 - protein, 157 aa, Glycine max
  Coding DNA Sequence Number=SeqID_4839
  Homolog annotation: Hit_ID=Q1T621; Match level="QueryCoverage=43%, HitCoverage=11%, E-value=4e-12, Identity=56%"; Hit description=GRAS transcription factor
MPFPSDKDFQGKGVLEFSSASNSFSVLLHNPQPKWTIDKEDYCYGQDQSILRLIIGDVEDPYVGLNKLFWGSSQQSVDFNAGFGVVDQGLNMISVVDPSGNNTYPGFPFITENIGGRNVKAGFLSIGESMFFVSGNSPLLFSTSLGGFNSQQQHQVV

SEQ ID NO: 121618 - protein, 320 aa, Glycine max
  Coding DNA Sequence Number=SeqID_4840
  Gene Ontology: Mol. function=zinc ion binding; Cellular component =nucleus; Biological process=regulation of transcription
  Homolog annotation: Hit_ID=Q0GLE3; Match level="QueryCoverage=82%, HitCoverage=87%, E-value=2e-84, Identity=64%"; Hit description=Dof9
  Pfam annotation: Domain name=zf-Dof; Domain location=23-85; Score =130.1; E_value=6e-36; Accession=PF02701.6; Description=Dof domain, zinc finger
MEQEGEKGREERRQVQRAATQQPPQQHQKCPRCGSMNTKFCYFNNYSLSQPRHFCKTCKRYWTHGGTFRNIPVGGGSRKVKRGKTNSSSFSSSSSSSSNLLTQPQQNLLMRPSPPLITTMVQSTSPYYHLAGGSGYLSSLATLHSLNNNTSQPFNQYLKVGGDFAGSSNSPLVSGFNAAYSLPPRFPQQQSMYPAQQQQQQQQRLIPSNMASSGAVSHSALRTQSLINNVSTSTNHRASISDASLWSAATVNTTSIGGNSDQNNVVKGGSSSLVPSHWLHRPGLLMEEDFEGEPGAAVKLCLGDLLVMGSNLETAYLHMQ

SEQ ID NO: 121619 - protein, 276 aa, Glycine max
  Coding DNA Sequence Number=SeqID_4841
  Gene Ontology: Mol. function=metal ion binding; Cellular component =intracellular; Biological process=regulation of ARF protein signal transduction
  Pfam annotation: Domain name=VWA; Domain location=44-207; Score=18.9; E_value=0.00015; Accession=PF00092.18; Description=von Willebrand factor type A domain
MPECAVISASRAHETYALVLKVKAPPPPPPSRNSAVLSQRAPIDLVTVLDIGGNMTGGNLHMLKRAMRLVISSLGTADTLSIVAFSATSKWLLPLRRMTSQGQRVVRRIVDRQVIGQGSSVGDALRKATRVLEDHRERNPVANVMLLWDGQEEKLTRAVCNSALTPPSARRLNRKKSAMELLFRNCSGDPFSCGAETEEEEALRVALGRGALGNTKRGVRLEEGKKKGLILVVGEEVEGESETNEDEEETIEIESPNTDPATFGYCNYHLPLTASE

SEQ ID NO: 121620 - protein, 229 aa, Glycine max
  Coding DNA Sequence Number=SeqID_4842
MTLKSTKAVLQPASIPEDLDPLRSKLLWASRVLPMPLVGLLIIGGVCTDVGSQASEYPEIEALSRLDFGAALKVFLAKRLTSEFTLVTADVEEKSVIIGERNRVAIEALRAAMEKGHNKIAILYGGGHMPDLGRRLREDFDLVPSNVQWITAWSITKKDLNTDSFPFLKTIAKASGWPLNRYQTLALLIFSSVLALDLWFWELFFGTAVNWVSELGSELLQYVDNSQMI

SEQ ID NO: 121621 - protein, 145 aa, Glycine max
  Coding DNA Sequence Number=SeqID_4843
  Homolog annotation: Hit_ID=Q00WL2; Match level="QueryCoverage=97%, HitCoverage=46%, E-value=1e-18, Identity=34%"; Hit description =Homology to unknown gene
MSPNPQRSEEWFALRKDKLTTGTFGTALGFWKGSRRPELWQEKVFASEAQIMEANNAMAWGTLKEAVAVEQYKKITGDEVSSMGFAVHLKQSCYWLGASPDGVLGILEVNCPHNKGKPEAGLPWLRMPFYYMPQVQGQMEIMDCE

SEQ ID NO: 121622 - protein, 63 aa, Glycine max
  Coding DNA Sequence Number=SeqID_4844
MDTWKNICNVIDDDNNNYNTDDVSNDGGDVTGRATDGGCDVKKVVVDSGDVSTVSNVGGGDNL

SEQ ID NO: 121623 - protein, 356 aa, Glycine max
  Coding DNA Sequence Number=SeqID_4845
  Homolog annotation: Hit_ID=Q8L720; Match level="QueryCoverage=99%, HitCoverage=77%, E-value=3e-55, Identity=37%"; Hit description =Expressed protein
MALNFSHRPIFSEDNLVSPMRMGIPEKSVVDNCFDYGRERGGGGANHDDILDLLPSDPFGMDISTTVTAITGWLEDLEIVDYGGYRRDELGASDGNYQLFAGLNFIWNNAMRFHASCVEEKRGFGESCSVRNDGAAAASSNFGFGSVNNYDEVSGLPAISRSGDVVRRVGGAGRGDVARPDGGGSGGEELAPHPALSFSLGYLGLSDLLVVERVCKSLHSTVCGDPLLWRSIHVDPPLNERITDDVLFQLTNRAQGHLQCLSLVECTRITDDGLKRVLQSNPKLTKQMLKSVFRTLVKESNLSVPGCTRLSIEGIVGILKAYNSMGTQGLKHLHIGGLYGVTQKHFEELSFLLGAD

SEQ ID NO: 121624 - protein, 159 aa, Glycine max
  Coding DNA Sequence Number=SeqID_4846
MRKIPKGWGKRVISGGFLDPVSPRLAFGSKEHQRKHWIHSNRGKLVKACYVQEICHVFIFLNSSSISLGSSLSIYRSCLLLKNRYVSRPCNNGSKLLGSRPRPNDTCICASGAPFFTSGLRWTPRMVTDVEVVVVHLLLANVVDLTLVVVPASTCNIFQ

SEQ ID NO: 121625 - protein, 70 aa, Glycine max
  Coding DNA Sequence Number=SeqID_4847
MKVKGRRLRVERVYGFIRQASGSCIILMEFGIKDANGRQAKEDGYCCQLSIFHSQTKSLKYMLDKWPQKF

SEQ ID NO: 121626 - protein, 290 aa, Glycine max
  Coding DNA Sequence Number=SeqID_4848
  Homolog annotation: Hit_ID=Q3LWF1; Match level="QueryCoverage=24%, HitCoverage=44%, E-value=1e-11, Identity=45%"; Hit description=RNA binding protein
MGVEFIMRSGGWYYKDRLGRTRGPLELITLKTAWGAGIIDKNTFIWGEDMDEWAPIHMIYGMERAIATWEVRLAASATALLHKLQKGIPPWVPLKGFEKKTYKQLQEEAIESKRRDLAVLEANDGLWPGAKIPSHALFLWASGSELTTILEQDHMPNKYIPKYLRKKLAEIIPGLRPWEVLSVEQAMDRLTFNGEWYREPLGSFTTGPPYLEHWNRDVMRLYKIFDDLNNELYEHMENSIAGFDKIMEKIRDDFIARTDKLLEKKDKEKREARKKAGLPEYQWPEKPYVP

SEQ ID NO: 121627 - protein, 288 aa, Glycine max
  Coding DNA Sequence Number=SeqID_4849
  Subcellular localization annotation: CTP_CleavageSite=65; ConfidenceScore=5.59e-01
MASINFNPFGGNWFSKPPNPLSVPSLPNNLTDAPSSLPPNFAAISLPNPFRRRPKPKPKPEEPVEPGHYEQLARQVLWECENLPDHRHTPEVDKILADNDAAFGGNNDDSVFVLREDATEEEVRENAELVERLRSSPVVQFMARAEEILDKMNEMELKENERPYHKEDWEVWKNVPNVIGLDGRPMPRKAQKTREEADDKFWDFARQFFFGLWNFRQRPYPPGKPIDAAQSIGYKNLDRRYYDCWFCVYELELSQNSKMALGGVVNLSPGGWSCPQMSSLQLGLDGVC

SEQ ID NO: 121628 - protein, 94 aa, Glycine max
  Coding DNA Sequence Number=SeqID_4850
MGKWKDCFYLKDLSIYSIKSIFRKLNSLLRFRREGHRNGLVNLYKDMEPFEENDDIQVMWKMIQVQSSTPQCTCTVKRTNRCLLETMFSTDLKF

SEQ ID NO: 121629 - protein, 327 aa, Glycine max
  Coding DNA Sequence Number=SeqID_4851
  Homolog annotation: Hit_ID=Q1S7V4; Match level="QueryCoverage=22%, HitCoverage=35%, E-value=1e-24, Identity=84%"; Hit description =Ribosomal protein S3Ae
  Pfam annotation: Domain name=DUF1677; Domain location=108-196; Score =5.8; E_value=6e-07; Accession=PF07911.4; Description=Protein of unknown function (DUF1677)
  Pfam annotation: Domain name=Ribosomal_S3Ae; Domain location=1-161; Score=-16.7; E_value=1.7e-05; Accession=PF01015.8; Description =Ribosomal S3Ae family
  Pfam module annotation: Pfam domain module=DUF1677::Ribosomal_S3Ae; Domain location=108-196::1-161
IAYEGLKHRVFEVSLTDLQGDEDDAFKKIRLRAEDVQGKNGMDFTTELLRSLVRKWQTLIEAHVDNLLCTIKPETELEFAPMIIDPMVISAPETQSAAASILVAETELEFAAVKDEIVRSERVVCTQKAMAKHMNFYKNFKASGPHPNPTVHLISALRQILRRTLDSPRVRSTPKSPTKTRTKIHGSVLTTSESCFPTSLKGCDEGNTWGLSCDEPEEDADAELMTRSKEPEERVILVSKKLEPDSFFLDADNQTSTRGENKLGFGSFNLAGGLKLLKQSLLGKKLHMRSTYWSFKLEKYQLQQQWLREQVREVAEQNVSLQREVPN

SEQ ID NO: 121630 - protein, 205 aa, Glycine max
  Coding DNA Sequence Number=SeqID_4852
MKNTWERVIKRGKDLGKISCGADESYRHWLKVRVQIVKVPFCNLILVIEGMFVQASIDMREVKELKEALAKFEEEMNMLKLELMESCQMCKKRKRQALANNQQLKEELKSSKIAKRQAQRLLEDLQQQSKRVVAEYEDRLEDEKQHRQEAEHAAVTHQDGWMKEQQNAHELIGCIKGQEFYIKELKVEIAFWKDELARSINKDDL

SEQ ID NO: 121631 - protein, 499 aa, Glycine max
  Coding DNA Sequence Number=SeqID_4853
  Gene Ontology: Mol. function=zinc ion binding; Cellular component =nucleus; Biological process=regulation of transcription, DNA -dependent
  Pfam annotation: Domain name=FAR1; Domain location=22-233; Score =107.5; E_value=3.8e-29; Accession=PF03101.5; Description=FAR1 family
MDPKELTIKLGLEFNSLEEAYLFWTDYGGMKGFGVRKKNSSNSKKDGSITHYKYVCCKEGVRQYDKRDPKTTNPEAETRTGCMASMKVKRFNEKYKVIEFFYDHNHPLHPPETVHMLACQRRITEKQAYELEVAEDVGIQQKVLFDLMSKYVGGRENLGYTWQDAKNYLNSKRRRDMAYGEAGCLLQYFQQQLIDNPSFFHAYQIDSEEQITNIFWADARMLFDYQCFGDVISLDTTYCTNGDHRPLAIFSGFNHYRGGVIFRAALLYDETIDSFKWLLETFLQAHSKKRPQTVFTDKDQAMARALQEVISETKHGLCTWHIMKNGIKHLGNLMKDESNFLSDFKKCMYNNKEETNFEASWRTLLLKYNVEENTWLNSTYQIKEKWAACYMKYAFTLGMRSTQLSESINSDIKSCTRPNLNINQFFKQFERIVKEKRYSELKQDYEMRQKLQRMIIQSSPMIRQLSQEYTPPMFNLFQREWDLIAATNINKKQRNGSSW

SEQ ID NO: 121632 - protein, 87 aa, Glycine max
  Coding DNA Sequence Number=SeqID_4854
MRYSCLDLASHLNQNIKASVFFHKLNEVFMQEWIQLKSKENLNFLSLSTQGIYEAISLERNRKDSIRNSDLSNGEFDNQILMSPLPT

SEQ ID NO: 121633 - protein, 253 aa, Glycine max
  Coding DNA Sequence Number=SeqID_4855
  Gene Ontology: Mol. function=cysteine-type peptidase activity; Cellular component=integral to membrane; Biological process =proteolysis
  Homolog annotation: Hit_ID=Q56763; Match level="QueryCoverage=99%, HitCoverage=87%, E-value=6e-91, Identity=67%"; Hit description=Type 4 prepilin-like proteins leader peptide-processing enzyme [Includes: Leader ...
  Homolog annotation: Hit description=peptidase (EC 3.4.23.43) (Prepilin peptidase); N- methyltransferase (EC 2.1.1.-)]
  Pfam annotation: Domain name=DiS_P_DiS; Domain location=17-126; Score= 177.3; E_value=3.9e-50; Accession=PF06750.3; Description=Bacterial Peptidase A24 N-terminal domain
MAFLDQHPGLGYPAAAALGLLLGSFLNVVILRLPKRLEWQWKRDAREVLEEPDFYEPPPPGIVVEPSHCPHCKHKLSWYENIPLFSWIIQGGKCRHCKAPISLQYPLVEALTSVLVLACVWQFGFGWQGFGVPIRAGPCFLIRLCPVSDLRTQLLPRPAHPAADVAGADRQHRQPVHAGQARAGGRGGGLPVAVDGLVAVQAADRQGRHGPRRLQAAGGAGRLVRAEGHPADHPVVVGAGRHHRLDLAVQPRS

SEQ ID NO: 121634 - protein, 185 aa, Glycine max
  Coding DNA Sequence Number=SeqID_4856
  Gene Ontology: Mol. function=dephospho-CoA kinase activity; Cellular component=cytoplasm; Biological process=coenzyme A biosynthetic process
  Homolog annotation: Hit_ID=Q4UXU8; Match level="QueryCoverage=82%, HitCoverage=73%, E-value=8e-37, Identity=54%"; Hit description =Dephospho-CoA kinase
RRVDTIALHQPGVLHGFGRIHQQHPVQPWVGLPPAHLGQQRNGRNRIGAGGLLALLLHQQADSRVGDRFQRRPLGRVGEHVSAQAGPVKAAVGQQHVGAEALGNAGQGGAAGGHHGPCGQIGVGHHDPQRLEAPGHFALAGGDASGQANYIAAHGDSPQRSPLITRYCSTSGAPHMKYSQPAMAR

SEQ ID NO: 121635 - protein, 52 aa, Glycine max
  Coding DNA Sequence Number=SeqID_4857
MSNATDSAGEIPPETRSAESDGGGPRPTIKINVTHGSSHHDLHLPAQSTFEI

SEQ ID NO: 121636 - protein, 212 aa, Glycine max
  Coding DNA Sequence Number=SeqID_4858
MVGASVNWFPRWKEGRTEVLSLCEGFSNIPLMGTMGCINYNLILAIRQLGYPMRGASSEESITPFIARGFTDPNARIFQGVRKAWNVVQRKHKELRGSINRIIDSYHKWLKAQTQELVWLPNLKASSEEEAETPEESEEVQALNAELERAQVVQEKFKMTTIKVRKECDKSRDVVGAFAKALERETKRVPKEEWGRDKFRGALWDNNSELKL

SEQ ID NO: 121637 - protein, 522 aa, Glycine max
  Coding DNA Sequence Number=SeqID_4859
  Gene Ontology: Mol. function=binding; Cellular component=signal recognition particle, endoplasmic reticulum targeting; Biological process=photosynthesis
  Homolog annotation: Hit_ID=Q5N842; Match level="QueryCoverage=83%, HitCoverage=64%, E-value=1e-113, Identity=52%"; Hit description =Putative signal recognition particle 72
  Pfam annotation: Domain name=SRP72; Domain location=407-458; Score =77.7; E_value=3.6e-20; Accession=PF08492.2; Description=SRP72 RNA -binding domain
MVTDKVILIKYCWRFRKSKECASEKLLTVIWGTSVQTNLYQSSDLGAMVLDPKLSHILMFIHIFWIRIGQEVLMEDNLADDEIEIELSPIAVQLAYVQQLLGRKQDAIEAYTDVIKRDMADESSIAVAVNNLVSLKGPKDVSDSLRKLDRLKDKENQSFRLAPGLDLKLSAKEKEAIYANRVLLLLHANKNEQARELVSALPDMFPESVIPIFLQAALLVRENKAGRAEEILAQFASKFPDKSKVVHLARAQVAAAAGHPHIAADSLTKISDIQHMPATVATLVSLKERAGDIDGAAAVLDNATKWWSNAMTEDNKLNTITQEAALFKLRHGKEEEAAQLYEQLVKSQGSIEALVGLVTTVARMDVAKAELYEKQLNALPGLKGIDVDSLERTSGVKQVDAPRVGVAETYEEGKNKTKSKKKRKRKPRYPKGFDPANPGPPPDPERWLPKRERSTYRPKRKDKRAAQVRGSQGAVVRDKHDTGASSNSSNLKSNQGTSKGAAQNAVSEQTKPSSKSRKKSRN

SEQ ID NO: 121638 - protein, 154 aa, Glycine max
  Coding DNA Sequence Number=SeqID_4860
  Gene Ontology: Mol. function=hydrogen ion transporting ATP synthase activity, rotational mechanism; Cellular component=proton -transporting two-sector ATPase complex; Biological process=ATP synthesis coupled proton transport
  Pfam annotation: Domain name=ATP-synt_G; Domain location=8-154; Score= 80.7; E_value=4.4e-21; Accession=PF04718.5; Description=Mitochondrial ATP synthase g subunit
MASKLQKLQATASQASQFVCSRGTNYYKQLLEQNKQHIQEPPTVEKCNLLAKQLFYTRLASFDPFMLNVVTFGFFGLPSKVPATECTSVVLGAILLPAATAPEELDYAKNLWKNRKELKVEDAGIAALFGLECFAWFCAGEIVGRGFTFTGYYV

SEQ ID NO: 121639 - protein, 85 aa, Glycine max
  Coding DNA Sequence Number=SeqID_4861
MIVRSPYVVARGSQVARMASGTACPAGGAGWPEWLAGRTSIAGGDVLGYKCEVKSHIGSPYVVARGPQVYPSNLPNNDSFILLPK

SEQ ID NO: 121640 - protein, 220 aa, Glycine max
  Coding DNA Sequence Number=SeqID_4862
  Gene Ontology: Mol. function=binding; Cellular component=signal recognition particle, endoplasmic reticulum targeting; Biological process=photosynthesis
  Homolog annotation: Hit_ID=Q5N842; Match level="QueryCoverage=91%, HitCoverage=29%, E-value=5e-46, Identity=50%"; Hit description =Putative signal recognition particle 72
MAPKPKPAPSQPAPPPALEDLFTTLNRHIQASAYDNAVRLTDQILAIAPGDEDALRCKVVALIKNDRVEDTLSAIRSSKKQLDDFHFLKARQFSAFVSAFSSAYCLYRQNKLDEALESLKRQESNDETMLLECQILYRLGKMDACLDIYRKLQNSKIDNMEINSVAALVMSGRSSEVQGMLDSLRVKATSSFELAYNTACSLIARNEYTDAEQLLLSGRR

SEQ ID NO: 121641 - protein, 577 aa, Glycine max
  Coding DNA Sequence Number=SeqID_4863
  Homolog annotation: Hit_ID=Q3LHL2; Match level="QueryCoverage=34%, HitCoverage=38%, E-value=2e-45, Identity=44%"; Hit description =Hypothetical protein PPS5
  Pfam annotation: Domain name=DUF292; Domain location=18-139; Score =220.1; E_value=4.8e-63; Accession=PF03398.5; Description=Eukaryotic protein of unknown function, DUF292
MFNRRSSKSSECKTALTLAVPRIKLLKNKREANVKQLRRELAQLLHSGHNHAARVRVEHVVKEEKTMAAYDLIKIYCDLIAARMPMIESQRNCPIDLKEAISSVIFASPRCSDIPELVVVKKHIMAKYGREFVSAAVELRPDCGLVEKLSTSAPDGPTKIRILTAIAEEHNVQWQPSLEENHVNASQDFLAGPNTLENGKPPQVQLHAPPVGDEKGPPNLRAYASYQLKEMHNISYEKSASLNSSGTGSQEMNFGNLYSENTSSFQMGRQNWNIEFKDATSAAHAAAESAERASMAARAAAELSSRGKLTRQCSSEWLSSSVGELPQKYAFHATEHLSAGYVNSTFRRSSFEIHNEQANVREQHNQVGSTNEHRTNSNENVAKLYQSASLTSHNAFREDKPFGNVYGVADIYPNDDNPQANQKSSTWDSNAHFYSDTSRSEDGLPKRNSVTLAGSASGLSRRMLAPSKTGTCLILKDDSLSKASKTSGASSGHGSAEHAASKPNSEPKSEEIIILSAMVQASSSLTTTMTPDKEEASKSLNSNQDIPSKEKASHVHPKLPDYDTFAAQFLPRKKGLQ

SEQ ID NO: 121642 - protein, 210 aa, Glycine max
  Coding DNA Sequence Number=SeqID_4864
  Gene Ontology: Mol. function=acyltransferase activity
  Homolog annotation: Hit_ID=Q9LU88; Match level="QueryCoverage=89%, HitCoverage=47%, E-value=3e-22, Identity=33%"; Hit description =Acetyltranferase-like protein
MSIRLTEGKHRDQVSIDCNDQGVSFLVARLRCKLSSILQNPTGASLNPLFPDELQWKPMKNTTSTIVAIQINCFACGGIAISVCMSKSLLAFPVPGASLFPQENLPVFSEVLFVENDAVCRRFVFEASEIDSLKAIVSSHNVPNPTRVEVVSALIYKRAVSALGLSFKTTSFRTAVNLRNRTVPPLPEKSLGNLVWFLLVLNPSEAELHE

SEQ ID NO: 121643 - protein, 685 aa, Glycine max
  Coding DNA Sequence Number=SeqID_4865
  Gene Ontology: Mol. function=two-component response regulator activity; Cellular component=nucleus; Biological process=two -component signal transduction system (phosphorelay)
  Homolog annotation: Hit_ID=Q1T3X9; Match level="QueryCoverage=99%, HitCoverage=100%, E-value=0.0, Identity=68%"; Hit description =Response regulator, RegA/PrrA/ActR type
  Pfam annotation: Domain name=Myb_DNA-binding; Domain location=305 -355; Score=44.4; E_value=3.9e-10; Accession=PF00249.21; Description =Myb-like DNA-binding domain
  Pfam annotation: Domain name=Response_reg; Domain location=130-232; Score=46.1; E_value=1.2e-10; Accession=PF00072.14; Description =Response regulator receiver domain
  Pfam module annotation: Pfam domain module=Myb_DNA-binding::Response _reg; Domain location=305-355::130-232
MDNGCFSSPRHDAFPAGLRVLVVDDDPTWLRILEKMLKKCLYEGGEIQPCVDFYSLCTFALRVQLLARISCAELQYLASLIREWKSRIRFLLNCYLYGYLSSTQAVHEVGLGWTIQKPELKKLRLHQIFMKLANFGSKHILCLLLTTCCLATEALKKLRERKDAYDIVISDVNMPDMDGFKLLEQVGLEMDLPVIMMSVDGETSRVMKGVQHGACDYLLKPIRMKELRNIWQHVFRKRMHEARDFESHEGFDFEGIHLMRNGSDHSDDGNLFAVEEITSIKKRKDADNKHDDKEFGDHSPMKKARVVWSVDLHQKFVKAVNQIGFDKVGPKKILDLMNVPWLTRENVASHLQKYRLYLSRLQKENDQKSSSSGIKHSDSPSKDPGSFSILDTANKQQNDVAIDSFSYSDGSLLLQMDATSHEGNLKGIVSEPTTEKRRGSTGDIPDPKIQKSSQKSLNQPFTSVESSEANHAVFDCTIPTQYSWSEFPKGPLKEEQKTLVQLEDSLSQLPLHGNGTQHHIHVDQSQSIASINSNPSITEEEVAAKLETKPLYAGYESDYVSPVSSIGSAVEVFPSQSKSLMVNDQSSEPTFTSNLSLKAQGFNRDCISDLDFYQRNLLLGGEVASAPLEEDLNFFLLQTECYNMNFGLQNIDMSEYYDPRLIAEVPSHFYDSADYSSVDQSLFIA

SEQ ID NO: 121644 - protein, 512 aa, Glycine max
  Coding DNA Sequence Number=SeqID_4866
  Gene Ontology: Mol. function=metalloendopeptidase activity; Biological process=proteolysis
  Homolog annotation: Hit_ID=Q5JKR1; Match level="QueryCoverage=99%, HitCoverage=53%, E-value=0.0, Identity=66%"; Hit description =Chloroplast processing enzyme-like protein
  Pfam annotation: Domain name=Peptidase_M16; Domain location=50-199; Score=72.4; E_value=1.4e-18; Accession=PF00675.10; Description =Insulinase (Peptidase family M16)
  Pfam annotation: Domain name=Peptidase_M16_C; Domain location=209 -392; Score=45.6; E_value=1.6e-10; Accession=PF05193.11; Description =Peptidase M16 inactive domain
  Pfam module annotation: Pfam domain module=Peptidase_M16::Peptidase _M16_C; Domain location=50-199::209-392
MELLPAGTPPISKKQGFRSLKLVNVDMDQLLSDQPVGVDYGILDNGLRYYVRCNSKPRMRAALALAVRAGSVLEEEDERGVAHIVEHLAFSATKKYTNHDIIKFLESIGAEFGACQNAVTSADDTVYELLVPVDKPELLSRAISVLAEFSSEIRVSKDDLEKERGAVMEEYRGSRNATGRLQDAHWILMMEGSKYAERLPIGLERVIRTVSSETVKHFYKKWYHLCNMAVIAVGDFSDTQGVVELIKTHFGQKIPDPDPPLIPTIQVPSHDEPRFSCFVESEAAGSAVMISYKIPTDELKTVKDYCNLLAESMFLYALNQRFFKIARRNDPPYFSCSAAADVLVRPLKANIMTSSCKRKGTIEALESMLIEVARVRLHGFSEREISVVRALLMSEIESAYLERDQIQSTSLRDEYLQHFLHNEPVVGIEYEAQLQKTLLPHISTLEVSKCSEKLRTSCSCVIKTIEPQPFAVLDDLKNVVKKVNLLEEEGRISPWDDEHVPEEIVTTKPNMG

SEQ ID NO: 121645 - protein, 149 aa, Glycine max
  Coding DNA Sequence Number=SeqID_4867
MSMQAIKGCVGCAVGASSSLEVRASSPLLVVDIEDLQLRWVVSPSRIIGRSLRREDHHDSDDVLQQRRPTASERRQREVAPIVEDDPMVTEDVHAHVEEVVDDAEGFLGGPHDPLLDFPCTPPSCLVRVSGFGLGASHSLSRAKDNHRA

SEQ ID NO: 121646 - protein, 117 aa, Glycine max
  Coding DNA Sequence Number=SeqID_4868
  Gene Ontology: Mol. function=catalytic activity; Biological process =cellular metabolic process
  Homolog annotation: Hit_ID=Q9CA28; Match level="QueryCoverage=78%, HitCoverage=28%, E-value=6e-35, Identity=77%"; Hit description =Putative reductase; 61412-62628
MPEFCVTGGTGFIASYLVKALLEKGHTVRTTVRNPGDVEKVGFLTELSGAKERLKILKADLLVEGSFDEAVRGVDGVFHMASPVLIPYDENVQGLPYKKIRRLIYKCTTYVNVYIRA

SEQ ID NO: 121647 - protein, 249 aa, Glycine max
  Coding DNA Sequence Number=SeqID_4869
  Gene Ontology: Mol. function=metalloendopeptidase activity; Biological process=proteolysis
  Homolog annotation: Hit_ID=Q5JKR1; Match level="QueryCoverage=86%, HitCoverage=21%, E-value=2e-94, Identity=76%"; Hit description =Chloroplast processing enzyme-like protein
MAGKRRLGEENWRMKNVIFTGYSYGGLSELPENEYFSCSMGPTIAGEIGVFGYRPSVLMDMLAGKRAEVGTKIGAYMRTFYGDCSPSDLETALQLVYQLFTTNLTPGEEDVKIVMQMAEEAVSAQDRDPYTAFTNRVKELNYGNSYFFRPIRKSDLQKVDPRKACEFFSTCFKDPSAFTVVIVGNIDPTIAMPLILQYLGGIPKPPEPVMHFNRDELKGLPFTFPTSIHRYINALCLQTKGVMIIVVLC

SEQ ID NO: 121648 - protein, 100 aa, Glycine max
  Coding DNA Sequence Number=SeqID_4870
MEIGIVWRLFAAIPPLDANSHMTLNGLSSAEPQPPMQRDRSSMLTELRIFGITRMVLQTESSNWVVGFIPLNLDYCVADNMLKEQRWKEIAASHVEVRII

SEQ ID NO: 121649 - protein, 155 aa, Glycine max
  Coding DNA Sequence Number=SeqID_4871
  Gene Ontology: Mol. function=RNA-directed DNA polymerase activity; Cellular component=chromatin; Biological process=chromatin assembly or disassembly
MADGQTEVVNRCLEDYLSRVWERPPPIIKANTSPSKVEAGNEMVEERDGGLVAYKWKLPPSSKIHPVFHISKLKQALPPCPVQPLPDDISEEWELLPQPFEVRDFRYNKAGDLEVLIKWQNQSGFENSWDSASKMVAVSPQFHLEDKVVAFGGKY

SEQ ID NO: 121650 - protein, 168 aa, Glycine max
  Coding DNA Sequence Number=SeqID_4872
MVKSTMHSKRDNIERSLQELQGHAVQEDEWHKSMDITMRGVGAIEGTAQGNPRVSNGISAKGRRWSFTILRFQPTLAQNPFEELLGLKQEGIVSEYGDWFEEISGPLKIGNSNYMKGIFMNGLKEEIRVELNLHPLKTLEELMDLALLIEPRNMILKKEGGNAFYSAG

SEQ ID NO: 121651 - protein, 375 aa, Glycine max
  Coding DNA Sequence Number=SeqID_4873
  Gene Ontology: Mol. function=RNA-directed DNA polymerase activity; Cellular component=chromatin; Biological process=chromatin assembly or disassembly
MASTKFDIEKFTSKNNFNLWGLNVFALLIQQEFELALEGETKLPTELRSTPKNAIMKKTHMMMKFWEKSLEKRLPTCFGQSLKVAYKKKRDFAKEAEFLGHVVSARGVAADLKKVAAMLNWPGPKDTKALWEFLSLTGYYRRFVKGYGIMAKPLKDLLKKVAFQWNIEAEQAFKALKSSMAALPTSAVPNFSKQFVVESDASSKGIGAVLLPDGIPLAFFSQTLSERAQRKSVHERELMAIVLAVQKWKHYLMGRHFIIKTDQRSLKFLTDQSLLGEEQHRWTSKLLGYDSEIQYKPGYENKAADGLSRQMMYAALSRVEMHEWQKWEEEIAADSELQRLMQAVMSSPQQHMVIKFEKGSCTIMSNRILKRIFEN

SEQ ID NO: 121652 - protein, 211 aa, Glycine max
  Coding DNA Sequence Number=SeqID_4874
  Gene Ontology: Mol. function=nucleic acid binding; Cellular component= mitochondrion; Biological process=DNA integration
MAEAQSISSPMASSCKLTKIGSDLFYDPTMDRSVDTHWIAVKRIPRYLEGTILHGLHLKPAVLGHPYTIKALCDTDWASDIDDRRSPSGAAIYFAPNLISWWSRKQQVVARSSTEAEYRSLAQTTAEISWIQTLLTELRVPLNTPIVFRDNQSEVAMPIIQFFMEEQNMKIDVFFVREKVLTKQLIVHHVPALDQWQMLSPSLFLQTDLFF

SEQ ID NO: 121653 - protein, 577 aa, Glycine max
  Coding DNA Sequence Number=SeqID_4875
  Gene Ontology: Mol. function=nucleic acid binding; Biological process= DNA integration
  Homolog annotation: Hit_ID=Q1SZR1; Match level="QueryCoverage=19%, HitCoverage=87%, E-value=3e-31, Identity=59%"; Hit description =Hypothetical mitochondrial protein atmg00820 (Orf170).-related
MASIDTFNADSISSYRMPTTLKGRLMQEFFMQIKAIFDSLTLVGSLIMLQEHVDLILEGLPFDYHSVISVIQSKFETLPIAEVKALLLVHEARLNKFNKQSLFDSPSINYTQEHNKSFLSHGSDGYTVSNKSVLQSDPKSFSNFRGGFGRGGGFNNHGGDRRGGTGGGGRVRGRFAIFQCQNNFNSGYGQSNSNSGQQNGDNRACNSAPSAMLTDAPSQPNSNSVIWIPDSGASCHFIGESQNIQQIEPFEGIDRIFIGNGQDLKITSSGSSSFISPYNSKVFLSLNRFLHVPYITKNLVSVSQFARDNGFCFEFHSNYCAVKSQVTNEVFKALSANSTVNPCKKTEIHGKSINYISKDVIFNESKFPYADLFKSPSLSQSVSVSVQPPSVSVQSDSDLPQSDFVQLSNSVQSDLPQSVSVQSFNPEQTDQPTVYNTVLSSNSESSSSTTNSPSPPRPSNIHPMQTRSKSEPKSVKQALPDPNWFSAMKQEYEALMSNHTLDLVPLPPNRKAIVCKWVFRVKENADGSISKFKARLVAKGFNQVHGFDFSEIFSPMVTSVTIRLSLTEALTNQCKHA

SEQ ID NO: 121654 - protein, 233 aa, Glycine max
  Coding DNA Sequence Number=SeqID_4876
  Gene Ontology: Mol. function=metalloendopeptidase activity; Biological process=proteolysis
  Homolog annotation: Hit_ID=Q9FJT9; Match level="QueryCoverage=99%, HitCoverage=28%, E-value=1e-101, Identity=66%"; Hit description=Zinc protease PQQL-like protein
  Pfam annotation: Domain name=Peptidase_M16_C; Domain location=42-197; Score=23.0; E_value=0.00032; Accession=PF05193.11; Description =Peptidase M16 inactive domain
MAEEAVSAQDRDPYTAFTNRVKELNYGNSYFFRPIRKSDLQKVDPRKACEFFSTCFKDPSAFTVVIVGNIDPTIAMPLILQYLGGIPKPPEPVMHFNRDELKGLPFTFPTSIHREVVRSPMVEAQCLVQICFPVELKNGTMVEEIHFVGFLSKLLETKIMQVLRFKHGQVDIALDEMLRLQEEGPSEQDVSTILEIEQRAHENGLQENYYWLDRILHSYQSRVYSGDVGTSFE

SEQ ID NO: 121655 - protein, 45 aa, Glycine max
  Coding DNA Sequence Number=SeqID_4877
MESGEEPQPGHTMILAGVTGLAVLAFSLWRRAQNNSRHLLSRGAN

SEQ ID NO: 121656 - protein, 119 aa, Glycine max
  Coding DNA Sequence Number=SeqID_4878
MVPFCKLIPQMGSFWNNFRHGVVFYVGCMHFACKTQARMATSWAEDTWKPNPPVLLATSGGSVSRQLYWRLRPCAKIAALTGDFRGYHARVQDAHKPFPRELQTATATRREAGNRQFDW

SEQ ID NO: 121657 - protein, 142 aa, Glycine max
  Coding DNA Sequence Number=SeqID_4879
  Gene Ontology: Cellular component=integral to membrane; Biological process=vesicle-mediated transport
  Homolog annotation: Hit_ID=O23429; Match level="QueryCoverage=95%, HitCoverage=58%, E-value=1e-55, Identity=85%"; Hit description =Vesicle-associated membrane protein 724
  Pfam annotation: Domain name=Synaptobrevin; Domain location=70-136; Score=8.8; E_value=0.0071; Accession=PF00957.11; Description =Synaptobrevin
MQPLDGSYCVVAKESVSKQISIAFLERVKADFKKRYGGGKADTAIAKSLNKEFGPVMKEHMKYIINHAEEIVKLIKVKAQVSEVKSIMLENIDKALDRGENLTILADKTEALRSHAEDFLNFRLKISESKEHKFVGRCGIRT

SEQ ID NO: 121658 - protein, 105 aa, Glycine max
  Coding DNA Sequence Number=SeqID_4880
  Homolog annotation: Hit_ID=Q6RIB0; Match level="QueryCoverage=99%, HitCoverage=100%, E-value=5e-33, Identity=68%"; Hit description =Flowering promoting factor-like 1
MAEVWVFKTGVVRLEEKPCGYEHKVMKKVLFHTASNEVITSYAVLEHKLSSLGWGRYYDDPDLLQFHKRSTVHLISLPRDFNKFRATHRYDIIVKNQNCFQVRDV

SEQ ID NO: 121659 - protein, 55 aa, Glycine max
  Coding DNA Sequence Number=SeqID_4881
MGVELQSLPPFSSDEVYGVWDLHANLPAPHVLADMLVSGFGSNVDDAWRAEEEKI

SEQ ID NO: 121660 - protein, 36 aa, Glycine max
  Coding DNA Sequence Number=SeqID_4882
MEVDAVVMKLMDDDVKVECQYLWSFSKVILCAQWDH

SEQ ID NO: 121661 - protein, 288 aa, Glycine max
  Coding DNA Sequence Number=SeqID_4883
MMQSYPARALDRGLQVDWARDPREGPRVLIRLREASQGGDLSYERGVCSKALASQGSFLKEASHGSFLKKASQGSYLARLGGEAPSSMAYSLLKDPTSIEAPQASFHHLGGMKKVMKEDIKGIREKVILRPIEVEQIFSYDNEERKDTERNRDYPVDTWEKMKRSRSVDEYFKEIEVAMIRASVVEEREATMVRFLYGRLPYTSQGSISNDSCPNSPPTSEGEEEYDEAYALDGDFGSCTNVASKRMDTKLNLKTIAHPKPCKLRWLSEEREREFFLDQQVLINFPTG

SEQ ID NO: 121662 - protein, 154 aa, Glycine max
  Coding DNA Sequence Number=SeqID_4884
  Subcellular localization annotation: CTP_CleavageSite=59; ConfidenceScore=5.15e-01
MLGKEVIIISTMTIAKVIGCEPGTSLKGTRTSTRKLKSSNRFVTRVFYTRRKAKSITVLDDMKERVDKFGVTKGANKVVKIQFTAKQQEGLAQQESRTKTRQESKASSPPAPQVKGPRTTPTRKSPRKYVLEKTTNKRLRELSESGVDDDAPLI

SEQ ID NO: 121663 - protein, 140 aa, Glycine max
  Coding DNA Sequence Number=SeqID_4885
  Gene Ontology: Mol. function=RNA-directed DNA polymerase activity; Biological process=RNA-dependent DNA replication
EFKDVFPKEIPYGLPPSRSIEHQVDLFPEASSPNRPTYNNKTQETRHKDAEAKFEYVKRLFDQVKVQIAKKNESYAKQANKKRKEVVLEPDDDPGHLRANVFQEGGNDENLETSQIQAKGPSREGQRPKWRRTKPSSGEG

SEQ ID NO: 121664 - protein, 141 aa, Glycine max
  Coding DNA Sequence Number=SeqID_4886
  Pfam annotation: Domain name=G-patch; Domain location=35-79; Score =4.8; E_value=0.047; Accession=PF01585.13; Description=G-patch domain
MEATEEFLETAFQAFKVVSNAYVESPPVQPRSSEAALMVARVMLGHGYEPDMGLGWKNNGVASLIEFIGKCRRFRLGNKPTRADVRRFSLERRGRSIGHSHGPQMKGVPLCHIDKTFVSAGWMCEGRVAMIHEETPQEKPN

SEQ ID NO: 121665 - protein, 114 aa, Glycine max
  Coding DNA Sequence Number=SeqID_4887
MTELNQTSEKKTYQGNPCGVYPDLSSFTGSGVYPDLSSLTGSGVYPDLSSFTGRGVYHDLSSFTGSGVIQTFVACIKRSTPTQVHIITFHSEVQFKRITYRDARNRTTKALGEI

SEQ ID NO: 121666 - protein, 95 aa, Glycine max
  Coding DNA Sequence Number=SeqID_4888
MASRASVKFMKTLSKPISLNIGEREEEKEENQALYASMGVQIAILGELGVNLLPPFSINRQREAGPNPYSLGYAFQLFWVKKIVSVKKIQAEVLP

SEQ ID NO: 121667 - protein, 62 aa, Glycine max
  Coding DNA Sequence Number=SeqID_4889
  Subcellular localization annotation: CTP_CleavageSite=46; ConfidenceScore=5.07e-01
MLQPYGISVGLKEHSNSVTPKAYTPKSPSGPLPPDSVLTCHLLRILALTRRPKRDLTLTRRP

SEQ ID NO: 121668 - protein, 87 aa, Glycine max
  Coding DNA Sequence Number=SeqID_4890
MEMQRKTKEKRLCSIVMIGYELGADEARGTGAISGEGRVEVDGDEVEGAVVSGGVEVDGALDPLALDLWVPGKVIEGSSRFHQFFII

SEQ ID NO: 121669 - protein, 86 aa, Glycine max
  Coding DNA Sequence Number=SeqID_4891
RKHRDNEKILSLWFNDQAAKIMKGVFVLSSRIDKPFCKYDGFTTRKCVAKVYINIVDLSLVESVRIPYMKNLPPYYILDACCSVCI

SEQ ID NO: 121670 - protein, 80 aa, Glycine max
  Coding DNA Sequence Number=SeqID_4892
MAKFDPKIVLEFYANAWPTEEGVRDMRSWFWRKASSVSPARGGTRPTGSMRKPFPNCCAHRGRISPGPLQGGGCGSCAPA

SEQ ID NO: 121671 - protein, 290 aa, Glycine max
  Coding DNA Sequence Number=SeqID_4893
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=2e-36, Identity=32%"; Hit description= UPI00006A17C9 related cluster
MPSLQRTMRLHLQRAYPLAFRGLHVLPFRGLHVLGFGGLHVLTFRGLHVLGFRELHVLSIRGLHDLIFRGLHVLVLRGLHALTFVGLHALTFRGLHVLEFIGLHALSFRGLYVLQFRGLHLLTFRGLNVLGFRGLHIPTFRGLHVLTFRGLQVLSFRGPHALAFRGLHVLATKGHTPSPSAARPRLQRTTRPPLQRTTCPYLQRTTCPYLQRATRPQPQRTRRPHLQRTTRPHLQRTARPRLLRATRPRLQRTPCPPLQRTASPRLYRTTRPHLRRAACRHLHRATCPHL

SEQ ID NO: 121672 - protein, 1122 aa, Glycine max
  Coding DNA Sequence Number=SeqID_4894
  Homolog annotation: Hit_ID=Q1SPJ4; Match level="QueryCoverage=95%, HitCoverage=70%, E-value=0.0, Identity=49%"; Hit description=Thiolase
  Pfam annotation: Domain name=GCC2_GCC3; Domain location=819-876; Score=5.1; E_value=0.03; Accession=PF07699.3; Description=GCC2 and GCC3
MAHTLHKPFSILLLLYFTFSFASQHSHHGFSILDSDFDALYGDYTPPSPPPPPPLPHPPSLTCLEGLNGTGSLTTTCDLNSSLIFNSDVYIEGNGSLNILPGVNLSCPVSGCVILINVSNEFSLQSGAAIVAGTVLVASRNATLFGGSVINVTGLAGAPPAQTSGTPSGTQGAGGGHGGRGATCVSDNTKLPDDVWGGDAYSWSSLDEPWSYGSKGGTTSKEEKYGGEGGGRIKFAVVDSIDVSGDLLANGGDGGMKGGGGSGGSIYVKAHRILQLIVSSTKCRTGTGTISATGGGGFAGGGGGRVSINVFSRHDNTKFFIHGGISLGCSRNAGAAGTYYDAVPRSLTICNHNLSTQTDTLLLEFPKVPLWTNVYVQNQAKALFPLYWSRVQVGGLIRLTYGAVLSFGLAHYGSSEFELMAEELLMSDSVVKASRTIRLLFLRTIIYGALRMSVKIHLMLNSKMLIDANGDQIVATSLLEASNLVVLKDSSVIHSNANLGVHGQGSLNLSGAGNLIEAQHLILSLFFSINVGPGSVLRGPLEASGDDMTPQLYCEVENCPVELLHPPEDCNVNSSLAFTLQICRVEDVIVEGTITGSVVHFHWIRNIDVSYSGVISVSGLGCTGGLGRARYFENGIGGGGGHGGYGGDGYYNGNFIEGGSTYGDVDLPCELGSGSGNNSLAGATAGGGIIVMGSLEHSLSSLTLNGSLRADGESFGDDPRGKDGGITSSIGPGGGSGGTVLLFIQTLALGDSSIISTAGGQGSPSGGGGGGGGRVHFHWSNIPVGDEYVPLASVKGSIITGGGFGGGQGLPGKNGSISGTACPRGLYGIFCEECPVGTYKDVSGSDRALCHDCPPDELPHRAIYISVRGGVAETPCPYKCISDRYHMPNCYTAFEELVYTFGGPWLFGLLLLGLLILLALVLSVARMKYVAGDDLPAVTPARNDTRLNHSFPFLESLNEIMETNRSEESQSHVHRLYFHGPNTFSEPWHLLHCPPEQVKDIVYEDAFNRFVDDINSLATYHWWEGSIYSILCIIAYPLAWSWLQMCRRKKLQKLREFVRSEYDHACLRSCRSRALYEGLKVLQSKFYEFVPYPKLGSWHTKFLSQFIHYCPTELNLRYVYTI

SEQ ID NO: 121673 - protein, 83 aa, Glycine max
  Coding DNA Sequence Number=SeqID_4895
ELSELKKTLNVEVDQLRAEFQDLRTTLQQQQEDVTASLRNLGLQDVSDVKHAPSQETKIEEIVKEEQVVVPEEDNSSKDLNQW

SEQ ID NO: 121674 - protein, 125 aa, Glycine max
  Coding DNA Sequence Number=SeqID_4896
  Gene Ontology: Mol. function=inositol oxygenase activity; Cellular component=inclusion body; Biological process=L-ascorbic acid biosynthetic process
  Homolog annotation: Hit_ID=Q9FJU4; Match level="QueryCoverage=61%, HitCoverage=25%, E-value=3e-28, Identity=71%"; Hit description =Inositol oxygenase 5
  Pfam annotation: Domain name=DUF706; Domain location=11-114; Score= -50.8; E_value=1e-11; Accession=PF05153.6; Description=Family of unknown function (DUF706)
MVHHLSLAGKYGDASGQKENMNQMSQSFLSQLKGDTFPVGCAFDKANIHDKDNPDSEYPANNTKKGIYAEGCGLENVTMSWEHDEYMYMVAKENSTTLPSTGLFIIRFHSIICVFVHILSSQLFT

SEQ ID NO: 121675 - protein, 377 aa, Glycine max
  Coding DNA Sequence Number=SeqID_4897
  Homolog annotation: Hit_ID=Q1SPJ4; Match level="QueryCoverage=99%, HitCoverage=25%, E-value=1e-103, Identity=51%"; Hit description =Thiolase
VAATSDLMLGYLDFFLGGDEKRPDLPPRLYQRFPMSIIFGGDGSYMSPFSIHSDNILTSIMSQSVPPTIWYRLVAGLNAQLRLVRRGHLKITFGPVISWLDVYANPKLATYGVRVDLAWFQPTASGYCQFGLVVYATENESMSSSCEGYDDSRITEKETCLLSSPRNPARYMRSNEHLMMPRRISGGILHAKSLRTLKEKKTVCYPFAFIIYNTKPVSHQDLVGLVISIILLGDFILVLLTLLQMYSLSLLSFFLVLFVLPLGVLFPFPSGISALFSQGPRRSAGLARLYALWNLMSLVNVVVAFFCGFIHYTARSHKLYNFQSWNFSMDESEWWILPSGLALCKIIQARLVDCHVANQEIQDPSLYSSDTNVFWNS

SEQ ID NO: 121676 - protein, 266 aa, Glycine max
  Coding DNA Sequence Number=SeqID_4898
  Gene Ontology: Mol. function=transferase activity; Cellular component= mitochondrion; Biological process=ubiquinone biosynthetic process
  Homolog annotation: Hit_ID=O65576; Match level="QueryCoverage=99%, HitCoverage=50%, E-value=1e-107, Identity=63%"; Hit description=ABC1 protein
  Pfam annotation: Domain name=ABC1; Domain location=1-91; Score=85.0; E_value=2.3e-22; Accession=PF03109.7; Description=ABC1 family
VHQAVMKDGMQVAMKIQYPGVADSIDSDIENVKLLLNYTNLIPKGLYLDRAIKVAKEELSRECDYKLEAANQKRFRDLLTGTDGLYVPIVVDDISSKRVLTTELVHGCSLMQTDPNWGNFLFDEATKTINLIDFGAAPCANGDSDGVVEMSRRLGFLTGMESDVMLDAHVQAGFIVGLPFSRPGGFDFRSTNITQSISHLGATMLRHRLTPPPDEAYSLHRKLSGAFLACIKIGAVVPCRELLLEVYKHHKFGEENEILSTGSVSA

SEQ ID NO: 121677 - protein, 97 aa, Glycine max
  Coding DNA Sequence Number=SeqID_4899
MDLATSIDEGYVQKFTRVVKEFNSITPLVYFYIQIRELSQGASGNEKEQLTSEDGVGVILRRKAARELRLGFHGGGEGGHKLAWITSLSLLPVQDNF

SEQ ID NO: 121678 - protein, 298 aa, Glycine max
  Coding DNA Sequence Number=SeqID_4900
  Homolog annotation: Hit_ID=O65576; Match level="QueryCoverage=44%, HitCoverage=21%, E-value=2e-40, Identity=66%"; Hit description=ABC1 protein
  Subcellular localization annotation: CTP_CleavageSite=44; ConfidenceScore=5.27e-01
MASFRDLTRLFNGFSLIANQFAKRSLPNSTTSDFQTLIKKALVSATDLSGITKGKVRHFPDTPPSSTATRRHDAAASSSVVFFSDDIPSSQSHSTPTTTTTVTNIDDVAKSSSDANHDAKEEKSEVVTSAETVNQVESEEVAPALAPSPPPLRKRRPRERKVPATPFSRAIGFAGLGAGLAWGTLQESAKRLAFGTPTTQGNQSALSPFLSEKNAERLALALCRMRGAALKIGQMLSIQDESLVPAPILAALEIVRQGADVMPKSQLNQVLNAELGPGWSSKLISFDYEPIAAASIGQ

SEQ ID NO: 121679 - protein, 120 aa, Glycine max
  Coding DNA Sequence Number=SeqID_4901
  Gene Ontology: Mol. function=peptidyl-prolyl cis-trans isomerase activity; Cellular component=chloroplast; Biological process=protein folding
  Homolog annotation: Hit_ID=Q41651; Match level="QueryCoverage=98%, HitCoverage=28%, E-value=1e-20, Identity=48%"; Hit description =Peptidyl-prolyl cis-trans isomerase, chloroplast precursor
  Pfam annotation: Domain name=Pro_isomerase; Domain location=11-116; Score=-12.8; E_value=5.3e-06; Accession=PF00160.11; Description =Cyclophilin type peptidyl-prolyl cis-
MANAGTNTNGSQFFICTVQGIIFADTEVPYIDLRFLNQFNNYGDNITAIETMEPQSRIHKSKRNYSVIQTPWLDNRHVVFGHVIDGMDVVRTLESQETGKFDNPRKPCKIADSGELPIDS

SEQ ID NO: 121680 - protein, 270 aa, Glycine max
  Coding DNA Sequence Number=SeqID_4902
  Gene Ontology: Mol. function=mitochondrial processing peptidase activity; Cellular component=mitochondrial respiratory chain; Biological process=electron transport
  Homolog annotation: Hit_ID=P29677; Match level="QueryCoverage=99%, HitCoverage=45%, E-value=8e-77, Identity=56%"; Hit description =Mitochondrial-processing peptidase alpha subunit, mitochondrial precursor
  Pfam annotation: Domain name=Peptidase_M16_C; Domain location=1-150; Score=78.0; E_value=3e-20; Accession=PF05193.11; Description =Peptidase M16 inactive domain
PLLSDLPSVPRPEEPKSVYTGGDYRCQKESGRTHFALAFELPGGWHKLKDAMVLTVLQMLLGGGGSFSAGGPGKGMYSRLYQNVLNEYPQVHEISAFNNIYNDTGIFGIQVTTGSDFVSKAIDIAANEILAVATPGQVDQVQLDRAKQATKSAILMNLESRMVVSEDIGRQILTYGERYGSHFIFFGGLVSWCIAILFCNEYKSADMMLKDVFSLLRKPVEDFLKAVDEVTSKDITSISRKLICSPLTMASYGDVLYVPSYESVSLKFRA

SEQ ID NO: 121681 - protein, 238 aa, Glycine max
  Coding DNA Sequence Number=SeqID_4903
MAYWFNLQRKDQGGPDLEDILEGSDFLSFIPDRYKVRFYLIAKSTLYETNWQPHLWLNINSGMFWGGGGDKGGIVGSGGDDNDMVVKLMVVMEAMSVATMVTMTCDAGSEVVVVVAMTKAVFGGGNDGGGGGGKGGGNKKYHCRMWEMPVLVQKMFKNTFQYGFLSNGFITSMHTPSSTKDSSDTSSSSKVVGSDLEAQYNKDLNLKEHGLGVDREWKTQCDSGETGMARIVSVVLSS

SEQ ID NO: 121682 - protein, 183 aa, Glycine max
  Coding DNA Sequence Number=SeqID_4904
  Gene Ontology: Mol. function=enzyme inhibitor activity
  Homolog annotation: Hit_ID=Q1RYM1; Match level="QueryCoverage=97%, HitCoverage=100%, E-value=7e-39, Identity=46%"; Hit description =Pectinesterase inhibitor
  Pfam annotation: Domain name=PMEI; Domain location=38-176; Score=3.1; E_value=0.008; Accession=PF04043.6; Description=Plant invertasepectin methylesterase inhibitor
MNSSTPCSLLFTLCLILIISQSPLPTNARAHGHYMIGQICKQLTRQEDKIKCPIILRANPKILRAKNYLEFSSAVLELGMHKGIEGQKFLKGLVKAKSSPAIAECANFCYDAVVNGFKGAMNELKDDPMTANYDAGVVSDGPATCERALADEHIVDPAISALNNRIMLLSAIASYAIDKLIAN

SEQ ID NO: 121683 - protein, 257 aa, Glycine max
  Coding DNA Sequence Number=SeqID_4905
  Gene Ontology: Mol. function=nucleotide binding; Cellular component =membrane; Biological process=phosphate transport
  Homolog annotation: Hit_ID=P76116; Match level="QueryCoverage=95%, HitCoverage=71%, E-value=1e-44, Identity=38%"; Hit description =Hypothetical protein yncE precursor
  Pfam annotation: Domain name=SGL; Domain location=2-237; Score= -117.4; E_value=0.076; Accession=PF08450.2; Description=SMP -30GluconolaconaseLRE-like region
MTASPDGSVLYITNTLDGGVTKVDARSGKVLQRLLFGLKNDKGNPIGAREILLHDGLLYIGAIENPAMIWVVDANTLRLKTTIKNAGKWVTGLLYSASTDRIYAANGSGEVLVINPRTHKIEQRWTPGDGKEYLLLNLAEDAANGRLYVTDNSKGKTTLVFDERSGKVIKRLDVGDSLGIKFNAKRNEIYISQRLGGKVLQLDATTYAVKNSWTLPTHPNSLLVSPDGQTLYVTVKQGLNKDRSPQGPDSVVRITLD

SEQ ID NO: 121684 - protein, 247 aa, Glycine max
  Coding DNA Sequence Number=SeqID_4906
  Gene Ontology: Mol. function=transferase activity; Cellular component= soluble fraction; Biological process=nitrate assimilation
  Homolog annotation: Hit_ID=Q5PMP5; Match level="QueryCoverage=97%, HitCoverage=84%, E-value=2e-98, Identity=72%"; Hit description =Possible transferase
  Pfam annotation: Domain name=GST_C; Domain location=102-204; Score =29.2; E_value=1.4e-05; Accession=PF00043.15; Description=Glutathione S-transferase, C-terminal domain
  Pfam annotation: Domain name=GST_N; Domain location=2-81; Score=14.4; E_value=0.036; Accession=PF02798.10; Description=Glutathione S -transferase, N-terminal domain
  Pfam module annotation: Pfam domain module=GST_C::GST_N; Domain location=102-204::2-81
LYSLGTPNGQKVTILLEELLALGVQEAEYDAWLIRIGDGDQFSSGFVEVNPNSKIPALRDHSITPPLRVFESGNILLYLADKFGHFIPSDVAGRTETLNWLFWLQGSAPYLGGGFGHFYHYAPEKIEYAINRFTLEAKRQLDVLDRQLADHRFLAGDEYTIADIATWPWYGNLVLNNQYGGGEFLDVQSYKNVVRWAKEIADRPAVIRGRKVNRAFGAEPQDQLLERHDASDFDTNTEDKRQARGEQ

SEQ ID NO: 121685 - protein, 149 aa, Glycine max
  Coding DNA Sequence Number=SeqID_4907
  Homolog annotation: Hit_ID=Q1T344; Match level="QueryCoverage=74%, HitCoverage=40%, E-value=1e-15, Identity=35%"; Hit description=RNA polymerase, RBP11-like
MMKEKKEFPKLDIGKQPGRKTFVILGYEKGDKYRQYKKDTKIVTRTKKCYCLFRLKGRPLKTSEGWVLRVLCGSHNHDIAKTLVDYPYVGRLTLDEKTMLIDMTKSMVKPKNILLTLKEHNDKNVTTVRQVYITRTTYRRSLRGPRIEM

SEQ ID NO: 121686 - protein, 140 aa, Glycine max
  Coding DNA Sequence Number=SeqID_4908
MSEEEDKVQEQIKADIEALKEKMATMMEAMMSMKKIMEVNAVAVAATSVVAKKGKELGSTGGPHFVQVQNKHAFPPYGLPPNYTPPNMVHTPNENVNDSTPILIKSQQPQSDHAPIPQPMGATHEIPHHNLANFEPCLEY

SEQ ID NO: 121687 - protein, 568 aa, Glycine max
  Coding DNA Sequence Number=SeqID_4909
  Gene Ontology: Mol. function=protein binding; Cellular component =intracellular; Biological process=defense response
  Homolog annotation: Hit_ID=Q1SVX0; Match level="QueryCoverage=98%, HitCoverage=73%, E-value=1e-138, Identity=47%"; Hit description =Disease resistance protein
  Pfam annotation: Domain name=LRR_1; Domain location=415-436; Score =5.8; E_value=24; Accession=PF00560.23; Description=Leucine Rich Repeat
  Pfam annotation: Domain name=LRR_1; Domain location=438-460; Score =13.6; E_value=0.73; Accession=PF00560.23; Description=Leucine Rich Repeat
  Pfam annotation: Domain name=LRR_1; Domain location=462-484; Score =13.4; E_value=0.84; Accession=PF00560.23; Description=Leucine Rich Repeat
  Pfam annotation: Domain name=LRR_1; Domain location=486-508; Score =10.6; E_value=3; Accession=PF00560.23; Description=Leucine Rich Repeat
  Pfam annotation: Domain name=LRR_1; Domain location=510-532; Score =11.0; E_value=2.5; Accession=PF00560.23; Description=Leucine Rich Repeat
  Pfam annotation: Domain name=NB-ARC; Domain location=2-197; Score= -115.3; E_value=0.0062; Accession=PF00931.13; Description=NB-ARC domain
  Pfam module annotation: Pfam domain module=LRR_1::LRR_1::LRR_1::LRR _1::LRR_1::NB-ARC; Domain location=415-436::438-460::462-484::486 -508::510-532::2-197
VPEFQSDDDAVYQLENLLKQIGKNPILLVLDDVPSESVSLVDKFVFQIPKYKILVTSRITIRGFDQPYVLKSLNEVDAINLFRHSASLNQSSSDIPENIVKKIARGCSGSPLALIVTGKSLSREPPWAWNNRAKKLSKGQPILAFSADVLTCLQKSFDDLDPKVAECFRDLSLFPEAQRIPAAALVDIWAELRDEDDDSAMENIYELVKRNMADIVVTRYGKCFLKDDTNISSGTIDYNYHYVTQHGLLRDLAILQTNKELMKKRNRLIIDVSGNNLPDWWTTQNEYHIAAHSLSISTDDTFTSEWCNLQASEVEVLVLNLREKKRSLPMFMEKMNKLKVLIVTNYEFYRADLENFELLDNLSSLKRIRLEKVSIPFLSNTGVQLKNLHKFSFFMCNVNEAFKNSTIQVSKVFPNLEEMNIDYCDMVELPIGLSDIVSLKKLSITNCHKLSALPEGIGKLVNLESLRLTSCTKLEELPESITSLSKLNFLDISDCVSLSKLPENMGELRSLENLNCRGCTRLTDLPYSITELESLSAVVCDEETAALWEPFKTMLRDLKLKDENREGK

SEQ ID NO: 121688 - protein, 128 aa, Glycine max
  Coding DNA Sequence Number=SeqID_4910
MAETEDSGAYLHGRRSLDGGRWFVAPLHGNKKNKNQTQAPLHGNNEEEGSARKTGLRGHQHNMKMALRKKKNQRLCEEEEESKGLCEEEEEEEETATERKSNGRESHAFFKKITQGYYDLFTSSVGCT

SEQ ID NO: 121689 - protein, 77 aa, Glycine max
  Coding DNA Sequence Number=SeqID_4911
YEQLCKWDQQSFIIRVIKHSGICSGDSKILQVASRFQDVKTSHVTSAFCSPCLHAPTTVKQFTAASSSSLQQSSSEQ

SEQ ID NO: 121690 - protein, 102 aa, Glycine max
  Coding DNA Sequence Number=SeqID_4912
MLVYGWLWKGVFCLCPVFLAVLVHDAWILNYLDVVEAWEDLWGPDVERNEDKGYVGVRELNEGGQLGMVGLCVICGCGELICTIARLPPSTTCDGYPIILQA

SEQ ID NO: 121691 - protein, 48 aa, Glycine max
  Coding DNA Sequence Number=SeqID_4913
MGTIDIGLVYHGDTSCALAGYLDFDYAVDLDARRTMTSFYGGRVFELQ

SEQ ID NO: 121692 - protein, 59 aa, Glycine max
  Coding DNA Sequence Number=SeqID_4914
  Subcellular localization annotation: CTP_CleavageSite=47; ConfidenceScore=5.24e-01
SLEDLVKPENPHNKRLKSYKSYAGGGSVTNFMGSNSRPSIPSHRSTSTNTIPNQTVLFA

SEQ ID NO: 121693 - protein, 770 aa, Glycine max
  Coding DNA Sequence Number=SeqID_4915
  Homolog annotation: Hit_ID=Q6F2V0; Match level="QueryCoverage=99%, HitCoverage=85%, E-value=0.0, Identity=47%"; Hit description =Expressed protein
MATLCSSSVDRSSFTDWMRDRPELYSIIRRASPGAAVKLCLGDLLVMGSNPETASLHMQGLLRRNPMGALGYSNLKPSLKKIAESTDGRPSEMSVVAALRNGEVLGSQTVLKSDHCPGCQHPRLPERVEGAPNFREVPGFPVYGVANPTIDGIRSVIRRIGSSKGGRPVLWHNMREEPVIYINGKPFVLREVERPYKNMLEYTGIGRERVEKMEARLKEDILREAEQYGNAIMVIHETDDGHIYDAWEHADGFPIKYARVPITDGKAPKSSDFDTVAFNIASAAKDTAFVFNCQVVSSSFISSSVFFVDIFIYISVYWFFSCLVFLFSSFTANIPFIYQMGRGRTTTGTVIACLVKLRIDYGRPIKILRDDMTREEADGGFSGGDEVGGYVTALTPDTLQIMPDEKQSHAFGINDILLLWKITAFFDNGVECREALDAIIDRCSALQNIRQAVLEYRKVFNQQHVEPRVRRVALYRGAEYLERYFRLIAFAAYLGSEAFDGFCGQAEYKMAFKNWMHERPEVQAMKWSIRLRPGRFFTVPEELRAPQESQHGDAVMEAFVKARSGSVLGKGYILKTYFFPGQRTSSHIQIHGAPHVYKVDEFPVYSMATPTISGAKEILSYLGAKPKANVSSAQKVILTDLREEAVVYIKGTPFVLRELNKPVDTLKHVGITGPAVEHMEARLKEDILAEIRQSGGLMLFHREEYDPSTNKSSVVGYWENILADDVKTPAEVYSTLKDEGYDIIYSRIPLTRERDALASDIDAIQYCKDE

SEQ ID NO: 121694 - protein, 69 aa, Glycine max
  Coding DNA Sequence Number=SeqID_4916
MLSCERELAAPQNHMYQQWVYTSSTPSHSSITDSTGNNSSESGLIEKYNPNLLPSSAHHCSIQQVSALW

SEQ ID NO: 121695 - protein, 134 aa, Glycine max
  Coding DNA Sequence Number=SeqID_4917
MSTQRESTESGAMRKRMKHEVAEKAGDEAESKTVEEEEFETNIAGSEEMELSVSLILEKIESYTQRVSELLESGKTMLKELSDEFEEKLIMIHKEQVEKWQEEIRELRALDASNEEANALLHNARHLLQPTRDH

SEQ ID NO: 121696 - protein, 102 aa, Glycine max
  Coding DNA Sequence Number=SeqID_4918
MTKLRSCIHPCRKFHVRRRGAVKETSRERVYREMGLKTAAKHVPQQTQIGFLNNHKLEPGKDGLNPRIDPRDVGEQNGGSGKTKIDRVVLARPSHASNDKII

SEQ ID NO: 121697 - protein, 96 aa, Glycine max
  Coding DNA Sequence Number=SeqID_4919
MQQGQAVILIARFPDSNYGIKTNNGGLWWLLVAMGDGEKAWNAGNGFGRKKGEEMAFFLSYLDYKAQNAQVSNALGNGNVAHTPEIFTKIPTVRSW

SEQ ID NO: 121698 - protein, 63 aa, Glycine max
  Coding DNA Sequence Number=SeqID_4920
MAIMKDLGKKGKEAVKEDWWVTMTFVAMMGGDPIARDNGKGDKINLRIHNNCTLWITCDSGPP

SEQ ID NO: 121699 - protein, 209 aa, Glycine max
  Coding DNA Sequence Number=SeqID_4921
  Homolog annotation: Hit_ID=Q6F2V0; Match level="QueryCoverage=98%, HitCoverage=84%, E-value=1e-90, Identity=58%"; Hit description =Expressed protein
MTSIPKEPEEVMKRRGGSVLGKKTILKSDHFPGCHNKRLHPHIDGAPNYRQAESLLVHGVAIPTTDGIRNVLKHIGARAEGKKAQVLWINLREEPVVYINGRPFVLRDVERPFSNLEYTGINRERVEQMEARLKEDILMEAARYENKILVTDELPDGQMVDQWESVSCNSVKTPLEVYQELQVAGYLVDYERVPITDEKSPKEWDFDIL

SEQ ID NO: 121700 - protein, 227 aa, Glycine max
  Coding DNA Sequence Number=SeqID_4922
  Homolog annotation: Hit_ID=Q1SU13; Match level="QueryCoverage=87%, HitCoverage=44%, E-value=2e-37, Identity=42%"; Hit description=IMP dehydrogenase/GMP reductase
MLMLRKVAIRTELATENGLSYISLNLENHGAAFRFASELKDEARVRFGADHEVKLGGWFIIIIIVGPTTEVEPAVMEGVGVREGSGEVNGEVEAAQKLGAADPAGAAHWAVVDGESEGEGLGGEAAEGGGVEVEGGGGGGGVGGRGGGREREEGGVGRESVDTDFAEAGGGGRVDTGEGWGFGRRGRELESEGFHQEAKEGARVHDSGSDIGNIYLCGLQIWLSASG

SEQ ID NO: 121701 - protein, 152 aa, Glycine max
  Coding DNA Sequence Number=SeqID_4923
  Gene Ontology: Mol. function=nucleic acid binding; Cellular component= oxygen evolving complex; Biological process=DNA integration
MISKELNLWYNAMKDEMDSMVSNQVWDLVELPDGVKAIGCIWVFKTKKDSQGSIERRKARLVAKGFTQREGINYIKTFSLVSKKDFFRVIMTLITHFDFEIHQMDVKTIFLNGHLEEKVYMKQLEGFSSSDNEHLVCKLNKSIYGLKQVSRQ

SEQ ID NO: 121702 - protein, 164 aa, Glycine max
  Coding DNA Sequence Number=SeqID_4924
  Gene Ontology: Mol. function=ATP binding; Cellular component =chloroplast
  Homolog annotation: Hit_ID=Q2PMM5; Match level="QueryCoverage=100%, HitCoverage=7%, E-value=4e-83, Identity=92%"; Hit description =Protein ycf2
MEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDL

SEQ ID NO: 121703 - protein, 108 aa, Glycine max
  Coding DNA Sequence Number=SeqID_4925
  Gene Ontology: Mol. function=actin binding; Cellular component=actin cytoskeleton; Biological process=actin cytoskeleton organization and biogenesis
  Homolog annotation: Hit_ID=Q9M7N0; Match level="QueryCoverage=80%, HitCoverage=55%, E-value=2e-27, Identity=71%"; Hit description =Profilin-3
  Pfam annotation: Domain name=Profilin; Domain location=3-108; Score =51.5; E_value=2.8e-12; Accession=PF00235.9; Description=Profilin
MKENVIGWQELNGGHHLTAAAIIGHDGSVWAQSSSFPQARNNFLFILFAHSTPIRPQEITDIMKDFDEPGHLAPTGLHLAGTKYMVIQGESGAVIRGKKVSRHAILHL

SEQ ID NO: 121704 - protein, 153 aa, Glycine max
  Coding DNA Sequence Number=SeqID_4926
  Gene Ontology: Mol. function=protein binding; Cellular component =endoplasmic reticulum; Biological process=retrograde protein transport, ER to cytosol
  Homolog annotation: Hit_ID=Q8VZU9; Match level="QueryCoverage=68%, HitCoverage=39%, E-value=2e-37, Identity=72%"; Hit description =Derlin-1
  Pfam annotation: Domain name=DER1; Domain location=22-141; Score =55.3; E_value=2e-13; Accession=PF04511.5; Description=Der1-like family
MKKKISCSVSAGWGGDGFYHSLPPITKAYGTVCLLATATYHLGLDHPAYIALLYDKVFYGFQAWRLFTNLFFLGPFSINFGIRLLMIVRYGVQLEKGPFDRRTADFLWMMIFGAFALLLYSVESILVVLVYGSGQEDDKPSFWIKMENLIGLI

SEQ ID NO: 121705 - protein, 81 aa, Glycine max
  Coding DNA Sequence Number=SeqID_4927
MWGTAIGCCGIGGDRRERGCPALGAGGIGEREGEGSPALGAGGIGGERREGWDAATGCCGTGLMRQHEALHGSRVQALFQF

SEQ ID NO: 121706 - protein, 60 aa, Glycine max
  Coding DNA Sequence Number=SeqID_4928
MAGVGDSGGEYHQLDGAQHLEGNDGPRQNRMEGQNKIEGVKLNVPPFKGRSDPDTTKTGR

SEQ ID NO: 121707 - protein, 124 aa, Glycine max
  Coding DNA Sequence Number=SeqID_4929
MEMTLVRANIEEETEDTMTRFLNGLNPDIRDVVELHELNNSSRGKVQQEETYPILSTRTRPTVLRRREATNPVHQQRPHMERRLHIAYECPTRRTMIMKAYGKITSESEISEEEVEEKLKEEAI

SEQ ID NO: 121708 - protein, 40 aa, Glycine max
  Coding DNA Sequence Number=SeqID_4930
MALKRDAHLLRIKAHATCGREDEVDHDLYYCEAVSHTVAT

SEQ ID NO: 121709 - protein, 76 aa, Glycine max
  Coding DNA Sequence Number=SeqID_4931
SGEKMKNKKVAVVGVSLSEAYALSKQHPLSETSAHLASEKNLEENLPRMHALSASSARSASSFKDRKSLKAEVGEK

SEQ ID NO: 121710 - protein, 53 aa, Glycine max
  Coding DNA Sequence Number=SeqID_4932
  Gene Ontology: Mol. function=actin binding; Cellular component=actin cytoskeleton; Biological process=actin cytoskeleton organization and biogenesis
  Homolog annotation: Hit_ID=P49231; Match level="QueryCoverage=81%, HitCoverage=33%, E-value=5e-17, Identity=90%"; Hit description =Profilin-1
MAGACRCTAGPGGVTVKKTGAALIIGIYDEPMTPGQCNMVVERLGDYLIEQGL

SEQ ID NO: 121711 - protein, 851 aa, Glycine max
  Coding DNA Sequence Number=SeqID_4933
  Gene Ontology: Mol. function=DNA-directed RNA polymerase activity; Cellular component=chromatin; Biological process=chromatin assembly or disassembly
  Homolog annotation: Hit_ID=Q1SJG5; Match level="QueryCoverage=98%, HitCoverage=63%, E-value=0.0, Identity=60%"; Hit description=SNF2 -related; Chromo; DEAD/DEAH box helicase, N-terminal; DNA-directed RNA polymerase, subunit beta-prime
  Pfam annotation: Domain name=Chromo; Domain location=493-548; Score =4.4; E_value=0.29; Accession=PF00385.14; Description='chromo' (CHRromatin Organisation MOdifier
  Pfam annotation: Domain name=Chromo; Domain location=582-637; Score =55.2; E_value=2.2e-13; Accession=PF00385.14; Description='chromo' (CHRromatin Organisation MOdifier
  Pfam annotation: Domain name=DEAD; Domain location=675-848; Score= -7.3; E_value=2.3e-05; Accession=PF00270.19; Description=DEADDEAH box helicase
  Pfam annotation: Domain name=ResIII; Domain location=671-842; Score =1.1; E_value=3.8e-05; Accession=PF04851.6; Description=Type III restriction enzyme, res subunit
  Pfam annotation: Domain name=SNF2_N; Domain location=677-851; Score =84.6; E_value=3.1e-22; Accession=PF00176.13; Description=SNF2 family N-terminal domain
  Pfam module annotation: Pfam domain module=Chromo::Chromo::DEAD::ResII I::SNF2_N; Domain location=493-548::582-637::675-848::671-842::677-851
MAFFRNFSNDTVSHGVMEDKSQGQNANRVHRSVGNDCTDATSSEKEFDMNMEAQYESDGEPDGSSRLQTEATADDGDAVKESNLQTTGSKTAMVGRWGSTFWKDCGQMDPQNGSESGQESKSGSDYRNADGSEDNSLDGRVVRVDSDDDDGQKEAGKGPRGHSDVPAEEMLSDEYYEQDGEEQSDSLHYGGIKKPTESNSWPQRMSTSANRTLHRNSRFSDDVEDNDGEDDDDGDNDNDGDDADYEEEEEADEDDPDDADFEPATSGHAGNKDKDWEGEGSDDDDDSDGNIVVSDDDESFYAKRPKGRQRGKIGQNIKSTRDRKVYVASGRQRRVKSSFEGNESTTEDSDSDSDEDFKSTKKRSVHVRKNNGRSSAATGFSSRNSEIRTSSRTVRKVSYVESEESEEADEGKKKKSQKEVEEISVMRFADCLTEFMLKMQDDFPIYLSGRIIDLLEYGVDEEIEEDDGDSIEKVLWHQPKGMAEDAQRNNRSTEPVLLSHLFDSEIDWNEIEFLIKWKGQSHLHCLWKSFAELQNLSGFKKVLNYTKKIMEDIRYRRTISREEIEVNDVSKEMDLDIIKQNSQVERVIADRISKDNSGNVIPEYLVKWQGLSYAEATWEKDIDIAFAQHTIDEYKAREAAMAVQGKMVDSQRKKSKASLRKLEEQPEWLKGGKLRDYQLEGLNFLVNSWRNDTNVILADEMGLGKTVQSVSMLGFLQNAQQIHGPFLVVVPLSTLSNWAKEFRKWLPDMNIIIYVGTRASREVCQQYEFYNEKKPGKPIKFNALLTTYEVVLKDKAVLSKIKWNYLMVDEAHRLKNSEAQLYTTLSEFSTKNKLLITGTPLQNSVEELWYH

SEQ ID NO: 121712 - protein, 69 aa, Glycine max
  Coding DNA Sequence Number=SeqID_4934
MMQARASERTTLTFPRSESGTEFRQFGSNGRNRAERRCAGIAVERDSKEEEAAAAERLAERGGGGGGGW

SEQ ID NO: 121713 - protein, 1047 aa, Glycine max
  Coding DNA Sequence Number=SeqID_4935
  Gene Ontology: Mol. function=DNA binding; Cellular component=beta -galactosidase complex; Biological process=DNA integration
  Homolog annotation: Hit_ID=Q1SDN3; Match level="QueryCoverage=99%, HitCoverage=86%, E-value=0.0, Identity=38%"; Hit description =Polynucleotidyl transferase, Ribonuclease H fold
  Pfam annotation: Domain name=zf-CCHC; Domain location=122-139; Score =13.1; E_value=0.0068; Accession=PF00098.13; Description=Zinc knuckle
  Pfam annotation: Domain name=zf-CCHC; Domain location=84-101; Score =5.7; E_value=0.11; Accession=PF00098.13; Description=Zinc knuckle
  Pfam module annotation: Pfam domain module=RVT_2::zf-CCHC::zf-CCHC; Domain location=606-861::122-139::84-101
MKQGALSVTKYFTRLRVIWDEIENFRPDPACSCNIRSHVLLMDPLPAISKIFSYVVQQERQLLGNVSSNLNLEPRDISINAAKVVYDFCGRTGHMENVCYKKHGMPLNHDGKNRNNNVRYGKTCTHCGKLGHTIEVCYKKHGYPPGYKAFIGRSSVNNVIAVEGKVTDDQEQRHESQEIISFSPEQCKALLALIQQPSAGSTASNHPQTKQVASISSTDTVTNPGIPSSLRTQKSTSWVLDSGATDHVTCSLSNLHSFNRIEPIMVKLPNGQHVYATHSGVDTSNRVKIGTVEVRHGLYQLTSDQIIPNTICSTIVHPKCNVVPIDLWHFRMGHPSSERLQYIWGPCSKPSMHGHRYFLTIVDDHTRFTWASLPPSFWGYALSHAAYLINCIPTPFLHNISPYEKLHGHPRDISNLRVFGCLCYINTLKAHRQKLDPRAHPCIFIGFKTHTKGYLVYDFHSHSINCSRNIVFYENHFPHFPETSSLKSTFTIPTPESFSSDQYEPPVDTIITVPRTQNGPTQAEPSSPHLRRSTRQKHAPTYLQDYHRGLTSSATSASTIARYPLSSVLSYSRLSPSHQHFVMTISSNIEPSSYAEASRHDCWIKAMQAELHALQENKTWTLTNLPPHKTAIGCRWVYKIKYHVDGSIERYKVRLVAKGYMQMEGLDYLDTFSPVAKLTTVRLLLALAALHQWHLRQLDVNNAFLHGELAEEVYMQIPPGLSIKDPNLVCRLQRSLYGLKQASRQWFTRLSSFLISHGFRQSTSDHSLFLRFTDNVTTTLLVYVDDIILTSNNIDEIQSITALLDQTFKIKDLGNLKFFLGLEIARTAQGIHLCQRKYTLDILADSGMLGCRPHSTPMDYSTKLQATSGTPLPAETSSSYRRLVGRLIYLTNTRPDITYAVQQLSQYMANPTTSHHQAAFRILCYLKGTPGSGLFFATTGTHQLQAFSDSDWAGSSEAEYRALASTTCELQWLTYLLQDFCVSFIQPATLYCDNQSAIQIANNPVFYERTKHIEIDCHIVRNKINSGLIKLLPRTNSPTSSPRLCLQ

SEQ ID NO: 121714 - protein, 56 aa, Glycine max
  Coding DNA Sequence Number=SeqID_4936
MTPENEEEKDQEVLDAAGMKRYRNDGGTGVLLGLDGGTTSTVCICMPMIPFSHSQL

SEQ ID NO: 121715 - protein, 189 aa, Glycine max
  Coding DNA Sequence Number=SeqID_4937
  Homolog annotation: Hit_ID=Q2R2Z9; Match level="QueryCoverage=49%, HitCoverage=21%, E-value=1e-07, Identity=35%"; Hit description =Expressed protein
MTILSSHVTTKLPLILTVHSEISVLDFQDAEPDILAHSSSEILERFNQFCDDEIKALCKKKGLYGEGAYLVGVDSLGVDVRVLSGAEVKTHRFPFKVQIDSVMDPHLNILEVGFSINGLVRMKMKKRRDKYKSPGPPLHKMQQRFCIVIGWLWAGAANANAAEKQIWQLLFPRSRRKKNMKKWWSASMI

SEQ ID NO: 121716 - protein, 310 aa, Glycine max
  Coding DNA Sequence Number=SeqID_4938
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=6e-42, Identity=33%"; Hit description= UPI00006A17C9 related cluster
HVLAFRGLHVLAFRGLHALPIRGLHVLTFRGLHVLAFKGLPALAFRGLHVLAFRGLHVLPIRELHVLAIRGLHILAFRGLHVVTFKGLHTFAFEGLHALTFKGLHVLAFRGLHVLAFRGLQDLTFRGLHVLTLRGLHALAFRGLDVLTFRGLLALTFKGLHVFAFRGRATCPHHQRATRPHVQRTTRPHLQRAARPCLYWTTRPRLQRTTRPRLQRTTRPPYQGTARPRHQRTTRPRLQRTTRPCLHRAARPHPQRTTRPRLLRTTPPHLQRTTHPHLPRATRPCLQRTTRPHIQRTTRPCLQRTRRPHL

SEQ ID NO: 121717 - protein, 100 aa, Glycine max
  Coding DNA Sequence Number=SeqID_4939
MLMLLKAWIVTICVCLCSIVLDNTIQESLRLILIQKSSHNSAPLSQRALRGRARARLTGALSKRGKMREVATNVYLWKTSGKPKETGQNENSKFGSCIYA

SEQ ID NO: 121718 - protein, 76 aa, Glycine max
  Coding DNA Sequence Number=SeqID_4940
  Subcellular localization annotation: CTP_CleavageSite=35; ConfidenceScore=5.23e-01
MSCTGSLSAPLHLSKRTASVYPLSEKGALSQKSLACAKRTSTNKATYLSLKLDFVKGVWTGIQSFACLSRVSRERK

SEQ ID NO: 121719 - protein, 242 aa, Glycine max
  Coding DNA Sequence Number=SeqID_4941
  Pfam annotation: Domain name=zf-CCHC; Domain location=111-128; Score =21.5; E_value=0.00028; Accession=PF00098.13; Description=Zinc knuckle
AHENPRVFSCISSPIFLESSIQCTWGVGLHQLQAFTTQRPKHNFASKESSSKVIVVGNALEEESNNDDSNDRDYELSMITIKIKRMWKSMNSSRFNYFSKRSFHKKEESPVICSKCKKPRHFKSECPDLEKSKDKKKKFFNKVEPTLDASSDDEDPPPDYTINSNGEEELPPELVKLYEEIEIFKNNLGKFIGGHEAFKKLLRCIMRLINARTSLKRRTHQRVSPVLASTPKLTRKKDPKRF

SEQ ID NO: 121720 - protein, 86 aa, Glycine max
  Coding DNA Sequence Number=SeqID_4942
MVNQEGHSQSIMVQDFNVTSNHGCSAPFRANIIRKLYIDNLESFLELKNLNNITRMNYDHCCCLLIHDHWGIDIRQGASSNLDHRL

SEQ ID NO: 121721 - protein, 142 aa, Glycine max
  Coding DNA Sequence Number=SeqID_4943
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=98%, HitCoverage=12%, E-value=7e-33, Identity=53%"; Hit description =Kinesin related protein
SLSAELSALRVERERESKLLKKENQSLKIQLRDTAEAVQAAGELLVRLREAEHAAAAAEENFANLQQDNENLKMQIAKMKRKHKTEINTMKQYITESKLPESALQPLYREEDSDVAHNATSSYTYDDQAWRAEFGAIYQEHY

SEQ ID NO: 121722 - protein, 575 aa, Glycine max
  Coding DNA Sequence Number=SeqID_4944
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=99%, HitCoverage=50%, E-value=3e-95, Identity=38%"; Hit description =Kinesin related protein
  Pfam annotation: Domain name=Kinesin-related; Domain location=94-575; Score=283.9; E_value=3.2e-82; Accession=PF06548.2; Description =Kinesin-related
SNDATLQTLRFGEQVRSIRNEPVINVVKETDADLSNNIRHLKEELIRAKDDVHSSAGSKDGYFQGHNMRESLNLMRVSLNHSLLLSNIDNDTDEHVNVNEDDIRKLRQQIDELDNSSEGNPKDISVDEDCVQFYSDEEYCDADTNSCDEVEKADVYCGKTLSNPSVATESSFRDSISLNSCNHSATLAGPQLSESPKFSKTQRRSVAISSSYLGSWNNVAESSTFSNKVLRKSFKQGDHVQSSLQSSKAKSLAASLQKGLQIIDYHQQNSALNKSSTSFSFEHLTLTPCLDIDKDDSYDQTIQQKPSSDEVTAAFLCASCWAKISNEDSSKAQAGNPDGMTDKIPKHLENVIAKSIMKEKELENVCKEQAARIEQLNQLVEKLKGEKELDSVTMYNSMKDEEKLLRGISSSGHLPCIIEENCEVKEVQEELAQSDVSFDSTEKESLLKEIQNLRSKLQLCSDAPVKKSTEKLRSSLVSRSIQLQKSGVFSYDNGNEDLENERQRWTEMESEWICLTDELRADLESYRQLTERLEMELKLEKKSSAEMDDALKRAVMGHARMVEHYADLQEKYDDL

SEQ ID NO: 121723 - protein, 296 aa, Glycine max
  Coding DNA Sequence Number=SeqID_4945
  Gene Ontology: Mol. function=pectinesterase activity; Cellular component=cytoplasm; Biological process=cell wall modification
  Homolog annotation: Hit_ID=Q8VYZ3; Match level="QueryCoverage=98%, HitCoverage=74%, E-value=1e-126, Identity=73%"; Hit description =Putative pectin methylesterase
  Pfam annotation: Domain name=Pectinesterase; Domain location=44-293; Score=195.1; E_value=1.7e-55; Accession=PF01095.10; Description =Pectinesterase
MTRVEFSEQQFMKWVKFVGGLKHSVFRTANNKLFPSHTLHVSKKHGKGGFSSIQAAIDSLPFINVVRVVIKVHAGVYTEKVNISPFKSFITIQGEGADKTIVQWGDTAQSQPLGTYGSATFAVNSAYFIAKNITFKASDKLHSNLPLSNTAPIPAPGAVGKQGVALRISADTAVFQGCKFLGAQDTLYDHIGRHYYKDCYIEGSVDFIFGNALSLFEGCHVHAIAQLTGALTAQGRSSLLEDTGFSFVHCKVTGSGALYLGRAWGPFSRVVFAYTYMDNIIIPKGWYNWGDPNREM

SEQ ID NO: 121724 - protein, 292 aa, Glycine max
  Coding DNA Sequence Number=SeqID_4946
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=74%, HitCoverage=18%, E-value=2e-70, Identity=59%"; Hit description =Kinesin related protein
  Pfam annotation: Domain name=Kinesin; Domain location=79-292; Score =75.0; E_value=2.3e-19; Accession=PF00225.13; Description=Kinesin motor domain
  Subcellular localization annotation: CTP_CleavageSite=93; ConfidenceScore=5.61e-01
MRQKTKNADSSGFLGSISSNFLRSISSSNRKPTSSNPKPPKSDTENTPPTTHPNIPINLHHQSKPNDPFSHSNSHVVVRIRPENSNGKEGDLKIKKVSSDALCVGDRKFTFDEVFDANSNQEDVFQSVGVPLVRNALAGYNTTILSYGQSGSGKTYTMWGPPSAMADESSLSSQQGIVPRIIRMLFSELERERLVSDQKQFNYQCRCSFLEIYNEQIGNLLNPIQQNLEMKDDSSNALYIENLIEEYITNYDDVAQILNKGLSRRKNEAMNLNSNSSRSHIIFTFVIESLCK

SEQ ID NO: 121725 - protein, 312 aa, Glycine max
  Coding DNA Sequence Number=SeqID_4947
  Homolog annotation: Hit_ID=Q9LK76; Match level="QueryCoverage=99%, HitCoverage=70%, E-value=3e-40, Identity=37%"; Hit description =Arabidopsis thaliana genomic DNA, chromosome 3, P1 clone: MDC8
  Pfam annotation: Domain name=IQ; Domain location=113-133; Score=30.0; E_value=8.3e-06; Accession=PF00612.17; Description=IQ calmodulin -binding motif
  Pfam annotation: Domain name=IQ; Domain location=135-155; Score=18.2; E_value=0.03; Accession=PF00612.17; Description=IQ calmodulin-binding motif
  Pfam module annotation: Pfam domain module=IQ::IQ; Domain location =113-133::135-155
MGRAIRWLKGLFGIRTDRERKENSNHSDRDSRGLCHNPTTIPPNISPAEAAWLQSFYSETEKEQNKHAIAVAAATAAAADAAVTAAQAAVAVVRLTSHGNGRDTMFGGGGQERLAVVKIQTFFRGYLARKALRALKGLVKLQALVRGYLVRKQAAATLHSMQALIRAQATVRSKKSHGLSSTKNEAHLFQTQARRSMERFDDIKSEYIAPIHSRRLSSSFDATMNNANSVDGSPKIVEVDTGSGRPKSRSRRSNTSMSDFGDDPSFQALPSPLPFAHLSIPSHRNYHDSEWGLTREECRFSTAQSTPRFTNS

SEQ ID NO: 121726 - protein, 79 aa, Glycine max
  Coding DNA Sequence Number=SeqID_4948
  Gene Ontology: Mol. function=transporter activity; Cellular component= integral to membrane; Biological process=transport
  Homolog annotation: Hit_ID=P53393; Match level="QueryCoverage=76%, HitCoverage=9%, E-value=2e-22, Identity=86%"; Hit description=Low affinity sulfate transporter 3
MNVDTSGILILEELHKRLLSRGVQLAMVNPRWLVIHKLKVAHFVDKIGRQWVFLTVAEAVDAFNYKKWVMLFLSKYRLS

SEQ ID NO: 121727 - protein, 467 aa, Glycine max
  Coding DNA Sequence Number=SeqID_4949
  Gene Ontology: Mol. function=drug transporter activity; Cellular component=membrane; Biological process=multidrug transport
  Homolog annotation: Hit_ID=Q4PSF4; Match level="QueryCoverage=89%, HitCoverage=88%, E-value=1e-139, Identity=58%"; Hit description=MATE efflux protein-related
  Pfam annotation: Domain name=MatE; Domain location=233-396; Score =131.4; E_value=2.5e-36; Accession=PF01554.9; Description=MatE
GNKNRGRSRLHVDGGSSRKGEAAVLEHKERSESGGGAGVSDRNNGVDILRAFHGIDAVPGTPGRVRTGSRVPRNGVREHHRLFGAVGSSTWDGTDVLASLRSKTREGVVVDPPPLRHDPNITLMAHTYLIFSLPDLLTHSFLHPIRIYLRAQGVTHPVTLASLAGTLLHLPFNYLLVTRLRLGLAGVAAASAASNLSILLFLGAAVCFTGLHCAAPSRDCFSGWKPLLRLAAPSCVSVCLEWWWYEIMIILCGILVDPTATVASMGILIQTTSLIYVFPSSLGFAVSTRVGNELGANRPSRAKLSAVVSVFLAAIMGFSAMFFAVGMRRRWGRMFTADEDIIRITSMALPILGICELGNCPQTVGCGIVRGMARPNTAANVNLGAFYLVGMPVAVGLGFWFDVGFCGLWLGLLSAQVCCAGLMLYVIGTTDWEFEAHRAQWLTLVEDGVMDGQKQPLTSVVTEAPST

SEQ ID NO: 121728 - protein, 78 aa, Glycine max
  Coding DNA Sequence Number=SeqID_4950
MARTILSSISVPFLILLMIVFTLVAQITPISADVKMRRLGPLLSPPPPPDHADGPHPVGPHPVIPPPTDGPGRPPPIP

SEQ ID NO: 121729 - protein, 70 aa, Glycine max
  Coding DNA Sequence Number=SeqID_4951
  Gene Ontology: Mol. function=nucleic acid binding
  Homolog annotation: Hit_ID=Q1S9T9; Match level="QueryCoverage=99%, HitCoverage=5%, E-value=1e-13, Identity=58%"; Hit description =Peptidase S8 and S53, subtilisin, kexin, sedolisin; Integrase, catalytic region; Zinc finger, CCHC-type
MGSVKYEVEKFTGQNDFRAWKMRALLIQQELVDALAGEAKLEKAMSNEDKTTLMEKAHSAIILSLGDKVL

SEQ ID NO: 121730 - protein, 89 aa, Glycine max
  Coding DNA Sequence Number=SeqID_4952
MATVVAATSVIAEVDPAPPSGLNQINHPISDMVGQRGKELGSTGGLHFVQVQNKYALPPYGLPPNYTPANVVHTPNENVNDSTPILIES

SEQ ID NO: 121731 - protein, 242 aa, Glycine max
  Coding DNA Sequence Number=SeqID_4953
  Gene Ontology: Mol. function=calpain activity; Cellular component =intracellular; Biological process=proteolysis
  Homolog annotation: Hit_ID=Q1SW04; Match level="QueryCoverage=87%, HitCoverage=35%, E-value=1e-24, Identity=34%"; Hit description =Cyclin-like F-box; F-box protein interaction domain
  Pfam annotation: Domain name=F-box; Domain location=23-70; Score =39.8; E_value=9.1e-09; Accession=PF00646.23; Description=F-box domain
NLDSECFGASLKVIETCDQRRKPWSSLLCNEIIKEILSRLPVKPLIKFKCVCKEWNSLISEPYFIKLHLSKSAAKDDLEHLQLIKNVCLGSIPEIHMESCDVSSIFHSLQMETFLFNFANMSGYHLVGSCNGLHCGVSEIPEGYCVCFWNKATRVISRESPTLSFSPGIGRRIMFGFGYDPSIGKYKVVAIALTMLSLDVSEKTEKKVYGAGDSSWRNLNGFPVLWTLPKVGGVYLSGTLNW

SEQ ID NO: 121732 - protein, 227 aa, Glycine max
  Coding DNA Sequence Number=SeqID_4954
  Gene Ontology: Mol. function=nucleic acid binding; Biological process= DNA integration
MNQPSANQNEDLPPKKINLKEETEMTSSKLQGLDKPQDADESEEDQTLEGNYLLARDRTRREIKAPQRYGYVDLITFALVIASEVLEEDPKSVDVSLARQEGQKWLKVNKNHIGHGDEEILMSQLKRFEVKASNNKDKLAKVKSELEKEFEMKNLGPGKRILGIEIRKHIKMKQFKLSVDQAPKTHEEEIYMEGIPYANAVGSLMYAMVGDGVQARKIYVWGRSAVI

SEQ ID NO: 121733 - protein, 38 aa, Glycine max
  Coding DNA Sequence Number=SeqID_4955
MALLYLYQSFLEVSSQQFTLYTDHAVWRIIFSTDIGHD

SEQ ID NO: 121734 - protein, 374 aa, Glycine max
  Coding DNA Sequence Number=SeqID_4956
  Homolog annotation: Hit_ID=Q9LVE6; Match level="QueryCoverage=89%, HitCoverage=90%, E-value=1e-104, Identity=57%"; Hit description =Similarity to senescence-associated protein
  Pfam annotation: Domain name=Senescence; Domain location=33-364; Score=515.7; E_value=5.2e-152; Accession=PF06911.3; Description =Senescence-associated protein
MGCCFRGSTAIPPPPMETSMPAVSVGEYSGLKQEVLIQIPACKVHLMDGGEALELAQGHFMIIKTFEENVSLATIIKVGDDLQWPLTKDEPVVKLDSLHYLFSLLVKDGEPLSYGVTFSEASLGSLSLLDMFLKDQSCFSGLNLSKKNNLDWREFAPKVDDYNHFLAKAIAGGTGQIVKGIFICSNAYTNKVQKGGETILNSSAGEKTGVVARESMSNKTASASKKNKINKNLKRVRKLSKMTEKLSKSLLNGVGIVSGSVMAPVVKSQPGKAFLRMLPGEVLLASLDAVNKVLDAAEAAEKQTLSATSKAASRAVSNRFGESAGEGTEHVFATAGHAANTAWNVFKIRKAFTPASSATNGVLKNAAKIPSFKH

SEQ ID NO: 121735 - protein, 389 aa, Glycine max
  Coding DNA Sequence Number=SeqID_4957
  Gene Ontology: Mol. function=transferase activity
  Homolog annotation: Hit_ID=Q946Y1; Match level="QueryCoverage=89%, HitCoverage=71%, E-value=1e-164, Identity=74%"; Hit description =Ceramide glucosyltransferase
  Pfam annotation: Domain name=Glycos_transf_2; Domain location=84-250; Score=-2.6; E_value=0.0025; Accession=PF00535.16; Description =Glycosyl transferase
  Subcellular localization annotation: CTP_CleavageSite=15; ConfidenceScore=5.01e-01
MSSLDLLLFSLSRAFCSSIAVFFQIQVFVWYNNVTLLLFSISVPRFFYLVWGCLICLTLALGWACAAYVSELEHSYQVNLPRVTVIMPLKGFGEHNLHNWRSQITSLYGGPIEFLFVVESTEDPAFHAVSRLIAEFEDHVEAKVVVSGLSTTCSQKIHNQLVGVETMHKDSKYVLFLDDDVRLHPGSIGALTREMEKNPEIFIQTGYPLDLPSGSLGSYCIYEYHMPCSMGFATGGKTFFLWGGCMMAIFLQMHADDFRQDRYGVVSGLKDGGYSDDMTLAAISGAHKRLITSPPVAVFPHPLASDLNFGRYWNYLRKQTFVLESYLTNVNWVMNRALFTTHCYLSWGFVAPYFMAMIHVAAAVRFYYKGFSPEEMAYTSGGENNTFPF

SEQ ID NO: 121736 - protein, 504 aa, Glycine max
  Coding DNA Sequence Number=SeqID_4958
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O82468; Match level="QueryCoverage=80%, HitCoverage=75%, E-value=9e-77, Identity=68%"; Hit description =Protein phosphatase-2C
  Pfam annotation: Domain name=PP2C; Domain location=249-494; Score =165.7; E_value=1.2e-46; Accession=PF00481.12; Description=Protein phosphatase 2C
RYREDSPIKGLREAEDEKGGVMNGGDRWRRSIRQDEQLERFDSEFASTSSISSTLSTDDFRNLTSSGDISSISSGSGEIPPVSVLAPPFLHCEGSNDGETAAAREKCVGRSNKGVSWGHTSVIGRRKEMEDAVAVIPGFMSRTCDHIGGCTAPGSRSSGEIAPVHFFGVYDGHGGSQFERGVACYGDWTQKGREVTTGDNDNDNSVSNDTSRDINGGYDDNNGGDSDVNGDSGSRIGGGDDNDVMLVSTATGGGCVGGDKGGIGISGGDNDYASGSVVVVTMVVATIITLVVAIVVAKFCAKRMHDVIAEEWDREMEGGARWHRRWETVFANSFERTDNEILSDAVAPEMVGSTASVVILSGCQIITSNCGDSRVVLYRRTQTIPLTVDQKPDRQDELLRIEGGGGRVINWNGARVFGVLAMSRAIGDRYLRPWIIPVPEITFTARTDEDECLVLASDGLWDVMTNEEVGEVARHILRRRRRSLSMEEASPAQVVADSLTEIAL

SEQ ID NO: 121737 - protein, 132 aa, Glycine max
  Coding DNA Sequence Number=SeqID_4959
MVYLLDFGRIDGVRRRACNKNMKDCSLTGNKKEKVWERWVHDVMVVGFGILDEGESGCEFALGGFPVNVPAHNVFPVSVSDNADKAFQRELEKEQTRREIGGGSPEGNGTGGSIWYACQCKDKTESQFRNEF

SEQ ID NO: 121738 - protein, 306 aa, Glycine max
  Coding DNA Sequence Number=SeqID_4960
  Gene Ontology: Mol. function=molecular_function; Cellular component =membrane; Biological process=auxin mediated signaling pathway
  Homolog annotation: Hit_ID=Q9LV20; Match level="QueryCoverage=90%, HitCoverage=87%, E-value=2e-75, Identity=47%"; Hit description =Nodulin-like protein
  Pfam annotation: Domain name=DUF6; Domain location=151-271; Score =20.0; E_value=0.0048; Accession=PF00892.11; Description=Integral membrane protein DUF6
  Pfam annotation: Domain name=DUF6; Domain location=20-147; Score =42.1; E_value=1.9e-09; Accession=PF00892.11; Description=Integral membrane protein DUF6
  Pfam annotation: Domain name=TPT; Domain location=95-271; Score= -38.3; E_value=0.097; Accession=PF03151.7; Description=Triose -phosphate Transporter family
  Pfam module annotation: Pfam domain module=DUF6::DUF6::TPT; Domain location=151-271::20-147::95-271
MASVVTKKVKLLVALLTLQLCFAGYHIVSRLALNIGVSQVVYPVYRNLIAVLLLSPFAYVLEKNQRPPLTLSLLAQFFLLALLGITANQGFYLLGLYYASPTFASALQNSVPAITFVLALALRLEEVNIRRRHGLAKVLGTIASVGGASVITLYKGPPLLHLQMDQIQGDTLEVDQSTKVQNWTWGCIYLLGHCLSWAGWIVFQGIIASGVVISLQTWCIQKGGPVFVAVFQPVQTILVAVMAALILGDQLYPGGLIGAVLIVLGLYLVLWGKTNEKKVTEPSLTNPLLKAEEENKETVAVPKDIP

SEQ ID NO: 121739 - protein, 230 aa, Glycine max
  Coding DNA Sequence Number=SeqID_4961
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q5QMV1; Match level="QueryCoverage=77%, HitCoverage=45%, E-value=2e-70, Identity=71%"; Hit description =Oxidoreductase, 2OG-Fe(II) oxygenase-like protein
  Pfam annotation: Domain name=2OG-FeII_Oxy; Domain location=42-141; Score=21.2; E_value=0.001; Accession=PF03171.10; Description=2OG -Fe(II) oxygenase superfamily
MNKFGAVLDDFGLETMLDKLMEGFIRPLSRVFFAEVGGSTLDSHHGFVVEYGKDRDVDLGFHVDDSEVTLNVCLGKQFSGGELFFRGIRCEKHVNTGTHSEEIFDYSHVLGRAVLHRGRHRHGARATTSGNRVNLLLWCRSSVFREMKRYQKDFSNWCGECNREKKERQRSTVAATKLFTESRKLDFASFHGEKAMEYIWSGELVELEPDVTFASTISVIMWLLQCAVFE

SEQ ID NO: 121740 - protein, 600 aa, Glycine max
  Coding DNA Sequence Number=SeqID_4962
  Gene Ontology: Mol. function=polynucleotide adenylyltransferase activity; Cellular component=nucleus; Biological process=RNA polyadenylation
  Homolog annotation: Hit_ID=Q9LMT2; Match level="QueryCoverage=87%, HitCoverage=77%, E-value=0.0, Identity=70%"; Hit description =F2H15.20 protein (Hypothetical protein At1g17980) (At1g17980) (Poly(A) polymerase)
  Pfam annotation: Domain name=NTP_transf_2; Domain location=75-172; Score=48.9; E_value=1.8e-11; Accession=PF01909.13; Description =Nucleotidyltransferase domain
  Pfam annotation: Domain name=PAP_RNA-bind; Domain location=342-479; Score=197.2; E_value=3.9e-56; Accession=PF04926.5; Description =Poly(A) polymerase predicted RNA binding domain
  Pfam annotation: Domain name=PAP_central; Domain location=13-341; Score=489.4; E_value=4.3e-144; Accession=PF04928.8; Description =Poly(A) polymerase central domain
  Pfam module annotation: Pfam domain module=NTP_transf_2::PAP_RNA -bind::PAP_central; Domain location=75-172::342-479::13-341
MGIPGLSNQNNGQQRLGITEPISLAGPTEDDVIKTRELEKYLQGVGLYESQEEAVGREEVLGRLDQIVKIWVKNISRAKGFNEQLVHEANAKIFTFGSYRLGVHGPGADIDTLCVGPRHASRDEDFFGELQKMLSEMQEVTELHPVPDAHVPVMKFKFNGVSVDLLYARLALWVIPDDLDISQESILQNVDEQTVLSLNGCRVTDQVLRLVPNIQVAGFLGGINLALLVARICQLYPNALPNMLVSRFFRVYTQWRWPNPVMLCAIEEGSLGLSVWDPRRNPKDRYHLMPIITPAYPCMNSTYNVTSSTLRVMSDEFRRGSEICEAMEASKADWDTLFEPYPFFESYKNYLQIDITAENADDLRQWKGWVESRLRQLTLKIERHTYGMLQCHPHPGEFSDNSRPFHHCYFMGLQRKQGVPVNEGEQFDIRLTVEEFKHSVNAYTLWKPGMNIHVSHVKRRNIPNYIFPGGVRPTFPSKVTAENKQSSKSRVPGHGQAEKPQGGKTVVVGADDVRKRKRSEDIMDNNPRNSKSPVSLAPPSREVNEDISPISASSSCSMKFDESEVNSIGGQKSEKPCLNSPGEIPSGDSGTNGSVTNNQQ

SEQ ID NO: 121741 - protein, 254 aa, Glycine max
  Coding DNA Sequence Number=SeqID_4963
  Gene Ontology: Mol. function=chitin binding; Cellular component =extracellular region; Biological process=chitin metabolic process
  Homolog annotation: Hit_ID=UPI00006A17C9; Match level="QueryCoverage =44%, HitCoverage=100%, E-value=4e-13, Identity=31%"; Hit description= UPI00006A17C9 related cluster
GLHVLTFRGLHPLIFKWLHALTFRGLHVLAFKVLHALIFKGLHAFTFRGLHALTFKGIHAFIFKGLHALTFRGLHVLALRGLHVLAFGGLHALVFRGLYVLPLRGLHVLAFRGLRSPSPFEGYALKLPVKGPIISLQPFFFPGHPLISKEGQLCKHNQRKAIAQLLCIPGQAFTRATGKRRVGCAHKTPNGPEEVQQGPGVSNFGYRPLSVLQGARTPRQGIAPTGHPVDPKKSNRVLGFPALITGLCHFYGVP

SEQ ID NO: 121742 - protein, 455 aa, Glycine max
  Coding DNA Sequence Number=SeqID_4964
  Gene Ontology: Mol. function=drug transporter activity; Cellular component=integral to membrane; Biological process=response to nematode
  Homolog annotation: Hit_ID=Q9FHB6; Match level="QueryCoverage=94%, HitCoverage=92%, E-value=1e-145, Identity=58%"; Hit description =Genomic DNA, chromosome 5, TAC clone:K24M7
  Pfam annotation: Domain name=MatE; Domain location=22-182; Score =132.4; E_value=1.3e-36; Accession=PF01554.9; Description=MatE
  Pfam annotation: Domain name=MatE; Domain location=243-387; Score =73.4; E_value=7.3e-19; Accession=PF01554.9; Description=MatE
  Pfam module annotation: Pfam domain module=MatE::MatE; Domain location=22-182::243-387
MKRVSRQEVVEEMKKQAWLAGPLFTVGVLQYSLQVISVMFVGHLGELPLSGASLATSFASVTGFNLLMGMASALDTLCGQSFGAGQHHMLGIQMQRATFVLSFVSVFLAIMLVFTKHILVAMHQQVAIAEEAGVYAIYMIPSLFAYGIFQCLLKFLQTQNIVFPMVLSSAVVALLHIPLCWVLVIKSGIGSKGAAIANSVSYWLNVLLIGFYVKFSSSCAKTWTGFSVKALQNIPEFLKISIPSACMLCLKAWTFELMVLLSGLLPNPQLETSVLSICTRVSNELGAGHPQAASLAVRVALFLVLADGIMMVLVMILLRKIWGNLYSSDTHVIKYVAAVMPILATCSFLDGIQSVLSGIARGSGWQKIGAIVNLGSFYFVGVPSSVVLAFVLHMKGKGLWLGIVSAFIVQVILFGVITIRTSWDKEANKAAMRVKDTKIPQELPQRDPFTITEMN

SEQ ID NO: 121743 - protein, 418 aa, Glycine max
  Coding DNA Sequence Number=SeqID_4965
  Gene Ontology: Mol. function=drug transporter activity; Cellular component=integral to membrane; Biological process=response to nematode
  Homolog annotation: Hit_ID=Q9FHB6; Match level="QueryCoverage=98%, HitCoverage=80%, E-value=1e-121, Identity=51%"; Hit description =Genomic DNA, chromosome 5, TAC clone:K24M7
  Pfam annotation: Domain name=MatE; Domain location=1-113; Score=29.4; E_value=1.2e-05; Accession=PF01554.9; Description=MatE
  Pfam annotation: Domain name=MatE; Domain location=125-300; Score =16.3; E_value=0.00025; Accession=PF01554.9; Description=MatE
  Pfam module annotation: Pfam domain module=MatE::MatE; Domain location=1-113::125-300
MASSLDTFCGQSYGAKQYHMLGIHLQRAMFTLMIVSIPLAIIWANTRSILTFLGQDPEIAAEAGSYARFMLPSLFAYGLLQCLNRFLQTQNIVFPMMCSSAITTLLHVLICWILVFKSGLGNRGAAVANSISYWLNVTILSLYVMFSPSCAKSWTGFSKEALHNIPSFVRLAIPSAVMVCLNTTAAAWMIPFGLSGAGSIRVSNELGAGRPWNARLAVRVVLVLAIIEGIIVGTVMILVRNIWGYAYSNEVEVVEYVATMFPILAASNFLDGLQCVLSGAMTQKHWYRLRGILELPIHLTYKNANSIQSIDIWLLWANTRKGTCVHSTNECTARGCGWQKIGAFVNLGSYYIVGIPSSIVFAFVLHIGGKGLWLGIICALIVQMCSLMIITIRTDWDQEAKKATDRVYNSVTLESLVS

SEQ ID NO: 121744 - protein, 153 aa, Glycine max
  Coding DNA Sequence Number=SeqID_4966
  Gene Ontology: Mol. function=drug transporter activity; Cellular component=membrane; Biological process=multidrug transport
  Homolog annotation: Hit_ID=Q8LF49; Match level="QueryCoverage=96%, HitCoverage=31%, E-value=4e-42, Identity=51%"; Hit description =Putative integral membrane protein
  Pfam annotation: Domain name=MatE; Domain location=1-113; Score=-6.5; E_value=0.0041; Accession=PF01554.9; Description=MatE
MASAVDTFCGQSYGAQQYHMVGIHTQRVIVVIMLATAPMSFIWAYLRPVLVVLHQDKTIAAKAQLYARYLIPSLSANALLRCITKFLQTHNTVLPIVLASGFTTLAHVLICWLLVLRFGLGIKGAAIAFCISNWLNTVLLALYIKFSSSCKST

SEQ ID NO: 121745 - protein, 116 aa, Glycine max
  Coding DNA Sequence Number=SeqID_4967
  Gene Ontology: Mol. function=protein binding; Cellular component =cytosol; Biological process=transcription
  Homolog annotation: Hit_ID=Q9Y3D0; Match level="QueryCoverage=83%, HitCoverage=64%, E-value=2e-20, Identity=49%"; Hit description =Protein FAM96B
  Pfam annotation: Domain name=DUF59; Domain location=28-104; Score =24.2; E_value=1.2e-06; Accession=PF01883.9; Description=Domain of unknown function DUF59
MVSELINANPIIYEKKERRPRTAPSAPHDEYAVELIDQQEDPEHPYSLEELKVITEEAVEVDDQRNYVRVMFTPTVEHCSMATVIGLCLRVKLMRSLPSRYKELERQKFMDELFVI

SEQ ID NO: 121746 - protein, 385 aa, Glycine max
  Coding DNA Sequence Number=SeqID_4968
  Gene Ontology: Biological process=response to UV-B
  Homolog annotation: Hit_ID=Q10DW0; Match level="QueryCoverage=88%, HitCoverage=78%, E-value=1e-78, Identity=46%"; Hit description =Expressed protein
  Pfam annotation: Domain name=DUF760; Domain location=6-385; Score =570.0; E_value=2.2e-168; Accession=PF05542.2; Description=Protein of unknown function (DUF760)
MTRRCMIHDAAMTPVAAAIADGVSCPSSYNPKHYHELYNFRARGLVARASADSRDNLVPFAPLQLESPVGQLLEKISNTHPHLLTAVIDQQLENLQNVRDAQKESDPSQDSLYKRIAEVKDKEKRITLEEIIYCSIVHKFLENNISMIPKISATSDPTGRVDLWPNQELKLEAVHSPEALEMIQSHLSLVLGDRLVGPLQTVVQISKIKLGKLYAASIMYGYFLKRVDERFQLERSMGILPKDFGKAKSYDEPSPGIKLWDPDSLITVQDYDDEGYNDSDYMDTDEDKSFRLRAYVMQLDAETLQRLATVRSKEAISLIEKQTQALFGRPDIRVSDDGSIETSNDELLSLTFSGLTMLVLEAIAFGSFLWDKENYVESKYPFLNE

SEQ ID NO: 121747 - protein, 897 aa, Glycine max
  Coding DNA Sequence Number=SeqID_4969
  Homolog annotation: Hit_ID=Q9FK80; Match level="QueryCoverage=75%, HitCoverage=78%, E-value=1e-52, Identity=36%"; Hit description =Arabidopsis thaliana genomic DNA, chromosome 5, P1 clone:MRA19
MEKNKSDDILLDDWEDALLEQLIQTEEQFVLTSTAPKPPPNPTSSSSSFSLALPPPLPPPPPPPPPSAVSFSPPREFSQRPTTSITLDSPSPTPIPISDNKDLEIDRLKVIARPPLPFLGFTLSFYVPSMNGIRSHAASCKETNVVKNNCSIVVILVKSEEGDKGGERTEGAGTCDKADCKSGMLVQLYILDAEKERVKLKKERDKKEDQLKSISSRNEEENACTKFSKSKSIDKGQNDRDFGTHALNCHKISSKFQNGVSSNDLIVESTSKAKGVETATISHQEAQGALPLRDDLSAYLDLSQKLLAIWGSPTDNKMGTNVISKLLVGCQRDFQVLFGCMNMSLPSEITRELLSDLSSSGVALHYLKDRFHTPEAAKISNLYLALTKIADGTDVLKTLIEPLLDLCGMENLSLCTTHGSEAPSGIGKECWKEVDVWSGFDNYDENTRKWNVFSRGIGDLGGMKYGHLLLLLLIFPKCLVVVSNSVIMLPSENAAEHLDNVFIEGLCIGKGLADSGVKDGNIFNEEIGSRKECQSHQNSLQPRVNWIYLFEIMHQIAMKITEERVRVEVVSIMKLLFLQSNAYFERERFGQKIVFETISELLKKDAGLSVKKHALRLLYLVLNLKIGWDITSVAWYLVGGFRVSQILIIVSLSLGLQLEHALNLHIPEFLGCPKLLAAFCCGCKERDDSSAMDDNDLALHFQNFKIILQGLSDCVASCRGGILELKVSRNAILVLAFLASSGQPGFEIFVGHKLSCRGVNYLMLILQLLVSEMDLEAGAHGQQPEIFRERTFLIRETLILLNRLVSSPSYSATVLHGLTTNRDMAGLTIDVASRLSQKGKKNEQQDSMVNHIRETEIVDLARMFKKRELILKCCEADRQQRHAGLFLAVLGVVPEKF

SEQ ID NO: 121748 - protein, 948 aa, Glycine max
  Coding DNA Sequence Number=SeqID_4970
  Gene Ontology: Mol. function=protein binding; Cellular component =membrane; Biological process=defense response
  Homolog annotation: Hit_ID=Q19PL5; Match level="QueryCoverage=98%, HitCoverage=98%, E-value=0.0, Identity=50%"; Hit description=NBS-LRR type disease resistance protein
  Pfam annotation: Domain name=LRR_1; Domain location=596-618; Score =10.2; E_value=3.5; Accession=PF00560.23; Description=Leucine Rich Repeat
  Pfam annotation: Domain name=LRR_1; Domain location=620-641; Score =9.8; E_value=4.3; Accession=PF00560.23; Description=Leucine Rich Repeat
  Pfam annotation: Domain name=LRR_1; Domain location=776-798; Score =0.5; E_value=2.3e+02; Accession=PF00560.23; Description=Leucine Rich Repeat
  Pfam annotation: Domain name=LRR_1; Domain location=848-870; Score =7.6; E_value=11; Accession=PF00560.23; Description=Leucine Rich Repeat
  Pfam annotation: Domain name=NACHT; Domain location=184-344; Score= -40.3; E_value=0.08; Accession=PF05729.3; Description=NACHT domain
  Pfam annotation: Domain name=NB-ARC; Domain location=146-457; Score =289.6; E_value=5.8e-84; Accession=PF00931.13; Description=NB-ARC domain
  Pfam module annotation: Pfam domain module=LRR_1::LRR_1::LRR_1::LRR _1::NACHT::NB-ARC; Domain location=596-618::620-641::776-798::848 -870::184-344::146-457
MAESAVSFLLERLKPVFVNKLKLFTGVEAEVIYLKGQLELIRAFLRAADAFEESDEELKVWVRQVRDVVHEAEDLLDELELVQLHNHTNGLSNYLSIRNMKAHYRIAHELKAINSRMKTISLTRKRFLSKLDTASEASNSTYTVNAWHDQRGDALLLDNTDLVGIDRPKKQLIGWLINGCTGRKVISVTGMGGMGKTTLVKKVFDDPEVRKHFKACVWVTVSQSCKTEELLRDLARKLFSEIRRPIPEGLESMCSDKLKMIIKDLLQRKRYLVVFDDVWQMYEWEAVKYALPNNNCGSRIMITTRKSNLAFTSSIESNGKVYNLQPLKEDEAWDLFCISTFQGHSCPSHLIDICKYISRKCGGLPLAIVAISGVLATKDKHRIDEWDMICRSLGAEIQGNGKLDNFKTVLNLSFNDLPYHLKYCFLYLSIFPEDYLIQRMRLIRLWIAEGFIKAKEGKTKEDVADDYLKELLNRNLIQVAEITSDGRVKTLRIHDLLREIIILKSKDQNFVSVVKEQSIAWPEKIRRLSVHGTLPCHRQQHIHRSGSQLRSLLMFGVGENLSLGKLFPGGCKLLGVLDYQDAPLNKFPVAVVDLYHLRYLSLRNTKVTMVPGYIIGKLHNLETLDLKKTSVRELPLDILKLQKLRHLLVYKFNVKGYAQFYSKHGFKAPTEIGNLKALQKLCFVEANQDCGMIIRQLGELSQLRRLGILKLREEDGKAFCLSIERLTNLHALSVASEGENKVIDLAFLCSPPPFLQRLYLSGRLQELPSWIQSLHSLARLFLKWSCLKHDPLVYLQDLPSLAHLELVQVYDGDTLHFVCGKFKKLKVLGLDKFDGLKQVTVGEDAMPCLERLSIGRCELLKKVPSGIEHLSKLKVLEFFDMPDELMKTICPHGPGKDYCKVSHIPNVYSTYWRDDGWDVYALDSFSRDCSPRSGTVMRSHEPRTLWKV

SEQ ID NO: 121749 - protein, 185 aa, Glycine max
  Coding DNA Sequence Number=SeqID_4971
  Gene Ontology: Mol. function=protein binding; Cellular component =membrane; Biological process=phosphate transport
  Homolog annotation: Hit_ID=Q7VWC2; Match level="QueryCoverage=99%, HitCoverage=69%, E-value=1e-78, Identity=78%"; Hit description =Putative transport protein
  Pfam annotation: Domain name=PhoU; Domain location=29-117; Score =87.7; E_value=3.7e-23; Accession=PF01895.9; Description=PhoU family
MRSTTQGARMTEHTNKQFDADLESVRSQFLQMGGVVKAMIQEAIDALASGDLTLVEKVRERDKEVNRHEVEIDESIIRILARHQPTAIDLRMLMAVSKMLTDMERSGDEAEKVATVARRIHESEVRHIPVIELRHMAANVRTMLHQALDAFARLDPILAAAVVRNDKEVDKEWKGALRHLITYMI

SEQ ID NO: 121750 - protein, 96 aa, Glycine max
  Coding DNA Sequence Number=SeqID_4972
  Subcellular localization annotation: CTP_CleavageSite=35; ConfidenceScore=5.54e-01
MQRLTQSSAPFVPPGTTKSFTYGNFMVTRDSRQPRGAKLVSYTDFRGPLLDDMRPFFGPCEVLGIHHQAICEILGTTSHGHPRLSSTERSEISVIH

SEQ ID NO: 121751 - protein, 51 aa, Glycine max
  Coding DNA Sequence Number=SeqID_4973
MATATTITIVVITAITTIDVDSGGGGNDNDNGHGDRGGSSNNHDGGCNGLL

SEQ ID NO: 121752 - protein, 96 aa, Glycine max
  Coding DNA Sequence Number=SeqID_4974
MFLRHSLYYCDVHINKKNQESLKDKKRRSRDESRHRLITERARWTKSVSYLCFPLISDKSLETCRKSKGSRLTRSVKFRNVAKTKRRCFCLIREFP

SEQ ID NO: 121753 - protein, 356 aa, Glycine max
  Coding DNA Sequence Number=SeqID_4975
  Gene Ontology: Mol. function=hydrolase activity, acting on glycosyl bonds; Cellular component=nucleus; Biological process=metabolic process
  Homolog annotation: Hit_ID=UPI0000526999; Match level="QueryCoverage =97%, HitCoverage=45%, E-value=5e-78, Identity=46%"; Hit description =alpha-L-rhamnosidase
  Pfam annotation: Domain name=Bac_rhamnosid; Domain location=173-356; Score=-299.9; E_value=0.0011; Accession=PF05592.2; Description =Bacterial alpha-L-rhamnosidase
  Pfam annotation: Domain name=Bac_rhamnosid_N; Domain location=6-168; Score=159.0; E_value=1.2e-44; Accession=PF08531.1; Description=Alpha- L-rhamnosidase N-terminal domai
  Pfam module annotation: Pfam domain module=Bac_rhamnosid::Bac _rhamnosid_N; Domain location=173-356::6-168
RRFDVGNVVSARLYSTALGLYEARLNGHRVGTAELSPGSTSYDRTLYAQAADVTGLLTDGTNSLEIELSDGWYRGQVGAFRLPAGWGTTLGARAELHLELGGGRREVIRTDGDWTSTESKVVRADLMDGQTTDFRLEGHALEPVIVGAVEGPAISWSPAPPVRVVETRDVAHASRTDDDTWVLDFGQNASGWLRLTDLGPSGTRTVIDYGEYVTPDGELSTSHLDSTKPGEPDVVFVQRDEVVSAGGDEAFEPRHTVHGFQYARVTRAGAPFDPATAQMRVVQTDLRRTASFESSDADLNRLHEIADWSFRGNAVDVPTDCPTRERLAWTGDYQVFAPTAARLYDVLGFTRKWLQS

SEQ ID NO: 121754 - protein, 92 aa, Glycine max
  Coding DNA Sequence Number=SeqID_4976
  Gene Ontology: Mol. function=catalytic activity; Biological process =auxin mediated signaling pathway
  Homolog annotation: Hit_ID=P33080; Match level="QueryCoverage=96%, HitCoverage=97%, E-value=1e-35, Identity=76%"; Hit description=Auxin- induced protein X10A
  Pfam annotation: Domain name=Auxin_inducible; Domain location=1-90; Score=166.0; E_value=9.9e-47; Accession=PF02519.5; Description=Auxin responsive protein
MGFRLPGIRKASLAAIQASSKALNVPKGYLAIYVGEKMKQFVIPLSYLNQPSFQDLLSKAEEEFGYDHPMGGLTIPCREDVFLDTSSRLNRC

SEQ ID NO: 121755 - protein, 298 aa, Glycine max
  Coding DNA Sequence Number=SeqID_4977
  Gene Ontology: Mol. function=hydrolase activity, acting on ester bonds; Cellular component=cellulose and pectin-containing cell wall; Biological process=lipid metabolic process
  Homolog annotation: Hit_ID=Q1S8F9; Match level="QueryCoverage=88%, HitCoverage=82%, E-value=9e-98, Identity=63%"; Hit description =Lipolytic enzyme, G-D-S-L
  Pfam annotation: Domain name=Lipase_GDSL; Domain location=15-289; Score=90.2; E_value=6.1e-24; Accession=PF00657.12; Description=GDSL -like LipaseAcylhydrolase
MVEFLILCPQRSRNAGIRISDKLIHVIDYGTVEELGIKELLPAYLKPNLQSSDLITGVCFASGGSGYDPLTSILESSMPLTGQVDLLKEYIGKLKGLVGEDRAKFILANSLFIVVAGSSDISNTYRTRSLLYDLPAYTDLLVNSASNFLTEINELGARRIAVFSAPPIGCLPFQRTVGGGLEKRCAERPNNLAQLFNTKLSKELDSLNRNFPNSRNVFINVYDPLLDIITNHQKYGYKVGDTGCCGTGRIEVAILCNRFDSSCPNVQDYVFWDSFHPTESVYKRLISPILQKYLDQFK

SEQ ID NO: 121756 - protein, 232 aa, Glycine max
  Coding DNA Sequence Number=SeqID_4978
  Gene Ontology: Mol. function=hydrolase activity, acting on ester bonds; Cellular component=cellulose and pectin-containing cell wall; Biological process=lipid metabolic process
  Homolog annotation: Hit_ID=Q1S8F6; Match level="QueryCoverage=82%, HitCoverage=52%, E-value=1e-68, Identity=67%"; Hit description =Lipolytic enzyme, G-D-S-L
  Pfam annotation: Domain name=Lipase_GDSL; Domain location=51-229; Score=55.5; E_value=1.7e-13; Accession=PF00657.12; Description=GDSL -like LipaseAcylhydrolase
MGLFMKLPFPPHLAASSLLHFILLLLLLIFDIVCKTRAVVKIPPNVSVPAVLVFGDSIVDTGNNNNNLGTTARCNYPPYGKDFKGGKPTGRFSNGKVPSDFIAEELGIKEYVPAYLDPHLQPGELATGVCFASGGAGYDPFTSQSASAIPLSGQLDLFKEYIGKLRGVVGEDRAKFILGNSLYVVVFGSNDISNTYFLTRVRQLQYDFPAYADFLLSSASNFFKVVHQLDKN

SEQ ID NO: 121757 - protein, 39 aa, Glycine max
  Coding DNA Sequence Number=SeqID_4979
MRPKSPLPGLVDFHGKRKQMVKIQVLEREIGLLQFDFKF

SEQ ID NO: 121758 - protein, 117 aa, Glycine max
  Coding DNA Sequence Number=SeqID_4980
  Gene Ontology: Mol. function=zinc ion binding
  Homolog annotation: Hit_ID=Q5YLY5; Match level="QueryCoverage=77%, HitCoverage=19%, E-value=4e-24, Identity=58%"; Hit description=Zinc finger protein-like
  Subcellular localization annotation: CTP_CleavageSite=44; ConfidenceScore=5.11e-01
MALCMKFDSITFAFWSKSSVDVEPGRIRLLSNRYTTNTLLDTVNAATIQFKEMGGSRRPSESLRTNEQPTEKKRGFGDWMNLIKPADEEKDHWVTLDANYVFFCFFLNPIPDLAPLK

SEQ ID NO: 121759 - protein, 467 aa, Glycine max
  Coding DNA Sequence Number=SeqID_4981
  Gene Ontology: Mol. function=nucleic acid binding; Cellular component= intracellular; Biological process=peptidyl-diphthamide biosynthetic process from peptidyl-histidine
  Homolog annotation: Hit_ID=Q6K6C0; Match level="QueryCoverage=89%, HitCoverage=90%, E-value=1e-119, Identity=50%"; Hit description =Diphthamide synthesis DPH2-like
  Pfam annotation: Domain name=Diphthamide_syn; Domain location=86-399; Score=398.2; E_value=1.2e-116; Accession=PF01866.8; Description =Putative diphthamide synthesis protein
MEKPAEAENVLVLPPHKQPDNDDNNNNNRPKPKPKRFVKNQIPESILNDPVLNAAISVLPSNYNFEVHKCVWRVLSSGAKRVALQFPEGLLMYSLPLSDILTSFAAVTHCYVLGDVTYGACCVDDLAASALGADLLIHYGHSCLVPIDSTTIPCLYIFVDIKIDVPHFVDTLILNLHKAKTLVIAGTIQFASAIRTAKPQLEELGFRVLIPQSKPLSAGEVLGCTAPKVSSKLLGDDGESSVLVFVADGRFHLEAFMIANPGIRAFRYDPYMGKLFLEEYDHLGMKRSRKNAIFKAREEARSWGLVLGTLGRQGNPRILERLEKMMRDRGFDYTVVLMSEMSPARIALFEDSIDAWIQIACPRLSIDWGEAFVKPVLTPFEADIALGVIPGWWEKNNEVVCCNKSGSCCGDAKGGGEDFGGDYPMDYYAQDGGEWNSSYVIKSTRPPARRVFVVSSVADTTAISQQP

SEQ ID NO: 121760 - protein, 83 aa, Glycine max
  Coding DNA Sequence Number=SeqID_4982
MEEGSKGHATILGEDQRQSISRSWERDEEEMVVANGQWRHVRERERVHCTRGRTSNDQWRRSSSDKDQTIERDQQWREGSIVK

SEQ ID NO: 121761 - protein, 60 aa, Glycine max
  Coding DNA Sequence Number=SeqID_4983
MKHGRRTRHGRRTHGHLSYRVSVSGAGKSQISSKSSGEGSSLKAMRDPRCYYLSIDGVEY

SEQ ID NO: 121762 - protein, 122 aa, Glycine max
  Coding DNA Sequence Number=SeqID_4984
  Gene Ontology: Mol. function=catalytic activity; Biological process =auxin mediated signaling pathway
  Homolog annotation: Hit_ID=Q1S393; Match level="QueryCoverage=72%, HitCoverage=66%, E-value=7e-36, Identity=78%"; Hit description=Auxin responsive SAUR protein
MEINKKLMRTEKPASFDNVVGVDGKQQQQQNPAHCARAANASPVAEEGGGGRSGGTRGSVRGAQQEEVHRARDAPEPPDFQDASCEGRRGIRFLQPRSSRYSLRRVSLRTPSSGGGPTRTPT

SEQ ID NO: 121763 - protein, 1010 aa, Glycine max
  Coding DNA Sequence Number=SeqID_4985
  Gene Ontology: Mol. function=protein binding; Cellular component =membrane; Biological process=retrograde transport, endosome to Golgi
  Homolog annotation: Hit_ID=Q0WRZ0; Match level="QueryCoverage=53%, HitCoverage=63%, E-value=0.0, Identity=71%"; Hit description =Putative vacuolar sorting protein 35
  Pfam annotation: Domain name=Vps35; Domain location=512-1010; Score =393.1; E_value=4e-115; Accession=PF03635.7; Description=Vacuolar protein sorting-associated protein 35
GKLQKGEDCENEQLERSGITEEFDQPVTSVEPCCLSDSTQSSKRKRSSPQLTHDHGPAIKIRLPLRKHREPEETKSKSKLQLGSSSGSVGAIADSFTKTTLASDPQSQCLRITEPKRVLGNSDSRHGKAMLNSVHGDAVVTKNNLVSDRQSQQRLMITEPKRVIGNSDSRHVKAMLNSVHGDAVVTKNTLVSDRQSQQRLMITEPKRVLGNSDLRHGKAMLNSAHGDAVVTKNTLVSDRQSQQRLMITEPKQVRGRADSRHGQAKQNLVHGDAMVTKNPIGSDQCLRITELKRVLGNSDSRNCKLKQNSVHGDAVVTKNTLGSDRQLKSVKITEPKCVTGNSDSKHCKALHNWVHGDAMVTDNAVADVIDTAVDDGIQKVGSLYKSLLQIPPLTYDALDSVDEDWLFSSEPTEARPVSKKQKFDSDVFQLSNSMWPRAQYLPEARFNSTTVAEVRSEAIGRAMIAQGFEDEEKWLAEGIAGIQHNAFFMHRALDDNNLRDALKYSAQMLSELRTSRLSPHKYYQLYMRAFDELRRLEIFFKDESRHGVSIVDLYELVQHAGNILPRLYLLCTVGSVYLRCKDAPVKDVLKDLVEMCRSVQHPIRGLFLRSYLSQVSKDKLLDIGYEYEEGESNSVMDAVEFVLQNFTEMNKLWVRLQLQHQSCLIFGDPELRPSIAHSGLQGPARIREKREKERNELRDLVGKNLHVLSQIEGVDLEMYKDTVLPSVLEQVVNCKDELAQFYLMECIIQVFPDEYHLQTLETLLGACPQLQPTVDIKTVLSQLMDRLSNYAASSTEVLPEFLQVEAFTKLSTAIGRENYRKGCPDKVMDNEQTKCDDVVIEAQVDDMPIVGAIALHVSLLTFTLRVHPDRLDYVDQVLGSCVKKLSGKPKLDDNRATKQVVALLSAPLDKYNDIVTALTLSNYPRVMYHLDHETNKVMAMVIIQSIMKNNTCISTADKVEVLFELIKGLIMDLDGTTVDEVDEEDFNEEQNSVARLIHMLHNDEPEEMFK

SEQ ID NO: 121764 - protein, 318 aa, Glycine max
  Coding DNA Sequence Number=SeqID_4986
  Gene Ontology: Mol. function=protein binding; Cellular component =membrane; Biological process=retrograde transport, endosome to Golgi
  Homolog annotation: Hit_ID=Q0WRZ0; Match level="QueryCoverage=91%, HitCoverage=32%, E-value=3e-96, Identity=64%"; Hit description =Putative vacuolar sorting protein 35
  Pfam annotation: Domain name=Vps35; Domain location=1-282; Score= -339.2; E_value=3.9e-05; Accession=PF03635.7; Description=Vacuolar protein sorting-associated protein 35
MDLPGLVRSIFHYKATDGDPMNHLIRQLQGQDGDIVGEEVPTTPKKIFQLLNEIIEALSSVSSPELALRLYLQCAEAANDCDLEPVAYEFFTQAFVLYEEEIADSKAQVTAIHLIIGSLQRMNVFGIENRDTLTHKATGSVWMRGDDGNGIIPITWRFKIFFREREYQGNHSTSAPKYSAKLLKKPDQCRAVYACSHLFWVDDQDGIKDGERVLLCLKRALRIANAAQQMANAARGSSGPVTLFVEILNKLKGNPQITSSTIQGLIELITTEMQSDSASALPASDAFFTSTLRYIQFQKQKGGILGEKYDPINVSIPA

SEQ ID NO: 121765 - protein, 1263 aa, Glycine max
  Coding DNA Sequence Number=SeqID_4987
  Gene Ontology: Mol. function=ATPase activity, coupled to transmembrane movement of substances; Cellular component=integral to membrane; Biological process=transport
  Homolog annotation: Hit_ID=Q9C7F2; Match level="QueryCoverage=98%, HitCoverage=98%, E-value=0.0, Identity=64%"; Hit description =Multidrug resistance protein 12
  Pfam annotation: Domain name=ABC_membrane; Domain location=46-336; Score=143.7; E_value=5e-40; Accession=PF00664.13; Description=ABC transporter transmembrane region
  Pfam annotation: Domain name=ABC_membrane; Domain location=693-972; Score=172.3; E_value=1.2e-48; Accession=PF00664.13; Description=ABC transporter transmembrane region
  Pfam annotation: Domain name=ABC_tran; Domain location=1044-1228; Score=218.0; E_value=2.1e-62; Accession=PF00005.17; Description=ABC transporter
  Pfam annotation: Domain name=ABC_tran; Domain location=410-594; Score= 239.8; E_value=5.9e-69; Accession=PF00005.17; Description=ABC transporter
  Pfam annotation: Domain name=SMC_N; Domain location=1037-1232; Score=- 130.1; E_value=0.044; Accession=PF02463.9; Description=RecFRecNSMC N terminal domain
  Pfam annotation: Domain name=YibE_F; Domain location=748-983; Score= -152.5; E_value=0.1; Accession=PF07907.2; Description=YibEF-like protein
  Pfam module annotation: Pfam domain module=ABC_membrane::ABC _membrane::ABC_tran::ABC_tran::SMC_N::YibE_F; Domain location=46 -336::693-972::1044-1228::410-594::1037-1232::748-983
MAEVELAPDSRLEQNVSSKIDQQTKTESVSFFGLFATADATDCVLMFLGCFGSCVHGAALPVFFILFGRMIDSLGHLSNDPHKLSSRVSEHALYLVYLGGVVLVSAWMGTSYNLDLISFFPSVAFWMQTGERQTARLRLKYLQAVLKKDINFFDNEARDANIIFHISSDAILVQDAIGDKTGHAIRYLSQFIVGFAIGFTSVWQLTLLTLAVVPLIAVAGGAYTIIMSTLSEKGEAAYAEAGKVAQEVISQVRTVYSFVGEEKAVGSYSKSLDNALKLGKKGGLAKGIGVGFTYGLLFCAWALLLWYASILVRNHKTNGGKAFTTIINVIFSGFALGQAAPNLGSIAKGRAAAGNIMNMIASTSRNSKKFDDGNVVPQVAGEIEFCEVCFAYPSRSNMIFEKLSFSVSAGKTIAIVGPSGSGKSTIVSLIQRFYDPTSGKILLDGYDLKNLQLKWLREQMGLVSQEPALFATTIAGNILFGKEDADMDKVIQAAMAANAHSFIQGLPDGYQTQVGEGGTQLSGGQKQRIAIARAVLRNPKVLLLDEATSALDAESELIVQQALEKIMSNRTTIVVAHRLSTIRDVDTIVVLKNGQVVESGTHLELMSNNGEYVNLVSLQASQNLTNSRSISRSESSRNSSFREPSDNLTLEEQLKLDAAAELQSRDQHLPSKTTSTPSILDLLKLNAPEWPYAILGSVGAILAGMEAPLFALGITHILTAFYSPQGSKIKQEVDRVAFIFLGVAVITIPIYLLLHYFYTLMGERLTARVRLLMFSAILNNEVAWFDKDENNTGSLTAMLAADATLVRSALADRLSTIVQNVALTVTAFVIGFTLSWKLTAVVVACLPLLIGASITEQLFLKGFGGDYGHAYSRATSLAREAIANIRTVAAFGAEDRVSTQFASELNKPNKQALLRGHISGFGYGITQLLAFCSYALGLWYASVLIKKNESNFGDIMKSFMVLIITSLAIAETLALTPDIVKGSQALGSVFGIIQRRTAITPNDTNSKIVTDVKGEIEFRNVSFKYPMRPDITIFQNLNLRVPAGKSLAVVGQSGSGKSTVISLVMRFYDPDSGLVLVDECDIKNLNLRSLRLRIGLVQQEPALFSTTVYENIKYGKEEASEIEVMKAAKAANAHEFISRMPEGYKTEVGERGVQLSGGQKQRVAIARAILKDPSILLLDEATSALDTVSERLVQEALDKLMEGRTTILVAHRLSTVRDANSIAVLQNGRVAEMGSHERLMAKSGSIYKQLVSLQHETRDQEDH

SEQ ID NO: 121766 - protein, 131 aa, Glycine max
  Coding DNA Sequence Number=SeqID_4988
MVKQKSFMKVVGTTMLKSWNVNFLGEPLTLYFVRQKECTEPVKLIKVIWSPPLSLPPSKPLDLSLHAGAVGHSQLSYKGGSSTTKGKSNKKKAQEAKSLFNPCDSYASITNWRKPISCFLSAIDEKYYLPM

SEQ ID NO: 121767 - protein, 52 aa, Glycine max
  Coding DNA Sequence Number=SeqID_4989
MFSNTRKAGPHQNKHLSALLVARGPKGYVAPRMRPHASQVDDATNLIAGLRS

SEQ ID NO: 121768 - protein, 90 aa, Glycine max
  Coding DNA Sequence Number=SeqID_4990
  Gene Ontology: Mol. function=ATP-dependent helicase activity; Cellular component=nucleus; Biological process=rRNA processing
  Homolog annotation: Hit_ID=Q6YS30; Match level="QueryCoverage=68%, HitCoverage=12%, E-value=9e-22, Identity=80%"; Hit description =Putative RNA helicase
MHAVSIIHIIGVFMSFHPGGNQLKNGNFQGLAGELVNVLREAGQIVPDALLKFGTHVKKKESKLYGAHFKEIPVDAPKSQKKTFDDSDED

SEQ ID NO: 121769 - protein, 142 aa, Glycine max
  Coding DNA Sequence Number=SeqID_4991
MTDPIIHPRQQIGNHPNWFWLRREEKRRKGSLSMWKKWKKGKKQLVSSAPWRGEETEEESLKEGKLKVTRQGDGTSTMHVPASNSKHLHHHHHHGINIDPQLRYSFQRNFQVSNPMLKPYFISTFYQITYLFNLSALFHLGN

SEQ ID NO: 121770 - protein, 900 aa, Glycine max
  Coding DNA Sequence Number=SeqID_4992
  Gene Ontology: Mol. function=protein binding; Cellular component =membrane; Biological process=defense response
  Homolog annotation: Hit_ID=Q19PL5; Match level="QueryCoverage=98%, HitCoverage=97%, E-value=0.0, Identity=52%"; Hit description=NBS-LRR type disease resistance protein
  Pfam annotation: Domain name=LRR_1; Domain location=582-603; Score =6.1; E_value=20; Accession=PF00560.23; Description=Leucine Rich Repeat
  Pfam annotation: Domain name=LRR_1; Domain location=605-626; Score =7.8; E_value=10; Accession=PF00560.23; Description=Leucine Rich Repeat
  Pfam annotation: Domain name=LRR_1; Domain location=628-649; Score =11.0; E_value=2.5; Accession=PF00560.23; Description=Leucine Rich Repeat
  Pfam annotation: Domain name=LRR_1; Domain location=781-803; Score =1.3; E_value=1.6e+02; Accession=PF00560.23; Description=Leucine Rich Repeat
  Pfam annotation: Domain name=NB-ARC; Domain location=154-465; Score =314.9; E_value=1.5e-91; Accession=PF00931.13; Description=NB-ARC domain
  Pfam module annotation: Pfam domain module=LRR_1::LRR_1::LRR_1::LRR _1::NB-ARC; Domain location=582-603::605-626::628-649::781-803::154 -465
KSHHQVLPIAEVEKKVMADSSVSFLLDKLSSLLEAEVKLQRGVREDVQHIKYELEGYKGILRVADALEDKNPELKAWVKRVRDVAHDMEDAIDEFSLGLVDQHGQGNNSSFHMNFFTRHKIASNIQGIKSRLDIISQKRPDIPWIGSGSSQRLSSRLDSQGDALLLEEADLVGIDKPKKQLSDLLFNEEAGRAVIPVYGMGGLGKTTLAKQVYDDPKVKKRFRIHAWINVSQSFKLDELLKDLVQQLHTVIGKPAPEAVGQMKSDQLKEVIKNLLQRSRYLVVLDDVWQVKVWDSVKLALPNNNRGSRVMLTTRKKDIALHSCAELGKDFDLEFLPEEEAWYLFCKKTFQGNSCPPHLEEVCRKILKMCGGLPLAIVGIGGALATKGRANIEEWQMVCRSLGSEIEGNDKLEDMKKVLSLSFNELPYYLKSCLLYLSIFPEFHAIEHMRLIRLWIAEGFVNGEEGKTLEEVADSYLKELLDRSLLQVVAKTSDGRMKTCRMHDLLREIVNFKSKDQNFATIAKDQDITWPDKVRRLSIINTLNNVQQNRTAFQLRSLLMFALSDNSLENFSIRALCSTGYKLLRVLDLQDAPLEVFPAEIVSLYLLKYLSLKNTKVKSIPGSIKKLQQLETLDLKHTHVTVLPVEIVELQRLRHLLVYRYEIESYANLHSRHGFKVAAPIGLMQSLQKLCFIEADQALMIELGKLTRLRRLGIRKMRKQDGAALCSSIEKMINLRSLSITAIEEDEIIDIHNIFRPPQYLHQLYLSGRLDNFPHWISSLKNLVRVFLKWSRLKEDPLVHLQDLPNLRHVEFLQVYVGETLHFKAKGFPSLKVLGLDYLDGLKSMTVEEGAMPGLKKLIIQRCDSLKQHCVQMEVRIIGECNKFQQFISPIGGIGVGMSTH

SEQ ID NO: 121771 - protein, 129 aa, Glycine max
  Coding DNA Sequence Number=SeqID_4993
MGRPSWGQAFMLGDLLWLHLGLAIRGHQVERFTKLKGSWLNLGIVSPRGSEFGDFFLDPGHVLDFNNSLIVDGSMNSMGIMAFVPYGPKDDSINCLCLTIGLRMFDKEVVATYEVFLGEFLHLVGRNFS

SEQ ID NO: 121772 - protein, 301 aa, Glycine max
  Coding DNA Sequence Number=SeqID_4994
  Gene Ontology: Mol. function=methyltransferase activity; Cellular component=chloroplast; Biological process=metabolic process
  Homolog annotation: Hit_ID=Q56GA2; Match level="QueryCoverage=83%, HitCoverage=71%, E-value=1e-131, Identity=90%"; Hit description =Gamma-tocopherol methyltransferase
  Pfam annotation: Domain name=CMAS; Domain location=25-280; Score= -151.1; E_value=6.7e-05; Accession=PF02353.10; Description =Cyclopropane-fatty-acyl-phospholipid synthase
  Pfam annotation: Domain name=Methyltransf_11; Domain location=85-183; Score=104.5; E_value=3.1e-28; Accession=PF08241.2; Description =Methyltransferase domain
  Pfam annotation: Domain name=Methyltransf_12; Domain location=85-181; Score=54.6; E_value=3.2e-13; Accession=PF08242.2; Description =Methyltransferase domain
  Pfam module annotation: Pfam domain module=CMAS::Methyltransf _11::Methyltransf_12; Domain location=25-280::85-183::85-181
MSVEQKAAGKEEEGKLQKGIAEFYDESSGIWENIWGDHMHHGFYDPDSTVSVSDHRAAQIRMIQESLRFASLLSENPSKWPKSIVDVGCGIGGSSRYLAKKFGATSVGITLSPVQAQRANSLAAAQGLADKVSFEVADALKQPFPDGKFDLVWSMESGEHMPDKAKFVGELARVAAPGGTIIIVTWCHRDLGPDEQSLLPWEQDLLKKICDSYYLPAWCSTSDYVKLLESLSLQDIKSADWSPFVAPFWPAVIRTALTWNGLTSLLRSGKLILNFISYLKSCTVIVVDNYFHIHSNFYIAN

SEQ ID NO: 121773 - protein, 521 aa, Glycine max
  Coding DNA Sequence Number=SeqID_4995
MPSFLFDSAIGMGGTDSGGSIEQPMMDREVISISGSSLKDTRCGASDSKSSSSERVRALHPTGGGISRPCEKAQPSTTSGELVPVIVILPPSASGGVRRVRDDVMKYKSSLTSAASITALQRQVKLASPKDFWKIVVQACGSDDFPFLRATSGNPPFVFQCALLEHLNVVPSELHPNSWAMDRFFKVLDSGVMADGLPLLLNTDAQQDLLTLVERVDKAILEHLPASLDTQAILSLPLVSNPFAVVDGKVPNLAPFFGLRLVGPARGNIPPPTAAFAERGQPAVKVGHVVVGTAEIAPSAPSTVLDKRRASSSVRALRQVVGLTPVVGCPSSVQDVPLALLIVKASTIDVVVAATRAPPPPLVVLVQEVAPVTTEVSVSAALAGAVVAPSSTVTAPILNVGVRPKVASTIVALIEVTLQGLAGREKELGWQGGECCGGKERACKEYGGSQGSVEGVESMLEESKIRAAREREANKELEEELLIYKKEDLDLGLFDPFKDVKDGILLDEDDIAAEEEASEEE

SEQ ID NO: 121774 - protein, 102 aa, Glycine max
  Coding DNA Sequence Number=SeqID_4996
MGTDGKFVADNAGMDSQHHVGDASMLMAGEVLIELRTLPGFRSELQLDELFDRFWASVKNVFAPIYIEFIGQACLVDGQGSDWRPFIHALDLSTFNCYGGKA

SEQ ID NO: 121775 - protein, 343 aa, Glycine max
  Coding DNA Sequence Number=SeqID_4997
  Gene Ontology: Mol. function=protein transporter activity; Cellular component=integral to membrane; Biological process=intracellular protein transport
  Homolog annotation: Hit_ID=Q9SUJ1; Match level="QueryCoverage=99%, HitCoverage=92%, E-value=1e-113, Identity=73%"; Hit description =Syntaxin-43
  Pfam annotation: Domain name=SNARE; Domain location=235-294; Score =65.5; E_value=1.7e-16; Accession=PF05739.9; Description=SNARE domain
  Pfam annotation: Domain name=Syntaxin; Domain location=77-172; Score =69.9; E_value=8.2e-18; Accession=PF00804.15; Description=Syntaxin
  Pfam module annotation: Pfam domain module=SNARE::Syntaxin; Domain location=235-294::77-172
  Subcellular localization annotation: CTP_CleavageSite=71; ConfidenceScore=5.46e-01
MATRNRTLLFRKHRDALKSVRIPSFSSAPSTASGAGGGPVIELATTSFLNSNRSYTPISTDDPGNSSRGPNAITVGLPPVWVDLSEEIAANVQRARTKMGELAKAHSKALMPSFGDGKEDQRAIETLTHEITDLIKKSEKRLRRLSATGPSEDSNVRKNVQRSLATDLQNLSVELRKKQSTYLKRLRQQKEGQDGVDLEMLNGSKSKYEDDDLDNMVFNEHQMAKLKKSEAFTIEREKEIQQVVESVNELAQIMKDLSVLVIDQGTIVDRIDYNIQNVATTVEDGLKQLQKVLLPFLVYYFNLAVLLASLFPSISLSLSHFPYDNYLVYGKCRQRELRKREAW

SEQ ID NO: 121776 - protein, 490 aa, Glycine max
  Coding DNA Sequence Number=SeqID_4998
  Gene Ontology: Mol. function=calmodulin binding
  Homolog annotation: Hit_ID=Q0WVV6; Match level="QueryCoverage=63%, HitCoverage=51%, E-value=1e-64, Identity=42%"; Hit description =Putative calmodulin-binding protein
  Pfam annotation: Domain name=Calmodulin_bind; Domain location=92-395; Score=372.3; E_value=7.8e-109; Accession=PF07887.2; Description =Calmodulin binding protein-like
MESNRQSLEGHEGADGRGHRISVMQSTQKHGDPKQPSLSGLRNVMKGLCTNDCELHFERFLRRVVREEVECKIQDFLSSRGWVNQISTSRATPFELRFVTRTPDIIFTNSNVISEDKTSIQIALFDVRDQSVVNVGPLSSLKVEICALNGEFGSNGSEDWTEGEFNANILRERDGRRPLLNGDRFITLKNGVGCVNKLVFTDNSRWIRSRKFRLGAKVVPPISIEANIKEGRSEPFVVKDYRGEAYKKHHPPSLNDDVWRLEQIAKDGKIHDRLSLHGIHTVQDLLRLYTTNPSSLLEKVGNITKRSWITIIEHAKTCAIDDDETFVYHTAEQSIGLLFNSIYILVGVTFDGQNYLSPDILNPNEKHLVETLKQHAYKNTDNFKSIHETSLSCSKPLTFLGVGQSDATEQSLQRFNISTEQEGHQGTWVGNGQPYASTSYTDESVHSYQIYADPVPDITDMPLNNPYGSNSMKDFFSGLCIEGDSWVPYG

SEQ ID NO: 121777 - protein, 218 aa, Glycine max
  Coding DNA Sequence Number=SeqID_4999
  Subcellular localization annotation: CTP_CleavageSite=64; ConfidenceScore=5.28e-01
MNIHSRSSKALKTQGPSLTIPWSILQRNHKTQGPSLVSPTDSRHYVSNTCYPQGVTCMQEHNTRVAHKTRQTQASHLVILTGSQNPRPILGKPRCSSTGFSKPREKHILDPRLDKSKEYKFIKSPRSILSTKKPKVYPWYARLQNPRHPLSLLTPSNYDGHHQRSCLLLINIRGETSQVKRPTPRLVGKTVNQGQVKHTPHKHQGISSAKQKEVPPNG

SEQ ID NO: 121778 - protein, 75 aa, Glycine max
  Coding DNA Sequence Number=SeqID_5000
MKGLSAFSMLLAMLGNGLMLPRALLIRDFMCLNIISKEFFLSATVGLISWIGYSLNPIALINTLSHISVAIPRLC

SEQ ID NO: 121779 - protein, 910 aa, Glycine max
  Coding DNA Sequence Number=SeqID_5001
  Gene Ontology: Mol. function=DNA topoisomerase (ATP-hydrolyzing) activity; Cellular component=chromosome; Biological process=DNA topological change
  Homolog annotation: Hit_ID=O24307; Match level="QueryCoverage=98%, HitCoverage=99%, E-value=0.0, Identity=64%"; Hit description =Topoisomerase I
  Pfam annotation: Domain name=Topoisom_I; Domain location=564-798; Score=498.8; E_value=6.4e-147; Accession=PF01028.11; Description =Eukaryotic DNA topoisomerase I, catal
  Pfam annotation: Domain name=Topoisom_I_N; Domain location=348-561; Score=534.8; E_value=9.4e-158; Accession=PF02919.5; Description =Eukaryotic DNA topoisomerase I, DNA b
  Pfam module annotation: Pfam domain module=Topoisom_I::Topoisom_I_N; Domain location=564-798::348-561
MAVETSDKPNLPHDFDDDDDGPVIYKRYSSSKKNQLHSEVRKSSSHSHAGQSYRQISDAPSLNGQTFSMQKGSTVPSPKPSPVKPSVAISKASKSLVNTSSTKLPVANSKAPSLGDKQKMSVDVKVEPKYIERCAKNFVEDSEDDEDNKPLSFRLKNSNHDNKATPVVVKKSSEDSDDDVPLAKKLYRNPNLGTTSSNRDDSDQKKPISKIQKERQNGAGLSNKKDRPSPLPAKRPLDNSDSLHASVKKPKVSDPVASIKTKPVSVKHELKVEDDDDDIPISQRIKKSAMSGDKSSATKKLLTKVTKVNKSGSKPFKKQIKKTVKKSGSGSEYSKSTKLLPSSGDGQKKWTTLVHNGVIFPPPYQPHGVKMLYKGRPVDLTPELEEVATMYAVMRDTEYMQKDRFKENFWNDWRKLLGRNHVIQNLKDCDFTPIYDWYQSEKEKKKQMTTEEKKALKEEKMKLEEKYMWAIVDGVKEKVGNFRVEPPGLFRGRGEHPKVMGKLKRRIRPGDITINIGKDAPIPECPIPGESWKEIRNDNTVTWLAYWSDPINPKLFKYVFLAASSSLKGQSDKEKYEKARMLKNYIGNIRSAYTKDFTSKDITKQQIAVATYLIDKLALRAGNEKDDDEADTVGCCTLKVENVTREPPNKLKFNFLGKDSIKYENTVEVELPVYNAILKFQKDKKPGDDLFDQLDTSKLNAHLKELMPGLTAKVFRTFNASITLDVMLNKETKDGEVGEKIVVYQHANKQVAIICNHQRSVSKSHTAQMSKLTEKIDELQAVLKELKTDLDRARKGKPPSKSSDGKRKKNLGPEMLEKKISQTNAKIEKMQRDMKTKEDLKTVALGTSKINYLDPRITVAWCKRHEVPIEKVLASFFVQIKLLITLFSSISRSWGDLLWPCSLPIFLKFI

SEQ ID NO: 121780 - protein, 225 aa, Glycine max
  Coding DNA Sequence Number=SeqID_5002
  Gene Ontology: Mol. function=serine esterase activity; Cellular component=integral to membrane; Biological process=medium-chain fatty acid metabolic process
  Homolog annotation: Hit_ID=Q680G4; Match level="QueryCoverage=93%, HitCoverage=51%, E-value=4e-83, Identity=69%"; Hit description =Putative LEA protein
  Pfam annotation: Domain name=Abhydrolase_1; Domain location=27-225; Score=-9.5; E_value=0.043; Accession=PF00561.10; Description =alphabeta hydrolase fold
MTVSYVVNEEMDAYVRHMLLRDRTKGWRVFVFNSLGCGDSPVTTPQFYLASFLGDMREVVSHVTGRYPNANVYSVGWSVAANILVRYLGQESHNCPLSGAVSLCNPFNLVMADEDFRKGFNIIYDKALSKALRKIFNKHVLLFEDIGAEYNIPLAANAKSVREFDDALTRVSFGFKSMDEYYSNSSSSDSIKHVKTPLLCIQAANDPIAPNRGIPGEDIEGDEKY

SEQ ID NO: 121781 - protein, 312 aa, Glycine max
  Coding DNA Sequence Number=SeqID_5003
LEMKPQTNGMSRAHKANNNTQFEGPNWLIFAAGALLSTLSIRLGYKLKQAVDSKPKQNATTGQKGTGGTMELKCPPNGQMQMLNEFDGALPLVTVPAVAEFSKENGVVWACSPDRLELPSKPFHHSNCSDSPCVSESGSDIFSKREVIQKLRQQLKRRDDMILEMQDQMAELQNSLNAQMGLSSHLQLQLDATNSDLFDSEREIQRLRKAIADHCVGFVHHDKSSKVTVFPAEIRNDLSNGHLDGENNCESPEKLRDEEERIELLKRQVGELKEVIEGKEYLLQNYKEQKAELSLKIRELQQRLDSQLPNIL

SEQ ID NO: 121782 - protein, 208 aa, Glycine max
  Coding DNA Sequence Number=SeqID_5004
  Gene Ontology: Mol. function=monooxygenase activity; Cellular component=membrane; Biological process=electron transport
  Homolog annotation: Hit_ID=Q1SYH3; Match level="QueryCoverage=99%, HitCoverage=92%, E-value=5e-31, Identity=52%"; Hit description=E -class P450, group I
METWFVATILCLCLSVILKAIRNVFFSPLPPGPHKCSFRLLPQYLTDPKTILQKLHAKYGSIFTVHVGYSRTDIFIADRFLAHQALIQHGTVFADRPKANPTNKIISSNQHDILFSFYGPKWRLLRRNLTSRILHPSQIGRDPTAWDDPLAFKPERFMNNGEQNGGTNFDIMGSKEIKMMPFGAGRRMCPGYALEILHLEYFVANFVW

SEQ ID NO: 121783 - protein, 42 aa, Glycine max
  Coding DNA Sequence Number=SeqID_5005
MKKNCLRKKRNRTPQAKWSGSVHVLHRLKSLRLRVCLVTVVA

SEQ ID NO: 121784 - protein, 183 aa, Glycine max
  Coding DNA Sequence Number=SeqID_5006
  Subcellular localization annotation: CTP_CleavageSite=35; ConfidenceScore=5.48e-01
MATLPSSPPSPPESTTPFSLFTLKKTRKATRFRLLATRPAGVERPVIHVDPVTGKADGLHKKKLRIYLGIVACDKVDVTYDNWKQVPVTQKDLIWEDIQIVGERWRQFESYLTSKWGLAHDRECEDDKVCEKYDISKEKWAQFCQSRRDPSWEMFERRRRPFRNKTLPFTCCLMRIMIFYNKS

SEQ ID NO: 121785 - protein, 52 aa, Glycine max
  Coding DNA Sequence Number=SeqID_5007
MGNANRHPYSTCESPADSPMRKFERTRRKQLDEEASCFNVKEIHKGVLRVRN

SEQ ID NO: 121786 - protein, 121 aa, Glycine max
  Coding DNA Sequence Number=SeqID_5008
MEEEAHSKPYGEEQAANVGGESLHKGEEELMKLCYLKKAYQLNFIKRIFKYRFFLRKHQNDYLMYRNMPLLRASETRLTGALSKGGKMCGVATNVYLWKTSEKPKETGQNENSKFGSCIYV

SEQ ID NO: 121787 - protein, 223 aa, Glycine max
  Coding DNA Sequence Number=SeqID_5009
  Gene Ontology: Cellular component=peroxisomal membrane; Biological process=peroxisome fission
  Homolog annotation: Hit_ID=Q10MN2; Match level="QueryCoverage=95%, HitCoverage=86%, E-value=3e-20, Identity=31%"; Hit description =Peroxisomal biogenesis factor 11 family protein, expressed
  Pfam annotation: Domain name=PEX11; Domain location=5-221; Score =260.9; E_value=2.6e-75; Accession=PF05648.4; Description=Peroxisomal biogenesis factor 11 (PEX11)
MNDSVDKLVIFLAKRDGIDKVVKTFQYVSKLVNWHVEGTQADISRRFKQWEVASGLSRKAFRTGRFLSGFNVLRRNPGSTLSLRLLAVLANAGEMVYFFFDHFLWLARIGTIDASLAKKMSFISAFGESVGYVFFIIADFIMLKEGIKAQRELSSSKEEEIKIGIQKIRSDRIMRLMAVAANVADLFIAIAEIEPNPFCNHTVTLGISGLVSAWAGWYRNWPS

SEQ ID NO: 121788 - protein, 188 aa, Glycine max
  Coding DNA Sequence Number=SeqID_5010
  Homolog annotation: Hit_ID=Q8S8T8; Match level="QueryCoverage=27%, HitCoverage=27%, E-value=4e-08, Identity=49%"; Hit description =Expressed protein
  Pfam annotation: Domain name=PLAC8; Domain location=111-185; Score =26.0; E_value=2.4e-05; Accession=PF04749.7; Description=PLAC8 family
MAIKERHSIGRLTQILNSVFVFGEMEERKQSRYVKLTKDQTPLEDITPGELNQPIQVPQGNPIPTKGRDGYLFSTPERNRNWVEDRLDVRKCPECRQPLPESYAPPADEPWMTGIFGCAEDRESCLTGLFCPCVLFGRNVERLKEDTPWTGPCICHAICIEGFIVYMVDVWHSHWSSAPILTEEISLE

SEQ ID NO: 121789 - protein, 111 aa, Glycine max
  Coding DNA Sequence Number=SeqID_5011
  Gene Ontology: Cellular component=mitochondrion
  Homolog annotation: Hit_ID=Q39818; Match level="QueryCoverage=96%, HitCoverage=72%, E-value=2e-21, Identity=47%"; Hit description=Heat shock 22 kDa protein, mitochondrial precursor
MASSLILKRFVYSSLLSCKSPTLLRPAASASHRSFNDHADDNDDRGSRSGTRVGFEPGSEHDESRRGWEWDAKETKDVLLLRVNMPGLGKEHVKISVEQNTLAVKGEGDEK

SEQ ID NO: 121790 - protein, 826 aa, Glycine max
  Coding DNA Sequence Number=SeqID_5012
  Gene Ontology: Mol. function=protein binding; Cellular component =membrane; Biological process=protein transport
  Homolog annotation: Hit_ID=Q655R9; Match level="QueryCoverage=99%, HitCoverage=99%, E-value=0.0, Identity=63%"; Hit description =Oligomeric golgi complex 7-like
MMLDLGSFSNENFDPKKWINSACQSRHPQDSLDKHLVDMEMKLQMVSEEIAASLEEQSSAALLRVPRATRDVIRLRDDAVSLRSAVSSILQKLKKAEGSSAESIAALAKVDVVKQRMEAAYETLQDAAGLTQLSATVEDVFASGDLPRAAETLANMRHCLSAVGEVAEFANIRKQLEVLEDRLDNMVQPRLTDALSNRKVDAAQDLRGILIRIGRFKSLESQYIKVHLKPIKQLWEDFDSRERASKSANEKNEMERTSSGDDFQSVSPAIPFSSWLPSFYDELLLYLEQEWKWCMIAFPDDYKTLVPRLLSETMMAIGSSFISRINLAIGDAVPETKALAKGAGDMQKGIKLQTKHLEALIELHNMTGTFARNIQHLFSVSDVRVLMDVLKSVYLPYESFKQRYGQMERAILSAEIAGVDLRGAVIRGLGAQGVELSETVRRMEESIPQITILLEAAAERCINFTGGSEADELILALDDIMLQYISTLQETLKSLRTVCGVDYGSDGTVKKDMEKKDGNQNARRVDLISNEEEWSIVQGALQILTVADNLTSRSSVFEASLRATLARLSTTLSFSAFGSSLDQHQTINSSVDGEPSYGGRAALDMAALRLVDVSEKARKLFNLLNQSRDPRFHALPLASQRVAAFTDTVNELVYDVLISKVRQRLSDVSRLPIWSSVEEQGAFPLPTFSAYPQSYVTSVGEYLLTLPQQLEPLAEGISNNEVNDEAQFFATEWMFKGATALYIEQLRGIQYISDRGAQQLSVDIEYLSNVLSALSMPIPPVLATFQSCLSTPRNQLKDLLKTDSGNQLDLPTANLVCKMRRVNLDS

SEQ ID NO: 121791 - protein, 333 aa, Glycine max
  Coding DNA Sequence Number=SeqID_5013
  Gene Ontology: Mol. function=protein binding; Cellular component =nucleus; Biological process=response to stress
  Homolog annotation: Hit_ID=Q84LL9; Match level="QueryCoverage=67%, HitCoverage=65%, E-value=1e-102, Identity=80%"; Hit description=Salt tolerance protein 3
  Pfam annotation: Domain name=LUC7; Domain location=1-267; Score =356.6; E_value=4.1e-104; Accession=PF03194.6; Description=LUC7 N _terminus
MDAQRALLDELMGAARNLTEEERKGYKEVSWDDKEVCGFYMVRFCPHDLFVNTRSDLGPCPRIHDPKLKESFEKSPRHDAYVPKFEAELSQFCEKLVMDLDRRVRRGRERLAQEVEPAPPPPLTAEKSEQLSVLEEKIKNLLEQVESLGEAGKVDEAEALMRKVETLNAEKTALTQPQNDKLLMLGQEKKMALCEICGSFLVANDAAERTQSHVTGKQHVGYGMTAKEKANEEERLAREREVEERRKQREKESERRRSDSSDRDRHRDKDHNRERDRYRDRDSDRERSREHDVRGYRDGGRGMDYRVRNGGRDRYRDRSRSRSPVKHSHRRSS

SEQ ID NO: 121792 - protein, 57 aa, Glycine max
  Coding DNA Sequence Number=SeqID_5014
MSLRLGRYLARDVPVTTKKPNKKRKGVIKGRVSNGKTYQEEDLLLRSRKKNKQGRWS

SEQ ID NO: 121793 - protein, 51 aa, Glycine max
  Coding DNA Sequence Number=SeqID_5015
MVTYYGCKLSMFQNMFGMEKKTGNYTSDELSPQRCAAPPITKLNQSEVCAS

SEQ ID NO: 121794 - protein, 158 aa, Glycine max
  Coding DNA Sequence Number=SeqID_5016
  Homolog annotation: Hit_ID=Q6YNK1; Match level="QueryCoverage=26%, HitCoverage=19%, E-value=3e-07, Identity=64%"; Hit description=HAP3 -like transcriptional-activator
  Subcellular localization annotation: CTP_CleavageSite=103; ConfidenceScore=5.09e-01
MCQRQPKAANGAGDMHTGTSLPRARYQSNGPDHGALTKSKGSYLSVQTHTCCSPSVPFHLSSSRQSSRHLPSATVSDPPNTPFSTSTQNLICFIFLNASSIICLSMADSNNESGGALNAEKGSEMSPREQDQFLPIANMSRIMKKGIENGYLPFFNQE

SEQ ID NO: 121795 - protein, 117 aa, Glycine max
  Coding DNA Sequence Number=SeqID_5017
MTVVNPPPVQEMKTTDDKETPETSSPNNGEHTDLEIQAPWLEEEEEEGMGDIFYGNDDHREMNDCMYKEDVIESMRKQREIKELKRRQNNNNYCCCYLYFLRCFDDFLTLLRAFINF

SEQ ID NO: 121796 - protein, 66 aa, Glycine max
  Coding DNA Sequence Number=SeqID_5018
  Homolog annotation: Hit_ID=Q9ZWR4; Match level="QueryCoverage=70%, HitCoverage=5%, E-value=2e-14, Identity=80%"; Hit description =Importin-beta2
MAAARNYKIGAAHFQSLGFEEKVLVYCDGIITQLHVELSSNQLHRSVKPPIFSSFGDIALAIGEKF

SEQ ID NO: 121797 - protein, 319 aa, Glycine max
  Coding DNA Sequence Number=SeqID_5019
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9FT02; Match level="QueryCoverage=97%, HitCoverage=72%, E-value=1e-129, Identity=68%"; Hit description=(1 -4)-beta-mannan endohydrolase
  Pfam annotation: Domain name=Cellulase; Domain location=39-314; Score= -80.3; E_value=0.022; Accession=PF00150.8; Description=Cellulase (glycosyl hydrolase family 5
MISIMNLTSSMAIISVLISALVCEARLLRVTPGFVETKGTELVLNDSPFLFNGFNSYWMMNVAADPNQRYKVSNVFREASAIGLTVCRTWAFSDGGNQSLQISPGLYNEAMFQALDFVVAEARKYRVRLILSLVNNYNDFGGRPRYVQWANSSGVPVANDDDFYTNPVVKGYYKNHVKRVLTRINTITKTAYRDEPTIMAWELINEPRCQVDYSGKTINAWVQEMAPYVKSIDPMHLLEVGMEGFYGDSIPDRKLDNPGFQVGTDFVSNHLIKEIDFATIHAYPDNWLTGQNDTMQMAFMQRWMTSHWEDSRTILKKPL

SEQ ID NO: 121798 - protein, 37 aa, Glycine max
  Coding DNA Sequence Number=SeqID_5020
  Gene Ontology: Mol. function=zinc ion binding; Cellular component =intracellular
  Homolog annotation: Hit_ID=Q1RWK5; Match level="QueryCoverage=81%, HitCoverage=21%, E-value=3e-12, Identity=83%"; Hit description=Zinc finger, RanBP2-type
METGFAQESAVEYIIMLAGQSASNAKCQGILVRKFNF

SEQ ID NO: 121799 - protein, 530 aa, Glycine max
  Coding DNA Sequence Number=SeqID_5021
  Gene Ontology: Mol. function=ATP-dependent helicase activity; Cellular component=intracellular; Biological process=DNA recombination
  Homolog annotation: Hit_ID=Q9FT74; Match level="QueryCoverage=97%, HitCoverage=81%, E-value=1e-175, Identity=62%"; Hit description=DNA Helicase
  Pfam annotation: Domain name=DEAD; Domain location=210-408; Score =62.6; E_value=1.3e-15; Accession=PF00270.19; Description=DEADDEAH box helicase
  Pfam annotation: Domain name=Helicase_C; Domain location=474-530; Score=2.8; E_value=0.0087; Accession=PF00271.21; Description =Helicase conserved C-terminal domain
  Pfam annotation: Domain name=ResIII; Domain location=206-402; Score= -31.2; E_value=0.019; Accession=PF04851.6; Description=Type III restriction enzyme, res subunit
  Pfam module annotation: Pfam domain module=DEAD::Helicase_C::ResIII; Domain location=210-408::474-530::206-402
MGSSSRKKNQDLELEKVRLISLALEFGFDESSANKCLDRLIALYGEDGRDFITVEHCGDDFLAALAESMQTEDWDDQQEMESQACGTLTHVLDKTVDTCADADNDDASRSFFVDIVDDSPQPQRRKGKSHTNVVELDSSDDEDMHCSVSREKPTDYRSGITQGSVSSTSSKMQSSFASRDTSSSPTYEELQALDDIELANVVIFGNRTFRPLQHQACKAALAKQDSFILMPTGGGKSLCYQLPATLQPGVTVVVSPLLSLIQDQIITLNLKFGIPSTFLNSQQTASQVTAVLQELSLLVSRKDKPSCKLLYVTPERIAGNQSFLEILKFMHQKGQLAGFVVDEAHCVSQYHNNNVNASVYSINTKIQCQWGHDFRPDYRGLGSLKLHFPDVPVMALTATATHAVREDILKALRIPHALVLERSFDRPNLKYEVIAKTKEPLKQLGQLLIDRFRNQCGIVYCLSKSECVEVSKFLNEKCKIKTVYYHAGLAARQRVAVQKKWYDGEVHIVCATIAFGMGIDKPDVVSCATS

SEQ ID NO: 121800 - protein, 304 aa, Glycine max
  Coding DNA Sequence Number=SeqID_5022
  Gene Ontology: Mol. function=RNA-directed DNA polymerase activity; Cellular component=extracellular region; Biological process=RNA -dependent DNA replication
AKSQFGIIGGRVNWVNHAAQIMKCRQLQTPFCYLGIPIGAKPSSNMVTLINSVLNALPIYLLSFFKIPQKDYKKIPWVKWETICLPNEEGGLGIKEISKFNEALLGKWIWDLASDQQQLWARIIKSKYGGWEELQLGRDRRGCSHWWKDLRKIYHNSGQSLFQQNLATTQHHITDGEFSEDGWRWDLNWRRNLFDHESVLAVNFMEDITSISIQRNVKDTMVWKAESTGVYSTRSAYRMMLNINASAIDVRIFKLIWKMNIPPRAATFTWRLLKDRLPTKGNLLRRNVITQDADCPLCGQVQEE

SEQ ID NO: 121801 - protein, 666 aa, Glycine max
  Coding DNA Sequence Number=SeqID_5023
  Gene Ontology: Mol. function=transcription factor activity; Cellular component=nucleus; Biological process=regulation of transcription
  Homolog annotation: Hit_ID=Q2LAH5; Match level="QueryCoverage=39%, HitCoverage=61%, E-value=1e-121, Identity=80%"; Hit description =Polygalacturonase precursor
  Pfam annotation: Domain name=GRAS; Domain location=4-319; Score =126.7; E_value=6.7e-35; Accession=PF03514.5; Description=GRAS family transcription factor
  Pfam annotation: Domain name=Glyco_hydro_28; Domain location=433-665; Score=165.4; E_value=1.4e-46; Accession=PF00295.8; Description =Glycosyl hydrolases family 28
  Pfam module annotation: Pfam domain module=GRAS::Glyco_hydro_28; Domain location=4-319::433-665
MNWDDDERIHLINLLNDCVRLTELGNFNDADIALYHLSQLASSDGDSMQRVATYFIEALAYCQVVKNLRGVPKVLHLVKTLSTPEQQLVKKLFFDFYPFIKIAHTITNQAIIEAMKGETSINVLDLSPSYNALQWTNLMKCLLKPNTPTCLKITITAIHEKKEVLEQMGLHLGVEAESLENLDPEKLPIKKGEPLAISSVLQLHSLLATDDDNEMVKMRRGTGQRMFPEMLAKPKKKKVVNPSPDSALSPFSPCPSHKMESFLYGLWKLQPKVMVITEQESNVNNGSSLTKRVRSALKFYSTLFDCLEASTSRTSERRSLMEKMLLGEEIRNIVAGEGVERKERHEKLVTWIPRLELAGFRREPISSNGIRLATKLLQTYVPGYHIHQKNKANRAIHLSSSRPRGTVSVDDFGAKADGRDDSEAFGKAWNEACSRGAILVVPENKIYRLKPITFSGPCRPNTAFMLYGTIEAWTQMSAYQEDRQHWIVFDRVSNFRVGGGGTFNGKGKKWWQSSCKVNTNHAVTFYQCNNLKVTNLRFKDAPQMHVTFEGCFNVIVSNLVIRAPGDSPNTDGIHVADTQNIVISNTDIGTGDDCISIISGSQNVRATDITCGPGHGISIGSLGADNSEAEVSNVVVNRATLIGTANGAVRQFTTPETVERIETMEV

SEQ ID NO: 121802 - protein, 262 aa, Glycine max
  Coding DNA Sequence Number=SeqID_5024
  Gene Ontology: Mol. function=nitric-oxide synthase activity; Cellular component=intracellular
  Homolog annotation: Hit_ID=Q66GP9; Match level="QueryCoverage=99%, HitCoverage=46%, E-value=5e-89, Identity=60%"; Hit description =Nitric-oxide synthase 1
MAINDPVAASAQRYKPIQSAVPGTTLGPIQINAFLGGGKLYDTPGVHLFHRQTAVVHSEDLPILAPQSRLRGLAFPSSIVSSDNVEEGASTIVNGLNEFSIFWGGLVRIDVLKVLPETCLTFYGPKRIPIHMVPTEQAVEFYQTELGFLLTPPSGGENAENWKGLESERKLQIKFEVVDRPACDIAISGLGWFTVEPVSRSHKISQPKPVETAGELILAVHVPKAVEIFVRPPIPVSKAGAEWYQYVELTEKQEEMRPKWYF

SEQ ID NO: 121803 - protein, 497 aa, Glycine max
  Coding DNA Sequence Number=SeqID_5025
  Gene Ontology: Mol. function=hydrolase activity; Cellular component =chloroplast; Biological process=biological_process
  Homolog annotation: Hit_ID=Q1SAN8; Match level="QueryCoverage=97%, HitCoverage=79%, E-value=0.0, Identity=85%"; Hit description =Metallophosphoesterase; Fibronectin, type III-like fold
  Pfam annotation: Domain name=Metallophos; Domain location=183-395; Score=76.0; E_value=1.1e-19; Accession=PF00149.18; Description =Calcineurin-like phosphoesterase
MKNDPNYLSCKKKECKTFQNGKCDVSTCSGSLQFHVINIRSDIEFVFFSGGFVKPCLVGRSTPVSFANPKRPLYGHISSIDSTGTSMRLTWVSGDKEPQQIQYGNGKTVTSAVTTFSQDDMCSSTLPSPAKDFGWHDPGYIHSALMTGLKPSSTFSYRYGSGSVGWSEEIKFSTPPAGGSDELRFIAFGDMGKTPLDASEEHYIQPGALSVIKAIANDVNSNNINSVFHIGDISYATGFLAEWDYFLHLINPVASRISYMTAIGNHERDYIDSGSVYVTPDSGGECGVPYETYFPMPTSAKDKPWYSIEQGSVHFTVISTEHAWSENSEQYVWMQKDMASVNRQKTPWLIFMGHRPMYTTNHGFVPSENKFMKAVEPLLLENKVDLVLFGHVHNYERTCSVFQNECKAMPTKDKNGMDTYDGRNYSAPVHAVIGMAGFTLDKFSNNVESWSLKRISEFGYLRAHATRNDLNLEIQEKLRTVSTSQSNSSLKIESIHK

SEQ ID NO: 121804 - protein, 252 aa, Glycine max
  Coding DNA Sequence Number=SeqID_5026
  Gene Ontology: Mol. function=transporter activity; Cellular component= integral to membrane; Biological process=transport
  Homolog annotation: Hit_ID=Q9STX9; Match level="QueryCoverage=94%, HitCoverage=92%, E-value=4e-82, Identity=63%"; Hit description =Putative aquaporin TIP5.1
  Pfam annotation: Domain name=MIP; Domain location=14-234; Score =208.2; E_value=1.9e-59; Accession=PF00230.10; Description=Major intrinsic protein
  Subcellular localization annotation: CTP_CleavageSite=61; ConfidenceScore=5.06e-01
MAPSSVTVTSRFHESVTRNALRSYLSEFISTFFYVFLVIGAGMSSRKLMPDASLNPTSLVVVGIGSAFALSSVLYIAWDISGGHVNPAVTFAMAVGGHISVPTALFYWVAQLIASVMACLVLRVIVVGMHVPTYTIAEEMTGFGASVLEGTLTFVLVYTVYAARDPRRGPMSSTGILVVGLIAGASVLASGPFSGGSMNPACAFGSAAIAGSFRNQAVYWVGPLIGATIAGLLYDNVLFRSQLTDSIQGIGV

SEQ ID NO: 121805 - protein, 474 aa, Glycine max
  Coding DNA Sequence Number=SeqID_5027
  Gene Ontology: Mol. function=ATP-dependent helicase activity; Cellular component=nucleus; Biological process=rRNA processing
  Homolog annotation: Hit_ID=Q6YS30; Match level="QueryCoverage=78%, HitCoverage=73%, E-value=1e-166, Identity=77%"; Hit description =Putative RNA helicase
  Pfam annotation: Domain name=DEAD; Domain location=141-315; Score =218.4; E_value=1.6e-62; Accession=PF00270.19; Description=DEADDEAH box helicase
  Pfam annotation: Domain name=Helicase_C; Domain location=384-460; Score=125.5; E_value=1.5e-34; Accession=PF00271.21; Description =Helicase conserved C-terminal domain
  Pfam module annotation: Pfam domain module=DEAD::Helicase_C; Domain location=141-315::384-460
MGRKHDAVLVSEPVAEEVPYSPELDSEKKKKKKKKKNKNKDKHQTDSSTKRKLDEQLDPQNGIESNKKKKKHHESKQNAEETNGNNNSDNGANRDETVADGSVVVTGKNAGDAKYAAVKSFADSGLPENVLECCKGFQKPSPIQSRAWPFLLDGRDLIGIAATGSGKTLAFGLPAVMHVLGKRKGKSSKGRNPLGLVLSPTRELAQQISDVMCDAGRSCGVQSICLYGGTSKGPQISSLKSGIDIIIGTPGRIQDLIEMGICCLKEVSFVVLDEADRMLDMGFEQIVRSILGQTCSDRQMVMFSATWPLPVHYLAQEFMDPNPVVVGSEDLAANHDVMQIVEVLDDRSRDKRLAALLEKYHKSQRNRVLVFVLYKLEAKRVENMLQEGGWKVVSIHGDKAQHDRTKALSLFKNGSCPLMIATDVAARGLDIPDVEVVINYSFPLTTEDYVHRIGRTGRAGKKGVAHTFFMQQNK

SEQ ID NO: 121806 - protein, 208 aa, Glycine max
  Coding DNA Sequence Number=SeqID_5028
  Gene Ontology: Mol. function=helicase activity
  Homolog annotation: Hit_ID=Q9LTU4; Match level="QueryCoverage=96%, HitCoverage=14%, E-value=7e-71, Identity=61%"; Hit description =Helicase-like protein
MLLTPWNLTAIDRPKIISRIFKLKYEQMLSDLTKNHLLGKVVAYMYTVEFQKRGLPHVHLLLFLHANNKYPSPNDIDHIISAEIPSQEDDPELYKLVQNHMVHGPCGILRPASPCMKKGKCSRFYPKKFQPTTLIDGDGYPVYRRRNTGRTITKNEIIIDNRCIVPYNPKLLKKYQAHINIEWCNQSTSIKYLFKYINKGYDRVTVVM

SEQ ID NO: 121807 - protein, 532 aa, Glycine max
  Coding DNA Sequence Number=SeqID_5029
  Gene Ontology: Mol. function=ubiquitin thiolesterase activity; Cellular component=cytosol; Biological process=ubiquitin-dependent protein catabolic process
  Homolog annotation: Hit_ID=Q9FPS3; Match level="QueryCoverage=99%, HitCoverage=99%, E-value=1e-138, Identity=51%"; Hit description =Ubiquitin-specific protease 24
  Pfam annotation: Domain name=UCH; Domain location=176-529; Score =205.3; E_value=1.4e-58; Accession=PF00443.19; Description=Ubiquitin carboxyl-terminal hydrolase
MFLFGSFTEDETQSLLSKQSSGKKEKPVEKNQLQFGSLNSVTVESNNLLNSSKSPDNSPPSDSQKCNGVKSVSDNSPEVSGTIKENGSITNISPRSITTSTISVNEVEEKNANSFTLRGEDGPSNKFTKLSLDASEAESLKNLHKIGNGDDSAPKLSDREPQKAPNGHAVMHVKDILPRGLINSGNLCFLNATMQALLSCSPFVHLLQQLRTRNLPKVGYPTLTAFAEFIAQFDMPSTTKVKKQDTDTFESGRPFRPVMFEVVLKNFTPDVPNSISGRPRQEDAQEFLSFVMDQMHDELLKLEGHSSSLNGSKSSLVSSVEDDEWETVGPKNKSAVTRTQSFLPSDLSGIFGGQLRSLVRAKGNRASATVQPYLLLHLDIYPDAVHTIEDALHLFSAPETLEGYRTSLTAKAGVVTARKSVRIVTLPKIMILHLMRFGYGSQGSIKLHKPVHFPLELVLGRELLVSPSTEGRKYELVATITHHGTEPSKGHYTADAQYPNGRWLRFDDQSVFAIGTNKVLHDQAYVLFYRQM

SEQ ID NO: 121808 - protein, 397 aa, Glycine max
  Coding DNA Sequence Number=SeqID_5030
  Gene Ontology: Mol. function=ATP binding; Cellular component =ubiquitin ligase complex; Biological process=electron transport
  Pfam annotation: Domain name=WD40; Domain location=167-203; Score =27.9; E_value=3.6e-05; Accession=PF00400.22; Description=WD domain, G-beta repeat
  Pfam annotation: Domain name=WD40; Domain location=207-243; Score =23.4; E_value=0.00084; Accession=PF00400.22; Description=WD domain, G-beta repeat
  Pfam annotation: Domain name=WD40; Domain location=253-292; Score =10.0; E_value=2.5; Accession=PF00400.22; Description=WD domain, G -beta repeat
  Pfam annotation: Domain name=WD40; Domain location=299-335; Score =30.8; E_value=4.7e-06; Accession=PF00400.22; Description=WD domain, G-beta repeat
  Pfam annotation: Domain name=WD40; Domain location=342-384; Score =30.3; E_value=6.6e-06; Accession=PF00400.22; Description=WD domain, G-beta repeat
  Pfam annotation: Domain name=WD40; Domain location=55-91; Score=23.4; E_value=0.00082; Accession=PF00400.22; Description=WD domain, G-beta repeat
  Pfam annotation: Domain name=WD40; Domain location=95-131; Score =11.5; E_value=1.7; Accession=PF00400.22; Description=WD domain, G -beta repeat
  Pfam module annotation: Pfam domain module=WD40::WD40::WD40::WD40::WD4 0::WD40::WD40; Domain location=167-203::207-243::253-292::299 -335::342-384::55-91::95-131
  Subcellular localization annotation: CTP_CleavageSite=80; ConfidenceScore=5.59e-01
MDLKPKLWNTPPSTSSSCSSSSCSSRSISSESDESPFCSQRIPIPIVSGGFFHSHRSLSVLSGHVGSVSCLALCGEFILSASQGKDIIVWQQPDLRVFAKFGQGDGSVKALATVGNKVFTAHQDSRIRVWKVSRSSENVFKLVDTLPTTKDYLGKFMKQSNYVQTRRHHKRLWIEHADSISCLTVYNGFIYSGSWDKTLKVWRLSDLKCLESIKAHDDAINGLVACKGVMYSASADGKIKAWGRKKDGKGEEHGLKGVLEGHKDVSFNAVVVSEDGKWVYGGGSDGFVMGWEGLESCCWKLVSETKAHEMAVLCMCLMGEILCSGSADKTIGIWRRETFGKLCKVGVISGHEGPVKCLQASPNRIGGGFLLYSGSLDRSVRVWWVPRMLKYWNEGQN

SEQ ID NO: 121809 - protein, 115 aa, Glycine max
  Coding DNA Sequence Number=SeqID_5031
MGKMGKKLGNSDANDLSLWFVDFQGVFFASKHFPAKELPTFLLRLCSDCALCCGMIIVFLELIVFDLIVAYLVPGDFLSYIVEYRGLIIPSSFWRDKIMSSTPHSNLASRARSWD

SEQ ID NO: 121810 - protein, 145 aa, Glycine max
  Coding DNA Sequence Number=SeqID_5032
MVAAAATTEEKHNENLSSEGSLEDDDSWRVRIFNGRRGNGPDVLDYLLSNLHTAVHKELKGLLWDDGSAPENSMIKEDSSSVVPSFQATAKDFVVAAFVNDKRAFRSRFFQVGVLDGEHYRLVMEEYGGHGGGERQQRKMESNIQ

SEQ ID NO: 121811 - protein, 489 aa, Glycine max
  Coding DNA Sequence Number=SeqID_5033
  Gene Ontology: Mol. function=RNA-directed DNA polymerase activity; Cellular component=chromatin; Biological process=chromatin assembly or disassembly
  Pfam annotation: Domain name=rve; Domain location=310-466; Score =89.5; E_value=1e-23; Accession=PF00665.16; Description=Integrase core domain
  Pfam annotation: Domain name=zf-H2C2; Domain location=251-292; Score =13.5; E_value=0.0059; Accession=PF09337.1; Description=His(2)-Cys(2) zinc finger
  Pfam module annotation: Pfam domain module=rve::zf-H2C2; Domain location=310-466::251-292
MAACDVTPDPSKIEAMVNWPTPTTPQSLRGFLGLIGFYRKFIREYVALATPLIALLQKDNFHWDPHTQLAFNQLKRAMTQALVLSLPDFSIPFTLKTDVSGTAMGVFLTQRGHPLAFFSKAFCPCLELASTYVLVVGPSIHHPHRSQKSEGPYESGHSNVGVTNVLVEAVKAPQNTNGQCMLLSVPHFVFLDAMPDHFITNAPFQDKLTQVTSNPGSHPGFHLRDGLLFFNDRVWLEPGNPFIVLLMEEFHSTPLGGHLGFAKTLHRLQMNFHWANMRANVNQFIRQCTTCQPVKYEPKKLAGLLHPLLIPTSPWQDLSLDFITGLPPSKGYTAVLVVIDRFSKGAYFGALLTHYTANKVALIFLDIVCKHHGFTRSLVSDRDLIFIGHFWRDLFTLSGTKLRMSITYHPETDDQTEVLNRTLEQYLRCFVHDTPSKWSQFLSLAEWCYNTAVHSATGITPFEATYDKPSPSLATYFKGRPLLRQLIVF

SEQ ID NO: 121812 - protein, 75 aa, Glycine max
  Coding DNA Sequence Number=SeqID_5034
  Gene Ontology: Mol. function=RNA-directed DNA polymerase activity; Cellular component=chromatin; Biological process=RNA-dependent DNA replication
MSSKNTTAEERLEEFIHGGLEGGGGITKAEQHHLVFIVVVRSSFENHVAEPSSSKSSSMVGIEKRSLTVKAFKAW

SEQ ID NO: 121813 - protein, 560 aa, Glycine max
  Coding DNA Sequence Number=SeqID_5035
  Gene Ontology: Mol. function=cytokinin dehydrogenase activity; Cellular component=vacuole; Biological process=electron transport
  Homolog annotation: Hit_ID=Q1SII4; Match level="QueryCoverage=99%, HitCoverage=95%, E-value=0.0, Identity=71%"; Hit description=FAD linked oxidase, N-terminal
  Pfam annotation: Domain name=Cytokin-bind; Domain location=277-553; Score=622.8; E_value=3e-184; Accession=PF09265.1; Description =Cytokinin dehydrogenase 1, FAD and cyto
  Pfam annotation: Domain name=FAD_binding_4; Domain location=72-245; Score=53.2; E_value=8.7e-13; Accession=PF01565.13; Description=FAD binding domain
  Pfam module annotation: Pfam domain module=Cytokin-bind::FAD_binding _4; Domain location=277-553::72-245
MRYILGEHNILFLKSFAFTILFLSCIAIRLNLCLSSIPSSLKSIPLEGHLKFDQVSLSHAARDFGNRYQYNPMAVLQPESVSDIVATIRHIWLMGPGSHLTIAARGHGHSLQGQAQAHGGLVINMESLKVPEMQLGNQIHNLFLSSFFLYNQTNLITPMQIHVDEGNKSPPYVDVSGGELWINILHETLRYGLAPRSWTDYLHLTVGGTLSNAGVSGQTFRHGPQISNVQQLEIVTGTGEVLNCSAENNGDLFHGVLGGLGQFGIITRARIVLEPAPTMVKWIRVLYSDFTAFTRDQERLISAEKTFDYIEGFVIINRTGLLNNWRLSFNPRDPVQASHFKSDGRTLFCLEMAKYLNVEEIDAANQEVEEHLSRLSYIPSTLFSTEVTFVDFLDRVHISEVKLRSKGLWDVPHPWLNLLIPKSQILNFAQVVFGNILSETSNGPVLIYPVNKSKWDNRTSVVIPEEDIFYLVAFLTSAVPSSNGTDGLEHILSQNKRILEFCERAQLGVKQYLPHYNTQQEWRAHFGPQWETFLLRKSVYDPLAILAPGQRIFQKAITFS

SEQ ID NO: 121814 - protein, 274 aa, Glycine max
  Coding DNA Sequence Number=SeqID_5036
  Homolog annotation: Hit_ID=Q10L99; Match level="QueryCoverage=89%, HitCoverage=51%, E-value=5e-13, Identity=27%"; Hit description=IQ calmodulin-binding motif family protein, expressed
MQDSKDKIIRMDSNSERKWDESTVLKEEVDTSCTSKKETILKRERIKEYSFNHRDLKLTYINPSQRSAESERSKVNGRWRYWLEQWVDTQLSKSKELEDLDSVFSSHSRAGEEYGGRQLKLTSINNQRQSPVEGLDSPTLGSRRSFPHRRQCSVGEDHSFSSSPATPAYMAATESAKAKARSTSSPKIRTGGNVDMNSDSYSPCKKKLSISSSINSEVLNSGRMGKLSSSNQQQRSPSFKGLSVPIKSSRTTIKDLSINSDCSLPNWDRQASFK

SEQ ID NO: 121815 - protein, 111 aa, Glycine max
  Coding DNA Sequence Number=SeqID_5037
  Gene Ontology: Mol. function=transporter activity; Cellular component= membrane; Biological process=oligopeptide transport
  Homolog annotation: Hit_ID=Q1SIG4; Match level="QueryCoverage=79%, HitCoverage=23%, E-value=4e-21, Identity=43%"; Hit description=TGF -beta receptor, type I/II extracellular region
MAAHEVLTVGETRHETMSVMWLIPQYLILGIGDSFSLVGLQEYFYDQVPDSMRSIGMALYLSVLGVGFFLCSFLIIIVEHITVSKRYTYKAVQRRAMETDCCKSDEVDMVA

SEQ ID NO: 121816 - protein, 260 aa, Glycine max
  Coding DNA Sequence Number=SeqID_5038
  Gene Ontology: Mol. function=RNA-directed DNA polymerase activity; Cellular component=chromatin; Biological process=chromatin assembly or disassembly
MEVGYGGVWLSWGRLGGRWEMMGDIDGNCGCVCPEKDRTTIVFKLHGQRGIVRNNGPELLKPLDSEDYVGAAKLQDMEVDSEYLTLESYWSMGANIVAGKHGTVSYCCLQRVGLSCRQLEVLGDARLDKIMSTPIIDEYCHAEIVDKAKEFECLRGRCARECVKAYLGWGRGLGGETYDYQVLGHLPRPQVGRSEPCICVKEPTSRHNCNIGHVLLCELFLSRSSGRPGGRWVVMGCLSTKEKRGVNGVRMVGGACGRGR

SEQ ID NO: 121817 - protein, 227 aa, Glycine max
  Coding DNA Sequence Number=SeqID_5039
  Homolog annotation: Hit_ID=Q10MM5; Match level="QueryCoverage=92%, HitCoverage=21%, E-value=7e-24, Identity=35%"; Hit description =Expressed protein
MEIQKKGFKGSFLSFFDWNGKSQKKLLCDRPILPDVSKQGKENMDSMPKSQENRIKMDDNGVNPSNNASCGFDCAISINSDEGYGTKAPGLVARLMGLDSLPVLTVSELSSSSTSLYGSNSLGSSHSHDEDVLHSMVDYGCPVDPINMRLKPEKSSWGAMQSRALKVGNPSMKRFQTEMLPPKSAKPIPVSHNKLLSPIKSPAFMQPKHAAHIMEAATKIIEASPQP

SEQ ID NO: 121818 - protein, 167 aa, Glycine max
  Coding DNA Sequence Number=SeqID_5040
  Homolog annotation: Hit_ID=Q9LSQ8; Match level="QueryCoverage=38%, HitCoverage=27%, E-value=3e-19, Identity=65%"; Hit description =Arabidopsis thaliana genomic DNA, chromosome 5, BAC clone:F24B18
  Pfam annotation: Domain name=zf-B_box; Domain location=1-34; Score =5.0; E_value=0.036; Accession=PF00643.14; Description=B-box zinc finger
MMLCDSDQAKLCWECDEKVHSANFLVAKHSRVLLCRLCHSPTPWKASGTKLMLTVSFCQRCVAHRHVSLTVHPYPSYGYQSSNNNDDVDLDVDDGIDDSDERESHQVMSSSATSPFKRLRNNSFSVDSNDETVSSSSEMFSATWPDDDESTTSLSVLKRHRDDQPNY

SEQ ID NO: 121819 - protein, 53 aa, Glycine max
  Coding DNA Sequence Number=SeqID_5041
  Gene Ontology: Mol. function=transporter activity; Cellular component= membrane; Biological process=oligopeptide transport
  Homolog annotation: Hit_ID=Q852B2; Match level="QueryCoverage=75%, HitCoverage=7%, E-value=5e-07, Identity=51%"; Hit description =Putative peptide transport protein
MEQEMEKRNVVRIEENEEKWVHDASVDYKGRVPLRASTGVWKASLFVLTLSSS

SEQ ID NO: 121820 - protein, 46 aa, Glycine max
  Coding DNA Sequence Number=SeqID_5042
MVKSFRVQVQMQFSELFDALKLLFSIYFNNNSLHMHDFRDAEQCGT

SEQ ID NO: 121821 - protein, 146 aa, Glycine max
  Coding DNA Sequence Number=SeqID_5043
MASQTQVHSSCCLLPTITRNGVVEHVVGTSSVHQEHHRIISDEAQEPELVKGFYIRQRGVLFLCDEEKNLRCIWMAPMELLVIVETEPALPARGYSSVENHFKIGGSGRLRDGSRGVGGITRRSGVGKGGGVRLRDAGRVSRSFSS

SEQ ID NO: 121822 - protein, 634 aa, Glycine max
  Coding DNA Sequence Number=SeqID_5044
  Homolog annotation: Hit_ID=Q10MM5; Match level="QueryCoverage=97%, HitCoverage=68%, E-value=8e-54, Identity=30%"; Hit description =Expressed protein
  Subcellular localization annotation: CTP_CleavageSite=57; ConfidenceScore=5.50e-01
MDTHTANPLNGKPSERRNNLYKSTLSFKGSRHSVKNSSCQLASKGKSASLAMPSKTNAQSRDELTLNGNRRYMRQKEHNNIKSNQLPRSQKKQIADRGRVMQQRACTSQNRNVLGKNNQKQNSVTNKGSSASKMDSNKPTQTWSSESSTGAKKTKKKVSVNANIEPKRFGTRITDTIKEFPVSKRKGISQKKNYSSCDIHNKPRGSDSAANTYENMPIKCNITTDGSIDQDAFSMKGSNGVISFTFTSPLRRNLPELQSSSEQAMGTRNKIDVNSCSSNDKFYPQKSSFSPPRLHVIDGDALSVLLEKKLQELTSRINPPQCSLTTEGSSTGLRSSLEDKFRSVLSTTVREQDISFYNQLDSVHDNCSSSDIVVLSMNQQLQTSESMEEPSCRSNSESKNGSYLDSAYGITVYSSMQDEEVSNFSLMNESMSLENEAEWSEQSSSIVMGDNMASEQSSVMSNSAEFTRSARNMELEYVKDIFSNAELMTEEFVVGETDKIIMPNLFDKLENKGLGAENYEEYSKIERRAIFDTVSECLELRCRQIFVGSCKAWPKWLASVQRKNCLAEEFYKEILSFRSMEEEVEVDELVNKDMSTGWCKWLDFEIEAFEKGSELEFDILTCLINELVSDLLHV

SEQ ID NO: 121823 - protein, 190 aa, Glycine max
  Coding DNA Sequence Number=SeqID_5045
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=39%, E-value=4e-39, Identity=50%"; Hit description =Integrase, catalytic region
  Pfam annotation: Domain name=Chromo; Domain location=106-154; Score =25.2; E_value=0.00024; Accession=PF00385.14; Description='chromo' (CHRromatin Organisation MOdifier
MKHFVDVKRREVTYQVGDWVLLKLRPHRQVSVKGPEAIHGKLAKRFYGPFQIVECIGPVAYQFQLPDMARIHLAFHCSVLKPFRGSPEFKDATQLPNDFIQDQPIISPLAILVYRKSSSSAESPWEVLVQWKGLPPDDTSWEDWDQLQTDYHLEDKVILQGPKSDNIAKEPVEETENEPITKPTYLKDYM

SEQ ID NO: 121824 - protein, 1042 aa, Glycine max
  Coding DNA Sequence Number=SeqID_5046
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q8W0V0; Match level="QueryCoverage=99%, HitCoverage=100%, E-value=0.0, Identity=67%"; Hit description=Type IIB calcium ATPase
  Pfam annotation: Domain name=Cation_ATPase_C; Domain location=876 -1021; Score=48.8; E_value=1.8e-11; Accession=PF00689.11; Description= Cation transporting ATPase, C-terminus
  Pfam annotation: Domain name=Cation_ATPase_N; Domain location=109 -186; Score=55.7; E_value=1.5e-13; Accession=PF00690.16; Description =Cation transporterATPase, N-terminus
  Pfam annotation: Domain name=E1-E2_ATPase; Domain location=203-444; Score=212.0; E_value=1.3e-60; Accession=PF00122.10; Description=E1 -E2 ATPase
  Pfam annotation: Domain name=Hydrolase; Domain location=448-780; Score=62.8; E_value=1.1e-15; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=876-1021::109 -186::203-444::448-780
  Subcellular localization annotation: CTP_CleavageSite=62; ConfidenceScore=5.03e-01
MEKYLRENFSVQPKNPSEAALLRWRSAVSVVKNPRRRFRMVANLAQRADAEQKRTKLQEKIRVALYVQKAALHFINAAGNRGGGSMLSKEIQEAGFGIEPDELASIVRSHDTKCLEHHKGVEGVARAVRVSLQEGVNTLDVHHRQNIYGFNRHAEKPPKSFWMFVWDAMQDLTLIILMVCSFVSVGVGILTEGWPKGMYDGVGIILCILLVVFVTSISDYKQSLQFKDLDKEKKNVSIQVTRDSKRQKVSIHDLVVGDIVHLSIGDIVPGDGLFTSGFGLLIDESSLSGESEAVNVDQEKPFLLSGTTVQDGSAKMLVTSVGVRTEWGRLMDTLNEGGDDETPLQVKLNGVATIIGKIGLCFAVVTFMVLTGRFLCEKIAHHEITKWSLNDASSLLNFFATAVIIIVVAVPEGLPLAVTLSLAFAMKKLMNDKALVRHLSACETMGSAGCICTDKTGTLTTNHMVVDKIWICQQTKAINIGNSENVFKSSVSEHIFDLLLQSIFQNTGSEIVKGQDGRNKIMGTPTESALLEFGLLLGGDSKFYNDKYKIVKVEPFNSIRKKMSVLVALPDGTNTKYRAFCKGASEIVLKMCQKVVNADGKVVQLNEQQRNSVTEVISGFASQALRTLCIAFKDIEGSSGSDSNSIPEDKYTLIAIVGIKDPVRPGVKEAVKTCLEAGIVVRMVTGDNINTAKAIARECGILTDGIAIEGQDFRNKSPQELMNIIPKIQVMARSLPLDKHTLVKHLRNDFNEVVAVTGDGTNDAPALHEADIGLAMGIAGTEVAKENADVIVMDDNFTTIVNVTRWGRAVYINIQKFVQFQLTVNVVALMLNFVSACVSGSAPLTAVQMLWVNMIMDTLGALALATEPPHDGLMKMPPIGRNAKFITRVMWRNIIGQGIYQIIVLLVLKFRGKQILNLNGPDDATLLLNTVIFNTFVFCQVFNEINSRDMEKVNVLQGMLSSWVFLMVMAATICFQAIIVEYLGAFAQTVPLSRELWLTSVMIGAVSIVVGAILKCIPVPSSNYVATHHDGYEQLPSGPELA

SEQ ID NO: 121825 - protein, 472 aa, Glycine max
  Coding DNA Sequence Number=SeqID_5047
  Gene Ontology: Mol. function=unfolded protein binding; Cellular component=endoplasmic reticulum; Biological process=protein folding
  Homolog annotation: Hit_ID=A0A762; Match level="QueryCoverage=81%, HitCoverage=91%, E-value=0.0, Identity=81%"; Hit description =Calreticulin-1
  Pfam annotation: Domain name=Calreticulin; Domain location=2-307; Score=539.8; E_value=2.9e-159; Accession=PF00262.8; Description =Calreticulin family
MPDGWENRWVKSDWKKDENVAGEWNHTSGQWNGDANDKGIQTSEDYRFYAISAEYPEFSNKGKTLVFQFSVKHEQKLDCGGGYMKLLSGDVDQKKFGGDTPYSIMFGPDICGYSTKKVHAILTYNNTNHLIKKDVPCETDQLTHVYTFILRPDATYSILIDNVEKQTGSLYSDWDLLPPKTIKDPEAKKPEDWDDKEYIPDPEDKKPEGYDDIPKELPDPEAKKPEDWDDEEDGEWTPPTIANPEYKGPWKAEKIKNPNYKGKWKAPLIDNPDFKDDPDLYVFPNLKYVGIELWQVKSGTLFDNVLITDDPEYAKQLVEETWGKHKDAEKAAFEEAEKKREEEESKDDPVDSDADEEEEDADEAGNDSDAESKTEAGEDTKEEGVHVLPESFRKKVLPVEQFVHPKEPSSGKTICSTGRTFFRRSYRKNLLSKKLPEEVLPIEQIVHPEESSSREVTERTSSGSFSKRRFFR

SEQ ID NO: 121826 - protein, 168 aa, Glycine max
  Coding DNA Sequence Number=SeqID_5048
  Gene Ontology: Mol. function=pseudouridine synthase activity; Biological process=RNA processing
  Homolog annotation: Hit_ID=Q1S0N8; Match level="QueryCoverage=66%, HitCoverage=35%, E-value=1e-39, Identity=75%"; Hit description =Pseudouridine synthase, Rlu
MLGSRPAPPELREGKGKQTQRERKFTINQQFCNCGFSLAQPCQLPFIPASSYVVVESKFGAWRVYAASDVGRTLPGGSVVRSMETSFEIFSINGNGSFREVLDFEFGNAEEGGNVIVVEGKAVKEEGNESEIVVRAYPQSGRTHQIRLHCQYLGISIIGDVKYKGVHE

SEQ ID NO: 121827 - protein, 90 aa, Glycine max
  Coding DNA Sequence Number=SeqID_5049
MTKIQGRDLVREEKKRRKDFIPSKRSSKKTLAEAMDKRERRKRERRSGLRTRNAIVNDGTTELGMCRNELEWTNLEIEVAQSYVDTRWQF

SEQ ID NO: 121828 - protein, 221 aa, Glycine max
  Coding DNA Sequence Number=SeqID_5050
  Gene Ontology: Mol. function=nucleotide binding; Cellular component =endoplasmic reticulum; Biological process=small GTPase mediated signal transduction
  Homolog annotation: Hit_ID=Q38M59; Match level="QueryCoverage=99%, HitCoverage=100%, E-value=3e-97, Identity=80%"; Hit description =NtSar1 protein-like
  Pfam annotation: Domain name=Arf; Domain location=5-220; Score=337.5; E_value=2.3e-98; Accession=PF00025.11; Description=ADP-ribosylation factor family
  Pfam annotation: Domain name=MMR_HSR1; Domain location=21-160; Score =7.0; E_value=0.00023; Accession=PF01926.13; Description=GTPase of unknown function
  Pfam annotation: Domain name=Miro; Domain location=22-160; Score= -0.2; E_value=0.0057; Accession=PF08477.3; Description=Miro-like protein
  Pfam module annotation: Pfam domain module=Arf::MMR_HSR1::Miro; Domain location=5-220::21-160::22-160
MFLFDWFYGILASLGLWQKEAKILFLGLDNAGKTTLLHMLKDELRKPQKLQYCAQGFKKIICNRHCSLSVMRLVQHQPTQYPTSEELSIGRIKFKAFDLGGHQIARRVWKDYYAKVDAVVYLVDSYDKERFAESKKELDALLSDESLTTVPFLILGNKIDIPYAASEEELRYHLGLTNFTTGKGNVNLSDSNVRPMEVFMCSIVKKMGYGDGFKWLSQYIK

SEQ ID NO: 121829 - protein, 189 aa, Glycine max
  Coding DNA Sequence Number=SeqID_5051
MYHYGTGKLMAWGKTKIPQNDLCLSTSLPHHGRLALINNNFLCYLHYKRGVASHHHNTNKSASCDKHIIQDSLETLIRVRSEKNDDDVVEGGGRFEKLEIGIPHGIKDEQGERRTRISPYFQNGVLGERTIFVHMNKIGGARYKLGGAKLKCPTQGTQKHGIKKEQKYDKVSHHNVAVAQWVMPKPQRV

SEQ ID NO: 121830 - protein, 114 aa, Glycine max
  Coding DNA Sequence Number=SeqID_5052
MCLELDMLKLKTLSKQTSLEISETVERVFCRLSGQEPPLFPLPNGEPQPDKETDNRKEKGKQKENENTNSNTPSKKRSFSEINLDGADETATRSSDPAAVLEGSGKSPLSISKT

SEQ ID NO: 121831 - protein, 654 aa, Glycine max
  Coding DNA Sequence Number=SeqID_5053
  Gene Ontology: Mol. function=hydrogen-translocating pyrophosphatase activity; Cellular component=membrane; Biological process=proton transport
  Homolog annotation: Hit_ID=Q946X5; Match level="QueryCoverage=99%, HitCoverage=99%, E-value=0.0, Identity=63%"; Hit description =Vacuolar H+-pyrophosphatase
  Pfam annotation: Domain name=H_PPase; Domain location=6-640; Score =924.5; E_value=4.5e-275; Accession=PF03030.7; Description=Inorganic H+ pyrophosphatase
MGVLSEGLTQILIPVTALIGIGFALLQWLLLSRVRVSSADHTNADNGYRKSLIGDSELENGVQSVEVTNNCAEIQHAISVVSDYLHGVFGAIIFVFLGSVKGFSTQSDPCTYNEGNICKPALANAVFSTVAFLLGALNSVLSDFLGMKIATYANARTTPEARKGIGKAFVTAFRSGPGLYESITGHGLGGLSMALFERVGGGIYTKAADFGADLVGNLNTVPEDDPRNPAVIVDNVGDNVGDIAGMGSDLFGSYAESSCAALFVASISSFGTNHDYTAMTYPLIISSMGIVVWLIATLFATDLFEITNVSQIEPSLKRQLLIATILITAGIAIVSFTALPSEFTLYNFGASKVVKNWTGAATNLIFGLALGYKSVIIPVFAIAIAIHVSFSLAAMYGIGVAALGMLSTITTSLAIDAYGPISDNGGGIAEMAGMRHKIRERTDALDAAGNTTAAIGKGFAIGSAVLASLALFGAYVSRAGIKTVNSVGSAALKMVEEVRRQFNTIPGLLEGREKPDYANCVKISTDASLKEMIPPSALVLLTPLIAGTFFGVENLAGVLAGSLVSGGVQVAISDSNTGGAWDNAKKYIEAGTTPHDASLGPKGSNPHKAAVTVGDPLKDTSGPSLNILIKLMAVESLLFAPFFAAHGGLIFKSF

SEQ ID NO: 121832 - protein, 1284 aa, Glycine max
  Coding DNA Sequence Number=SeqID_5054
  Gene Ontology: Mol. function=RNA-directed DNA polymerase activity; Cellular component=chromatin; Biological process=chromatin assembly or disassembly
  Pfam annotation: Domain name=Chromo; Domain location=1093-1139; Score= 8.4; E_value=0.099; Accession=PF00385.14; Description='chromo' (CHRromatin Organisation MOdifier
  Pfam annotation: Domain name=RVP_2; Domain location=133-264; Score= -48.9; E_value=0.0064; Accession=PF08284.2; Description=Retroviral aspartyl protease
  Pfam annotation: Domain name=RnaseH; Domain location=596-712; Score= -25.2; E_value=0.013; Accession=PF00075.14; Description=RNase H
  Pfam annotation: Domain name=rve; Domain location=847-989; Score= -5.8; E_value=0.018; Accession=PF00665.16; Description=Integrase core domain
  Pfam module annotation: Pfam domain module=Chromo::RVP_2::RVT _1::RnaseH::rve; Domain location=1093-1139::133-264::354-523::596 -712::847-989
  Subcellular localization annotation: CTP_CleavageSite=40; ConfidenceScore=5.20e-01
MDDQRPVHVVDRVPPSSPDTIRPNMMILRGRYSSSLREVASSPGSPQRYAERFRRFSHSLWSKLQGWRASKKRNSWTNVLHHDQDLLRQSQPQPWFRLPHHLIPHALHHYHPFSLLPPALHHPQYAVYLWTKSPHGGNVVSVSIVMKNSIEDTNVPLGHPVVVLVDGGNTHNFIQQELVTQLRLPCQPTPSPLRVMVGNGQNLQCTSFCETIILDIQSTQFTVDLHVLPIVGANVILGGDKEFTLNPITSSQFRHMSQTTETGLYCHISLIETDSITSQNFHPDIQKLLTKFASLFQQPNTIPPARETDHHIHLLPHSAPVNVWPYRYPHFQKCEIKTQVDAMLQKGLIQPSTSPFSSPVLLVKKHDDTWRFCVDYRALNAITIRDRFPIAMIDELLDELGGARCFSKLNLLQGYHHIRMHSDDIPKTTFHTHHGHYKFRVMPFGLCNAPSSFQAMMNAIFRPYLRQFIIMFFDDILIYSSCFADHLLHLELAFQVEYLGHLVSYRGVEPLASKVAAIHNWPILRTTRAVRSFLGLAGFYCHFIRGYASIAAPLVHITTMDQFAWSPLAHTAFDQLKQALSHAPVLALPDFTMLFTEETDASGIGMRAVLSQNNHPIAFFSKPFPPKLLRASAYVRELFAITAAVKKWRQYLLGHRFTIITDHQSLKELLTQVIQTPEQHMYLARLMGYDYQIQYRSGAHNQAADALLRCFDQDSTLLSLFVPCPLFLTKLYNQLDAHQEYNQLRQKILKNPEKHVGLSLAQKLILPKGRIWLPKDLKIIPTLLVEYHTTPTGGHMGVVKTIARLMENFDWEGLRADATKFMAQCLDYQYVKYETKRVVGLLCPLPVPHRPWEDLSLDFITGLPPYHDNIVILVVVDQFFKGMHLGMLPASHTAQVVATLFMEIVGKIHGLPRSLVSDRDPLFVNKFWQELFRRRTTPFEVTFGCKPFKFPEYIAGTSVLDAVDEMLTNREETFQTIRKKLLRAQERMRKAADANRREVNYQTRDWVMLKLRPYRQVSAKGPQAAMGKLTKRFYGLFQIVELIGKAAYRLKLSEGPRIHPIFHCSLLKSFKGNPEQGSEVALPKCFTQHQPVISLMAILDYCRASEQAPWEVLVQWEGLLPEETSWEDWKQLCADYHLKDKVNFQGPTTDTKTEASTSKKEVKIATTDQEHEARVQSQNTGLTWLRKGESTIAELSVDGTADPFLNGRRTCAEGNQYADGVAIEPISEGGEEVLAVDFAVLVDCDEDVDGDWVMTCDIDMATAEKTKALGLNESVSPEAHKSPV

SEQ ID NO: 121833 - protein, 387 aa, Glycine max
  Coding DNA Sequence Number=SeqID_5055
  Gene Ontology: Mol. function=binding; Cellular component =intracellular; Biological process=protein kinase C activation
  Homolog annotation: Hit_ID=Q1S1I3; Match level="QueryCoverage=98%, HitCoverage=97%, E-value=1e-163, Identity=71%"; Hit description =Pentatricopeptide repeat
  Pfam annotation: Domain name=PPR; Domain location=108-142; Score =52.9; E_value=1.1e-12; Accession=PF01535.11; Description=PPR repeat
  Pfam annotation: Domain name=PPR; Domain location=210-244; Score =41.8; E_value=2.4e-09; Accession=PF01535.11; Description=PPR repeat
  Pfam annotation: Domain name=PPR; Domain location=245-278; Score=1.7; E_value=4.7; Accession=PF01535.11; Description=PPR repeat
  Pfam annotation: Domain name=PPR; Domain location=281-315; Score=5.5; E_value=1.7; Accession=PF01535.11; Description=PPR repeat
  Pfam annotation: Domain name=PPR; Domain location=347-381; Score=6.2; E_value=1.4; Accession=PF01535.11; Description=PPR repeat
  Pfam annotation: Domain name=PPR; Domain location=46-80; Score=3.0; E_ value=3.3; Accession=PF01535.11; Description=PPR repeat
  Pfam module annotation: Pfam domain module=PPR::PPR::PPR::PPR::PPR::PP R; Domain location=108-142::210-244::245-278::281-315::347-381::46-80
MKTRAISPDEYTLAPLFKSASNLRYYVLGGCVHAHVVRLGFTRHASVRVAALEVYASCERMGDASKVFDEMRDPDVVVWNLMIRGFCKMGDLETGMKVFGQMKERTVVSWNLMMSCLAKNNKEEKALELFNEMLEQGFEPDDASLVTVLPVCARLGAVDIGEWIHSYANSKGFLQDTINVGNSLVDFYCKCGNLQAAWSIFNDMASKNVVSWNAMISGLAYNGEGEVGVNLFEEMVHGGFEPNDSTFVGVLACCAHVGLVDRGRDLFASMSVKFKVSPKLEHYGCVVDLLGRCGHVREARDLITSMPLKPTAALWGALLSACRTYGDREIAENAAKELVRLEPWNSGNYVLLSNVYAEEGRWDEVEKVRVLMRGGGVKKVPGQSATG

SEQ ID NO: 121834 - protein, 426 aa, Glycine max
  Coding DNA Sequence Number=SeqID_5056
  Gene Ontology: Mol. function=pepsin A activity; Cellular component =endoplasmic reticulum; Biological process=proteolysis
  Homolog annotation: Hit_ID=Q9FGI3; Match level="QueryCoverage=85%, HitCoverage=83%, E-value=1e-154, Identity=72%"; Hit description =Similarity to nucleoid DNA-binding protein
  Pfam annotation: Domain name=Asp; Domain location=42-401; Score= -152.3; E_value=0.00013; Accession=PF00026.14; Description=Eukaryotic aspartyl protease
  Subcellular localization annotation: CTP_CleavageSite=59; ConfidenceScore=5.16e-01
TASKMMLLNSLLANNNNNNTRLKSPPYSSPYNYKLSFKYSMALIVDLPIGTPPQVQPMVLDTGSQLSWIQCHKKAPAKPPPTASFDPSLSSTFSILPCTHPVCKPRIPDFTLPTSCDQNRLCHYSYFFADGTYAEGNLVREKFTFSRSLFTPPLILGCATESTDPRGILGMNRGRLSFASQSKITKFSYCVPTRETRPGYTPTGSFYLGNNPNSNTFKYIAMLTFGQSQRMPNLDPLAYTVALQGIRIGGRKLNISPAVFRADAGGSGQTMLDSGSEFTYLVNEAYDKVRAEVVRAVGPRMKKGYVYGGVADMCFDGNAIEIGRLIGDMVFEFEKGVQIVVPKERVLATVEGGVHCIGIANSDKLGAASNIIGNFHQQNLWVEFDLAYDHDDVVEIQRSKSEEEKESSTTVAMMTPTAFGRCVKAH

SEQ ID NO: 121835 - protein, 86 aa, Glycine max
  Coding DNA Sequence Number=SeqID_5057
  Gene Ontology: Mol. function=dihydroneopterin aldolase activity; Biological process=folic acid and derivative metabolic process
  Homolog annotation: Hit_ID=UPI00005F7124; Match level="QueryCoverage =97%, HitCoverage=71%, E-value=3e-28, Identity=69%"; Hit description =COG1539: Dihydroneopterin aldolase
  Pfam annotation: Domain name=FolB; Domain location=1-83; Score=56.9; E_value=6.8e-14; Accession=PF02152.8; Description=Dihydroneopterin aldolase
MAWDNRQAAVSDDVNHCLSYADVTEAILSHLQGQRFALVERVAEEIADLLMNRFKTPGVRVKVGKPGAVAQAASVGVRIERGTIPK

SEQ ID NO: 121836 - protein, 393 aa, Glycine max
  Coding DNA Sequence Number=SeqID_5058
MASRRFHSLDAWNRYTNNILGRNILPERNVQIYHTEYDEFKVELERRNLHKCLANLQDGSIDVAMVKEFYANLYTIEEQAPKQARVRGHLIKIDADGLNEFLQMPMVLEEGESLPTYSRFCRLRTNPQDIEARLCIPCKGFVLNAEGQPWKLLRKDLMTLAQTWSVFSYSNLAPTSHTSDLNMDRARLVYGLVTNMDMNIGALILGEFSSIAQSNSSRLGFPALITTLYRATGVTSDSLTYESLSLAINLAYIKKNYWNVDDLIVNFRGARKARVRPAYVPSSSTLPAPSTSATPTPAPPGSSTQDSQRFEAMLQKQFIEKVSWPGTLPSVVRKGEGPSAQPADPPTPMLDLPADPSTLLEILEDPVTPVLGLTTTPPTTPVLHLTNEEGTQD

SEQ ID NO: 121837 - protein, 181 aa, Glycine max
  Coding DNA Sequence Number=SeqID_5059
MTGRLLARSLTFDCRIMHYIIVRILLPRSSNLAQASKEDLILMWAFLTGCQVDRAHLVRYRMHKALRANAPLPYPQLVTLFLHHFQIPLDDEPFVQVKRSFAICASAITSFGYRKDRDGQWLKKDALPPQDERTPSPPPQRDDSSALMNEVLSELRGLRTYVGERFDSLDGRFEGMNTRIT

SEQ ID NO: 121838 - protein, 55 aa, Glycine max
  Coding DNA Sequence Number=SeqID_5060
MATIVMATIELSSRYGSKLAYYTGIGVGFMVDLGMALVDDWVVGNDIVEPVENLA

SEQ ID NO: 121839 - protein, 202 aa, Glycine max
  Coding DNA Sequence Number=SeqID_5061
MGEVEEVQKQMKADMEAVKVQMATMMEAMMSMKEIMEANAVAVAATRAVAKVNPMPPFDINQMNHPTSDMVGKDLGSTNDPMMCKFKMSTPSRHMARLPTHEIPHHNLADFEPCLGYATGGQSVGGIPMPNTLEGPQFRPQPQPLHFAVGRAPPAMAEKGKLDHIEESLKDIEGGEDCAFANLEELFLVPEHGHSQVQGARL

SEQ ID NO: 121840 - protein, 115 aa, Glycine max
  Coding DNA Sequence Number=SeqID_5062
  Gene Ontology: Mol. function=translation initiation factor activity; Cellular component=cytoplasm; Biological process=translational initiation
  Homolog annotation: Hit_ID=Q4PZB3; Match level="QueryCoverage=83%, HitCoverage=47%, E-value=2e-41, Identity=79%"; Hit description =Eukaryotic initiation factor 4E
  Pfam annotation: Domain name=IF4E; Domain location=1-115; Score=53.3; E_value=4.4e-15; Accession=PF01652.9; Description=Eukaryotic initiation factor 4E
VFKPSKLQINADFHLFKTGIDPKWEDPECANGGKWSITSNSGRKANLDNMWLETMMALIGEQFEDAEDICGVVASVRQWQDKLSLWTKTAANEAAQLMAEGGMDHSPQKMLQQHI

SEQ ID NO: 121841 - protein, 297 aa, Glycine max
  Coding DNA Sequence Number=SeqID_5063
  Homolog annotation: Hit_ID=Q5W2P3; Match level="QueryCoverage=54%, HitCoverage=98%, E-value=6e-47, Identity=62%"; Hit description =Putative RepA protein
MTEATTLQQHLEKAYMLFGKAQKLTADRAARRILHEINELISAMEEFPLYGLDYDEAEVGTKLCYYEKQLQLIEEKRDSMLLRSFRQMVSKSDDKLGSLPQNLDEEKYFINWMKEKGYEECYYSKVEALRRLDEIGAEAAVEEVEDPLGSGLDIWCLKFRRVDNIQQLEGDCQQLISKFFNAIANDDPSFTEDLEEDKVKVLELGFDDVEINSKDFAEEGSLLLSIHSENQKTFFHLSTAEAALLKERLDYILALLAKQYIEADEKAAKTRQSKNQQKKNQEEGEEVDWEEIESEKE

SEQ ID NO: 121842 - protein, 214 aa, Glycine max
  Coding DNA Sequence Number=SeqID_5064
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=84%, HitCoverage=13%, E-value=4e-24, Identity=33%"; Hit description=Chromo
  Pfam annotation: Domain name=Chromo; Domain location=123-174; Score =24.3; E_value=0.00043; Accession=PF00385.14; Description='chromo' (CHRromatin Organisation MOdifier
MAHFKALFGRDPPMIVKYQPESTRVQQADHMLIESDAILEELKAQPYRFKSMAKRVNEKLGPRFYDPFMVIERMGQTAYKLKLPPDAKIHLVVHVSRLKEAVAVTGLCQKLPAALTAEWELLVKPQEVVAVCKHLDGTVQGLIKWVNLFEHENTWEDSKVIDMVFPDFHLENKVQLAGEGIVRPSIKHVYHRNRRGQVVKNKRIVVEKEGVGND

SEQ ID NO: 121843 - protein, 388 aa, Glycine max
  Coding DNA Sequence Number=SeqID_5065
  Gene Ontology: Mol. function=sequence-specific DNA binding; Biological process=DNA recombination
  Homolog annotation: Hit_ID=Q5W2X6; Match level="QueryCoverage=99%, HitCoverage=92%, E-value=0.0, Identity=89%"; Hit description =Integrase
  Pfam annotation: Domain name=Phage_integrase; Domain location=198 -375; Score=16.2; E_value=6.7e-05; Accession=PF00589.13; Description =Phage integrase family
MLDVGRSTLYRYVNSDQSIPLDIVRKAAEMLASDELSDAMYGLKVVDVDFTTALSVVVKAMKDEKFRNFFVSILYQYLGDYLKNVSSTYIVTEEDVKKFEKLLQGKSKSTIVMRMRYLRIALTKLGYELSPDSIRDLIAELSEDSSNVARHTANSLKLFIKTVVKEKNLQLAQLLYNSFKVPKSKYKYKPQPLSLETLRRIFDNIEHLGAKAFFLLLSESGLRVGEVYSLKMDQLDLENRIIKVMKESETKRAYISFIHTETRKWLQEVYFPYREEFIRTYEHVVGHIGADVEAWKQKLFPFQLADLRSSIKEGMRKVLGKEFRLYDLRSFFASYLIKNGVSPMIVNILQGRAPPAQFQILQNHYFVMSEIELKKIFDEKGPKLLSPK

SEQ ID NO: 121844 - protein, 93 aa, Glycine max
  Coding DNA Sequence Number=SeqID_5066
  Gene Ontology: Mol. function=nucleotide binding; Biological process =DNA replication
MKVYPINAKYKVLIVLLKLGGSGKYSDIDRMMRNSNLRFFIEQLRQEGFIEDRYEGNKHIIKLTEDGEKLAKRLMEAEEFVMMKIAQARGQIQ

SEQ ID NO: 121845 - protein, 98 aa, Glycine max
  Coding DNA Sequence Number=SeqID_5067
  Homolog annotation: Hit_ID=Q9UXS3; Match level="QueryCoverage=98%, HitCoverage=21%, E-value=7e-36, Identity=77%"; Hit description =Putative transposase
  Pfam annotation: Domain name=DUF1610; Domain location=10-31; Score =13.7; E_value=0.038; Accession=PF07754.2; Description=Domain of unknown function (DUF1610)
  Pfam annotation: Domain name=Transposase_35; Domain location=1-46; Score=54.9; E_value=2.6e-13; Accession=PF07282.2; Description =Putative transposase DNA-binding doma
  Pfam module annotation: Pfam domain module=DUF1610::Transposase_35; Domain location=10-31::1-46
VNPHLTSKSCPRCGWVSRKVGRIFKCERCGFTLDRQLNASLNIYLKMCGFPHLFLTPTGSRWIGVIPLKGRRGMNGALPRDSGEAQGLRIGYKFMKIQ

SEQ ID NO: 121846 - protein, 344 aa, Glycine max
  Coding DNA Sequence Number=SeqID_5068
  Homolog annotation: Hit_ID=Q0ZNP4; Match level="QueryCoverage=58%, HitCoverage=95%, E-value=1e-37, Identity=40%"; Hit description =Putative Mob protein
MIIGMGKSPVTAILQQYSYICAYPCFFDNKVLLTENRSRAYIQYIKLLVRHYAKYGRALKIAIWPDYTPLYKVEKIANIYLFNNISFIVPIHDLSELEIVDELVENGFRVFAGYASDKKLRKYELDDFKEVANYDRWYLGVSSKHEVREAVLYNFQGFDITTFLFGRHEDRKDSKKLASNILNFVKEISKVKGKQTILYDFCGKLGSLTGERRVINTLAFLLENGSSFAHQLSQIMNMDSREVYPMLKTWILKGVVTVSKQGRRNVYSISQKFKSLISSVVKKYSYKGREFIIAKAKERYKRFLGRDPDPEVLAVIEYFVDKALSGNPYVQGSQNESVAELLAR

SEQ ID NO: 121847 - protein, 215 aa, Glycine max
  Coding DNA Sequence Number=SeqID_5069
  Homolog annotation: Hit_ID=Q8L9X1; Match level="QueryCoverage=14%, HitCoverage=12%, E-value=7e-08, Identity=81%"; Hit description =Putative lysophospholipase
  Subcellular localization annotation: CTP_CleavageSite=77; ConfidenceScore=5.43e-01
MIIPFLRPTLSSCSDSLSRSTHSHTPPLTLPHILRELSLSLCHFVSLTLSCSLTLSLSLSTSMSLSHNVPPGAIIPEAMQPDYSCLVFTFRPDNIGIIERNRWQEVSGGGGEGIRLAESVRAINIKIMTRQIREATVNEGRAIMWIYKAKYYFAINQIPEEEKQRGIVVEYIEQFELVSSPLRHAADEVLSEAFMNGLKEKIREEAFCIVKVRGV

SEQ ID NO: 121848 - protein, 233 aa, Glycine max
  Coding DNA Sequence Number=SeqID_5070
MAELGRGYCRQRYVGVAFQLNEASMVYKLHGQLALNLHHHIPAYCATFNFVPVIDKHMQCRGRLDLQPQGFDQALLHEIVCVVTVDQDHNVVVGNPTHRAQGFGGGVARKSMQTNLGLKRVVGSKWYHPAPHQPREGKIARHIDGPSEWWGFYGRRQKGKEISEACGREGACGVHEVSPLADEPTPRRAPRSCVEEPVLHGEFQGMAEDDEGEELPPGGPWPIWIEWIRPSGQ

SEQ ID NO: 121849 - protein, 209 aa, Glycine max
  Coding DNA Sequence Number=SeqID_5071
  Gene Ontology: Mol. function=chromatin binding; Cellular component =chromatin; Biological process=chromatin assembly or disassembly
  Homolog annotation: Hit_ID=Q1SAV4; Match level="QueryCoverage=51%, HitCoverage=34%, E-value=7e-30, Identity=47%"; Hit description =Integrase, catalytic region
MVAVKKWRQYLLGHHFTILTDHRSLKELMAQEIQTPEQHTYLDLKVELMTNLEFLRYSVNFDDPYRIPFKTHRRAHGRHEDIGMGSQKFHMGQYETVCLAGVHLGMLPPHYTASGVTKTFMEISDKIHDMPHSLVLDRDPLFVSRFWQELFKLSGTKLHMSSVYHPQIDGQTEWSYNTSVHYATGMSPYEVTFGKKPPSLPQYLVGTSQ

SEQ ID NO: 121850 - protein, 458 aa, Glycine max
  Coding DNA Sequence Number=SeqID_5072
  Gene Ontology: Mol. function=RNA-directed DNA polymerase activity; Biological process=RNA-dependent DNA replication
MGPCHHPSCELRLSQNLLDGIVCLDHLLMNLEVGPKSSARGSSCFHSSCTRVELTTLSATERYSSKGAPSLGQLKIGSVAMVFLKGRKACSQVSSHRKGSVFLSNVGSAFIRVGFNPPVCDHEAEELASAYLESTFLKVEVHAIFVELLEDFFQAERHGPIAKVGIFSDKCNFLLVWRMHLDLVCVFGACPVQICVVGAHSPFSIGLFDHDDVGKPVILVWPSSKWQHVNNASLLMIGKVPTEPRALPGCHSQIYVELIALAFLVDSQGSDLRPFIHAHDSSAFNCCGIFDGEAPRELALTEGGHQVQAASSLDSLACKAEEWTSVRDINRNALINEDPGHHEVRNDNGDNHGVVMVDRVNALEVHVVARIAVVVVFICLGLLLFFYLLLGSYATPLGVLRGNWMGTPRLNAYSRIVARLAVRETQKKAWKRVEGLETLAQRTICTKCDAVAQWAALA

SEQ ID NO: 121851 - protein, 110 aa, Glycine max
  Coding DNA Sequence Number=SeqID_5073
MEHKVYLALKFLNSDESLSGEKRKLQLLELEEMRLNVYESSKIYKSVDAKSGNGHLALSAHQHAKRVCIVTRVVLSALTLPKRALTPAKRSLACLPALSTNLPLCASALA

SEQ ID NO: 121852 - protein, 98 aa, Glycine max
  Coding DNA Sequence Number=SeqID_5074
MEAYIPLGWKPLNLERYDETKNPNEHLDAFLTQANLYTNDNAILCRVLHMFLKGVALTWYNGLPARSIDNFDTLFERFSVQYTTNRSHHMIAVALASL

SEQ ID NO: 121853 - protein, 106 aa, Glycine max
  Coding DNA Sequence Number=SeqID_5075
MSGWTWLKWGPGLHTSALRVAFVERTGEGTWKTKDSDTQSVQWNLVLIGVERDWQSLFVGAVVAFVDNSRELIDNVRDKHLLIDKRLEITYLLGSLAAKGQASALL

SEQ ID NO: 121854 - protein, 164 aa, Glycine max
  Coding DNA Sequence Number=SeqID_5076
  Gene Ontology: Mol. function=RNA-directed DNA polymerase activity; Cellular component=mitochondrion; Biological process=RNA-dependent DNA replication
MVDFLEEFTGNDTTTPDWWTLYVDSASDVKGSEVGIILEGPNNIALEQALKLNFRALNNQAEYDALIVDSQLVQGHVANIYQTKEIMLLKYYHIAKSLINNLECFKMYYISRECNTRVDIFSKLASTKKAGHLKTIIQETLQTPTIDAKDIMVGEEEEPNWMTP

SEQ ID NO: 121855 - protein, 288 aa, Glycine max
  Coding DNA Sequence Number=SeqID_5077
MELMPNQYDEFYDELKRRQWHQRLTSLPEKHIDVALVKEFYSNIYDPEDGSLKQCKLTTHAQYLHTYLDHQTIAVKLCTSGGKIILNAKRASWKILRKDPTSHTSDLNVDHAHLIYGLVMKMELDLGNFISFQITQIAQSSSSRLGFPTLIMTLCNANEVTSGSLTFESLSPVINLAYIQKNCWNSIDPSIIFPGPRQPPPRLVPPHAEPLPALPPAANDDARGLPRVCCLAKGPTFLCPGGGGGDTFGDGDDADGSDVDVADVGVDDDYVTDVIVIQGAGDPWPTQD

SEQ ID NO: 121856 - protein, 294 aa, Glycine max
  Coding DNA Sequence Number=SeqID_5078
MSDIEQVQEQMKVDMRAMKEQMTIMMEAMMSMRKMMEVNVSIAVAASTITKRDSIHPPGFNQVSRSILDVVGQEGEGVDMSLIISRSKLMQSYPARALDRNLQVDWARDAREGPRVLMSLRISELLLSTKFRALLSLSLHSSPSSSKLLSMASYGEFIWGETHDWPAFSSVPMPNAVREPQYRPPSQSLHFVMEGGPSAIVEKKKFDHIEERLRVIEGGGNYGFADMSELCLVPDVFISLKFKVPEFDKYKGTTCPKNRLKMCGSNDFQDYFDDAKESRVKQVSKNQESKSFKN

SEQ ID NO: 121857 - protein, 199 aa, Glycine max
  Coding DNA Sequence Number=SeqID_5079
FTSPKAWERYTNIIVPRKLLLERNVVIYDIEFHEFKEELERRRWDEELTSFEEGSIDVAIVKEFYANLYDPEDKSTMQLAAKLCIPGRGFELNVDGQPLKILKKNMTTLAHTWSVLSYSNLIPTSHTSDIPLDRTKLIYGIIMKMDMNLSYLISHQISIIAQHDSSRLGFPALITTLCKSRGVTIRLLASAPDRASSIK

SEQ ID NO: 121858 - protein, 171 aa, Glycine max
  Coding DNA Sequence Number=SeqID_5080
DHTGLCVSSNLGSLNDELEDADICGKGADDHIGLCVSSDLGSPNDKVQIIGADDYIGLCMSSDSGSPNDESEHSDIFGKGADDHIGLYVSSDLGSPNNEVQITVRCLHMSSDLSSPDDKGADNRETCRLRMTKVWITVRCLHMSSDLSSPDDEGADNHKKSLRVIGLAISG

SEQ ID NO: 121859 - protein, 241 aa, Glycine max
  Coding DNA Sequence Number=SeqID_5081
  Gene Ontology: Mol. function=phosphogluconate dehydrogenase (decarboxylating) activity; Cellular component=integral to membrane; Biological process=glyoxylate metabolic process
  Homolog annotation: Hit_ID=Q122U5; Match level="QueryCoverage=68%, HitCoverage=53%, E-value=9e-76, Identity=87%"; Hit description=2 -hydroxy-3-oxopropionate reductase
VVSDWYQADKFMVEPLVKECSDQYAEEKNGDDTLGAGRPFLGVPELGRGGFTKCSPCAGRPPTNRVVSCAASGRDLLAHFEVGLDLQRTHHARVVPVRAAVGHAAVEQLLGLGGVGQGHAELARAAQGQVQVLLVQRDAEARIERALDHALGMHLQDLGRGKAAQQRLAHAGRVGAGARCEQQGLCHRLDVQRHDDLVGHLGGLAVAIAAHQGDVLAHALEQRLDAREHVLGARDHDGQRG

SEQ ID NO: 121860 - protein, 171 aa, Glycine max
  Coding DNA Sequence Number=SeqID_5082
  Gene Ontology: Mol. function=protein-methionine-S-oxide reductase activity; Cellular component=cytosol; Biological process=protein metabolic process
  Homolog annotation: Hit_ID=Q0M0K3; Match level="QueryCoverage=97%, HitCoverage=98%, E-value=2e-68, Identity=72%"; Hit description =Peptide methionine sulfoxide reductase
  Pfam annotation: Domain name=PMSR; Domain location=3-156; Score =306.0; E_value=6.9e-89; Accession=PF01625.11; Description=Peptide methionine sulfoxide reductase
MQDTIILAGGCFWGMQDLFRRLPGVLSTRVGYTGGEVANATYRNHGNHAEAIEITFDSANISLRQLLVFFFQIHDPTTLNRQGNDLGPSYRSAIYYANPAQKEIAQQLITEMDASGIWPGKIVTEVTLASDFWLAEPEHQDYLVKYPTGYTCHGLRPTWILPQDRASAVWL

SEQ ID NO: 121861 - protein, 182 aa, Glycine max
  Coding DNA Sequence Number=SeqID_5083
  Gene Ontology: Mol. function=hydrolase activity; Biological process =pathogenesis
  Homolog annotation: Hit_ID=Q1GZE7; Match level="QueryCoverage=84%, HitCoverage=90%, E-value=2e-79, Identity=84%"; Hit description=NUDIX hydrolase
  Pfam annotation: Domain name=NUDIX; Domain location=7-150; Score =90.8; E_value=4.1e-24; Accession=PF00293.18; Description=NUDIX domain
MLDRDGYRPNVGIVLCNAHNQVFWGKRIREHAWQFPQGGIKYGETPEQAMYRELMEEVGLKPEHVKILGRTRDWLRYEVPTSWIKREWRGSYKGQKQIWFLLRLTGRDSDVSLRATEHPEFDAWRWSEYWVPLEDVIEFKREVYQLALNELATFLHHSGRRHGGKPRKPAVTNKQPPTVTPE

SEQ ID NO: 121862 - protein, 103 aa, Glycine max
  Coding DNA Sequence Number=SeqID_5084
MHHPKRKTLDEYSLLSSKSEIQHDHRSTSTPYGSHRPGEGISTLRAHHKGQQPLIKFILIPNKKSFKALDLETVLSYPNFVRGPLLDDVRPFFGPREVLGTHH

SEQ ID NO: 121863 - protein, 83 aa, Glycine max
  Coding DNA Sequence Number=SeqID_5085
MNIEEFIHVTFDESDAILSRKNILDDIATLDQIHIHGQDSKGKGKGSTEDPQEEAESNDELPQAWKASKDHPLDSIIGDISKG

SEQ ID NO: 121864 - protein, 271 aa, Glycine max
  Coding DNA Sequence Number=SeqID_5086
AKVHFLDHHTSFGYPQGMICAFQRFHPLEELKGSNDIQPARLSPAEIAKTTVEANKSALLVFPGMVHCEPHDQISWAEFQYHIDDVGDIYFEISDDANLLADCGANNPVVVKILRTPKCFASGNHVMGLSVKPLCTIFLNALIGMDIPIYDNNRRTASEYDIFNNGSDDEFKFDDDDIEVSEMEEFNIPVNWGQSDTTKSVHPIYFSKCLAKAINNMEYVKRMNHPSNGVSIIGFLRPVYGEEKSYLRWMYHTEDGDVYISDWRGICFLQI

SEQ ID NO: 121865 - protein, 86 aa, Glycine max
  Coding DNA Sequence Number=SeqID_5087
MKHMWLTLQVLGVMSEIWDARKIVLQRQERIEKVGVRFFIFVFTREAEAEAEVEARVEFHFPLHKQRTTHNAHTRHRHGSARVAVL

SEQ ID NO: 121866 - protein, 267 aa, Glycine max
  Coding DNA Sequence Number=SeqID_5088
  Homolog annotation: Hit_ID=P10973; Match level="QueryCoverage=34%, HitCoverage=98%, E-value=1e-14, Identity=42%"; Hit description =Nonspecific lipid-transfer protein A
  Pfam annotation: Domain name=Collagen; Domain location=17-76; Score= -46.8; E_value=0.087; Accession=PF01391.8; Description=Collagen triple helix repeat (20 copies)
  Pfam annotation: Domain name=Tryp_alpha_amyl; Domain location=166 -252; Score=27.1; E_value=6e-05; Accession=PF00234.12; Description =Protease inhibitorseed storageLTP f
  Pfam module annotation: Pfam domain module=Collagen::Tryp_alpha_amyl; Domain location=17-76::166-252
IGALGGPAFGGPEVVIGALGCPAFGGPEGVIGGSGSEAVTGALGGPAFGGPEVVIGTLGGPSFGGLEVEIGALGGPAFGGPEVVTGGSGSEAVTSVLGGPAFGDLEVVISTLGGPSFGGPEVEIGALGGPAFGGPEGVTGGSGSEAVALQLQNQSHQCYTPNDYNCSQVNNLLISCVDYLIGGDGIPSGVCCQSVNAVKASAPTQIQQMAACKCFFDVAIRLPSLLENKAGSLPKLCGVNLGFIMSKQNTNCNNVHVSSGQRGELYN

SEQ ID NO: 121867 - protein, 204 aa, Glycine max
  Coding DNA Sequence Number=SeqID_5089
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=5e-21, Identity=30%"; Hit description= UPI00006A17C9 related cluster
MTSPLNESISCFLIRVNLWVLVPSPSRGLHVLPSRGLHVLTFRELHALAFRGLHVLAFRGLHVLTLGTRTLTFRGLHVLAIRGLHVLTFRGLHALTFRGLDVLAVRGLHALTFSGLHILAIRGLHALTFRGLHVLTFRGLHTLTFRGLHVLAIRGLDAFTFRGLHVLAIRGLDVLTFRGLHVLAFRGLCVLTFSGLHKPHLKRI

SEQ ID NO: 121868 - protein, 136 aa, Glycine max
  Coding DNA Sequence Number=SeqID_5090
  Gene Ontology: Mol. function=GTPase activity
  Homolog annotation: Hit_ID=Q1EP28; Match level="QueryCoverage=73%, HitCoverage=12%, E-value=2e-35, Identity=78%"; Hit description =Dynamin family protein
MWDLEAASRFESGSIVDHLQYEGSASAHLDLTDVETEPEERFEEGALPVGLAPDRHDLRDRQRLAEGHGGALEPVVGLEPGSRIHVAPPALRRGFRRSGSVGAGDGGGGRHGGGGGGDGKGKREGETKSLNLNFGV

SEQ ID NO: 121869 - protein, 681 aa, Glycine max
  Coding DNA Sequence Number=SeqID_5091
  Gene Ontology: Mol. function=nucleotide binding; Biological process =catabolic process
  Homolog annotation: Hit_ID=Q1EP28; Match level="QueryCoverage=91%, HitCoverage=77%, E-value=0.0, Identity=67%"; Hit description=Dynamin family protein
  Pfam annotation: Domain name=Dynamin_N; Domain location=27-183; Score= 49.9; E_value=8.3e-12; Accession=PF00350.13; Description=Dynamin family
MIKNRLSWFGYVKRKPLEALVRMLDCIVFSPEKSGRRSSRKTLEGVVKRGVSWYQEEDSEEYGSPVVLASAIADIIKSRTEALLKKTKTAVSPKPIVMRAEYAHCPNLTIIDTPGFVLKAKKGEPENTPDEILSMVKSLASPPHRILLFLQQSSVEWCSSLWLDSIREIDPAFRRTVIVVSKFDNRLKEFSDRWEVDRYLSASGYLGDNTHPFFVALPKDKGNVSNDEFRRQISQVDSEVLHHLREGVKGGFNEEKFKSSIGFGRLRDYLESELQKKYKEATPATLALLEQRCNELTSELARMDSKIQANSDVSHLRKFAMLQAASISNHVGALIDGAADPSPELWGKTTVEERSRSGIGVWPGITADVNPPNATLRLYGGAAFERVLHEFRCAAYSIECPSVSREKVANILLAHTGRGGGRGITEAAAEIARAAAKSWLAPLLDTACDRLAFVLGSLFDLALERNRSHDSECGIKGEDMDGYVGFHAALRCAYNRFIGDLAKKCKQLVRHHLDSVTCPYSQVCYFNDSYSKVLELSDTSSASHDARRDQENIPPEKNAQETTPGKAAETRDVLRESHITIPETPSPDQPGDAAYGVVKKELGICNDMGPRKRASRIVGNSKNSDNARLQNGVILFGSGERSGSPYSDICVSAAQHFARIRGVLVERGVTSTLNSGFLTPW

SEQ ID NO: 121870 - protein, 149 aa, Glycine max
  Coding DNA Sequence Number=SeqID_5092
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=94%, HitCoverage=20%, E-value=3e-76, Identity=100%"; Hit description=DNA -directed RNA polymerase beta' chain
  Pfam annotation: Domain name=RNA_pol_Rpb1_2; Domain location=52-149; Score=47.4; E_value=1.6e-11; Accession=PF00623.11; Description=RNA polymerase Rpb1, domain 2
MCQEKLVQEAVDTLLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKIREKEPIVWEILQEVMQGHPVLLNRAPTLHRLGISTELRKF

SEQ ID NO: 121871 - protein, 156 aa, Glycine max
  Coding DNA Sequence Number=SeqID_5093
  Gene Ontology: Mol. function=protein binding
  Homolog annotation: Hit_ID=Q9SPM0; Match level="QueryCoverage=83%, HitCoverage=16%, E-value=3e-09, Identity=33%"; Hit description =Extensin-like protein
MIWGEIVYLGGHDNGTGSEIQRHVAGLGVEGASITHAPKLRYGYVVVVIGALGGPEVIIGVLGGPAFGGPEVVIGALGGPEAVTGALGGPAFGGLEGVTGGSGSEAVTSALGGPAFGGPEGVTGGSDSEAVTGALGGPAFGGPEGVTGGSGSEAVT

SEQ ID NO: 121872 - protein, 232 aa, Glycine max
  Coding DNA Sequence Number=SeqID_5094
  Gene Ontology: Mol. function=protein binding; Cellular component=cell outer membrane
  Homolog annotation: Hit_ID=Q41805; Match level="QueryCoverage=59%, HitCoverage=54%, E-value=2e-13, Identity=32%"; Hit description =Extensin-like protein precursor
MGVSQAEPAHIPTPTFITGALGGPAFGGPEVVIGALGGPAFGGPEVVIGALGGPAFGGPEGVTGGSGSEAVTGALGGPAFGGPEVVIGALGGPAFGGPKGVTGGSGSEAVIGGSCSEAVTGALGGPAFGGPEVVIGALGGPAFGGPEVEIGALGGPEGVTGGSGSEAVTGAFGGPAFGGPEVVISALGGPAFGGPAFGGPEGVTGGSGSEAVTVRTNTTSREKIVTNTPFIL

SEQ ID NO: 121873 - protein, 71 aa, Glycine max
  Coding DNA Sequence Number=SeqID_5095
MKQLKREEARKHDAELYLNRLRIAQGLALSIECGPCVVTAEARGFSQQLLRRDVLLGPPPLLRCERKKGSM

SEQ ID NO: 121874 - protein, 56 aa, Glycine max
  Coding DNA Sequence Number=SeqID_5096
MLAYLELFVHEKNSESRQDNDIARLSKALELEASVEELCPTEVPSKDFDVIEPHGS

SEQ ID NO: 121875 - protein, 126 aa, Glycine max
  Coding DNA Sequence Number=SeqID_5097
MKEDLKKLRDMNKDDVNSQNNVVKRVEDEDDVFLATNDEFAKIKWAINYAASKHICRDREMFGTLKIDGEFSHFKLGNSGKMKVEGIRSMRMKIHDALKRNHDGKVKKKVKFSNVVEVLGDTSIGG

SEQ ID NO: 121876 - protein, 887 aa, Glycine max
  Coding DNA Sequence Number=SeqID_5098
  Gene Ontology: Mol. function=protein dimerization activity; Cellular component=nucleus; Biological process=regulation of transcription, DNA-dependent
  Homolog annotation: Hit_ID=Q6L8U1; Match level="QueryCoverage=99%, HitCoverage=100%, E-value=0.0, Identity=58%"; Hit description=Auxin response factor 3
  Pfam annotation: Domain name=Auxin_resp; Domain location=280-322; Score=38.2; E_value=2.3e-08; Accession=PF06507.4; Description=Auxin response factor
  Pfam annotation: Domain name=B3; Domain location=153-258; Score =114.2; E_value=3.8e-31; Accession=PF02362.12; Description=B3 DNA binding domain
  Pfam module annotation: Pfam domain module=Auxin_resp::B3; Domain location=280-322::153-258
MKLSSSGFNPPAEEEGEKKCLNSELWHACAGPLVSLPLVGSRVVYFPQGHSEQDWDSQFVCSTVKVWRCKLGGGSSQMVAASTNREVDAHIPNYPNLPPQLICQLHNVTMHADAETDEVYAQMTLQPLSPQEQKEVYLLPAELGTPGKQPTNYFCKTLTASDTSTHGGFSVPRRAAEKVFPPLDYSQQPPAQELIARDLHDNEWKFRHIFRGQPKRHLLTTGWSVFVSAKRLVAGDSVLFIWNEKNQLLLGIRRANRPQTIMPSSVLSSDSMHIGLLAAAAHAAATNSRFTIFYNPRYMGTITGISDLDPVRWPNSHWRSVKVGWDESTAGERQPRVSLWEIEPLTTFPMYPSPFPLRLRRPWPSGLPSLYGLKDGDMGIGSPFMWLQGGLGDQGMQSLNFQGLGVTPWMQPRLDASIPGLQPELYQAMASSAFQEIRTMDPSKSSQSLLQFQQTSNVPSAHASEVQRQVLPQSQPQNTLLHNYQENQVPAQSQLLQQQLHRYHPYSDPRQQQQQLKNLPVQQQLPNVISPLSNFASGTQSQSPPIQALASHCQQQSFPELMRNHISGSDVSSIHSLLGSFSQDGTSQLLNLSGSNSVMSSAAMLPKQITTEPPQLPSAAPQCVLPQVENLGTSQSNVSELAALPPFAGREHSAYHAAADPQSNLLFGINIDPSSLMLQNGMSNLRNIGNVNNSLSLPFSASNCGGASGTDFPLSSNMTTSSCVDESGFLQSSENVDQANTPTGTFVKDYYFFQLVHKSGSFGRSLDISKFSSYDELISELARMFGLEGQLEDPKTQRSGWQLVFVDRENDVLLLGDDPWQEFVNNVWYIKILSPLEVQQMGKGLSPSTSAPGNKLSTPANSCDNYVSQQELRSSRNGMASMGSFHY

SEQ ID NO: 121877 - protein, 510 aa, Glycine max
  Coding DNA Sequence Number=SeqID_5099
  Homolog annotation: Hit_ID=UPI0000DB7211; Match level="QueryCoverage =86%, HitCoverage=9%, E-value=1e-08, Identity=23%"; Hit description =PREDICTED: similar to Stretchin-Mlck CG18255-PA, isoform A
  Pfam annotation: Domain name=CRA_rpt; Domain location=132-187; Score =9.5; E_value=0.087; Accession=PF07046.2; Description=Cytoplasmic repetitive antigen (CRA)
  Pfam annotation: Domain name=CRA_rpt; Domain location=209-243; Score =4.7; E_value=0.34; Accession=PF07046.2; Description=Cytoplasmic repetitive antigen (CRA)
  Pfam module annotation: Pfam domain module=CRA_rpt::CRA_rpt; Domain location=132-187::209-243
MALPTNRDQTPKSDSTNPCCELWKKKYLKTQESRNALRQAVKVLEQKINEIQSRYNKVCGVKVEREEKLGEFVASRAPLESENCSLESQIGTPITELGHGGGGNENGTLQADWEKEIGRLKELTEVEKGRADSERKKAAEACKLLENEKNKVVEKEKEIGGLKRLIEVEKGRADSERKKAAEACKLLENEKNKVVEKEKEISGLKRLIEAEKRRADSESKKAAEACKMVGDEKNKAAEKEKEMSRLKELIEVEKRKDDSERKEDTDVCKLLGEEKKKVAEKEKEIGRLKGLIEEKKRRVDSESKKAAEACKLLEEEKKKASVKGEMARIEAEKAVKYSFQIGQLEKQVNEAKTKLAFEISTFREATKKFEAEKRKLLAEKINAESGMAKANERLEVEKQKVDEEKRRADAEMVKLKEQKALAEDNWNKFMKEKCLADQMSQQLEEDKLAIEDLKRKIHELSSLTKPVEMAADSKANAESTEVKLLKNKLKLEKLRAKHTRQKYKLEASRY

SEQ ID NO: 121878 - protein, 112 aa, Glycine max
  Coding DNA Sequence Number=SeqID_5100
MIADQQRKQSLIFDHTLRMDVFLCKKEIGKLRHRIRPLANQSQNQSKEAANNSNSQKRRSAGDYYLRHRLVTAQGRTLNPRDFPTENRAAGELPCDYPKGKKEMLRVANPKS

SEQ ID NO: 121879 - protein, 125 aa, Glycine max
  Coding DNA Sequence Number=SeqID_5101
  Homolog annotation: Hit_ID=Q1SP37; Match level="QueryCoverage=43%, HitCoverage=16%, E-value=7e-12, Identity=56%"; Hit description =Bacterial adhesion
MDPNIDLDEVLDKMIDEELEDNNNEEIIRLILESQQQLDGNTTRRRQRRRVVHWNCEEDRFNNHDEYFQMRVDALRRKGLSPLQKCTIALRILAYGSLADSVDEYVLIGDQITKTPSDYYKWSDT

SEQ ID NO: 121880 - protein, 154 aa, Glycine max
  Coding DNA Sequence Number=SeqID_5102
MVGGVDARCTMTSVGDSMSCSGENQCWWLVERIIAGGWWRGSMQGTEMSREWFGRVKTENRERSMQGWWGSFWRKRIHPPVQKFNGSYKKAVKHRRSGSSEKDVSVDAHMIYLQDTGKKFEVSASGNYSLSSNPEIPIEVKEYDTPSPVSHSIG

SEQ ID NO: 121881 - protein, 550 aa, Glycine max
  Coding DNA Sequence Number=SeqID_5103
  Gene Ontology: Mol. function=drug transporter activity; Cellular component=integral to membrane; Biological process=flavonoid biosynthetic process
  Homolog annotation: Hit_ID=Q9LYT3; Match level="QueryCoverage=89%, HitCoverage=97%, E-value=0.0, Identity=73%"; Hit description =TRANSPARENT TESTA 12 protein
  Pfam annotation: Domain name=MatE; Domain location=103-263; Score =111.9; E_value=1.8e-30; Accession=PF01554.9; Description=MatE
  Pfam annotation: Domain name=MatE; Domain location=324-487; Score =123.2; E_value=7.1e-34; Accession=PF01554.9; Description=MatE
  Pfam module annotation: Pfam domain module=MatE::MatE; Domain location=103-263::324-487
MSNNAYTCTSNDSAQVVLSTCLYVKKHVNTTERCQQNMLEVHIITMSSLEHQPLLPRLDSHSHIQNLSSDAIEEFLEHRPIALRWWSKLIVWESRLLWLLSGASIVVSIFNYMLSFVTLMFTGHLGSLELAGASVASVGIQGLAYGIMLGMASAVQTVCGQAYGAKKHGAMSIILQRAIILHIGAAVILSFLYWFSGDFLKAIGQSDSIAERGQVFARGIILQLYAFAISCPMQRFLQAQNIVNPLAYMSVGVFLVHILLSWLVIYVLGYGLQGAALTLSFSWWLLVLFNGLYIIFSPRCKETWAGFSVKAFKGIWPYFKLTVASAVMLCLEVWYNQGLVLLSGLLSNPTISLDSISICMNYLNWDMQFMLGLSTAASVRVSNELGASHPRVAKFSVFVVNGTSILISVVFCTIILIFRVSLSKLFTSDSDVIDAVSNLTPLLAISVFFNGIQPILSGVAIGSGWQALVAYVNLASYYVVGLTVGCVLGFKTSLGVAGIWWGMILGVLIQTVTLIILTARTNWQAEVEKAVVRINKSAENDTLDQLVADT

SEQ ID NO: 121882 - protein, 404 aa, Glycine max
  Coding DNA Sequence Number=SeqID_5104
  Gene Ontology: Mol. function=oxidoreductase activity; Cellular component=nucleus; Biological process=electron transport
  Homolog annotation: Hit_ID=Q8LE44; Match level="QueryCoverage=78%, HitCoverage=64%, E-value=1e-149, Identity=80%"; Hit description =Putative amine oxidase
  Pfam annotation: Domain name=Amino_oxidase; Domain location=1-311; Score=101.1; E_value=3.2e-27; Accession=PF01593.14; Description =Flavin containing amine oxidoreductase
  Pfam annotation: Domain name=HI0933_like; Domain location=19-309; Score=-276.4; E_value=0.088; Accession=PF03486.5; Description=HI0933- like protein
  Pfam module annotation: Pfam domain module=Amino_oxidase::HI0933 _like; Domain location=1-311::19-309
MQTNNVREEFSEDMSILRALSIVFERKPELRLEGLSHKVLQWYLCRMEGWFATDADTISLKCWDQEVLLPGGHGLMVRGYQPVINTLAKGLDIRQGHRVTKIVRQYNEVKVAVENGKTFVADAAIVAVPLGVLKAKSIKFEPKLPDWKEAAISDIGVGIENKIILHFKNVFWPNVEFLGVVAETSYGCSYFLNLHKATGRPVLVYMPAGQLAKDIEKMSDEAAASFAFMQLKKILPDTSSPIQYLVSRWGTDINTLGSYSYDAVGKPHDLYERLRVPVDNLFFAGEATSMLYTGSVHGAYSTGMMAAEDCRMRVLERYGELDLVPPTGRTVGYIHGCMVRASIHPEQYIYHTELIDGVKFAAPDDWSSIAIESDSKKVGNINRNVTDWSELGVIYEGIRLAVIV

SEQ ID NO: 121883 - protein, 895 aa, Glycine max
  Coding DNA Sequence Number=SeqID_5105
MQNSNVMRQICNLNLSETCRQFENELLEPCCTTIEASDPLRENMQNTQLLTPGGNYSEKSITGIGSKLEPLVRGSDRTKIQSSAVNSSTESFSDGQLMGSQDATIFPVTASAKLTQDFKPSDKPVDVHHRKRKRTQDTVEHDANLSSEKLSDLHGLMHIKVGKCLDGGKEVLHNLNNLQEENKRAHKKRKKYRREKVDMIPLVNRDEQKGTEEAGTEVYDDANVCRHTSCPAPHTLETSQAYGDRICDAVNNFDTVPDGNYMKLLELEDATSEECYRKAMDFPISPSLPEIEFRETFEEGNLTNTSLEEALQDDMLRSRTDLFTSPYFDVINVEINSNEQKCDDYGVSCNLHMHTTEKSRTAFSVEDGIGSLNNQLPGFCVVFSNMEDNSIISRILVATKNCIARCNLATQTGWGVSNILTVLKMEEKLSQKEKVSVLLTLMLFNFAMTASKTFGKLWDGNLFHCLQSYSEHICTETRILFVENYSLHELLSLIEDFLIEGKVIVNSGVDAETLSCDLRANDFLDCVNEVSSNVASSEQLVAASIILASVCAATDYVGFICDASYHILQSCKWDSLMVLTILHIFAYLGGEKFFNIDNFGLMVTVLKSLIMFLEDESPSVASACLPSINQLHAELCMNVKCPFSEGAESIDAVVCLLLEEIKRINLSDSGLMSDNYNDRQWYNQGAVQCAISKNCDVPCLKKCLISATQPDALMNVNFCRLNDVLSLVELVANKMSWHWVDMKLVPQLLNLLDSCVEENFAVRIIVLLGQLGRTGVDVGGYEDNGVGNLRCYLYTYFCRTSSMKAGLSLQVAAATTLFDLLPLDFETLFHTKIHLSAYSKSVSDNAETLRKWFSGLDLNYFQSSLDIHHHASPPEEIFGGGTHRFRKPHLAEFVL

SEQ ID NO: 121884 - protein, 53 aa, Glycine max
  Coding DNA Sequence Number=SeqID_5106
MCSECKIQRGSFSKSLCCANDDKQQERSPSVIVIGGGMAGIAAARALQDASFQ

SEQ ID NO: 121885 - protein, 90 aa, Glycine max
  Coding DNA Sequence Number=SeqID_5107
  Subcellular localization annotation: CTP_CleavageSite=50; ConfidenceScore=5.45e-01
MEAAPSPNTRSTKRKQTWSQHTKVRTHASRLFSTMSLGFAKNGSTIVTTVAEEHEAIDYRLESQELGEIVARVRNNVKVGNDVYYKLSNP

SEQ ID NO: 121886 - protein, 323 aa, Glycine max
  Coding DNA Sequence Number=SeqID_5108
MYYKMQWRMTEEASRKAYKTLLAVAKYGFKGMSNDVEKCLSLERMRGLINNLIRISKQGAKKIAVSLKENWSITTLNLILSHGSCLAMIPLDQMVPRPWLKFSSFMGKSSPAIAKEDKRSFLATKRLKELLEFRKASSSETKGVGGGNGPGVQLLAIEHEIEVNVRVHEVRSECEHQNHSLCLSQEFPIGSKLDPIVYGPPESTITKEILEQELSGMSLEQFSSIFSCHISSRIAFSEKNGKFVIHEFVDTHNHLYSLQKQHMLSSHRKISEVQAYEIQIEKDSGMKQKASFPLMSAHVAGDRANLGYTRLDAKNYLQARRQA

SEQ ID NO: 121887 - protein, 247 aa, Glycine max
  Coding DNA Sequence Number=SeqID_5109
  Gene Ontology: Cellular component=endoplasmic reticulum
  Homolog annotation: Hit_ID=O82352; Match level="QueryCoverage=90%, HitCoverage=88%, E-value=1e-34, Identity=37%"; Hit description =Expressed protein
  Pfam annotation: Domain name=Reticulon; Domain location=59-244; Score= 145.2; E_value=1.8e-40; Accession=PF02453.8; Description=Reticulon
MSEKITAEKLLNTLVETLTEKQKSGLFFEEDKSSSVSSQFNRLFGRQKPVHHILGGGKSADVLLWRNKKISASVLSAATAIWVLFEWLNYNFLTILFFVVALGMLGQFLWTNASGLFSRKPSKVPRFVLPDGIFVNIATAVGAEILISEQKTQGVGTQEGCGIGNDLKDVKFLLRCWSEEFGWCNTIHAHKCFVAAHTLPVLYERYEDQVDNFVYKVFDQLQNHYQKLDTGLLSKIPKGKLKGKKYE

SEQ ID NO: 121888 - protein, 252 aa, Glycine max
  Coding DNA Sequence Number=SeqID_5110
  Gene Ontology: Cellular component=mitochondrial matrix
  Homolog annotation: Hit_ID=Q6YZC6; Match level="QueryCoverage=99%, HitCoverage=100%, E-value=2e-45, Identity=44%"; Hit description =Cation exchanger-like protein
MGISKTEVNLRRLLAAAPQQQNQAKLVHYVATLREQLEQLAEERTLEGLPRISKAMLNDYSEKIEAIASKLVNHVIDTQVPGKDFERNFVKEKHSEIEEKKQILLSSGLRRRPVLFYCCSSDSLDRPASSMEDRAHEPAETDHTSPIKLDATAHAHIEKHRKLQEDLTDEMVVLAKQLKESSLTMSQSLQNTEKILDSTEKAIEHSLASTGRANVRATAIYSESSKTSCLTWLVMFVMTCVFVMVILLIRVT

SEQ ID NO: 121889 - protein, 75 aa, Glycine max
  Coding DNA Sequence Number=SeqID_5111
MKHTILKSPFSSQMSMFGQNLCCKAMVVFICKEEYGVLLGNDWAATHEFGHNFCISNEGDDDDDDNGVIDVAPAA

SEQ ID NO: 121890 - protein, 262 aa, Glycine max
  Coding DNA Sequence Number=SeqID_5112
  Gene Ontology: Mol. function=nucleotide binding; Cellular component =myosin complex; Biological process=cell wall organization and biogenesis
  Homolog annotation: Hit_ID=Q2US45; Match level="QueryCoverage=95%, HitCoverage=19%, E-value=8e-90, Identity=71%"; Hit description =Myosin class I heavy chain
  Pfam annotation: Domain name=Myosin_TH1; Domain location=1-103; Score= -42.3; E_value=0.0008; Accession=PF06017.4; Description=Myosin tail
  Pfam annotation: Domain name=SH3_1; Domain location=214-259; Score =7.5; E_value=0.0033; Accession=PF00018.18; Description=SH3 domain
  Pfam module annotation: Pfam domain module=Myosin_TH1::SH3_1; Domain location=1-103::214-259
ERTVPIGAIKAVSTSNLKDDWFSLIIGGQEPDPLINCVFKTEFFTHLQTALRGQLNLKVSENIEYNKKPGKLATVKAIKDPAASPNVDTYKSHTIHTSPGEPPSSVSKPTPKAKQVAARPVTKGKLLRPGGPGGGPSKLASRPASRPTPKPQPLPQSQPATAQPIPAPQPAAVPRPVPQPVAAAAASHTRNASSGSVRAPPPPPPASPPAPKKATAKALYDFTSAQSNELDIRAGDVVQIVSKEGNGKFWLPHFYAYEANVY

SEQ ID NO: 121891 - protein, 80 aa, Glycine max
  Coding DNA Sequence Number=SeqID_5113
  Subcellular localization annotation: CTP_CleavageSite=46; ConfidenceScore=5.02e-01
MASSVRNGCVTGKPLVRLATSPLVDLATSTGESASGFTNRWFDWRLASAGGSVFHCEGCFFREKEVATPIDRVKAKLRSH

SEQ ID NO: 121892 - protein, 294 aa, Glycine max
  Coding DNA Sequence Number=SeqID_5114
MGGNNSRLNGNGGEVLPARIRNRWEELRKRKSGEDGTLLKKELLNSDGVDEGNSQSSEENGSEHKRDSLNDAQQAKGVEKLSKVVPLPVSEPGNEEQRNELHNEEKGKDAEKKGEVVELKTGKVQSTAGLQPEIKHEESNVKNDSSDDDDEDEDEDEDEEDDIQRLIGPSSPSFKIYCTEADKIKEEELHDSKALGDENQTVALLQKSSSTNSIDESSTSASGNTGNSNEANIYENCFSIVEIKSASSKRKGNKKKKFGAMKKNLLQVKHLNMNRMNPILACTGNDRRRLLSED

SEQ ID NO: 121893 - protein, 152 aa, Glycine max
  Coding DNA Sequence Number=SeqID_5115
  Gene Ontology: Mol. function=protein serine/threonine kinase activity; Biological process=protein amino acid phosphorylation
  Homolog annotation: Hit_ID=Q1S9D3; Match level="QueryCoverage=100%, HitCoverage=27%, E-value=4e-66, Identity=79%"; Hit description =Protein kinase
MGCVLGTPAGAGDQRLRRSEKRNGAVDEGNNAVGLREKERNRHTGDFPGTLPAPGRRKPRLDPCAVTQQGWPSWLMAVAGEAIGDWTPRRANTFEKLAKIGQGTYSNVYKARDLVTGKIVALKKVRFDNLEPESVKFMAREILVLRRLDHPN

SEQ ID NO: 121894 - protein, 459 aa, Glycine max
  Coding DNA Sequence Number=SeqID_5116
  Gene Ontology: Mol. function=DNA binding; Biological process=DNA integration
  Homolog annotation: Hit_ID=Q1S9D5; Match level="QueryCoverage=46%, HitCoverage=100%, E-value=3e-93, Identity=80%"; Hit description =Ubiquitin-conjugating enzyme, E2; UBA-like
  Pfam annotation: Domain name=UBA; Domain location=422-459; Score =31.7; E_value=2.6e-06; Accession=PF00627.21; Description=UBATS-N domain
  Pfam annotation: Domain name=UEV; Domain location=245-366; Score= -40.5; E_value=0.067; Accession=PF05743.3; Description=UEV domain
  Pfam annotation: Domain name=UQ_con; Domain location=250-412; Score =206.5; E_value=6e-59; Accession=PF00179.16; Description=Ubiquitin -conjugating enzyme
  Pfam module annotation: Pfam domain module=UBA::UEV::UQ_con; Domain location=422-459::245-366::250-412
MGDPLSAEASSSYHHLVGRLIYLMNTRPDIAHVVQQLSQYMAHPTTAHSQAASRVLRYLKGTPGSGIFATGSLQFKAFSDSDWAGCRDTRRSITDFSVYLGNSIISWRSKKQPTVSRSSSEAEYRALASTTCELQWLTYLLQDLRVLFVQPANLYCDNQSAIQIASNQVFHERTKHIDLDFHIVREKVQSGLLKLLPISSSMQLADIFTKSLPPTMFQLLFSRFVVLPVCDSLPRVWLIGDRLKMIDLARVQKELVECSKDAEGSGIKVCPKSDNLVLLIGTIPGPVGTPYEGGIFQIDITLPDGYPFEPPKMKFKTKVWHPNISSQSGAICLDILKDQWSPALTLKTALLSVQALLSAPQPDDPQDAVVAQQEKFLLISFAYGTAKAQYIEDYIPYLKDYQTFVNTARYWTESFAKESSRGIEDKVQKLVEMGFPEAQVRSILEAVGGDENLALERLL

SEQ ID NO: 121895 - protein, 85 aa, Glycine max
  Coding DNA Sequence Number=SeqID_5117
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=98%, HitCoverage=24%, E-value=9e-38, Identity=74%"; Hit description =Photosystem II 44 kDa reaction center protein precursor
SQAQAFTFLVRDQRLGANVGSAQGPTGLEPLRGPNGLDLSRLKKDIQPWQERRSAEYMTHAPLGSLNSVGGVATEINAVNYVSPR

SEQ ID NO: 121896 - protein, 125 aa, Glycine max
  Coding DNA Sequence Number=SeqID_5118
  Gene Ontology: Mol. function=RNA-directed DNA polymerase activity; Biological process=RNA-dependent DNA replication
EFKDVFPKEIPHGLPPSRSIKHQVDLLPEASLPNRPTYNSKPQETQHKDAQAKVEYVKRLYDQVKVQIAKKNESYTKQANKKRKEVVLEPGDNLGHLRTNVYQEGGNDENPETGQIQAKGPSGEG

SEQ ID NO: 121897 - protein, 42 aa, Glycine max
  Coding DNA Sequence Number=SeqID_5119
MYRGPRGSFGVEGRSKVGPCDHPSTNAPDPIRTPQLSVLGRE

SEQ ID NO: 121898 - protein, 1164 aa, Glycine max
  Coding DNA Sequence Number=SeqID_5120
  Gene Ontology: Mol. function=ATP-dependent helicase activity; Cellular component=intracellular; Biological process=multicellular organismal development
  Homolog annotation: Hit_ID=Q5ZAP0; Match level="QueryCoverage=97%, HitCoverage=92%, E-value=0.0, Identity=58%"; Hit description =Putative DEIH-box RNA/DNA helicase
  Pfam annotation: Domain name=DEAD; Domain location=195-363; Score =11.3; E_value=6.2e-07; Accession=PF00270.19; Description=DEADDEAH box helicase
  Pfam annotation: Domain name=DUF1605; Domain location=876-993; Score =55.6; E_value=1.6e-13; Accession=PF07717.6; Description=Domain of unknown function (DUF1605)
  Pfam annotation: Domain name=HA2; Domain location=744-839; Score =78.3; E_value=2.4e-20; Accession=PF04408.13; Description=Helicase associated domain (HA2)
  Pfam annotation: Domain name=Helicase_C; Domain location=592-681; Score=50.1; E_value=7.6e-12; Accession=PF00271.21; Description =Helicase conserved C-terminal domain
  Pfam annotation: Domain name=R3H; Domain location=34-89; Score=47.3; E_value=5.2e-11; Accession=PF01424.13; Description=R3H domain
  Pfam module annotation: Pfam domain module=DEAD::DUF1605::HA2::Helicas e_C::R3H; Domain location=195-363::876-993::744-839::592-681::34-89
METTTKTNKTGKKKGEPLFRQNPNVDEVTRICISQILEQFRASNDEVYKFDAGLSNQERALVHQMALKMGFRSKSYGLGKERRVCVQKMKKKVDTDNEFGSLPPFTFSGEAKWVLGDLFAHHPPGEGNLWEMVGENSEDTTTDGTKQRPGDIFSRPSMTKAEIARRLEALASRMNNVSNLKQINEGRSKLPIASFKDSITSTVESHQVVLISGETGCGKTTQVPQFILDHMWGKGEVCKIVCTQPRRISATSVSERIASERGETIGENVGYKIRLESRGGRQSSIVLCTTGVVLRVLVSKGSHSSKTGRVKDEISGITHIIMDEIHERDRYSDFMLAIIRDMLPLYPHLRLILMSATIDAARFSQYFGGCPIIHVPGFTYPVKTFYLEDVLSIVKSRHDNHLDSTTCSIPKNTCELSEEEKLSIDEAINLAWSNDEWDLLLELVSSEGTPELFNYQHSLTGLTPLMVFAGKGRVGDMCMLLSCGADFCLRAKDGMAALEIAERENQPEAAEILKKHMDSDFSNSMEEKKLLDKYLATVNPELVDDVLIEQLIRKICIDSTDGGILVFLPGWDDINRTRERLLASSFFKNSSMFMLISLHSMVPSMEQKKVFRRPPHGCRKIVLSTNIAETAITIDDIVYVIDTGRMKEKSYDAYNNVSTLQSSWISKASAKQREGRAGRCQPGICYHLYSRTRAVSLPDFQIPEIRRMPIEELCLQVKLLDPSCKVEEFLCKTLDPPVFESIRNAIIVLQDIGALSNDEKLTQLGEKLGSLPVHPLICRMLFFAILMNCLDPALTLACASDYRDPFTLPMLPEEKKRASAAKYELASLYGGCSDQFAILAAFECWNNAKKMGLEARFCSQYFVSSSTMNMLSGMRRQLQAELIRLGFIHEDVSGYSVNTHDPGVLNAVLVAGLYPRVGRFLTNKSGKRVIVETTSGDKVRLHNHSINFKLSFKKKLDDTLIVYDEITRGDGGMNLRNCTVVGPLPLLLLSTEIAVAPAEENDEGDEDDVGGSEDEAGSEDVMEFDAESSGGREDKLMSSPDNMVKVIMDRWLYFCSTAIDVAQLYCLRERLSAAILYKVTNPRNTLPPIMAASVHAIACILSCDGCIGVPAMLEGVETLTTMVNATTLGKPATGTRRFGKRPKGSLAELLNYDGRQTSGPYFKA

SEQ ID NO: 121899 - protein, 77 aa, Glycine max
  Coding DNA Sequence Number=SeqID_5121
MKFKHKRYVTIILRLKPTCNWYHFSVKNLVGRLGVHDRTCLTMGKSGLQEHSNRMTPKAYTPKSPLGPLPPDSVRLK

SEQ ID NO: 121900 - protein, 187 aa, Glycine max
  Coding DNA Sequence Number=SeqID_5122
  Gene Ontology: Mol. function=DNA binding; Cellular component=nucleus; Biological process=regulation of transcription
  Homolog annotation: Hit_ID=Q6ER41; Match level="QueryCoverage=35%, HitCoverage=12%, E-value=5e-21, Identity=68%"; Hit description=Myb family transcription factor-like
  Pfam annotation: Domain name=Myb_DNA-binding; Domain location=19-70; Score=45.2; E_value=2.3e-10; Accession=PF00249.21; Description=Myb -like DNA-binding domain
MIKNSESSVRKYNKSELPRLRWTPELHQHFVEAIESLGGKHKATPKRILQQMRVKGLRIAHIKSHLQMYRNRKGHAIIAPVGQLLEDFKICSISPTERILKREETDYDLNQEPQSSALLLSDDVSNEEENFADLSFSFSTPLMSIIQRENSKEIMRFSSSTAAANHSVDSSSTPSFANNYINLDLTI

SEQ ID NO: 121901 - protein, 80 aa, Glycine max
  Coding DNA Sequence Number=SeqID_5123
MKYRGRANRREFGEGKKCDRLVEMGRGNLNTENPNMFGLGLGLGLGMGEVRLRRKMIGRNMVGTPRLLYTFSILLPFFIF

SEQ ID NO: 121902 - protein, 562 aa, Glycine max
  Coding DNA Sequence Number=SeqID_5124
  Gene Ontology: Mol. function=binding
  Homolog annotation: Hit_ID=Q9FI58; Match level="QueryCoverage=96%, HitCoverage=95%, E-value=1e-142, Identity=51%"; Hit description =Arabidopsis thaliana genomic DNA, chromosome 5, TAC clone:K3K7
  Pfam annotation: Domain name=Arm; Domain location=178-218; Score =27.7; E_value=4.1e-05; Accession=PF00514.13; Description =Armadillobeta-catenin-like repeat
  Pfam annotation: Domain name=Arm; Domain location=262-302; Score =19.1; E_value=0.016; Accession=PF00514.13; Description=Armadillobeta- catenin-like repeat
  Pfam annotation: Domain name=Arm; Domain location=303-343; Score =19.6; E_value=0.011; Accession=PF00514.13; Description=Armadillobeta- catenin-like repeat
  Pfam annotation: Domain name=Arm; Domain location=354-395; Score=0.9; E_value=9.5; Accession=PF00514.13; Description=Armadillobeta-catenin -like repeat
  Pfam annotation: Domain name=Arm; Domain location=438-478; Score=2.4; E_value=6.2; Accession=PF00514.13; Description=Armadillobeta-catenin -like repeat
  Pfam annotation: Domain name=DUF634; Domain location=150-335; Score= -160.5; E_value=0.09; Accession=PF04826.4; Description=Protein of unknown function (DUF634)
  Pfam module annotation: Pfam domain module=Arm::Arm::Arm::Arm::Arm::DU F634; Domain location=178-218::262-302::303-343::354-395::438 -478::150-335
MKDSTETDAISDSLELLSTFLDSELPSVRNFKGKWSLARVKLTQLQTHLTDFSAEFPNASTTNPLSLHLLHSIFKTLNDAVSLSRSCQPQTLPNGKLKTQSDLDSLLATLDRHVSDCDILFRSGLLLENDAVSVSVSVSSKREAIRSESRNLITRLQIGSPESKASAMDSLLGLLQEDDKNVTIAVAQGVVPVLVRLLDSPPSDTKEKTVAAISKVSTVESAKSVLLAEGLLLLNHLLRVLDSGSGFAIEKACIALRALSLTKENARAIGSRGGISSLLEICQAGTPGAQASAAAVLRNLAAFEEIRDNFVEENAVVVLIALASSGTAVARENAVGCLSNLINSDSSSEETEGLSNLRITVVKEGGVECLKNYWDSGTQIQSLEVAVVMLRHLAESGPIGEVLVGEGFVQRLVGVLNREVLAVRIAAARAVYALGLNSGRARKEMGELGCVLGLIKMLDGKGVEEKEASAMALSVLLMHPANRRVFRKDERGVVSAVHLLNPSLQGLDKKYPVSLLALLVHSKSCRKQMVAAGACVYTQKLVEMDVPGSKKFLESLGRGTMT

SEQ ID NO: 121903 - protein, 317 aa, Glycine max
  Coding DNA Sequence Number=SeqID_5125
  Homolog annotation: Hit_ID=Q9LW21; Match level="QueryCoverage=74%, HitCoverage=23%, E-value=2e-26, Identity=38%"; Hit description =Arabidopsis thaliana genomic DNA, chromosome 3, P1 clone: MDJ14
VLSNPERTPIHTFFCNYDLSDMPTGTKSKLGYNPSLREYNGQLEQLGVTRLQYTLASILKAKTGVICVRTATFLRQKVTLTASRSKSMMGKESQTDSDTRADAKSSLISVTSHRDKDLLTSKCGEFDSFTCSKAGKEENFSSIACLINQDKFLHGSSKIIDNAINTGILLYALHLRFMCPLPKRRSRSVHKCKSGPVSADMRNIVDIEQERSFYLYDDMRVVFPQRHSDSDEGKLNSLTESMVGWCFTTLIMRLYQSERVVKYLLQSCKCSYLIHSTCFDPLRVCLCSPTTVHQMAQKRPEVPWPKQKYHYAYTGRV

SEQ ID NO: 121904 - protein, 404 aa, Glycine max
  Coding DNA Sequence Number=SeqID_5126
  Gene Ontology: Mol. function=hydrolase activity, acting on ester bonds; Cellular component=cellulose and pectin-containing cell wall; Biological process=lipid metabolic process
  Homolog annotation: Hit_ID=Q9FJ45; Match level="QueryCoverage=69%, HitCoverage=81%, E-value=2e-55, Identity=41%"; Hit description=GDSL -motif lipase/hydrolase-like protein
  Pfam annotation: Domain name=Lipase_GDSL; Domain location=35-293; Score=51.5; E_value=2.8e-12; Accession=PF00657.12; Description=GDSL -like LipaseAcylhydrolase
LSNIMKISILFITIFSCGFLGNVVSNASPLPYEAIFNFGDSISDTGNAAHNHPPMPGNSPYGSTYFKHPSGPEAYGMPMLPAYLNLTKGQDIKKGVNFAYAGSTALDKDFLVQKRINIEEATFSLSAQFDWFKGLKSSLCTSKEECDNYFKNSLFLVGEIGGNDINALIPYKNITELREMVPSIVETIANTTSKLIEEGAVELVVPGNFPIGCNSAVLAIVNSEKKEDYDQFGCLIAYNTFIEYYNEQLKKAIETLRKNNAHVKITYFDYYGATKRLFQAPQQYGGWELSLEWRRLFEWEKSQVVELHQGLAIVTVNGDREDQWRWELDSTGSFNVKVAYQALHMDTVGSQPNEPTDVWKNLWGVKAQPKALFLVWRDVMERDAFFVEAVKNPYLIIASFLVAK

SEQ ID NO: 121905 - protein, 432 aa, Glycine max
  Coding DNA Sequence Number=SeqID_5127
  Gene Ontology: Mol. function=protein binding; Biological process =hypersensitive response
  Homolog annotation: Hit_ID=Q1HIU5; Match level="QueryCoverage=88%, HitCoverage=55%, E-value=1e-128, Identity=61%"; Hit description =Ankyrin repeat BTB/POZ domain-containing protein
  Pfam annotation: Domain name=Ank; Domain location=115-148; Score =16.3; E_value=0.11; Accession=PF00023.20; Description=Ankyrin repeat
  Pfam annotation: Domain name=Ank; Domain location=149-181; Score =23.0; E_value=0.0011; Accession=PF00023.20; Description=Ankyrin repeat
  Pfam module annotation: Pfam domain module=Ank::Ank; Domain location =115-148::149-181
MQRHLLNFVEKALVEDVIPILMAAFNCQLDQLLSRCIQRVARSDFDNTSLEKELPHEVLTEIKSLRLSFQPESTPNAMEAESLNEKSIRRIHKALDSDDVELLKLLLNESSVTLDDAYALHYACAYSDSKVIQEVLSLGMADILRRNSRGYTVLHVAARRKDPSILVALLNKGARASDTTPDGQTALAICQRLTRCKDYHEKTVQCKESNKDRLCVDVLEREMRRNSMTVNMSVSSQLTADDLHMRLDYLEDRVAFARLLFPAEARVAIENAEADSSSLYANSSALKVTNGNPKEVDLNESPSARTRKLQLRLHALMKTVENGRRFFPHCSEVLDKFLEDDEMPDVFFLEKGSEEEQRIKKARFMELKDDVQKAFHKDMAENNHSGFSSTVSSSSSSTRREGLNHRLQQGVTLVFNKVMEGLMWTYCYSQAG

SEQ ID NO: 121906 - protein, 356 aa, Glycine max
  Coding DNA Sequence Number=SeqID_5128
  Homolog annotation: Hit_ID=Q6H4U9; Match level="QueryCoverage=58%, HitCoverage=76%, E-value=2e-12, Identity=44%"; Hit description =Dentin sialophosphoprotein-like
MAMFLKACGTLAGTPAEIRKASEKLKSLAPDKDSDPSRFHSWLPNTSVEKLQLDVQPFDPPTPINLCQKLGNSMDSFEHTPSSRISKAQDTEDDSVDYMEKNWSGNLHTADRSERNAALVSPLLATYTQRKNKSVRFESETDLATYGSSSDDWHMKENKSPNSQSAYKPSPYPTPLKLFDEMQTPGTVYPASLEELRTGKAQVRSQFVYPTNKPGDNVFWCKILEERDFNLEEDSSELSDLVEKAQNETPTPEKGSKKFSKENDDEVKSNLSARISPVSTIKEHSPMPFKWWYDNGIPNSTTKYKEDQKVKWHATPFEERLDKALSENFISQRKLVCGKPVEFDEIEESDTTLSQL

SEQ ID NO: 121907 - protein, 454 aa, Glycine max
  Coding DNA Sequence Number=SeqID_5129
  Homolog annotation: Hit_ID=Q9FQD4; Match level="QueryCoverage=45%, HitCoverage=95%, E-value=1e-104, Identity=90%"; Hit description =Glutathione S-transferase GST 24
  Pfam annotation: Domain name=GST_C; Domain location=112-202; Score =47.7; E_value=3.9e-11; Accession=PF00043.15; Description=Glutathione S-transferase, C-terminal domain
  Pfam annotation: Domain name=GST_N; Domain location=1-75; Score=76.3; E_value=9.9e-20; Accession=PF02798.10; Description=Glutathione S -transferase, N-terminal domain
  Pfam annotation: Domain name=NB-ARC; Domain location=155-384; Score= -130.5; E_value=0.058; Accession=PF00931.13; Description=NB-ARC domain
  Pfam module annotation: Pfam domain module=GST_C::GST_N::NB-ARC; Domain location=112-202::1-75::155-384
MAVKVYGPHCASTKRVLVCLVEKEVEFEVVPVDVTKGEQKDPEYLKLQPFGVVPVIKDGDYTLYESRAIMRYYAEKYRSQGVELLGKTIEERGLVEQWLEVEAHNFHPQAYNLCLHGLFGSLFGVTPDPKVIEESEAKLVQVLNIYEERLSKTKYLAGDFFSIADISHLPFLDYVVNNMGKKYLLEERKHVGAWWDDISSRPSWNKDNIVQDFDAASFLADKTLLLEMQEELETELGGSKSKRMYEIKRKLRRKKVPLVLDDVDDKDKLEKLAGGLAVDVSKHLPLALKVIGSDLATLDEESLDDWECALEEYERTPPERIQDEFGSTSNINVLVNKSLLTIEYGCLKMHDLIQDMGREIVRKEAPKNPGQLSRLWYYVDVIEILTDDLGSDKIEGIMLDPPQRAVVDWSGFAFEKMEWLRILIVRNTSFSYEPKHLPNHLRVLDWKEYDGNKF

SEQ ID NO: 121908 - protein, 140 aa, Glycine max
  Coding DNA Sequence Number=SeqID_5130
MVKKQCKEVSVSPERLAKKESHFAIKTNIKKSFLLRQPPHLLLCKRKIVSIAIPLELKVITQVKELLDEGVVRKSLNPYALLVPKIGVPTNPKRIKVIPEWSTPASVEGKSLEFQEPLDLRSNPFQGGGNDEILPTKGIG

SEQ ID NO: 121909 - protein, 60 aa, Glycine max
  Coding DNA Sequence Number=SeqID_5131
MSHERMYQRWVKNTFDKKVCLRKFNEGALVLKKAFSGGALVLANMDDKELASPVNADIAK

SEQ ID NO: 121910 - protein, 110 aa, Glycine max
  Coding DNA Sequence Number=SeqID_5132
MNCWNLDDPIVTFRGLRKARGKRSEAPSTSASEAPPGDQPSSSGGGGASTAQEPMTKEPTTPVPSPAAVEEETTPAQTPQPSPPSAPAPEETQPSALDINEDQPQEEQDV

SEQ ID NO: 121911 - protein, 182 aa, Glycine max
  Coding DNA Sequence Number=SeqID_5133
  Gene Ontology: Mol. function=DNA binding; Cellular component=nucleus; Biological process=regulation of transcription, DNA-dependent
  Homolog annotation: Hit_ID=Q9SK55; Match level="QueryCoverage=75%, HitCoverage=49%, E-value=4e-64, Identity=80%"; Hit description =Putative NAC domain-containing protein 42
  Pfam annotation: Domain name=NAM; Domain location=21-150; Score =269.3; E_value=7.5e-78; Accession=PF02365.6; Description=No apical meristem (NAM) protein
MDVAKLHNSDDDDDKKEEEVVLPGFRFHPTDEELVGFYLRRKVEKKPLRIELIKQIDIYKYDPWDLPKVSSVGEKEWYFFCIRGRKYRNSIRPNRVTGSGFWKATGIDKPIYCVREPQECIGLKKSLVYYRGSAGKGTKTDWMMHEFRLPPNGKTSNNPQANDANDVQEAVSQLYKCYSLFP

SEQ ID NO: 121912 - protein, 247 aa, Glycine max
  Coding DNA Sequence Number=SeqID_5134
  Gene Ontology: Mol. function=aspartyl esterase activity; Cellular component=cell wall; Biological process=cell wall modification
  Homolog annotation: Hit_ID=O04887; Match level="QueryCoverage=90%, HitCoverage=44%, E-value=1e-105, Identity=79%"; Hit description =Pectinesterase-2 precursor
  Pfam annotation: Domain name=Pectinesterase; Domain location=1-233; Score=443.0; E_value=4e-130; Accession=PF01095.10; Description =Pectinesterase
MVPTLIYSKVPCSAEARLDYTAVGDGFIAQDITFRNTAGAANHQAVAFRSGSDLSVFYRCSFEGFQDTLYVHSERQFYKACDIYGTVDFIFGNAAAVLQNCNIYARTPPQRTITVTAQGRTDPNQNTGIIIHNSKVTGASGFNPSSVKSYLGRPWQKYSRTVFMKTYLDSLINPAGWMEWDGNFALDTLYYAEYANTGPGSNTANRVTWKGYHVLTSASQASPFTVGNFIAGNNWIPSSGVPFTSGL

SEQ ID NO: 121913 - protein, 81 aa, Glycine max
  Coding DNA Sequence Number=SeqID_5135
MMMNQERLESKAKSKLFWKFKEEDKAMGNKFILLENENENVSPVKIVYVTQPALGKINVMELIEKFNTQSDEFISKKASRP

SEQ ID NO: 121914 - protein, 229 aa, Glycine max
  Coding DNA Sequence Number=SeqID_5136
  Gene Ontology: Mol. function=peptide deformylase activity; Biological process=translation
  Homolog annotation: Hit_ID=Q10FJ2; Match level="QueryCoverage=42%, HitCoverage=24%, E-value=3e-11, Identity=37%"; Hit description =Pleckstriny domain-containing protein, putative, expressed
MILRSSKSCLHRRYAIWLLKESAEKIVGLSKEREQLIRQRDAAIQEANMWRSELAKAREHDVILEAAVVRAEEKVRVAEANAETRIREAVQRESAALKEKEELLAYVNVLKAQLQRQHIDTTQVFEKTESCSDTKHVDPTEENVDKACLSVSRAIPVPAENVVHMATDQVNIQPVGDNEWSDIQATEARIADVREVAPETDGSSLDIPVVSQPGTNHHHEQGANSFHQP

SEQ ID NO: 121915 - protein, 228 aa, Glycine max
  Coding DNA Sequence Number=SeqID_5137
  Gene Ontology: Mol. function=DNA binding; Cellular component=nucleus; Biological process=regulation of transcription, DNA-dependent
  Homolog annotation: Hit_ID=Q9SK55; Match level="QueryCoverage=91%, HitCoverage=68%, E-value=1e-39, Identity=46%"; Hit description =Putative NAC domain-containing protein 42
  Pfam annotation: Domain name=NAM; Domain location=1-66; Score=43.4; E_ value=1.5e-11; Accession=PF02365.6; Description=No apical meristem (NAM) protein
RKYRNSIRPNRVTGSGFWKATGIDKPIYCVREPQECIGLKKSLVYYRGSADKGTKTDWMMHEFRLPPNGKTSNNPQANDANDVQEAEVWTLCRIFKRVPTYKKYTPNLKDSAAPITEPNHPTNSSSSKTCSLESDNCKPYLTFTNSSSPQLILQNERKPVINGHVDVERNHLFLGQLGNVAQAPSFWNHHQNNNVEFANENWDDLTSVVQFAIDPSRVSDHSKEFNRF

SEQ ID NO: 121916 - protein, 209 aa, Glycine max
  Coding DNA Sequence Number=SeqID_5138
  Gene Ontology: Mol. function=peptide deformylase activity; Biological process=translation
  Homolog annotation: Hit_ID=Q10FJ2; Match level="QueryCoverage=98%, HitCoverage=41%, E-value=2e-54, Identity=66%"; Hit description =Pleckstriny domain-containing protein, putative, expressed
MERALGHLGPDYGENGIQVCVCILVSVCVGKRKITLITDLLYCFECFPFLRIRRNEPSVKGTIIFDANSTITISPVNFHGLPKYDGCCFCILFVAFTTYESSDIGTPQKKDYFLCAETPGAARAWVSTLHATQLVLKAHKEAVNSLSGNGSTKLGTVATVVAAANSTALECSKEIEAAMQISLRNALGMMNNRTTDGPMDDLTIMKRTA

SEQ ID NO: 121917 - protein, 508 aa, Glycine max
  Coding DNA Sequence Number=SeqID_5139
  Gene Ontology: Mol. function=protein serine/threonine kinase activity; Cellular component=anaphase-promoting complex; Biological process=ubiquitin-dependent protein catabolic process
  Homolog annotation: Hit_ID=Q67YV2; Match level="QueryCoverage=95%, HitCoverage=52%, E-value=1e-147, Identity=57%"; Hit description=MRNA, complete cds, clone: RAFL24-07-B09
MGGILKQPGAFAITPHKVSLCILLKIYAPPAQISVPFPFASVAQHNRLGLFLLALTKSCDDIMEPKLDELIHQLRMMSQNWEASWVIDQLMSRLSSLSSPDDLFNFFSDIRGILGGPDSGAVEDDQVILDMNSNLGIFLRRCVLAFNLLSFEGVSHLLTNLGIYCKEEFSNCPSYEEHGLDDSSSNLETYSEYENMDLENFVYEKVSEEIEARKEASEIVPFHLHTHNTLLSLVDDIDVPADSVSKQSEKVRVASPYGDPSSNMLRDVDHSSPVFLRTNWQVQGYLQEQAHTIEKNGSAVSFNGLEIILRQLQKLAPELHRVHFLSYLNGLSHDDYISALENLHCYFDYSAGTEGFDYIPSVSGNGFGRYEIGLLCLGMMHFHFGHPKLALEVLSEAVRVSQQQSNDTCLAYTLAAISNLLFENGISSTAATLGSSYSPFTSIGISLSVQQQLFVLLRGSLKRAESLKLKRLVASNHLAMAKFDLTVMKFADYFKLNTLFILPVLYES

SEQ ID NO: 121918 - protein, 76 aa, Glycine max
  Coding DNA Sequence Number=SeqID_5140
  Homolog annotation: Hit_ID=Q10FJ2; Match level="QueryCoverage=45%, HitCoverage=8%, E-value=5e-07, Identity=77%"; Hit description =Pleckstriny domain-containing protein, putative, expressed
MNYGFRSLEKWSLQQVSTGSGSELALDLLQAILGVFCSSLCHCKFSSVSLTAIQKHTTHNESEKEKVSIDQLPEKP

SEQ ID NO: 121919 - protein, 74 aa, Glycine max
  Coding DNA Sequence Number=SeqID_5141
MEEGRKGYVPVLVGKGGHNMEKIWVSIKAIQHPTIVELLDQSADELGYQQGLLRIIYDVDNFKAIVDKASKNCI

SEQ ID NO: 121920 - protein, 327 aa, Glycine max
  Coding DNA Sequence Number=SeqID_5142
  Gene Ontology: Mol. function=ubiquitin-protein ligase activity; Cellular component=anaphase-promoting complex; Biological process =ubiquitin-dependent protein catabolic process
  Homolog annotation: Hit_ID=Q67YV2; Match level="QueryCoverage=96%, HitCoverage=34%, E-value=1e-116, Identity=68%"; Hit description=MRNA, complete cds, clone: RAFL24-07-B09
MEVGISPLSRINALVHATRFADASSSSDAALAYVKLIQHLAVSKGYKEAFFALKIAEEKFLSVSKSQILLLKLQLLHEHALHRGQLKLAQKLCDELGVLASRVTGVDMELKTEASLRHARTLLAANQFREAAAVAHSLFCMCYKYNLQVENASVLLLLAEIHKKSGNAVLGLPYALASLSFCLSFNLDLLKASATLTLAELWLSLGSSHATRALNLIHGAFPMILGHGGLELRSRAFIVEAKCYLCDSNFNVFENYEIVIDSLRQASEELQLLEFHELAAEAFYLMAMVYDKLGQLEEREEAAASFQKHILALRNPQDEDDPLVSVF

SEQ ID NO: 121921 - protein, 107 aa, Glycine max
  Coding DNA Sequence Number=SeqID_5143
MIRDHGKVECMVESVEENDAHPDMMNREQEQQQQQNCLEKYGCHDFEWLNMMEPTNPLNDVKMNWFSDDIVGMVDFGYANEECYSQICDGLVSNEASYGFLWEDYDI

SEQ ID NO: 121922 - protein, 208 aa, Glycine max
  Coding DNA Sequence Number=SeqID_5144
  Gene Ontology: Mol. function=structural constituent of ribosome; Cellular component=intracellular; Biological process=translation
  Homolog annotation: Hit_ID=Q1SCP5; Match level="QueryCoverage=85%, HitCoverage=100%, E-value=3e-94, Identity=93%"; Hit description =Ribosomal L18ae protein
  Pfam annotation: Domain name=Ribosomal_L18ae; Domain location=35-208; Score=433.6; E_value=2.6e-127; Accession=PF01775.7; Description =Ribosomal L18ae protein family
MVEVGLAKKFKEAQLVAVEQQLRSQSKSAEMVAMRFHQYQVVGRALPTESDEHPKIYRMKLWATNEVRAKSKFWYFLRKLKKVKKSNGQVLAINEIFEKNPTKIKNYGIWLRYQSRTGYHNMYKEYRDTTLNGAVEHMYTEMASRHRVRHPCIQIIKTATIPAKLCKRESTKQFHNSKIKFPLVFKKIRPPTRKLKTTYKASRPNLFM

SEQ ID NO: 121923 - protein, 559 aa, Glycine max
  Coding DNA Sequence Number=SeqID_5145
  Gene Ontology: Mol. function=pepsin A activity; Cellular component =cellulose and pectin-containing cell wall; Biological process =proteolysis
  Homolog annotation: Hit_ID=Q9SJG1; Match level="QueryCoverage=93%, HitCoverage=93%, E-value=1e-167, Identity=56%"; Hit description =Putative chloroplast nucleoid DNA binding protein
  Pfam annotation: Domain name=Asp; Domain location=194-554; Score= -77.0; E_value=4.6e-09; Accession=PF00026.14; Description=Eukaryotic aspartyl protease
MVLKVSLIVVLLVICSCVVEAISRNHNNHNHNNINKNGSSLAAIKFPDHPSFSDVSSSGDNDCSFSNSEQLGHSVPTMTSGEETDEESEAFPAPKPHKNSVKLHLKHRSGSKGAEPKNSVIDSTVRDLTRIQNLHRRVIENRNQNTISRLQRLQKEQPKQSFKPVFAPAASSTSPVSGQLVATLESGVSLGSGEYFMDVFVGTPPKHFSLILDTGSDLNWIQCVPCIACFEQSGPYYDPKDSSSFRNISCHDPRCQLVSSPDPPNPCKAENQSCPYFYWYGDGSNTTGDFALETFTVNLTTPNGKSELKHVENVMFGCGHWNRGLFHGAAGLLGLGKGPLSFASQMQSLYGQSFSYCLVDRNSNASVSSKLIFGEDKELLSHPNLNFTSFGGGKDGSVDTFYYVQINSVMVDDEVLKIPEETWHLSSEGAGGTIIDSGTTLTYFAEPAYEIIKEAFVRKIKGYELVEGLPPLKPCYNVSGIEKMELPDFGILFADGAVWNFPVENYFIQIDPDVVCLAILGNPRSALSIIGNYQQQNFHILYDMKKSRLGYAPMKCADV

SEQ ID NO: 121924 - protein, 68 aa, Glycine max
  Coding DNA Sequence Number=SeqID_5146
MFCDGGGDDDSEVAATAKVEETEGGDKDYSLSRVEYLENDGVDDEYELLFVYIEKGWHASKTRMFAGP

SEQ ID NO: 121925 - protein, 355 aa, Glycine max
  Coding DNA Sequence Number=SeqID_5147
  Gene Ontology: Mol. function=triacylglycerol lipase activity; Biological process=lipid metabolic process
  Homolog annotation: Hit_ID=Q943F9; Match level="QueryCoverage=84%, HitCoverage=78%, E-value=1e-105, Identity=59%"; Hit description =Lipase (Class 3)-like protein
MANQVVPRESHPYAFHVSGPRKFTSLNWRDLFISSWKDVNYKRTVIACFIQAVYLLELDRQEKRTQGNALAPNWWIPFKYKLKQTLIDERDGSIFGAILEWDRSAALADLIPIRPSGAPRAVLALRGTLLKSPTMRRDIEDDLRFVAWESLKGSVRFKAALEVLKLICGKYGSNNVCIAGHSLGAGFALQVGKELAKEGTYVEAHLFNPPSVSLAMSLKTIGEKAEFVWNRLKSMLPYIGEAQISNGGLKDASLGVAKWVPYLYVNKGDYICCYYNDGAGTSTKVNVGTTNGQAKLFVVSKEKQKFLEGVCVVVLFFLLTRQRLFSGQHWSHFILKQKFCRRCFEWPLIKSENYK

SEQ ID NO: 121926 - protein, 137 aa, Glycine max
  Coding DNA Sequence Number=SeqID_5148
  Gene Ontology: Cellular component=chloroplast thylakoid membrane
MRFSFMSDLASGDFVLLGSLSSSRAQLDLLEQLTSTSSPNSGYESDGSKLTIREQLEQLFGERDDDFTIPLGKNLKKVSAKFLTISQKRNIRRQAYLNEVSQRNDSVFFATIGAFVILPPFIILGIAILTGYVQLFP

SEQ ID NO: 121927 - protein, 326 aa, Glycine max
  Coding DNA Sequence Number=SeqID_5149
  Gene Ontology: Mol. function=cellulose synthase (UDP-forming) activity; Cellular component=membrane; Biological process=cellulose biosynthetic process
  Homolog annotation: Hit_ID=Q93XQ0; Match level="QueryCoverage=85%, HitCoverage=25%, E-value=1e-107, Identity=65%"; Hit description =Cellulose synthase D-like protein
  Subcellular localization annotation: CTP_CleavageSite=29; ConfidenceScore=5.28e-01
MGWLFHGILHLGRRRGGGARRGCDRGSISSGSSQASRTGCTPASPLETMSSINRQPSKKSARNSGGSTSQGSQSSGGPSVKFARRTSSGRYVSLSRDDIDMSSDLSGDYMNYTVHIPPTPDNQPMDSSVAMKAEEQYVSNSLFTGGFNSVTRAHLMDKVIDSEVTHPQMAGSKGSLCSICDGRVMRDERGHDVTPCECRDCFIDAQKESGMCPGCKEPYKVGEYEEDLTDQYSNNGALPLTAPNGSKRNANNMSVMKRNQNGEFDHNKWLFETQGTYGVGNAYWPQDEMYGDDGDDALKEGILDQEKPWKPLSRVMPIPSGIISPY

SEQ ID NO: 121928 - protein, 833 aa, Glycine max
  Coding DNA Sequence Number=SeqID_5150
  Gene Ontology: Mol. function=molecular_function; Cellular component =Golgi transport complex; Biological process=intra-Golgi vesicle -mediated transport
  Homolog annotation: Hit_ID=Q9C9V9; Match level="QueryCoverage=89%, HitCoverage=89%, E-value=0.0, Identity=67%"; Hit description =Putative golgi transport complex protein; 67058-70172
  Subcellular localization annotation: CTP_CleavageSite=67; ConfidenceScore=5.93e-01
MASPAAARTPVSTGASPMQRLSTFKNPSSAAASTATTTPSSSALDSLASDPIFSAFLSPSFSSTSFSSAALSSGSPASTAEKLHHAIRLLENQLRSEVLSRHHDLLSQLSSLHHADHALSTLRSALSSLQSSVRRLRSELSDPHRSVAAKTAQLSNLHRTTELLQHSIRALRLSKKLRDLMAAADPEKLDLAKAAQLHFEILSLCDEYDLVGIDAVDEELNWVRETGDLLRSEAMKVLERGMEGLNQAEVGTGLQVFYNLGELKGTVEQVVNKYKGLGAKSVTVALDMKTISGGSGYGPGGIRGSGTPHIGGGAKAREALWHRLGNCMDQLHSIAVAVWHLQRVLSKKRDPFTHVLLLDEVIQEGDPMLTDRVWEAITKAFASQMKSAFTGSSFVKEIFTMGYPKLYSMIENLLERISHDTDIKGVLPAINLSGKEQIISAVEIFQNAFLAHCLSRLSDLVNSVFPMSSRGSVPSKEQISRIISRIQEEIETVQMDARLTLLVLREIGKVLILLAERAEYQISTGPESRQVNGPATPAQLKNFTLCQHLQDVHTRISSILKGMPSIAADVLSASLGVIYGVACDSVTALFQAMLDRLESCILQIHDHNFGVLGMDAAMDNNASPYMEELQKCILHFRSEFLSRLLPSRNSTAPGTENICTRLVQSMASRVLVFFIRHASLVRPLSESGKLRMARDMAELELAVGQNLFPVEQLGAPYRALRAFRPLIFLETSQLASSPLLQDLPPNVILHHLYTRAPEELQSPLQRNKLTPLQYSLWLDSQWEDQIWKGIKATLDDYAANVRSRGDKEFSPVYPLMLQLGSSLIEKDQTSSKS

SEQ ID NO: 121929 - protein, 194 aa, Glycine max
  Coding DNA Sequence Number=SeqID_5151
  Gene Ontology: Cellular component=integral to membrane
  Homolog annotation: Hit_ID=Q1H8M6; Match level="QueryCoverage=67%, HitCoverage=71%, E-value=2e-24, Identity=42%"; Hit description =Cytochrome B561-related protein
MGVQQKLSAFLFQLSMFLLVSASQEHKKAKGRHSSKKDHNIKMSSRLQFEITLHGFLLWASMAFLMPIGMKLAVLLATAGAIMSIKSFNNSFSNNHQRLGVALYCIIWLQVLVGIFRPQRFTSLPRKNIQKHNNLEYTFHRSDIFDCDLLPSSIKMGLHTKPGSDLGQLITDSYLIRKKASSDDKNAGMKAESC

SEQ ID NO: 121930 - protein, 108 aa, Glycine max
  Coding DNA Sequence Number=SeqID_5152
  Subcellular localization annotation: CTP_CleavageSite=60; ConfidenceScore=5.70e-01
MTLSSWQNKLSRPMATPANSPPLPPHSPPPPTEAASQSPSTLKRTRKATRLRSLATRPARADRPVVPVDPGIGKPDGPHKKKLRTYLGIVARDKVDLTYENWKQVLAA

SEQ ID NO: 121931 - protein, 86 aa, Glycine max
  Coding DNA Sequence Number=SeqID_5153
  Homolog annotation: Hit_ID=Q3SGU7; Match level="QueryCoverage=96%, HitCoverage=28%, E-value=4e-08, Identity=50%"; Hit description =Thiamine-monophosphate kinase
  Subcellular localization annotation: CTP_CleavageSite=46; ConfidenceScore=5.15e-01
MSMPICCRSRMRCVSCLGAKPPANAHCGVATTTNCASRQLPTSATRCITSPNQLDVPLTRIGRIAEGQGVHVDGEAAGGGYQHFAG

SEQ ID NO: 121932 - protein, 855 aa, Glycine max
  Coding DNA Sequence Number=SeqID_5154
  Gene Ontology: Mol. function=cellulose synthase (UDP-forming) activity; Cellular component=membrane; Biological process=cellulose biosynthetic process
  Homolog annotation: Hit_ID=Q93XQ0; Match level="QueryCoverage=99%, HitCoverage=75%, E-value=0.0, Identity=81%"; Hit description =Cellulose synthase D-like protein
  Pfam annotation: Domain name=Cellulose_synt; Domain location=1-848; Score=2009.5; E_value=0; Accession=PF03552.5; Description=Cellulose synthase
MPIPSGIISPYRLLIVVRLIVLCFFLHWRVVNPNKDAVWLWLMSITCEIWFGFSWILDQVPKLCPVNRSTDLEALHEKFDSPSPSNPTGRSDLPGMDVFVSTADPEKEPPLTTANTILSILAVDYPVEKLACYVSDDGGALLTFEAMAEAASFADLWVPFCRKHNIEPRNPESYFSLKVDPTKNKSRTDFVKDRRRVKREYDEFKVRINGLPDSIRRRSDAFNAREEMKMMKHMKESGADPSEPVKVLKATWMADGTHWPGTWASPSGEHAKGDHAGILQVMLKPPSPDPLFGTADEKILDFTGVDTRLPMFVYVSREKRPGYDHNKKAGAMNALVRASAILSNGPFILNFDCDHYIYNCKAVREGMCFMMDRGGEDICYIQFPQRFEGIDPSDRYANHNTVFFDGNMRALDGLQGPMYVGTGCMFRRFALYGFDPPVVDKDADNKNDGKRLQGSETPAMNASEFDPNLDVNLLPKRFGNSTMLAESIPIAEFQGRPLADHPAIKFGRPLGVLRTPREPLDATTVAEAVSVISCWYEDKTEWGDRVGWIYGSVTEDVVTGYRMHNRGWRSVYCITKRDAFRGSAPINLTDRLHQVLRWATGSVEIFFSKNNAFLASKRLKLLQRLSYLNVGIYPFTSVFLVVYCFLPALSLFSGFFIVETLSIAFLIYLLIITVCLVMLAILEVKWSGVELEQWWRNEQFWLISGTSAHLAAVVQGLLKVMAGIEISFTLTSKSAGEDEDDMFADLYIVKWSSLMVPPIVIAMTNIIAIAVAFSRTIYSANPQWSKFIGGAFFSFWVLAHLYPFAKGLMGRRGKTPTIVFVWSGLIAITLSLLWVSISPPQGADGQGVGGDFQFP

SEQ ID NO: 121933 - protein, 102 aa, Glycine max
  Coding DNA Sequence Number=SeqID_5155
WAIPGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 121934 - protein, 170 aa, Glycine max
  Coding DNA Sequence Number=SeqID_5156
  Homolog annotation: Hit_ID=O04892; Match level="QueryCoverage=47%, HitCoverage=15%, E-value=3e-28, Identity=74%"; Hit description =Cytochrome P450 like_TBP
  Subcellular localization annotation: CTP_CleavageSite=83; ConfidenceScore=5.79e-01
RPGKRPRRARSNPSPDRHATTRSRRGSSSSSPPTADGFGTGTPVPSPQSQSFSRGYGSILPTSLAYIVPSTRGCSPWRPDAVMSTTGRGRHSVLRIFKGRRGRTGHHATCEKITLSGAPANVSGLPNVAVSRHVPICTDDRSARARALGFAATAAPSYSSGLGPCPDGRV

SEQ ID NO: 121935 - protein, 91 aa, Glycine max
  Coding DNA Sequence Number=SeqID_5157
MALVFIALELSYPNFGQGRSFANVWIFASQIELLNTNCHAIHKASLWLAWATINLRVEVTSSPGRARLLLEEASSSPGRAVVQPPPLISYK

SEQ ID NO: 121936 - protein, 171 aa, Glycine max
  Coding DNA Sequence Number=SeqID_5158
  Gene Ontology: Mol. function=RNA-directed DNA polymerase activity; Cellular component=signal recognition particle, endoplasmic reticulum targeting; Biological process=RNA-dependent DNA replication
  Pfam annotation: Domain name=zf-CCHC; Domain location=98-115; Score =20.1; E_value=0.00048; Accession=PF00098.13; Description=Zinc knuckle
  Pfam module annotation: Pfam domain module=Retrotrans_gag::zf-CCHC; Domain location=1-70::98-115
EYWNDLKSALRKRHIPSYYERELMDKLQRLRQESMSVEEYRQQMELLFLRVGLREEERTSIARFLSGLNIEVRDKEDKGKTIEKYTPKTNSEERTSNIKCFKCLGRGHIASQYPTKKTTIMRGQDIYSSQEETTSSPSSSGSEDDVRGEEYSEEVYPHEECDLLMVRRLLG

SEQ ID NO: 121937 - protein, 57 aa, Glycine max
  Coding DNA Sequence Number=SeqID_5159
MLNIAYMNLNTLNPGGFPPGLSVAQVNRVTGKQQLQSNEILLRKKKHFLIQESLISI

SEQ ID NO: 121938 - protein, 108 aa, Glycine max
  Coding DNA Sequence Number=SeqID_5160
MLQPYGINIGLKEHSNRVTPKAYTPKSPSGPLPPDSGLSSKLRYDFEIPNGENVRNWVANMILKFHDDPTVNGFQIVVFLRLVWWAAGKRKSFERRRGKTKMRPKGTS

SEQ ID NO: 121939 - protein, 468 aa, Glycine max
  Coding DNA Sequence Number=SeqID_5161
  Gene Ontology: Mol. function=translation elongation factor activity; Cellular component=ubiquitin ligase complex; Biological process =translation
  Homolog annotation: Hit_ID=UPI000034EE6E; Match level="QueryCoverage =90%, HitCoverage=75%, E-value=1e-177, Identity=70%"; Hit description= protein binding
  Pfam annotation: Domain name=Ank; Domain location=32-62; Score=6.0; E_ value=4.3; Accession=PF00023.20; Description=Ankyrin repeat
  Pfam annotation: Domain name=Ank; Domain location=63-95; Score=12.4; E_value=0.5; Accession=PF00023.20; Description=Ankyrin repeat
  Pfam annotation: Domain name=BTB; Domain location=143-250; Score =57.2; E_value=5.3e-14; Accession=PF00651.21; Description=BTBPOZ domain
  Pfam annotation: Domain name=BTB; Domain location=317-432; Score =52.3; E_value=1.7e-12; Accession=PF00651.21; Description=BTBPOZ domain
  Pfam module annotation: Pfam domain module=Ank::Ank::BTB::BTB; Domain location=32-62::63-95::143-250::317-432
MMTLVDELETLVDELDALDLGSSVVPVKKVPYGDVFEASRAGDVERLRYLLEAGVNVNARDQWDSVALYYACLAGHLDAARTLLENGAICSENTFDGDRCHYAALNLSVRRLLKAFEARPPPLDPLQASLRDTFLGCIPSTQGSICSSSHFPPDVAFIVQGKPIRAHRVILSSRSPFFKKKFTTDWKERSEVRFSRERLSYPALYSLIHFFYSDRLEVAVDDMQDLIRICKVCRCESLHKVLEKELIHQKYADYKALGDVDNSQKRYILQGLSLPQEDRLPAALHRILLTALSNSTRQSGQEDEIDKLVTRMGAMQMAKSLDDLADVCVRVDRKIFRCHQVILASRSEYFKARLSHMKDFHEDIDELSVDILPCLEEHDLSMEAFEKMIEYMYTDRLQDINPDQAEEMLDVASRYLLFPLKRAVADVLLPHLEMVSPEELCHWLILADMYLLFCQSPHSQSISMDHLH

SEQ ID NO: 121940 - protein, 184 aa, Glycine max
  Coding DNA Sequence Number=SeqID_5162
  Homolog annotation: Hit_ID=Q1SUP5; Match level="QueryCoverage=46%, HitCoverage=18%, E-value=5e-29, Identity=77%"; Hit description =Carbamoyl-phosphate synthase, GATase region
MPLSKAAARGTFPGRKKKKKEEEKRKPSISVEKNCIRIEEPNMVTKKRRREKKRREAYGIEGPKSLGLHTLYDCGACTVYDAMFYGNWIKCVDLGKASMATKALSFALSLNDLTNKHFSSNTPHTATKVSVFTVQCSSSGGGERPWKNSNARLVLEDGSIWKAKSFGASGTQVGEVFFNTSLIG

SEQ ID NO: 121941 - protein, 177 aa, Glycine max
  Coding DNA Sequence Number=SeqID_5163
  Homolog annotation: Hit_ID=Q5CEG7; Match level="QueryCoverage=58%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAQARSLGLWFRWIVDRDSGESR

SEQ ID NO: 121942 - protein, 163 aa, Glycine max
  Coding DNA Sequence Number=SeqID_5164
  Subcellular localization annotation: CTP_CleavageSite=32; ConfidenceScore=5.24e-01
MSISSCKRITTTRYPVDPGKSNRALGFPALVRASVSPTGCPSPPARSCHRDIGIAPARHLVDPEKSNRVLGFPALITGLCKFYRVSVAPSKIIRPPTNRAFIKKYYTPQASTGRDTTAARGWQAAGNRCIAATSRAPQRIHKKVRALPTTHGRPIGDQVQSQR

SEQ ID NO: 121943 - protein, 66 aa, Glycine max
  Coding DNA Sequence Number=SeqID_5165
MWNARGVVMADTEGPPKCFAEVYHQLLALQWHIRGKARSRLECGGEFRVSPPWVERHVHDEVVGSQ

SEQ ID NO: 121944 - protein, 185 aa, Glycine max
  Coding DNA Sequence Number=SeqID_5166
  Gene Ontology: Mol. function=RNA-directed DNA polymerase activity; Biological process=RNA-dependent DNA replication
MGKLDHMEERLKAIEGGEDYSFANLEELFLVPNIITPPKFKVPNFDKYKGTTCPKNHLKMYCRKMGAYTKYEELLIHFFQESHTGVAVTWYTNLEPSRVHSWKDLMVAFVRQCQYNSDMASDRMQLQNMCKKGHESFKEYVQRWRDLAAQVVPSMTKREMITVIVDTLPIFYYEKMVGLHTFKLC

SEQ ID NO: 121945 - protein, 950 aa, Glycine max
  Coding DNA Sequence Number=SeqID_5167
  Gene Ontology: Mol. function=sucrose-phosphate synthase activity; Biological process=sucrose metabolic process
  Homolog annotation: Hit_ID=Q1RTA0; Match level="QueryCoverage=99%, HitCoverage=88%, E-value=0.0, Identity=77%"; Hit description =Glycosyl transferase, group 1
  Pfam annotation: Domain name=Glycos_transf_1; Domain location=375 -540; Score=21.7; E_value=5.9e-05; Accession=PF00534.10; Description =Glycosyl transferases group 1
  Pfam annotation: Domain name=S6PP; Domain location=666-937; Score= -63.5; E_value=4.3e-06; Accession=PF05116.4; Description=Sucrose-6F -phosphate phosphohydrolase
  Pfam module annotation: Pfam domain module=Glycos_transf_1::S6PP; Domain location=375-540::666-937
LEGEELQRFANRRWEREQGRRDATEDLSEELSEGEKGDGVGEMIQIETSKKNFQRQISNLEVWSDDKKEKKLYIVLVSLHGLVRGENMELGRDSDTGGQIKYVVELARALAKMPGVYRVDLFTRQISSPEIDWSYGEPTEMLTAGTDEDDDNIGESSGAYIIRIPFGPREKYLQKELLWPHIQEFVDGALAHILNMSKVLGEQVSGGKPVWPHVIHGHYADAGDSAALLSGALNVPMVLTGHSLGRNKLEQLLKQGRQSKEDINSTYKIMRRIEAEELSLDAAELVITSTRQEIDEQWGLYDGFDVKLEKVLRARVRRGVNCHGRFMPRMAVIPPGMDFSNVVTQEDGPEVDGELTQLTRGVDGSSTKALPTIWLEVMRFFTNPHKPMILALSRPDPKKNITTLLKAFGECRPLRELANLTLIMGNRDDIDEMSSGNASVLTTVLKLIDKYDLYGQVAYPKHHNQSDVPEIYRFAAKTKAAAHGLPMVATKNGGPVDIHRALNNGLLVDPHDDIAIADALVKLLSEKNMWHECRKNGWKNIHLFSWPEHCRTYLTRVAACRMRHPQWQTNNPEDDKAVEEEESFNDSLKDEHDMSLRLSIDGDLAAASGGTGLDMQDQVKRILSKIRKTDSGSNGNGGGNINMLLDNVTSTSTSTNTSKYPLLRRRRRLIVIALDLYDNNGAPEKKMIEMVQKIIKAVQLDPQTARVTGFALSTAMPVIETVEFLTSGNVQVNEFDALICSSGSQVYYPGINTEEGKLLPDPDYEVHIDYRWGCEGLKKTIWKLMNGDENSPIEEDLKSSNAHCISYKIKDLSKAKKVDELRQKLRMRGLRCHPMYCRGSSRMHVIPLLASRAQALRYLFVRWRLNVANMYVILGETGDTDYEEMISGTHKTIIMKGVVSKGSEELLRGPGSYQRDDIVPNESPLVASITETTHENIANALKQLSKSGGI

SEQ ID NO: 121946 - protein, 496 aa, Glycine max
  Coding DNA Sequence Number=SeqID_5168
  Gene Ontology: Mol. function=protein serine/threonine kinase activity; Cellular component=membrane; Biological process=protein amino acid phosphorylation
  Homolog annotation: Hit_ID=Q0WPA7; Match level="QueryCoverage=97%, HitCoverage=96%, E-value=0.0, Identity=71%"; Hit description =Receptor-like protein kinase
  Pfam annotation: Domain name=Pkinase; Domain location=180-449; Score =143.0; E_value=8e-40; Accession=PF00069.15; Description=Protein kinase domain
  Pfam annotation: Domain name=Pkinase_Tyr; Domain location=180-449; Score=141.8; E_value=1.9e-39; Accession=PF07714.7; Description =Protein tyrosine kinase
  Pfam module annotation: Pfam domain module=Pkinase::Pkinase_Tyr; Domain location=180-449::180-449
MELSKKTSFLGLKRWVLIGIGVGAFIVLILCILSIWAMFRRKSRRSLDKYSVSQIPNFSKDIDVDKVGVQSSHVQPENVVIPVHDKASDKNSDNVSVHLGNSKSGDPDNISQCSSIYHHERGLSSMSAEEGSSGNVKKQSTLSHGGLATASPLVGLPEFSHLGWGHWFTLRDLEMATNHFSSENIIGEGGYGIVYRGRLVNGTEVAVKKLLNNLGQAEKEFRVEVEAIGHVRHKHLVRLLGYCVEGVHRLLVYEYVNNGNLEQWLHGDMHQYGTLTWEARMKVILGTAKALAYLHEAIEPKVIHRDIKSSNILIDDEFNAKVSDFGLAKLLDSGESHITTRVMGTYVAPEYANSGLLNEKSDIYSFGVLLLEAVTGRDPVDYARPANEVNLVEWLKTMVGTRRAEEVVDSSLQVKPPLRALKRTLLVALRCIDPDADKRPKMSQVVRMLEADEYPLREDRRKRKSGTASMEIETVKDISGPSDAEKMGISESHVEE

SEQ ID NO: 121947 - protein, 365 aa, Glycine max
  Coding DNA Sequence Number=SeqID_5169
  Gene Ontology: Mol. function=sequence-specific DNA binding; Cellular component=nucleus; Biological process=regulation of transcription
  Homolog annotation: Hit_ID=Q93WV4; Match level="QueryCoverage=42%, HitCoverage=54%, E-value=3e-37, Identity=52%"; Hit description =Probable WRKY transcription factor 71
  Pfam annotation: Domain name=WRKY; Domain location=217-276; Score =149.1; E_value=1.2e-41; Accession=PF03106.6; Description=WRKY DNA -binding domain
MENEKDRFYDPFHYNHHHDQQLNHSSSSFPFFRDNNNNSAPIGSQLNFQGFDDHNNPSSHHHTTFTDCLHGSMDYNTLSRAFDMSCSSSEVISSNIVENPKKPSAGGDSVGVSGNQQSTPNSSVSSSSNEAEAIIEEDSTKSQKDKQPKGCEEGDEKSKKEALNPKIIVIGLVSIICHLAENLTDVLERFRNKPKKKEKKPREPRFSFLTKSEIDHLEDGYRWRKYGQKAVKNSPYPRSYYRCTSQKCGVKKRVERSFQDPTIVITTYEGQHNHHCPATLRGSAASMLSSPSFFGSSYMASSLPQDFLAQLLPSYSQNDHQNPMFNQNLSHNLHPQPQQQQQFQLSRDYGLLQDLLPSFPGKQVP

SEQ ID NO: 121948 - protein, 254 aa, Glycine max
  Coding DNA Sequence Number=SeqID_5170
  Homolog annotation: Hit_ID=Q1T493; Match level="QueryCoverage=59%, HitCoverage=29%, E-value=5e-12, Identity=27%"; Hit description =Nucleic acid-binding, OB-fold, subgroup
  Pfam annotation: Domain name=Rep_fac-A_C; Domain location=71-196; Score=-30.8; E_value=0.00012; Accession=PF08646.1; Description =Replication factor-A C terminal domain
MINDLVLEIQEFRESLLDLGIEVRSILAPIGQGSSQVSGSSQLSSKDAFLSKTEVKNISQINASSEEFVCVTVVKDNYSWCYPACGQCYKKDDMQTVPFTCPCGKENDQPVLRYQVEVMVNHKGEQTKFLIWYRECAQLIGQSADEVNRLKIEDGDVDLNASPQALDRLLGCFLAFKVKVQPRFKNSVVLKYSDELDLINVVLDMIPDSEPCCKIENSILELTDPTELESQFVSITADHDRSMLGSSEPIELES

SEQ ID NO: 121949 - protein, 105 aa, Glycine max
  Coding DNA Sequence Number=SeqID_5171
MKMKANKKGNELKVSDSNTYRLKNEERMKNGQRKVKNGGKSSQICSQKCLGSITEALRHDFSSQKRVFFLSKIAKMHNLGVMKILKHLPPLFIGKKGGACSPEAS

SEQ ID NO: 121950 - protein, 93 aa, Glycine max
  Coding DNA Sequence Number=SeqID_5172
MEFAPPPNNGYEHHFTHRKHTLYCRLAILKYLSDQVSWSDGLKEQLDTLIAQPPACVTWEKMGFPELWRDDPLWTRPFNPPGSGAQPDQTAGG

SEQ ID NO: 121951 - protein, 257 aa, Glycine max
  Coding DNA Sequence Number=SeqID_5173
  Gene Ontology: Mol. function=uroporphyrin-III C-methyltransferase activity; Cellular component=ribonucleoprotein complex; Biological process=porphyrin biosynthetic process
  Homolog annotation: Hit_ID=Q6D2V5; Match level="QueryCoverage=91%, HitCoverage=85%, E-value=2e-79, Identity=64%"; Hit description =Uroporphyrin-III C-methyltransferase
  Pfam annotation: Domain name=TP_methylase; Domain location=3-214; Score=266.0; E_value=7.7e-77; Accession=PF00590.10; Description =Tetrapyrrole (CorrinPorphyrin) Methylases
PGRVWLVGAGPGDVELLTVKALRLLQRADVVVYDRLVSEAVMAEVASSALCIDVGKQPGHHGLKQAQINQLLVDLAASGRNVVRLKGGDPFIFGRGGEEMVSLQQANIVCEVVPGITAAVGCAAASGIPLTHRDCAQSLRFITGHGRSGEPQLDAAALTATNQTLVFYMGLSWSSVISARLRECGRSEATPVAIIENGTRQNQRVLITTLAGLPETVEQQKPVSPSLLIVGEVVRYYRADRVSAHGCDLALSDIEAH

SEQ ID NO: 121952 - protein, 223 aa, Glycine max
  Coding DNA Sequence Number=SeqID_5174
MTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPRRTRTRASASASEGPPTYPVSVSAIPATATSTCFHLSIHGHAWADAEMDPPLTTPEAYRQRVAWPGDQPSTDRGEEPSRVAEDPAVDEDLIADLATADWGPWADLGGGS

SEQ ID NO: 121953 - protein, 261 aa, Glycine max
  Coding DNA Sequence Number=SeqID_5175
  Gene Ontology: Mol. function=ribonucleoprotein binding; Cellular component=nucleus; Biological process=ribosome biogenesis and assembly
  Homolog annotation: Hit_ID=Q53MQ7; Match level="QueryCoverage=79%, HitCoverage=31%, E-value=2e-68, Identity=54%"; Hit description =Expressed protein
  Pfam annotation: Domain name=DUF663; Domain location=75-261; Score =102.9; E_value=9.7e-28; Accession=PF04950.3; Description=Protein of unknown function (DUF663)
MVYFLAGFCKLLVVYLYSHGSNTNLINITWKKLIKQGGKDYHPVLLLPNQEVDNLTREKIEDELNELKEAHAAYEVDTPLDVPARKRFAKYRGLKSFRTSSWDPKDCIPVGSYARLHIMGVPSAIASKLSLLAKTIPITACGLLKHESKVSVLHFSVKKHEAYDAPIKSKEELIFHVGFQQFVGWPIFSSEFINTDKNKMERFLHAGRFSVASIYAPVSFPPLPMIILKRNGENATPVVAAVGSLKTVDADRIILKRVILT

SEQ ID NO: 121954 - protein, 87 aa, Glycine max
  Coding DNA Sequence Number=SeqID_5176
MGVYKAVEGAKYLVYIAGWSFNPMMVLPTKVGPVDNNNIHTIMNLNSTADIRTSWVADPHTEIPHATRIKVGELLKKKTEEGMQLES

SEQ ID NO: 121955 - protein, 703 aa, Glycine max
  Coding DNA Sequence Number=SeqID_5177
  Gene Ontology: Mol. function=microtubule motor activity; Cellular component=microtubule associated complex; Biological process =microtubule-based movement
  Homolog annotation: Hit_ID=Q5MNW6; Match level="QueryCoverage=99%, HitCoverage=72%, E-value=0.0, Identity=57%"; Hit description=Kinesin
  Pfam annotation: Domain name=Kinesin; Domain location=261-576; Score =517.1; E_value=1.9e-152; Accession=PF00225.13; Description=Kinesin motor domain
MGLPTFEVSDLEQGGKSSRIVNCVLALKSYSEWKMGGKIGSWKYGGNPKPPAPSAKPIMWKSSEPFMRSLSRGFWLGDRDGLPSDNSPSSVLSEEGSIPSLNSLVREILCNKKQEEIPIVVESLLSNVMEEFEQRLLIQQETFKTTQEDKAPPEAEDSNVEAACDDEEHNGDEESIDQPLKQQKLFQQQNENVQELKMMVHQTKTGIQVLQHKYEEDIIYLSKHLLGLASAASGYQKIFEENRKLYNQLQDLKGNIRVYCRVRPSTSGQTNHHCPINNIDGGSMSLIIPSKNGKDGKKTFNFNKVFGPSSTQGEVFSDTQPLIRSVLDGYNVCIFAYGQTGSGKTHTMSGPDNYTEETVGVNYRALRDLFFLSEQRKDIIHYDISVQMLEIYNEQVRDLLTTDKIRNSSHNGINVPDANLVPVSSTSDVLNLMNLGQKNRAVSATAMNDRSSRSHSCLTVHVQGRELASGNSLRGCIHLVDLAGSERVDKSEVTGDRLKEAQHINKSLSALGDVIASLAQKQSHVPYRNSKLTQLLQDSLGGQAKTLMFVHVSPDAEAIGETISTLKFAERVSTVELGAARVNKDSSEVKELKEQIASLKAASARKDGELEHFQQYANSITETPKFKPDLTSFARSPSWSHGPPRPPSRDDPSSMEDKKKPTPKFMKRRSFDPRDICRKSPRWPHHERVNGKEDDKESISGDC

SEQ ID NO: 121956 - protein, 276 aa, Glycine max
  Coding DNA Sequence Number=SeqID_5178
  Gene Ontology: Cellular component=integral to membrane; Biological process=protein transport
  Homolog annotation: Hit_ID=Q9C6X2; Match level="QueryCoverage=96%, HitCoverage=92%, E-value=1e-100, Identity=67%"; Hit description =Secretory carrier membrane protein, putative
  Pfam annotation: Domain name=SCAMP; Domain location=102-276; Score =384.6; E_value=1.5e-112; Accession=PF04144.4; Description=SCAMP family
  Subcellular localization annotation: CTP_CleavageSite=53; ConfidenceScore=5.18e-01
MVWVFFPFYLFFQNGGAAPASKSRIPPLASQPLGFGQRHDATVDIPLDTTNVMSSLIQGLPLMTDSKKRGQELAAWEADLKRKEKEIKRREEAVSRAGVPVDDKNWPPIFPIIHHDIANEIPVHAQRLQYLAFASWLGIVLCLVFNVVAVTVCWIRGGGVKIFFLAVIYGLLGVPLSYVLWYRPLYRAMRTDSALKFGWFFMFYLLHIGFCIFAAIAPPIVFHGKSLTGILAAIDVFSDHVLVGIFYLIGFGMFCLEALLSLWVLQKIYMYFRGHK

SEQ ID NO: 121957 - protein, 55 aa, Glycine max
  Coding DNA Sequence Number=SeqID_5179
MVVSGNNNGCVSGQQWWLEGLSCLQGSDTGGLRGGHGSNNDIIVLNVSNVFNEIF

SEQ ID NO: 121958 - protein, 212 aa, Glycine max
  Coding DNA Sequence Number=SeqID_5180
  Gene Ontology: Cellular component=membrane
  Homolog annotation: Hit_ID=Q5JLH8; Match level="QueryCoverage=97%, HitCoverage=19%, E-value=6e-27, Identity=38%"; Hit description =Putative ERD4 protein
MATLVDIGVSAAINILSAFAFLLAFALLRIQPINDRIYFPKWYLSGGRSSPKRSGENFVGKFVNLNFRTYLTFLNWMPQALRMSESEIISHAGLDSAVFLRIYILGTDELAVMLLGIVVLLVVMHRCAATIDSRVMPCGFQLSFLVLPAFVKAIPWKLHLMGFKVFAPITLVALFILIPVNVSSGTLSFLKKELVVSDIDKLSISNVPPKSI

SEQ ID NO: 121959 - protein, 92 aa, Glycine max
  Coding DNA Sequence Number=SeqID_5181
  Gene Ontology: Mol. function=microtubule motor activity; Cellular component=microtubule associated complex; Biological process =microtubule-based movement
  Homolog annotation: Hit_ID=Q1RV39; Match level="QueryCoverage=94%, HitCoverage=8%, E-value=5e-26, Identity=65%"; Hit description =Calponin-like actin-binding; Kinesin, motor region
MAPELALPFSVVSVVEDVLQKHGSPLIDIDLASRKAEEASLRRNEAAAWLQKTVGGKDMPGEPTEEHFRIALRSGIVLCNALNNIQPGAVPK

SEQ ID NO: 121960 - protein, 307 aa, Glycine max
  Coding DNA Sequence Number=SeqID_5182
  Gene Ontology: Mol. function=rhodopsin-like receptor activity; Cellular component=integral to membrane; Biological process=G -protein coupled receptor protein signaling pathway
  Homolog annotation: Hit_ID=Q336N0; Match level="QueryCoverage=75%, HitCoverage=61%, E-value=6e-68, Identity=55%"; Hit description=LrgB -like family protein, expressed
MGTSESCKSEELCTELLEFQTGDTSTESVIQTFRLLVYGVLHWVVSLGLILAIDFLLKKAFVAASIEFPSALFGMFCIFSVLIILNYAIPSAAMALMKFFEPGIMFIQRWLPLFYVPYLVVLPLSLKDISPSSAIKICLIVVGGWLATLCVTGLTAIGVRKAVKTELIDAEPMEKPSPFSSSELWAWTGIFLISFVASLVYPTALGTRARTYLPFLLASTVLGYMIGSRLPSSVKKVLHPIICCAASAELTAVVFGFLSKSGLDPVLGINYNLKLNRKLTILYKSLFVIDINKVIKLENLRKFVRVL

SEQ ID NO: 121961 - protein, 211 aa, Glycine max
  Coding DNA Sequence Number=SeqID_5183
  Gene Ontology: Mol. function=catalytic activity; Cellular component =peroxisome; Biological process=metabolic process
  Homolog annotation: Hit_ID=Q84P24; Match level="QueryCoverage=98%, HitCoverage=37%, E-value=4e-57, Identity=56%"; Hit description=4 -coumarate-CoA ligase-like protein
  Pfam annotation: Domain name=AMP-binding; Domain location=1-209; Score=-122.3; E_value=0.02; Accession=PF00501.18; Description=AMP -binding enzyme
MVVLFVRFEASQYGLSCLRNVYRAVWPMFHVNVLSLFAVGLLSLGSTVVVMMKFDIDEVVRVIDEYKVIHFPVVPPMLTALITRANGVNGGESLVQVSSGAAPLSTGVINEFIRAFPNVDFIQGMTESTAVGTRGFNTEKFLNYSSIGLLAPNMEAKVVDWNTGAFLPPGSSGELWLRGPSIMTGYLNNEEATMSTIDKDGLATYWRCCLF

SEQ ID NO: 121962 - protein, 614 aa, Glycine max
  Coding DNA Sequence Number=SeqID_5184
  Gene Ontology: Mol. function=amylo-alpha-1,6-glucosidase activity; Cellular component=membrane; Biological process=carbohydrate metabolic process
  Homolog annotation: Hit_ID=Q5JLH8; Match level="QueryCoverage=86%, HitCoverage=69%, E-value=0.0, Identity=62%"; Hit description =Putative ERD4 protein
  Pfam annotation: Domain name=DUF221; Domain location=119-544; Score =581.7; E_value=6.9e-172; Accession=PF02714.6; Description=Domain of unknown function DUF221
MRLHFLASQWRRVDQFTVVVRNIPHMSGHTVSDTVDSFFQTNHPEHYIGHQAVYNANKFAKFAKRRERLQNWLDYYQLKFERHPDRRPTVKTGILGLWGGKVDAIEHYKHSIKELDKMMTLERQKIIKDPKSILPVAFLSFKSRWGASVCAQTQQSKNPTLWLTDWAPEPRDVYWRNLAIPFVSLNIRKLIISLSVFALVFFYMIPIAIVQSLANLEGLERVAPFLRPVIELKFIKSFLQGFLPGLALKIFLYILPTVLMIMSKIEGYIALSTLERKTAGKYYYFMLVNVFLGSIVTGTAFQQLHAFLHQSPTQIPRTIGVSIPMKATFFMTYIMVDGWAGIASEILRLKPLVIYHLKNMFLVKTERDRGKAMDPGSVDFPETIPSLQLYFLLGIVYAVVTPILLPFIVVFFAFAYLVYRHQIINVYNQQYESAAAFWPLVHCRIIASLLISQLLLLGLLSTKKAAKSTPLLVILPILTFAFHKFCQRRFEPAFRKYPLEEAMSKDLLEKSTEPDLNIEAYLADAYLHPIFRSFEVEEEELVEVRVDKHQTNVASSPPTEPSSPSPPHHVQQQPSPPHHIHEPSLPQYSEYQTSPPGYYYQYHPPSPPHYVYQY

SEQ ID NO: 121963 - protein, 56 aa, Glycine max
  Coding DNA Sequence Number=SeqID_5185
MEVPHDAQEFVVTPMRFDARGNVTEDQGDYTDMTLKDEEEYHELLRDLESSFEKED

SEQ ID NO: 121964 - protein, 95 aa, Glycine max
  Coding DNA Sequence Number=SeqID_5186
  Gene Ontology: Mol. function=catalytic activity; Cellular component =peroxisome; Biological process=metabolic process
  Homolog annotation: Hit_ID=Q9FRQ0; Match level="QueryCoverage=90%, HitCoverage=16%, E-value=1e-18, Identity=54%"; Hit description =Putative 4-coumarate CoA ligase
MAYDLLQIAPANLDAVLSLHPEIVDVAVTGAMDEETGEMPAALVVRKVGSVLSPKRIMDFVAELVRKVFFTDKIPRSATGKILRKQLSNCSTSKL

SEQ ID NO: 121965 - protein, 175 aa, Glycine max
  Coding DNA Sequence Number=SeqID_5187
MVRGGRFSGKRNFRKRVRSKEGGSDDSDEDYVVSDEGREASDYYCSSLDGCASEEGFDSFMEEEEEQFRRVRSINRSKSKKGIAGRRKNGSKSSHRRGRITYAEEEDVEEEEEEEEEFEDEEEEDEDEEEYKEEEEEEESKISPKRGRKIRAEQLEEEEEEEEEEKQVEEEEEEK

SEQ ID NO: 121966 - protein, 47 aa, Glycine max
  Coding DNA Sequence Number=SeqID_5188
MKEVAVEAEGGAPGVVHEGGKATTTCGYTCLDEGSKLEENEIVRNKN

SEQ ID NO: 121967 - protein, 149 aa, Glycine max
  Coding DNA Sequence Number=SeqID_5189
  Homolog annotation: Hit_ID=Q9FH41; Match level="QueryCoverage=20%, HitCoverage=11%, E-value=2e-08, Identity=83%"; Hit description =Arabidopsis thaliana genomic DNA, chromosome 5, TAC clone:K2N11
  Subcellular localization annotation: CTP_CleavageSite=34; ConfidenceScore=5.40e-01
MLRSLTKLRCLAVQSRQVLSPPSSRRLLHHLPPPQSLHSASNFRISSPSFIFSWCPPHASQPSPSLVQVRHASSKERKRKPVPPTVSKVKKTKMKSYSSFKSRFRAMNDGNIRRWKEGKRHNAHLKVEFFSFFHFSYGFVIFFIVTLFR

SEQ ID NO: 121968 - protein, 484 aa, Glycine max
  Coding DNA Sequence Number=SeqID_5190
  Gene Ontology: Mol. function=oxidoreductase activity; Cellular component=intracellular; Biological process=metabolic process
  Homolog annotation: Hit_ID=Q46979; Match level="QueryCoverage=99%, HitCoverage=100%, E-value=0.0, Identity=91%"; Hit description=5 -carboxy-2-hydroxymuconate semialdehyde dehydrogenase
  Pfam annotation: Domain name=Aldedh; Domain location=7-470; Score =799.3; E_value=2.2e-237; Accession=PF00171.12; Description=Aldehyde dehydrogenase family
MKTINHWINGKNVTSKEYFTTTNPANGEVLAEVASGGQLEIDQAVAAAKEAFPKWANTPMKERARLMRRLGELIDQNVPQIAELETADTGLPIHQTKNVLIPRASHNFEFFAEVCQQMNGKTYPVDDKMLNYTLVQPVGVCALVSPWNVPFMTATWKTAPCLALGNTAVLKMSELSPLTADRLGELALEAGIPAGVLNVVQGYGATAGDALVRHKDVRAVSFTGGTATGRRIIESAGLKKFSMELGGKSPVLIFEDADIERALDAALFTIFSINGERCTAGSRIFIQESIYPEFVKRFAERANRLRVGDPQDPNTQVGALISPQHWEKVSGYIRLGVEEGATLLAGGPDKPAGLSHGNFLRPTVLADVDNRMRVAQEEIFGPVACLLPFKSEEDGLRMANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 121969 - protein, 201 aa, Glycine max
  Coding DNA Sequence Number=SeqID_5191
  Gene Ontology: Mol. function=RNA-directed DNA polymerase activity; Biological process=RNA-dependent DNA replication
MVSTWSGLKCKTPFEGSNSPLTAMTNTDTLQQLQNRITEMEQCHEEEPRKLKVDYDQLEARIKCSQGESHPQCTVNNPGDLSLSHKHRLAGRTTRRHSFIDNIMKVDILLGWKPLNLKRYDGTTNPYEHLDAFLTQANLYTNDNTILCRVFPTSLKGATLTWYGGLPPRSIENFDTLVECFSVQYATSRSHRMTLAALASL

SEQ ID NO: 121970 - protein, 83 aa, Glycine max
  Coding DNA Sequence Number=SeqID_5192
MTLINKRQPLPKGPRYERYTPLTANHTTILEEAFNLEVPIRLPPMKPPRPVLYATKYYRFHHGIGHNTKHYWAVKDKIEELIQ

SEQ ID NO: 121971 - protein, 123 aa, Glycine max
  Coding DNA Sequence Number=SeqID_5193
MLQPYEISIGLKEHSNPVTPKAYTPKSPSGPLPPDSDSSGFLRERKRLQCEGFFSHFRHDIEIPNGENARNCVANMILKFHDDPTVNGFEIVVFLRLVWWAAGKRKGFERRRGKTKMRPKGGS

SEQ ID NO: 121972 - protein, 115 aa, Glycine max
  Coding DNA Sequence Number=SeqID_5194
  Homolog annotation: Hit_ID=Q8GT87; Match level="QueryCoverage=42%, HitCoverage=22%, E-value=1e-18, Identity=81%"; Hit description=Fiber protein Fb2
  Pfam annotation: Domain name=Di19; Domain location=11-113; Score =20.0; E_value=8.5e-11; Accession=PF05605.3; Description=Drought induced 19 protein (Di19)
MDGDSSWSARLSSASRRYQSALQSRSDMFMGFDENDGDDDIREEFLCPFCSEYFDIVGLCCHIDEEHPMEAKNGVESFGYYPSSILGRNNSWSDFTYLWTNSGLVRTSFPEKPEG

SEQ ID NO: 121973 - protein, 265 aa, Glycine max
  Coding DNA Sequence Number=SeqID_5195
  Gene Ontology: Mol. function=DNA binding; Biological process =regulation of transcription
  Homolog annotation: Hit_ID=UPI00005DC297; Match level="QueryCoverage =93%, HitCoverage=99%, E-value=2e-61, Identity=52%"; Hit description =transcription factor
  Pfam annotation: Domain name=Myb_DNA-binding; Domain location=23-74; Score=47.1; E_value=5.8e-11; Accession=PF00249.21; Description=Myb -like DNA-binding domain
MEGGGREGYNGIVMTMTRDPKPRLRWTADLHDRFVDAVKKLGGPDKATPKSVLRLMGLKGLTLYHLKSHLQKYRLGQQARKQNEDMHKENSRCSYVNFSNRSSAPNTSYRGDDEGGEIPIAEAMRCQIEVQKRLEEQLEVQKKLQMRIEAQGKYLQAMLEKAQRSLSLDGPGSLEASRAQLTEFNSVLSNFMENMKKDSKENIIEVSDFYSKNHDSAFHYQEVGRDQKPKVEGGSIQFDLNIKGSNDLVCAGGAEMDANMISYRV

SEQ ID NO: 121974 - protein, 767 aa, Glycine max
  Coding DNA Sequence Number=SeqID_5196
  Gene Ontology: Mol. function=nucleic acid binding; Cellular component= intracellular; Biological process=DNA integration
  Pfam annotation: Domain name=rve; Domain location=1-114; Score=47.7; E_value=3.9e-11; Accession=PF00665.16; Description=Integrase core domain
  Pfam module annotation: Pfam domain module=RVT_2::rve; Domain location=283-537::1-114
DVFLKFKQWKSLVEKQTEKKVKRLRTDNGLEFCNNEFNEFCANEGIARHRTMRHTPQQNGVAERMNRTLLESARCMLSNVGLPKQFWAVNTACYLVNISPSTAIDCKTPEEMWSGSTTNYSILRVFGCPAYAHINEGKLEPRAKKCILLGYQDGVKGYRLWDPKKSKLLISRDVTFDETTMLNPRPHKDHDNKVEVHGDIKKVEFEVEARKPEEIYDESEVTPTEFEHTLASDRPRRQTRPPQRYDDFVAFALNMAESIDDEQEPSSFHEAVTCDEASQWIGAMKEELESLHKNHTWKLVEKPVDQKIVGCKWIYKKKDGIRFKARLVAKGFTQRKGIDFNEVFSPVVKHSSIRVLLALVSLLDLELEQLDVKTAFLHGDLEETIYMQQPDGFVVPGKEDHVCLLKKSLYGLKQSPRQWYKRFDSFMIDIGYIRSEYDSCVYQKKLFDNTYIYLLLYVDDMLIACKHPNEINKVKTQLSGEFEMKDLGPAKRILGMEITRDRKIGRLCLSQKSYVEKVLERFGMHNAKAVSTPFAAHFKLSANMSPQTKEEEEFMSRVPYSNAVGSLMYAMVCTRPDIAHAVSVVSRYMANPGKSHWQAVKWILRYLRGSTNLGLVFSKATNECNGHVIGYCDSDYAGDLDRRRSLSGYIFTLGGSAISWRATLQSTVALSTTEAEYMAATEAVKEALWLKGLVGDLGVSKKEVVVHYDRQSAIHLTKNQMYHERIKHIDIRMHFIRDVVTQGDVLIEKISTSDNPADMMTKALPTL

SEQ ID NO: 121975 - protein, 111 aa, Glycine max
  Coding DNA Sequence Number=SeqID_5197
  Gene Ontology: Mol. function=oxidoreductase activity, acting on paired donors, with incorporation or reduction of molecular oxygen, reduced flavin or flavoprotein as one donor, and incorporation of one atom of oxygen; ...
  Gene Ontology: Mol. function=Biological process=phenylacetate catabolic process
  Homolog annotation: Hit_ID=Q66BX1; Match level="QueryCoverage=63%, HitCoverage=13%, E-value=1e-31, Identity=87%"; Hit description=4 -hydroxyphenylacetate 3-monooxygenase
RAAGVAEKFVGIAAVAGVGIPAQAILAGRIVQRVIQLADRRRRVAERRVGGDVFHALAVNVDFAAVLQTFQLPKPVSRRDFCGNRRYFSGQFAAFAANCDRGYERACCAAR

SEQ ID NO: 121976 - protein, 217 aa, Glycine max
  Coding DNA Sequence Number=SeqID_5198
  Gene Ontology: Mol. function=sequence-specific DNA binding; Cellular component=intracellular; Biological process=regulation of transcription, DNA-dependent
  Homolog annotation: Hit_ID=Q5PG98; Match level="QueryCoverage=96%, HitCoverage=71%, E-value=5e-85, Identity=72%"; Hit description=4 -hydroxyphenylacetate 3-monooxygenase operon regulatory protein
ALARLLLPGAFPGNRQDRAAARRSALFGAGAAVHPYAAVGAACVLHRTGQRRPCADGAPGADLAAAGAPVSRQQPGAGHAGHLPVAGRCAAGADGAQPLLGADPPRVRPEPGRARTDAGAAGAGGVHAAAAQHRAGRQRQQRRARRTAAVSAVQQDGGRAFSRAPAGAGVCAGAGSDRIAAQRSVPALRQPAAQAADLRSAAARGQTHAAVQRLHGA

SEQ ID NO: 121977 - protein, 121 aa, Glycine max
  Coding DNA Sequence Number=SeqID_5199
  Gene Ontology: Mol. function=transcriptional repressor activity; Biological process=regulation of nitrogen utilization
  Homolog annotation: Hit_ID=Q05JX8; Match level="QueryCoverage=90%, HitCoverage=35%, E-value=1e-49, Identity=88%"; Hit description =Pinoresinol-lariciresinol reductase homolog
  Pfam annotation: Domain name=NmrA; Domain location=6-121; Score=-8.9; E_value=1.3e-07; Accession=PF05368.3; Description=NmrA-like family
MGKSKVLVVGGTGYVGRRIVKASLEQGHETYVLQRPEIGLDIEKVQMLLSFKKQGAHLVEASVSDHQSLVEAVKLVDVVICTMSGVHFRSHNLLVQLKLVEAIKAAGNVKHYSIFLSKKLR

SEQ ID NO: 121978 - protein, 78 aa, Glycine max
  Coding DNA Sequence Number=SeqID_5200
MKNEERMKNEQRMTEERTTNGVGIDHRCNSEAFQLVFSSFFFLSLLSSSSWTIGPQGTSGTLYFSLPTPIYSKTKHLG

SEQ ID NO: 121979 - protein, 93 aa, Glycine max
  Coding DNA Sequence Number=SeqID_5201
MAYSLVDGASSHLFSFVFHCISMVENHHLRTSLKLKDPASIEAPQASFHQKPSLKATSWKVFAFNDESNISLTIPKGFDFGFLTETFAFETKS

SEQ ID NO: 121980 - protein, 157 aa, Glycine max
  Coding DNA Sequence Number=SeqID_5202
MAKYDPELLMEFYENSWPTKEGVMDKRSWVRGQWIPYDEDATHQFMGHPLISVHVAQLILEAIYQFVGISPPRHSVDPEKSKKALGFPALITGLCQFYGLLLVYTAPTAPGPQPLPWPLEQFRATIAWPRDRPNFQAGQVPLRPQEMKTKLSKTETW

SEQ ID NO: 121981 - protein, 123 aa, Glycine max
  Coding DNA Sequence Number=SeqID_5203
  Homolog annotation: Hit_ID=Q1SL03; Match level="QueryCoverage=87%, HitCoverage=34%, E-value=4e-10, Identity=29%"; Hit description =Ribosomal protein S2; Nucleic acid-binding, OB-fold
  Pfam annotation: Domain name=DUF223; Domain location=22-118; Score =4.3; E_value=0.0012; Accession=PF02721.5; Description=Domain of unknown function DUF223
MENIVRITDLWQARKQNSKQTIEMVLMDQTGSKIGATLWQELFIELRDKLQCGSSYLIQNLRIVDNQSEYRVSPAPYLVYFLKTTSVKEIHRPEIPSNVYLITPFTDIISGLVPRHTLVGQFV

SEQ ID NO: 121982 - protein, 670 aa, Glycine max
  Coding DNA Sequence Number=SeqID_5204
  Gene Ontology: Mol. function=nucleotidyltransferase activity; Biological process=aromatic amino acid family biosynthetic process
  Homolog annotation: Hit_ID=Q1RZX6; Match level="QueryCoverage=99%, HitCoverage=98%, E-value=0.0, Identity=66%"; Hit description =Oligopeptide transporter OPT superfamily
  Pfam annotation: Domain name=OPT; Domain location=38-654; Score =519.1; E_value=4.9e-153; Accession=PF03169.6; Description=OPT oligopeptide transporter protein
MNNNEELDGIQNCDNDDIEKAGLEELEEQSGVASWTRQITIRGLITSFIIGIVYSVIVMKLNLSTGLVPNLNVSAALLGFVLVRAWIMLLEKANVVSKPFTRQENTIIQTCAVACYSTAFGGGFGSHLLGLNRKTYEQAGVDTKGNTPITKEPGIGWMTAFLFVTYFVGLSALIPLRKMMIIDYKLTYPTGTATAVLINGFHTPKGDEMAKKQVHGFLKFFSFSFLWSFFQWFYAGDGDQCGFSQFPTFGLKAWKNSFYFDFSMNYVGAGMICSHLVNLSLLLGAVLSWGVMWPLIRGLKGQWFPESLSESSMKSLNGYKVFISIALILGDGLYNFAKILLFTATNIHASMERRNHKSLSISDIQKQQQPLDLKRNEVFVRERIPIWLAFTGYILFSAISIIIIPLIFPEVKWYYVVVAYLLAPTLSFCNAYSAGLTDMNMAYNYGKVALFVLAALGGKSHGVVAGLVGCGVIKSLVSTSSDLMQDFKTGHLTFASPRSMLLSQAIGTAIGCVLAPLTFFLFYKAFDVGNPDGDYKAPYAIIYRNMAILGVEGFSALPHHCLQLCCGFFAFAVATNLVRDLNPKNIGRWIPLPMAMAVPFVVGGYFAIDMCMGSLVVYAWQTLKSKEASLMVPAAASGLICGDGFWILPSSILALFKVHPPICMRFLPTK

SEQ ID NO: 121983 - protein, 157 aa, Glycine max
  Coding DNA Sequence Number=SeqID_5205
MAPWFRQIAPFGALLKTFSPYGVICKHFPPGGCFARKLHASPKQTASQTGEFTDSEEAAIPIGDFAMHGGTASQTGEFVAGEGRGPGYVVGLRHRGASERCRDARIVIGAGGLQEELASLIGELKFTKIFIKRNARLPYACIPFFCLYLLHCIRFFS

SEQ ID NO: 121984 - protein, 221 aa, Glycine max
  Coding DNA Sequence Number=SeqID_5206
MAVSGGGGGGWGVGGGFRGIDEGVSRTSTGGPVLPLNPLSNVCPLPLCAIVIVWKRQDSWRSSSSRPRWHRSRPPLLLCPPFSNGSPSEAPPKQKAQALDKLNESLPTSESMSTTSSKHSSSWQPSLTKATSLSMSSSKMMHSVFCIFKTFDRLDQLVLMLLTRPDGKLGDLEQRTFQVLVRLRDEGDEAKEALEEVLSQNSSKQYDSYFANTRESVFQLI

SEQ ID NO: 121985 - protein, 119 aa, Glycine max
  Coding DNA Sequence Number=SeqID_5207
MKRVALSSLFVYGFFEVIVVLNGLLVTKDLNGTSDGWVLVVSYWVFIVSQSYFVAVFMVSKIAFNTVLYAYCKPNHGEVIVEEFEKEGLIGLPFHDDGKVKIILHIKLNLLDFSATEVR

SEQ ID NO: 121986 - protein, 150 aa, Glycine max
  Coding DNA Sequence Number=SeqID_5208
MTLLLSNILPSDHNADLPLRKYQLGSRPQDTQWTRRNPTGPWGFQLWLLASVSPTWCPPPQQGIAPARQPVDPEKSNRGQGETPQQPGDGWQRATDAPPPPPKSISSFTKAGALPMTHGRPSPKPKVSKSTRSAIEKSSRVQLKTLKKRY

SEQ ID NO: 121987 - protein, 54 aa, Glycine max
  Coding DNA Sequence Number=SeqID_5209
ALKGLDDAPHPKSKAPTRWIVVKYFNDPRPLEPKRLKALRIQWTQYYLQVRAQS

SEQ ID NO: 121988 - protein, 194 aa, Glycine max
  Coding DNA Sequence Number=SeqID_5210
MDKRSWVRGQWIPYDVSAINQFLGHPLILEESQSYEYAERRSQVLGFDEEAIGQLLCSPGHDFAWSVARRQVWIMRTSMTTLTQIWMTLLLSNILPNDYNSDLPLPKCQLFDAILTQTSVHVARLISDAIYQFIGIAPLRHPVDPEKSNKGLGFSALITGLYQFYGVPITPTKLIRPLINRSFIEKYCMQRQAE

SEQ ID NO: 121989 - protein, 145 aa, Glycine max
  Coding DNA Sequence Number=SeqID_5211
MAPRIRKTATCSVSKDGNDASVGTDVPFPADYSELLEHARVAADLAIKDNRQLMEIEFPTAGLRSVPEASEVDFARQSVFSRCSFKLDYLTKSSFFEDFGFVEKVKMSDRVKTGDELFLVGYPYFNVNEILVVEELYKEAVLNTE

SEQ ID NO: 121990 - protein, 59 aa, Glycine max
  Coding DNA Sequence Number=SeqID_5212
MGGVGCGINFSISTSWEKMRRSFLTWSVQCVEWSIDRDLLHPPLIMDSLHGDEGFSIAL

SEQ ID NO: 121991 - protein, 471 aa, Glycine max
  Coding DNA Sequence Number=SeqID_5213
  Homolog annotation: Hit_ID=Q33BI2; Match level="QueryCoverage=44%, HitCoverage=19%, E-value=7e-57, Identity=53%"; Hit description =Expressed protein
MCREPRCTSWFCVADSAFQYEVSDDSVQADWRQTFADASGTYHHFEWAVGTTEGKSDILEFENVGLNGCVRASGLDLGGLSACFVTLRAWRLDGRCTELTVKAHSLKGQQRFFEHAEEAEEEEDDDSVDKDGNELDGECSRPQKHAKSPELAREFLLDAATIIFKEQACLALVEKAFREGTARQNAHSIFVCLALKLLEDRVHVACKEIITLEKQMKLLEEEEKEKREEEERKERRRTKEREKKLRRKERLKGKEKEKKCSESNDALGSPEISKKELSAVADMEQNTPISCSNLVIETDETNLLRDDSPNIEDEEFSSECSTLKPQDLSYDDCEEEISNAEDEMGQSTIEQSMFSHRKLRCRKEFQLDMPMKWSDRRRYAVVSENSVMVCRSEPRHYGESFVTSSRVMNGLNRKSRINFPTKSNCRNVGPVHHRKLNLTELENSSLQGSKGTLSITDNSGIFEICEWNPVN

SEQ ID NO: 121992 - protein, 70 aa, Glycine max
  Coding DNA Sequence Number=SeqID_5214
MAGPFAQHPGQNFLQHSFCSTYLAIKSQRCFNANKIQDGAIFFCWSWLRNLEKGFDNPFHQWSPYQSRVL

SEQ ID NO: 121993 - protein, 248 aa, Glycine max
  Coding DNA Sequence Number=SeqID_5215
  Gene Ontology: Mol. function=protein serine/threonine kinase activity
  Homolog annotation: Hit_ID=Q9FH45; Match level="QueryCoverage=85%, HitCoverage=27%, E-value=2e-73, Identity=67%"; Hit description =Arabidopsis thaliana genomic DNA, chromosome 5, TAC clone:K2N11
MSTGEISRSNVYAEHQGGGGGGGENCSILLAVSVKLMVYVLLFYNKKEKNHRIMMAAFNIQEALIWKEKIEYVIDQHQGAQPSNGNKYISFEYKSGMDNGKTASSSDRESQFSAQEDEDEPHPNLLRRTTIGNGLLCIPTSCGLAITLLQSIFKPFLSCDAGPPESVFDWTREIDSDLSNQNINNQAFSRKHWRLLQCQDGLRIFEELGEVDYLPRSFSKAMKAVGVVEATCEEIFELVMSMDGTRFE

SEQ ID NO: 121994 - protein, 97 aa, Glycine max
  Coding DNA Sequence Number=SeqID_5216
MARMIRVVDEERVVKIKRKRRSSSHERDGNGGNLIVILPSCPSPLRPLLLADALNVATLKPWPPLKSYQGTAEWCLHGSIVPTSLPADFECFKVGTS

SEQ ID NO: 121995 - protein, 174 aa, Glycine max
  Coding DNA Sequence Number=SeqID_5217
  Homolog annotation: Hit_ID=Q7X6G3; Match level="QueryCoverage=90%, HitCoverage=58%, E-value=3e-56, Identity=63%"; Hit description=Plant viral-response family protein
  Pfam annotation: Domain name=DUF716; Domain location=12-160; Score =231.8; E_value=1.4e-66; Accession=PF04819.3; Description=Family of unknown function (DUF716)
MISAKKLKNQSNYHEKLEGALCLLAASAFTAEYLLFYFHSTTHKGLEGYYHTLLVFVVGLCILSSIAGALLPTSFPVDLCNGIAIALQGLWFYQTAFVLYGPMMPSGCKLRENSVMCHSIDSEVRGELLANIQLFVAVLVVLVGTVASYGFAASRYGNSEVKNLHAIQAELDQD

SEQ ID NO: 121996 - protein, 218 aa, Glycine max
  Coding DNA Sequence Number=SeqID_5218
MDSFKQIWGSAEGCSSSESGWTMYIASPMQEDDAGCSNENDGYHDNNIYGENRRKKQGAQVDEEESDDSMASDASSGPVHYHHAYTHRQSSHGTAASKKDKQDHGSKFSSKKNANKQEKKRVDSRIEISLVDYYAKSCIELVDRRNKKHDTRKVAKGQLEIEDNISTKGESFSIIEFIMDTEDLKENVRKAKKLNINIEEKIMSKKEKYGFTEVTSNH

SEQ ID NO: 121997 - protein, 105 aa, Glycine max
  Coding DNA Sequence Number=SeqID_5219
  Gene Ontology: Mol. function=kinase activity; Cellular component =nucleus; Biological process=protein amino acid autophosphorylation
  Homolog annotation: Hit_ID=Q9FHI1; Match level="QueryCoverage=99%, HitCoverage=45%, E-value=6e-43, Identity=82%"; Hit description =Arabidopsis thaliana genomic DNA, chromosome 5, P1 clone:MFC19
  Pfam annotation: Domain name=Mob1_phocein; Domain location=1-96; Score=28.6; E_value=3.4e-12; Accession=PF03637.7; Description =Mob1phocein family
MDWIEAQLDDESIFPQKLGSPFPPNFKEVVKTIFKRLFRVYAHIYHSHFQKIVSLKEEAHLNTCFKHFILFTCILFETFVMQEFGLIDKKELAPLQELIETIIPY

SEQ ID NO: 121998 - protein, 90 aa, Glycine max
  Coding DNA Sequence Number=SeqID_5220
  Gene Ontology: Mol. function=kinase activity; Cellular component =nucleus; Biological process=protein amino acid autophosphorylation
  Homolog annotation: Hit_ID=Q9FHI1; Match level="QueryCoverage=75%, HitCoverage=32%, E-value=3e-32, Identity=92%"; Hit description =Arabidopsis thaliana genomic DNA, chromosome 5, P1 clone:MFC19
  Pfam annotation: Domain name=Mob1_phocein; Domain location=22-90; Score=-17.1; E_value=2.2e-08; Accession=PF03637.7; Description =Mob1phocein family
MLVLKKLLISSKEIIIMGAQLRKHIDATLGSGNLREAVKLPPGEDLNEWLAVNTVDFFNQVNLLYGTLTEFCTPENCRTMSAGPKYGIFN

SEQ ID NO: 121999 - protein, 270 aa, Glycine max
  Coding DNA Sequence Number=SeqID_5221
MVAKSVRAPVVATTTEAGTSEKAASRPKRLPMLKERCLLPFIMFPEYMRVDKEVGTYFSRYNHKSYFTNLISWLPINTITDLETYLVTVHTIQLDATPLAEFRVHEPRGMNKDFFHMYDCLFLDLHVRVPFDDFIKGVLQILNVAPTQLHMNRWTIMKAFQALCLLLSEKDHFYDLVGNHLFPFYWQQCPQRYDKYPNKHLSVDESRDLEFLESLPRQLPARRNRIATTGGQSPHATTNQTSRPREVPTDIVPPVGKDPRGKHKHKKRSH

SEQ ID NO: 122000 - protein, 45 aa, Glycine max
  Coding DNA Sequence Number=SeqID_5222
METCLHSPAYTEEAHGWDIEITKSPFLLLLITPLGPFRPCGMTLP

SEQ ID NO: 122001 - protein, 251 aa, Glycine max
  Coding DNA Sequence Number=SeqID_5223
MEQSTNHHNEDVHIEDQTHLSSIVRRLQAQANPSEGREAESTTVGLPRAINLSVCLDIIPSSFNTLGRKLSQFKNRFIPSIMEATLPSNWKNLNIEKYDGTTDSDEHLDVYITQMNELIEYQNQVRANVVSTKKDNDRPSSNKARDEGRRDQPLRESCFTQYILVTTSRSRIMDQALAVNILTMPKRTNTPPKADYSKRCRSLFITRNCTGLRGGIGLSPARGEIKNMQIGQKGEGAGAALGREKKDPSTK

SEQ ID NO: 122002 - protein, 169 aa, Glycine max
  Coding DNA Sequence Number=SeqID_5224
MGTGHSSHNNLRSDCTSFDVTHDGAKARWRNSLEVSMGNWRKGNTEFWGVEYKTNQKKREKCSHFEFWGVEYDDVGLYVVAKIRHKMGHGFVVEVDGPFKRSVVYLDEVISLTFHTGVWSPNAFSHSNGANRSHGEETRGQIVNTFLQKNNGEQYNTVFSIQVDALLVI

SEQ ID NO: 122003 - protein, 363 aa, Glycine max
  Coding DNA Sequence Number=SeqID_5225
  Homolog annotation: Hit_ID=Q6ZIK5; Match level="QueryCoverage=29%, HitCoverage=29%, E-value=9e-38, Identity=66%"; Hit description =Putative growth-regulating factor 1
  Pfam annotation: Domain name=QLQ; Domain location=13-49; Score=74.0; E_value=4.7e-19; Accession=PF08880.1; Description=QLQ
  Pfam annotation: Domain name=WRC; Domain location=68-113; Score=91.1; E_value=3.3e-24; Accession=PF08879.1; Description=WRC
  Pfam module annotation: Pfam domain module=QLQ::WRC; Domain location =13-49::68-113
MSVPPPSTAAMWTPFTAAQWHELEHQALIFKYLKAGLSVPPDLLLPIRKSLQLISSHPSMGYYGKKIDPEPGRCRRTDGKKWRCSRDAHPDSKYCDRHMIRRRYRSRKPVESSQTHSSSSASAASSNSNPVAAGGGGGSVANVSATAAKNLHTLPLHINGAREGFTFTLGNNTSTNTNTNTNTLPHLHMNPLTLSADNTKKTYSKHGSCDVKLPNMWIIMMCGVRVRFWEFGLNSEADEHNVLQKDLGSVRYQGYDFTSDAMWSQMSHIPSNTVSESRIGSTMLGNCFQHQTMRDAELLNLETARTKDLVFSGQLSSAGGMKQEYQSPQSLFSDWDWKKDLSSSALEYRPNKDFNCNPDVNVD

SEQ ID NO: 122004 - protein, 69 aa, Glycine max
  Coding DNA Sequence Number=SeqID_5226
MEIVGKMRRVQQSGRSNWEVGVCYPINNKLGLGILLFSSNVGGLNRSRGVTSSSLSYVYRIGPIRSTSN

SEQ ID NO: 122005 - protein, 997 aa, Glycine max
  Coding DNA Sequence Number=SeqID_5227
  Gene Ontology: Mol. function=binding; Cellular component =intracellular; Biological process=metabolic process
  Homolog annotation: Hit_ID=Q6Z0F9; Match level="QueryCoverage=77%, HitCoverage=94%, E-value=1e-150, Identity=30%"; Hit description=PPR -repeat protein-like
  Pfam annotation: Domain name=PPR; Domain location=149-183; Score =30.3; E_value=6.8e-06; Accession=PF01535.11; Description=PPR repeat
  Pfam annotation: Domain name=PPR; Domain location=17-51; Score=25.2; E_value=0.00023; Accession=PF01535.11; Description=PPR repeat
  Pfam annotation: Domain name=PPR; Domain location=250-284; Score =21.5; E_value=0.0029; Accession=PF01535.11; Description=PPR repeat
  Pfam annotation: Domain name=PPR; Domain location=351-385; Score =26.5; E_value=9.6e-05; Accession=PF01535.11; Description=PPR repeat
  Pfam annotation: Domain name=PPR; Domain location=386-420; Score=7.9; E_value=0.86; Accession=PF01535.11; Description=PPR repeat
  Pfam annotation: Domain name=PPR; Domain location=452-486; Score =40.0; E_value=8.4e-09; Accession=PF01535.11; Description=PPR repeat
  Pfam annotation: Domain name=PPR; Domain location=487-521; Score=1.0; E_value=5.7; Accession=PF01535.11; Description=PPR repeat
  Pfam annotation: Domain name=PPR; Domain location=553-587; Score =45.1; E_value=2.4e-10; Accession=PF01535.11; Description=PPR repeat
  Pfam annotation: Domain name=PPR; Domain location=588-621; Score=6.7; E_value=1.2; Accession=PF01535.11; Description=PPR repeat
  Pfam annotation: Domain name=PPR; Domain location=624-658; Score=9.0; E_value=0.64; Accession=PF01535.11; Description=PPR repeat
  Pfam annotation: Domain name=PPR; Domain location=690-724; Score=6.9; E_value=1.1; Accession=PF01535.11; Description=PPR repeat
  Pfam annotation: Domain name=PPR; Domain location=83-117; Score=1.9; E_value=4.5; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=149-183::17-51::250 -284::351-385::386-420::452-486::487-521::553-587::588-621::624 -658::690-724::83-117
MNYAFKVFDRMPHRDVISWNTMIFGYAEIGNMGFAQSLFDTMPERDVVSWNSLLSCYLHNGVNRKSIEIFVRMRSLKIPHDYATFSVVLKACSGIEDYGLGLQVHCLAIQMGFENDVVTGSALVDMYSKCKKLDGAFRIFREMPERNLVCWSAVIAGYVQNDRFIEGLKLFKDMLKVGMGVSQSTYASVFRSCAGLSAFKLGTQLHGHALKSDFAYDSIIGTATLDMYAKCDRMSDAWKVFNTLPNPPRQSYNAIIVGYARQDQGLKALEIFQSLQRTYLSFDEISLSGALTACSVIKGHLEGIQLHGLAVKCGLGFNICVANTILDMYGKCGALVEACTIFDDMERRDAVSWNAIIAAHEQNEEIVKTLSLFVSMLRSTMEPDDFTYGSVVKACAGQQALNYGMEIHGRIVKSGMGLDWFVGSALVDMYGKCGMLMEAEKIHDRLEEKTTVSWNSIISGFSSQKQSENAQRYFSQMLEMGVIPDNFTYATVLDVCANMATIELGKQIHAQILKLNLHSDVYIASTLVDMYSKCGNMQDSRLMFEKTPKRDYVTWSAMICAYAYHGHGEQAIKLFEEMQLLNVKPNHTIFISVLRACAHMGYVDKGLHYFQIMQSHYGLDPHMEHYSCMVDLLGRSDQVNEALKLIESMHFEADDVIWRTLLSNCKMQGNVEVAEKAFNSLLQLDPQDSSAYVLLANVYANVGMWGEVAKIRSIMKNCKLKKEPGCSWIEVRDEVHTFLVGDKAHPRSEEIYEQTHLLVDEMKWAGYVPDIDSMLDEEVEEQDPYEGLKTTVCSVRLEFGSIKVKLFPTNPLNSNTAEAKLHGESKVVQRCFDDNNDNDKGDDKKLKDQSKNNSRYIYLGLTENKRGYISCGSVLVKGTSTRFKENKGGYIPCGSLLVKGFLQEVVIIKKGEIVEAKLHGESKVVQRCFDDNNDDDKGDDKKFKDQSKNNSSESRTIQEFKIRIKKDSRTQEESLETRIKIKIQDSRFKNKEKTQSR

SEQ ID NO: 122006 - protein, 377 aa, Glycine max
  Coding DNA Sequence Number=SeqID_5228
  Gene Ontology: Mol. function=RNA-directed DNA polymerase activity; Biological process=RNA-dependent DNA replication
  Homolog annotation: Hit_ID=Q1RXD8; Match level="QueryCoverage=49%, HitCoverage=20%, E-value=5e-14, Identity=29%"; Hit description=RNA -directed DNA polymerase
MAPTHLKTKYQTSIKRMFTIGGERHQVIIIEEGASDDGRHNFSSRRPSDSLEELYSDGIDGESLISPYSPPYELRRQPNNQHSDPKVVADSDGGPPTGTGILIRRATDPLEANHSDDPSSDPLNTAQKATRDGDTVVVAANKPRLPLPKGPKAIENTADNSPPSKLVSVYRPKRGYIYLGLTENKRGYISCGSVLVEDTSTRFKENKGGLKEISRTAGRLGTGGHSIQQEIWATVIYSKYGGWRTLEEGRIGTHDSTWFWEDPWTADELPLMEKYLRMYHISCQQKQLMTQMGSSMNNGWEWKLIWRREDTWIWKLDTCGDYSTKSGYNLIWGETTGAILNSDFQELWKLKIPAKAAVFAWRLIRDRLPTKKNLSRR

SEQ ID NO: 122007 - protein, 82 aa, Glycine max
  Coding DNA Sequence Number=SeqID_5229
MAPLPPKDDVPLMFWSITCVLEDSACPVLLKCNLAAILFKPPLHRFFVLQTPCPLKQRTAIPGNTGCRLVVLQAIDIVDKLQ

SEQ ID NO: 122008 - protein, 98 aa, Glycine max
  Coding DNA Sequence Number=SeqID_5230
MSAPHVSPLEMATLHTYFAGGIGEICMAHVSQVVLAKHALLLCVPLDLAVDVALLPDLACVATLTGEISDAISQMALAKWPPHVAPMHVSPACMAIYV

SEQ ID NO: 122009 - protein, 171 aa, Glycine max
  Coding DNA Sequence Number=SeqID_5231
  Gene Ontology: Mol. function=L-asparagine transporter activity; Cellular component=integral to plasma membrane; Biological process =asparagine transport
  Homolog annotation: Hit_ID=Q6YUT5; Match level="QueryCoverage=85%, HitCoverage=30%, E-value=6e-38, Identity=55%"; Hit description =Putative amino acid transporter A1
MTIGSLAPKAEKKKSRKNKTVVVNENAPLLPKSHVQESDAGFDDFNGASFSGAVFNLSTTIIGAGIMALPATLKQLGMIPGLLAIIIMALLTEKSIELLIRFTRAGKSASYAGLMGDSFGNYGKALVQICVIINNIGVLIVYMIIIGLGFNHQPLEARSVFDLVLCCSSCR

SEQ ID NO: 122010 - protein, 229 aa, Glycine max
  Coding DNA Sequence Number=SeqID_5232
  Gene Ontology: Mol. function=hydrolase activity, hydrolyzing O -glycosyl compounds; Cellular component=vacuole; Biological process =carbohydrate metabolic process
  Homolog annotation: Hit_ID=O49011; Match level="QueryCoverage=80%, HitCoverage=93%, E-value=2e-79, Identity=69%"; Hit description=Beta -1,3-glucanase 1
  Pfam annotation: Domain name=Glyco_hydro_17; Domain location=34-229; Score=139.5; E_value=9.3e-39; Accession=PF00332.9; Description =Glycosyl hydrolases family 17
MASLFARTKWFSLPTLLLLLELFTINLSTADAQIGVCYGMIGDNLPPANEVVPALQALRNSGIELTLGVLQQDLQGLATNASIAQQWVQSNVLNFWPSVKIKYVVVGNEIDPVGSSSQFAQYVLPAIQNTYQAIRAQGLHDLIKVTTAISMDLLGNSYTPSQNYFKPDVRSYIDPIIGYLFPMLFSTNVVVWDGQYGYQNLFDATLDAVLVAIDNTGIGYVEVVVSESG

SEQ ID NO: 122011 - protein, 62 aa, Glycine max
  Coding DNA Sequence Number=SeqID_5233
  Subcellular localization annotation: CTP_CleavageSite=45; ConfidenceScore=5.23e-01
MAIIKEGMDAKVSKRDPPAMRRFPVNSSRRSRRVANENLWFLAKREGMVQNSPCRRRIYTPP

SEQ ID NO: 122012 - protein, 275 aa, Glycine max
  Coding DNA Sequence Number=SeqID_5234
  Gene Ontology: Mol. function=hydrolase activity, hydrolyzing O -glycosyl compounds; Cellular component=vacuole; Biological process =carbohydrate metabolic process
  Homolog annotation: Hit_ID=P23535; Match level="QueryCoverage=99%, HitCoverage=88%, E-value=1e-137, Identity=90%"; Hit description =Glucan endo-1,3-beta-glucosidase, basic isoform precursor (EC 3.2.1.39) ...
  Homolog annotation: Hit description=((1->3)-beta-glucan endohydrolase) ((1->3)-beta- glucanase)
  Pfam annotation: Domain name=Glyco_hydro_17; Domain location=1-273; Score=440.9; E_value=1.6e-129; Accession=PF00332.9; Description =Glycosyl hydrolases family 17
MRLYDPNQAALEALRNSGIELILGVPNSDLQGLATNPDTSRQWVQKNVLNFWPSVKIKYVAVGNEVSPVGGSSSVAQYVLPAIQNVYQAIRAQGLHDQIKVSTSIDMTLIGNSFPPSQGSFRGDVRSYLDPIIGYLVYANAPLLVNVYPYFSYTGNPRDISLPYALFTAPNVVVWDGQYGYQNLFDAMLDSVHAAIDNTKIGYVEVVVSESGWPSDGGFAATYDNARVYLDNLVRRANRGSPRRPSKPTETYIFAMLGKVVIDDFNATTSIKSDV

SEQ ID NO: 122013 - protein, 102 aa, Glycine max
  Coding DNA Sequence Number=SeqID_5235
  Gene Ontology: Mol. function=catalytic activity; Biological process =metabolic process
MWNFNFLLKEEPSKTFMYFLYNLHLLFHLKVPQISFSNSRLFPHADDPLLQETPSELAERRSDVGVGGHIELHPPVKGRVVDAYHAVEVLAGMEDLGHVLCH

SEQ ID NO: 122014 - protein, 41 aa, Glycine max
  Coding DNA Sequence Number=SeqID_5236
MAKQQSQPNRAMSSTKFDVEKFTGKNNFNLWRVKMLALLTQ

SEQ ID NO: 122015 - protein, 47 aa, Glycine max
  Coding DNA Sequence Number=SeqID_5237
MIDAHQMRMINQYDIRGGIGYNTEIGDVEEYKNKGHAASLMPIPSVV

SEQ ID NO: 122016 - protein, 153 aa, Glycine max
  Coding DNA Sequence Number=SeqID_5238
  Subcellular localization annotation: CTP_CleavageSite=28; ConfidenceScore=5.05e-01
MADQSDSITLAKITVTQDFRTIQQYPLRATRRKISITTVHTDSVQMLHSKMQAESNIQSQIYMLQPCRSKNRPSQFFFQVDTDDDVIEVLHDRYLNQEEDLPIVLTECWVSNALPKEHLSRNFFLDWCFAKKNKNKRLLVQVHLRCSTCIRRM

SEQ ID NO: 122017 - protein, 372 aa, Glycine max
  Coding DNA Sequence Number=SeqID_5239
  Gene Ontology: Mol. function=zinc ion binding
  Homolog annotation: Hit_ID=Q17TI5; Match level="QueryCoverage=87%, HitCoverage=88%, E-value=5e-90, Identity=55%"; Hit description =Brevis radix
  Pfam annotation: Domain name=DZC; Domain location=162-197; Score =80.6; E_value=4.9e-21; Accession=PF08381.1; Description=Disease resistancezinc fingerchromo
  Pfam annotation: Domain name=DZC; Domain location=317-362; Score=5.5; E_value=0.063; Accession=PF08381.1; Description=Disease resistancezinc fingerchromo
  Pfam module annotation: Pfam domain module=DZC::DZC; Domain location =162-197::317-362
MKGIFEGGSTLLAVGESTALRFSSKKDLFAYQMSLVINFLKDMALKFSGAYKQCKPCTGSSTYKNGQRSYPDFDTISEGVPYPYIGGASSTSTPAWDFTSSNFPGGRSDQRFMGRFSGDRTPRGPQSAPASDVVVVEDEDETKEWMAQVEPGVHITFVSLPNGGNDLKRIRFSREIFDKWQAQKWWGENYDRIMELYNVQRFNRQALNTPSRSEDERRDSSYSRMTSGQDSPMHSMSLKGWTPRNHYKPSGNNPSEAMEQGSGGGQDFHAAASSVEASRTTTSSRDERSMSNASDLETEWIEQDEPGVYITIRQLADGTKELRRVRFSGSSTKSCDMFLGTSGRDLGRDMQRNGGKTTEKEYKLNIFEVLWH

SEQ ID NO: 122018 - protein, 230 aa, Glycine max
  Coding DNA Sequence Number=SeqID_5240
  Gene Ontology: Mol. function=metalloendopeptidase activity; Cellular component=mitochondrial respiratory chain; Biological process =proteolysis
  Homolog annotation: Hit_ID=Q948V5; Match level="QueryCoverage=50%, HitCoverage=42%, E-value=4e-15, Identity=56%"; Hit description =Mitochondrial processing peptidase alpha subunit
MDSNNLFSDYFSDDLDSSPTVPTVVTTTTTTTATWWLEEADHRGEAVLYTARSCSSSRIPASAKFASSVATQQSSSGLGGLFGWLAGDRSNSLPSLDFRLLGVILPPSLPNFVAPGKTIITTLPNGLKVASETSPVNEQLLKVKAEIGEASKNPQDLLLEAIHSAGFSGALANPLLASESALNRLNGICWQSLALKDPASQELVAAVEDEKCMRSRNIANSRAPLGIILL

SEQ ID NO: 122019 - protein, 396 aa, Glycine max
  Coding DNA Sequence Number=SeqID_5241
MDVFDSRHLVRPFTSSYKNFKVGFFKVPRRHDNYPKEYLTIQERHNPTLLSKLPWRLLAKPLVSLFKFLDLFKDLRAMLLSFGMDALDFANMCQEVGLTAGNALEAWPTDPFPPPCPFPRDIVPPADKTKKKGPHRDGGRGSTFEEVAATNPSSIFFFSSLIFGCFILPMVVATGDTSRDANKDGCLKFEEKPMEVDIEPVQIMMVDITEHVNPRHDKTPIAKENMNKAFDEFENEVEGVFLRARDTLAQFLIQKKVCDRDIMLCPCGSAVFDRSVEGLLNHLRFEEICQPLKGLRFKTRETYPDGRTTYLPSAQVPPNKWIRQSNALNQLKWQTFGPDIVGSSVQHNEMNNQIKPLNPYGFNFAKMAYYGALGFRNMSKTQWRRNQRMRKLTLEN

SEQ ID NO: 122020 - protein, 78 aa, Glycine max
  Coding DNA Sequence Number=SeqID_5242
MKPGVAWPDNSGDSEGLGVRMEGFGYEMDAYKRLDWVFLGKELVADMPPTRDFFYIYDGIFCDLNMELPFDDFTMSVL

SEQ ID NO: 122021 - protein, 265 aa, Glycine max
  Coding DNA Sequence Number=SeqID_5243
MGNLLKETSQGASSPSFLSNNNNNDNNDDDNNNDNNNNDDNNNNDDDNNKNSDDNNNDDDKNNNNNNNDNIIIIIIIIIIIIMRFQELRFRPTVSLPCDFDPHSCCATVVHTLQKDFVDFLLIAHCALLLLHFSRNADSIIKRPRVAYDPTLGYAFEKHNLYTVEAKLHDESRLIQRCFDDNKDDDKGDDKKLKGQSKNEFKIESRTLQDSRGKLKNTSRFKRKVDFKNQESRFKDQASKNQDQDSRIKRRLNQDKYEKVFSKTE

SEQ ID NO: 122022 - protein, 435 aa, Glycine max
  Coding DNA Sequence Number=SeqID_5244
  Gene Ontology: Mol. function=DNA binding; Cellular component =intracellular; Biological process=DNA integration
  Homolog annotation: Hit_ID=Q0ZCB7; Match level="QueryCoverage=66%, HitCoverage=27%, E-value=2e-32, Identity=32%"; Hit description =Integrase
PKPYVKEPPELELKPLLSNLNIHDIKGLDPIICTQRINTNVGFLPKRLPQRRVNANMMEVSKESPIQCVPKEGDTTVMENEHHKLTAGWIEVDPTKLEVVAKLPQPNCVNAVMRRFLGHECLRTFNIPKQTLVSALVMTTLDLSLPLKLMCDASDIADINFDFSEECLRTFNIPKQTLVSALVITTLDFSLPLKLMCDASDIVVGVFLGQRKDRFDLEIKDMKGCENLVVDHLSRLDPLVMQSTNDGRINETLLDESLLTIVVDLETYWYAGIVNYLACKVFPPNINYQAKKRLMFEVKKYFWDDPYFFKVCGDNLEVEDDEEDQLEPPSWLDPMYVSIKLQCFVQFETIGLVQTEEYHMVFLKHLKCRYQEAQFIREIIGSPTLTPGTSKARLLPSPTLRVIHKWLIWSFQGKKESTRVVTFVGSKLEALNICL

SEQ ID NO: 122023 - protein, 120 aa, Glycine max
  Coding DNA Sequence Number=SeqID_5245
  Homolog annotation: Hit_ID=Q1SG42; Match level="QueryCoverage=72%, HitCoverage=94%, E-value=1e-15, Identity=45%"; Hit description=PsAD2
MADLMKRILEMIEAEQARKGSNHGTSNSHNTYGSGSQNGSTINSGNHHNNGNWYDDSYHYGERPIYNDGTFNGNGNGAHVEGGFDSSTRNYYGRRYVRREKLCEMGETLEKFTHVDIPLM

SEQ ID NO: 122024 - protein, 106 aa, Glycine max
  Coding DNA Sequence Number=SeqID_5246
MENEKKKCGCWAVLKPDVRGACKPSSASRDSLNTIPRTSLVYDAAIENYALQINEARLSSDNPDPPSQENKVLCQLLQFTFQQLKAATENFRPNNIFGENGFGYMD

SEQ ID NO: 122025 - protein, 76 aa, Glycine max
  Coding DNA Sequence Number=SeqID_5247
MDLLEPEQEAAKGSKSNSYNRYDSGSQNGSTVAIIQTTITGMTIHTTTVDALFITAVLSMVMATRDILRVALISQQ

SEQ ID NO: 122026 - protein, 92 aa, Glycine max
  Coding DNA Sequence Number=SeqID_5248
  Gene Ontology: Cellular component=intracellular; Biological process =intracellular protein transport
  Homolog annotation: Hit_ID=Q2V732; Match level="QueryCoverage=59%, HitCoverage=8%, E-value=3e-25, Identity=100%"; Hit description=VHS and GAT domain protein
MVLKWSGGTVWSRKLLETIIKNCGDIVHMHVAERDVLHEMVKIVKKKPDFHVKEKILVLVDTWQEAFGGPRARYPQYYAAYQELLVMFIIKF

SEQ ID NO: 122027 - protein, 241 aa, Glycine max
  Coding DNA Sequence Number=SeqID_5249
  Gene Ontology: Mol. function=DNA binding; Cellular component =intracellular; Biological process=regulation of transcription, DNA -dependent
  Homolog annotation: Hit_ID=Q7W125; Match level="QueryCoverage=96%, HitCoverage=91%, E-value=8e-38, Identity=36%"; Hit description =Probable transcriptional regulator
  Pfam annotation: Domain name=HTH_IclR; Domain location=5-93; Score =63.9; E_value=5.1e-16; Accession=PF09339.1; Description=IclR helix -turn-helix domain
  Pfam annotation: Domain name=IclR; Domain location=121-239; Score =10.0; E_value=4.3e-05; Accession=PF01614.9; Description=Bacterial transcriptional regulator
  Pfam module annotation: Pfam domain module=HTH_IclR::IclR; Domain location=5-93::121-239
MDVKTAARVLDVLNLFAEAQKPLLYSEIAAQMEIPLSSCHGLLKTMVARGYLYEIGKKHGYYPTQKLIHVATLICRSDPLNAVIEPVLARVRDLTGETALLAKLADDKVVYLIVAESKQTIRFSHQAGGFKAVHATSSGKALLSVLSEDERQKWFKTYPGFASYTETTLTSQAAFERDLQAGIQRGWQRSLGENVEDVMSISLGFKAYEQPFAIVVARPPGAHAEERSHHWAATQRGQGAA

SEQ ID NO: 122028 - protein, 81 aa, Glycine max
  Coding DNA Sequence Number=SeqID_5250
MSLNQVLVKRKKAEWCDKNTEIMLNVCIEELIGKDTGLGWDGEKKAIAASDEWWEAKIQALMVVVVIMILLVQKKCKSISP

SEQ ID NO: 122029 - protein, 104 aa, Glycine max
  Coding DNA Sequence Number=SeqID_5251
MKKTKGKITYDSIGGIVAATTSPSRFDAASDDLSASWFLWKVVSAEKREGGGFGKKFRHQSADKNQTRESLPNTWLSRLKRLRLNQGQTKNFVDMNGFKHLSNR

SEQ ID NO: 122030 - protein, 231 aa, Glycine max
  Coding DNA Sequence Number=SeqID_5252
MCTFEKKKHENVNGTHHEDNENEKDLMYEELKELTLGHESPYLSMSCDVNDTPDENICTMENDFLNVTANSEKKEESSSPPVEHHNTIDQLMQEVVELTTFKKIQKQKNCCLEKKLREAELKIQHLWDRCTMIESTLNLLLPHAENTVIASYAEQSIDPKETSFLKGNLDGESWLPTIDLYCPSQQLSSLMCFNGTTKCWILLSNFRPVDLMPLFESEQRKLGSDFSGQWN

SEQ ID NO: 122031 - protein, 78 aa, Glycine max
  Coding DNA Sequence Number=SeqID_5253
MAKFDPEVVLEFYANAWPTEEGVRDMRSWVRGQWIPFDVDSLSQFLGDPLVLEEGQECEFSQRRNRADVFDEEAIAQL

SEQ ID NO: 122032 - protein, 533 aa, Glycine max
  Coding DNA Sequence Number=SeqID_5254
  Gene Ontology: Mol. function=RNA-directed DNA polymerase activity; Cellular component=chromatin; Biological process=chromatin assembly or disassembly
  Pfam annotation: Domain name=RVP_2; Domain location=10-123; Score= -59.9; E_value=0.046; Accession=PF08284.2; Description=Retroviral aspartyl protease
  Pfam module annotation: Pfam domain module=RVP_2::RVT_1; Domain location=10-123::242-408
MAPETLRFVATIFGRDVVLLVDGGSTYNFIQRQLVTQLGLPSWATAPLRAMLFPLSFSQRKLACDSVCEAVSVIIQSTKFHVDLYILPISGTNVVLGVHWLKSLGPVLTDYNTLAMKFFYEGKLITLQGDMDASLCSLSAFQRLSRTHNDALYYHITMLPDITSSPQELPSAINTLLHKFEALFQTPHTLPPPRVTDYRIHLLPQATPVNVRPYRYPHYQKQEIESQVDSMLQKGLIHPSTSPFSSPVLLVKKHDGAWRFCIDYRALNALIVRDRFLIPTIDELLDELGGARYFSKLDLLQGYHQIRMHSDDIPKTTFRTHHGHYEFKVMPFGLFNAPSSFQATMNMIFRPYLRDFIIVFFDDILIYSATMDDHLKHLKLTFKVEYLGHLVSHKGVEPLESKVLAIQQWPVPRTTKVVRSFLGLAGFYRRFIRQYATIAVPLVKATTKEPLQWNTDTQAAFDTLKHALSTAPVLALPDFDLPFTIKTDASGVGMGVVLSQHNHPIAFFSKPFSSKLLCSSAYVRELFAITAAI

SEQ ID NO: 122033 - protein, 80 aa, Glycine max
  Coding DNA Sequence Number=SeqID_5255
GLAPDETSWEDWSQLCHDFHLEDKVLFQGPWSDKEADSVEGNINANAGGAEDIAIVTEQAQGAEKPERVVKRPSYLMDFV

SEQ ID NO: 122034 - protein, 49 aa, Glycine max
  Coding DNA Sequence Number=SeqID_5256
  Homolog annotation: Hit_ID=Q9FVC9; Match level="QueryCoverage=83%, HitCoverage=8%, E-value=1e-14, Identity=85%"; Hit description =Diacylglycerol kinase variant B
MVIAYTLSWHILMRMRAPKQGPCDPIPPLELPHSLHAFHRVSEADELNK

SEQ ID NO: 122035 - protein, 45 aa, Glycine max
  Coding DNA Sequence Number=SeqID_5257
MDVPYADDVVKVEYVRQVFDTFIAWQRHLVRHVSHEDSHVSKEIG

SEQ ID NO: 122036 - protein, 93 aa, Glycine max
  Coding DNA Sequence Number=SeqID_5258
  Gene Ontology: Mol. function=intramolecular transferase activity, phosphotransferases; Cellular component=cytoplasm; Biological process=carbohydrate metabolic process
  Homolog annotation: Hit_ID=Q9SM60; Match level="QueryCoverage=63%, HitCoverage=10%, E-value=4e-22, Identity=85%"; Hit description =Phosphoglucomutase, cytoplasmic
MAMDNNKDEGNGGCTTVYMVYGSIFGSKPVAVILMMQGNCSVCGEESFGTGSDRIREKDGIWEVLAWLSILAYKNKDKLEDKLVTVEDIVRQH

SEQ ID NO: 122037 - protein, 334 aa, Glycine max
  Coding DNA Sequence Number=SeqID_5259
  Homolog annotation: Hit_ID=Q1STZ2; Match level="QueryCoverage=43%, HitCoverage=35%, E-value=3e-15, Identity=34%"; Hit description=IMP dehydrogenase/GMP reductase
MGQLQRQAFRKAYGKIWDLARVEVSMEPIASLSQYYDQPLRCFTFEDFQLVPIVKEFEEILGCPLGGRKPYLFSGFYPSTTRVAKVVKISAQELDRANGLSFIDILALLIFGVVLFPNMEGLVDLAAIDAFLAFHHGKESPVVAILAMYDTFDQGCEKSGARIDVLMRGVPSDESITPFIARGFSDHNARDRELRGSRNGIIGGYHKWLRVRTQGLDWLPNLKTVRDDEVKASEESDEVQALKAELERARVVEEKFKSIAIKESSRVKGMILKDELKAYLRSKRNLSQQLSETEGNMWAVIDECKEKLNLAATHEQRLEDEYAKISAESEARER

SEQ ID NO: 122038 - protein, 49 aa, Glycine max
  Coding DNA Sequence Number=SeqID_5260
MGSGDLVLSGPFGLNKYGRDHALSAGFALSAPLTFFVSLLRAKLELTAK

SEQ ID NO: 122039 - protein, 87 aa, Glycine max
  Coding DNA Sequence Number=SeqID_5261
  Gene Ontology: Mol. function=protein binding; Biological process =defense response
  Homolog annotation: Hit_ID=Q1T3Y2; Match level="QueryCoverage=92%, HitCoverage=15%, E-value=3e-09, Identity=54%"; Hit description =Disease resistance protein
MNSWSLLKHYAFGPNREQREELVAIGKEIVRKCVASPLAIQTYGKSFFQEAKSDEFGIITSFKMHDLFHDLAQSIMGEECVVHEHCG

SEQ ID NO: 122040 - protein, 111 aa, Glycine max
  Coding DNA Sequence Number=SeqID_5262
MINSSWSILHTPQSPRSIKTTWGKKLRCDNREKTIDRTIIPNTETRVLWLCVWLKESEVVKGVLPKTLARNVNANVSEREEEKVKEGPRLKRPTNKSDLCEAQANIDQPFI

SEQ ID NO: 122041 - protein, 110 aa, Glycine max
  Coding DNA Sequence Number=SeqID_5263
  Gene Ontology: Mol. function=heat shock protein binding; Cellular component=integral to membrane; Biological process=protein folding
  Homolog annotation: Hit_ID=Q337K3; Match level="QueryCoverage=80%, HitCoverage=29%, E-value=2e-19, Identity=51%"; Hit description=DnaJ domain containing protein, expressed
TAWILVKRSAEYKPLQFLAFAFVYRLFEKLKTFESPVTPKYNEEGEDTGEGLRMGKRLLRSLALVFGCVAISSLAYTFILNIIEFAGGFIPTLLYNSQLCDVKELVAIEV

SEQ ID NO: 122042 - protein, 60 aa, Glycine max
  Coding DNA Sequence Number=SeqID_5264
MRAWPKKGVTIKEVGQGRYLFQFYHELDCNRIMEGGPWVGCRRVQLQLKFLYSILRVGYK

SEQ ID NO: 122043 - protein, 62 aa, Glycine max
  Coding DNA Sequence Number=SeqID_5265
MTHEGGGAPCPEQILSTPSFMKVEEHHAQQIWLPMVYVMNLVDDKPFLSLFSNNNNLLDWLL

SEQ ID NO: 122044 - protein, 275 aa, Glycine max
  Coding DNA Sequence Number=SeqID_5266
  Gene Ontology: Mol. function=protein transporter activity; Cellular component=nucleus; Biological process=protein transport
  Homolog annotation: Hit_ID=Q337K5; Match level="QueryCoverage=99%, HitCoverage=23%, E-value=8e-80, Identity=52%"; Hit description =Expressed protein
VSCMLERLRGAASASEPRTQKAIYDLGFSLMNPILVLLEVYKHESAVVYLLLKFVVDWVDGQITYLEAQETAAVVNFCTRLLQLYSSHNIGKISLSLSSSLLSEAKTDKYRDLRALLQLLSSLCSKDMIDFSSDSIEAQGTNISQVVYFGLHMVTPLISMDLLKYPKLCHDYFSLLTHMLEVYPETFAQLNSEAFAHILGTLDFGLHHQDADVVSKCLRALQALASYHYKETGNGNIGLGAHTVGHKDLSGNVQEGLLSRFLRSMLQLLLFEDYR

SEQ ID NO: 122045 - protein, 43 aa, Glycine max
  Coding DNA Sequence Number=SeqID_5267
MRKLIKERMENKVVNFVGLNKVKWWLDRNIEMAITEATGLQMR

SEQ ID NO: 122046 - protein, 137 aa, Glycine max
  Coding DNA Sequence Number=SeqID_5268
  Subcellular localization annotation: CTP_CleavageSite=84; ConfidenceScore=5.13e-01
MKLLQTHNQRTKGTTHTNKSRRRTHTCLALLLWLRSCCWCWGLSETASSEMSSMASASLGLFFFFKPWVGGLRGGKGCFSSSPKEEMVVVKRILEDGVELGWDWKERGDKVVIVVVDGALELEGSGWKGKVLEKRVE

SEQ ID NO: 122047 - protein, 377 aa, Glycine max
  Coding DNA Sequence Number=SeqID_5269
  Gene Ontology: Mol. function=nucleic acid binding; Cellular component= nucleus; Biological process=DNA replication
  Homolog annotation: Hit_ID=Q9FHJ6; Match level="QueryCoverage=75%, HitCoverage=19%, E-value=4e-21, Identity=39%"; Hit description =Replication protein A1-like
  Pfam annotation: Domain name=Rep-A_N; Domain location=175-276; Score =131.7; E_value=2e-36; Accession=PF04057.3; Description=Replication factor-A protein 1, N-terminal domain
  Pfam annotation: Domain name=Rep-A_N; Domain location=4-105; Score =131.3; E_value=2.7e-36; Accession=PF04057.3; Description=Replication factor-A protein 1, N-terminal domain
  Pfam module annotation: Pfam domain module=Rep-A_N::Rep-A_N; Domain location=175-276::4-105
MAVSLTQGAITEICRGNCSENLQPVLQVIELKQVQSQQNSTVERYCVVLSDGSFYQQGMLATQKNDLVHSGKLQKGSVLRLTQFLCNVVQNHKIIIIIDLDVILDYCELIGQPVSTPKHTPKEPGVNFGNSQSLNSSSHAGGMNARPNVSGSSIYYPKANPPARNDPPAYPKAKTLTQGAIMEICSGNDPKNLQPVLQVIEFKLVQSQQNSTIERYRVVLSDGSFYQQGMLATQKNELIYSGRLQQGAIIRLTQFICNVVQNRKIIIIVDLDVICEKCELIGEPVAAPKGAPAESATGQSGFTFGNLQYLDRSSHSGGMTTIQNLAGQSLDLKPVLQVLELELVNSQQHSASVNFHLVLSDGYHFQQAMLTTQKNQL

SEQ ID NO: 122048 - protein, 155 aa, Glycine max
  Coding DNA Sequence Number=SeqID_5270
VDIRSSKICELGLLDYKAKDVFHHFERSKFRCRYDYYWASVFKVEYKDHFSGQTQVAFAEAPNEALPLYCRPNFGAAWLTQYKFKVNETYDCWYTSGISKVRLHQDSLFGCDAHEQSTLEKSRQYSTISLWPLKCVTKFTDLKMANKLGHRLVGI

SEQ ID NO: 122049 - protein, 486 aa, Glycine max
  Coding DNA Sequence Number=SeqID_5271
MVVKKDRNSFQYHKEALVINLNSAGKFLIKIYIKGYNSPSIGLNSRLSKRISTELANNVSNQKHVGVTSEGRNNDKLYMQNNLLANDVSGDINFPIRDPVNRELQSSTDLFLAKAWYLSDQRVTRSRSSELRRRYTEMQNSQTKQGMESMSMDPQHGVDTTKQGIAHFNGFDYITMTELPSQKGSFISPSNSSSSTFHTHQLVDADKVSSCVSMLKGTLQRKRLSNQVEIEREAAADSLNGLFGPQEPLFQNGFHEGLENWSHQKPISFQGASTGQIKNPGVYIVSDGFGNQTNQAYVGNASQEPSQSESSAAAPVISSGLDACEGPSNSNQNLCESSWKPVGVSRSSENTQNRVRGVREQIMDNIKDDRKRKSLERYGSITSAVSEEKGDTTKKRRVERSRKMAEAKERNLTPSVPSDMQAVLRRCETLEKEVRSLKLNLSFMNRKDSEQTKQIEDLQKQNEDLADEKERLLEEIERIVSETGKI

SEQ ID NO: 122050 - protein, 272 aa, Glycine max
  Coding DNA Sequence Number=SeqID_5272
  Gene Ontology: Mol. function=nucleoside-triphosphatase activity; Cellular component=chloroplast
  Homolog annotation: Hit_ID=Q2PMM5; Match level="QueryCoverage=100%, HitCoverage=11%, E-value=1e-161, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSK

SEQ ID NO: 122051 - protein, 404 aa, Glycine max
  Coding DNA Sequence Number=SeqID_5273
  Gene Ontology: Mol. function=transferase activity, transferring phosphorus-containing groups; Cellular component=membrane; Biological process=peptidyl-histidine phosphorylation
  Homolog annotation: Hit_ID=Q08PB2; Match level="QueryCoverage=100%, HitCoverage=22%, E-value=3e-59, Identity=35%"; Hit description =Serine/threonine protein kinase and signal transduction histidine kinase (Sthk) with gaf and pas/pac sensor
  Pfam annotation: Domain name=ABC_tran; Domain location=151-303; Score= -60.2; E_value=0.037; Accession=PF00005.17; Description=ABC transporter
MSPEHTTRTRRPVDSRSDLYSLGMVLYELLTGRLPFELGADDQTNWAHYHIASEPLAPDVIRPDVPGMLSTILLKLLEKHPDNRYQTVDGLIADLRRCQATLTGEGEIAPFTPGQQDRTPAIHLADSLFATHPQANDVIAAFERVGQSRVPELVTIGGPSGIGKSSIIATALKTLQQRTVLLAVGKVDQFSPSLPYGVLSSAFRTLTLHLLGLPADDVAKWKIRLSRALEGHEALAVSLVPELGLLLESKPRFSPDTFSIDARARFSHMVLALVKTFASQGCPLVLVLDDLQWSDAASLHTLKYLLVNSGAIPLLVVVAHRDICSLSDATLQALLTSLPEAALNASEIVPQALSVKAVARWLATLFRTRSTATSDLATLIHEKTGGNPLFVHEFFRRIVDDGLV

SEQ ID NO: 122052 - protein, 195 aa, Glycine max
  Coding DNA Sequence Number=SeqID_5274
  Homolog annotation: Hit_ID=Q5XWM0; Match level="QueryCoverage=42%, HitCoverage=26%, E-value=1e-27, Identity=68%"; Hit description=ZF-HD homeobox protein-like
  Pfam annotation: Domain name=ZF-HD_dimer; Domain location=61-122; Score=148.6; E_value=1.7e-41; Accession=PF04770.3; Description=ZF-HD protein dimerisation region
  Subcellular localization annotation: CTP_CleavageSite=60; ConfidenceScore=5.31e-01
MDLTSSTTHNTNTTQTLEAANTITITTKATPPIPTTTLKSLSFTNGTLKRHPITTVAPPPSMVVSYKECLKNHAASIGGHALDGCGEFMPSSSTVPSDPRSLKCAACGCHRNFHRREPQENNLNNNLKNNNPTSSTTFTPSHEPKHITEPEFKPEPQPKPDIKPITAATLARATLPRFSATHASSPRHCLFSCTL

SEQ ID NO: 122053 - protein, 57 aa, Glycine max
  Coding DNA Sequence Number=SeqID_5275
MVMDMADTFGEGFWKWASLYEDPIQLQCDILKEMGLSYKEEDSKVKGLLLDMENKMI

SEQ ID NO: 122054 - protein, 45 aa, Glycine max
  Coding DNA Sequence Number=SeqID_5276
MAFKSGTFDINSRVNSSQEGEANDIGLFKEEVFDLDGFNINGSIT

SEQ ID NO: 122055 - protein, 40 aa, Glycine max
  Coding DNA Sequence Number=SeqID_5277
GAREIVSFLDTTSWGTTVPDGIKMEPMHNAYAKGTTQGCT

SEQ ID NO: 122056 - protein, 169 aa, Glycine max
  Coding DNA Sequence Number=SeqID_5278
MEESLKKRKGMSSTTAAVGHRRHGPSEAPTAPIHPSLSSPRSSTLFSLDDQCLRYNSQFSSRIILDPKYRDTDFFNDETFDYYQVFQNSGLVDFMSLKLSYYPKLVKVFYSNLKIQDGIISFEVHGISMIIDQSLFLSLTKLLSQGAPFEGTIVDDWKFDYSSHDACRM

SEQ ID NO: 122057 - protein, 196 aa, Glycine max
  Coding DNA Sequence Number=SeqID_5279
  Gene Ontology: Mol. function=oxidoreductase activity; Cellular component=integral to membrane; Biological process=electron transport
  Homolog annotation: Hit_ID=O81974; Match level="QueryCoverage=76%, HitCoverage=29%, E-value=7e-37, Identity=52%"; Hit description =Cytochrome P450 71D8
THLLLEVASPLSLPFSIPLPFIFQEAKESIDEEDPRPTSSNGACITFGGIYKDQDEFVVSLIRKIVESGGGFDLADVFPSIPFLYFLTGKMTRLKKLHKQVDKVLENIIREHQEKNKIAKEDGAELEDQDFIDLLRIQQDDTLDIQMTTNNIKALILDIFAAGTDTSASTLEWAMAETTRNPTVREKAQAELRQAF

SEQ ID NO: 122058 - protein, 132 aa, Glycine max
  Coding DNA Sequence Number=SeqID_5280
MTIDPTKTLMHYLTPTLGEANTIQLLDLPPSYLTSSMVPLDAREQPIGSKRVYLKNGKGSKILSKVVHTMPLLNIDWSIYSMGKPYVKSTAIINNAFPYNNSGNKRIMKSNVNQVGIDESQTELGKQNKLYQ

SEQ ID NO: 122059 - protein, 220 aa, Glycine max
  Coding DNA Sequence Number=SeqID_5281
MATMMEAMMSMKKMMEVNAAIVVAASIAIEVDPAPPSGLNQINHPTSDIVGQGSKDKHAFPPYGLPPNYAPPNVAHTLDENVNNSTPILIDSQQPQSDHAHVFQPMGETHEAPHHNLVDFEPCHGHATKGQAVGGVPLPNTLEGPQFRPQPLYFAVRRIPPVIAEKGKLDHIEERLRAIENVLSEDGGARLTGALSKGGKMRGVATNAYLWKSSEKPKET

SEQ ID NO: 122060 - protein, 47 aa, Glycine max
  Coding DNA Sequence Number=SeqID_5282
MAWARTSALNGEGTTVWAQRHGRWRHGLNESVVYTMRKQVVMIHNYT

SEQ ID NO: 122061 - protein, 104 aa, Glycine max
  Coding DNA Sequence Number=SeqID_5283
MQTVNDKLLQRATSSLDEKPLLEKELIRALKLEVGAGTFELAELKLAVVEFLLPNCKVQLQPSRITSSTKNKNLVQLYKVNLRTKTGRRVKDETNGAGSGMNSG

SEQ ID NO: 122062 - protein, 368 aa, Glycine max
  Coding DNA Sequence Number=SeqID_5284
  Gene Ontology: Mol. function=protein kinase activity; Cellular component=membrane; Biological process=protein amino acid phosphorylation
  Homolog annotation: Hit_ID=Q1T053; Match level="QueryCoverage=94%, HitCoverage=93%, E-value=1e-179, Identity=90%"; Hit description =Protein kinase
  Pfam annotation: Domain name=Pkinase; Domain location=59-349; Score =151.2; E_value=2.7e-42; Accession=PF00069.15; Description=Protein kinase domain
  Pfam annotation: Domain name=Pkinase_Tyr; Domain location=59-347; Score=123.1; E_value=7.9e-34; Accession=PF07714.7; Description =Protein tyrosine kinase
  Pfam module annotation: Pfam domain module=Pkinase::Pkinase_Tyr; Domain location=59-349::59-347
MKRTNERAIATATDFQIANGVYKPAQLWQLEDQTPRPTKRLHGSSVYTLKEMEEATCSFSDENLLGKGGFGKVYRGTLRSGEIHTNTTSLLLKVVAIKKMELPAIKAAEGEREFRVEVDILSRLDHPNLVSLIGYCADGKHRFLVYEYMRKGNLQDHLNGIGERNMDWPRRLQVALGAAKGLAYLHSSSDVGIPIVHRDFKSTNILLDDNFEAKISDFGLAKLMPEGQETHVTARVLGTFGYFDPEYTSTGKLTLQSDVYAFGVVLLELLTGRRAVDLNQGPNDQNLVLQVRHILNDRKKLRKVIDPEMARNSYTIQSIVMFANLASRCVRTESNERPSIVECIKELLMIIYTNSKGLGMVMHSLRMI

SEQ ID NO: 122063 - protein, 202 aa, Glycine max
  Coding DNA Sequence Number=SeqID_5285
  Gene Ontology: Mol. function=DNA binding; Cellular component =mitochondrion; Biological process=DNA integration
  Homolog annotation: Hit_ID=Q1RSZ9; Match level="QueryCoverage=90%, HitCoverage=15%, E-value=1e-56, Identity=58%"; Hit description =Polynucleotidyl transferase, Ribonuclease H fold
MLIPSTPYARSISLSKALQETLQYFTFTRPDIACDVQQVCLFMHDPREEHMHALKRIVCYIQGTFDHGLHPYPSFTSTLLSYTDADWGGCLDTRRSTLGYCVFLGPPNGKLRCHDLVWRRNNEVLPMCAIYLFENPVQHQRTKHIERDIHFVREKIAHGEVRVLHVMSHYHIAEIIDVWTSELDIQLFLTNVMSWNPSSCQE

SEQ ID NO: 122064 - protein, 52 aa, Glycine max
  Coding DNA Sequence Number=SeqID_5286
MGAQVRYRLDWHSISDVNRLSDMKTQNENFKFNVFRFEPDITVKNKVDKYFP

SEQ ID NO: 122065 - protein, 107 aa, Glycine max
  Coding DNA Sequence Number=SeqID_5287
  Gene Ontology: Cellular component=membrane
  Homolog annotation: Hit_ID=Q9FL11; Match level="QueryCoverage=70%, HitCoverage=23%, E-value=5e-09, Identity=42%"; Hit description =Nodulin-like protein
MARWVNGRGNLLPFLGMVLVMLAQSGSMVVIKVAMSDGINKYVMVVYSLALSTILLLPFALFLHRSSGQIMAYVGIDLSSATLASAMLNLIPAFTFILALIFRFFFF

SEQ ID NO: 122066 - protein, 197 aa, Glycine max
  Coding DNA Sequence Number=SeqID_5288
  Gene Ontology: Mol. function=molecular_function; Cellular component =membrane; Biological process=auxin mediated signaling pathway
  Homolog annotation: Hit_ID=Q9FL09; Match level="QueryCoverage=88%, HitCoverage=60%, E-value=2e-34, Identity=38%"; Hit description =Nodulin-like protein
  Pfam annotation: Domain name=DUF6; Domain location=48-168; Score=9.7; E_value=0.018; Accession=PF00892.11; Description=Integral membrane protein DUF6
MENLNLKLRSSHAKIIGTVISIAGALIITLYKGMPLTGSSMRNLVLGGSEAYLSVQLDWIIGGFLLATSSLCLSVLFIVQTWIIKDYPEELVVTTICCSPVAIFVVSMRSVVYTWAMRKKGPVYVAMFSPLGMVIAIGMGVIFLGESLYLGSMIGAATIGIGFYAVMWAQAQDEKLVNEKNENHDFVTSSSAPLLST

SEQ ID NO: 122067 - protein, 380 aa, Glycine max
  Coding DNA Sequence Number=SeqID_5289
  Gene Ontology: Mol. function=carboxypeptidase activity; Cellular component=membrane; Biological process=auxin mediated signaling pathway
  Homolog annotation: Hit_ID=Q8L9I2; Match level="QueryCoverage=81%, HitCoverage=84%, E-value=1e-55, Identity=39%"; Hit description =Nodulin MtN21-like protein
  Pfam annotation: Domain name=DUF6; Domain location=16-148; Score =24.2; E_value=0.00047; Accession=PF00892.11; Description=Integral membrane protein DUF6
  Pfam annotation: Domain name=DUF6; Domain location=184-313; Score =22.2; E_value=0.0018; Accession=PF00892.11; Description=Integral membrane protein DUF6
  Pfam module annotation: Pfam domain module=DUF6::DUF6; Domain location=16-148::184-313
  Subcellular localization annotation: CTP_CleavageSite=51; ConfidenceScore=5.25e-01
MQGAGITFVMVVAQVLSVGLNTLIKASMSKGMSIFVYVAYSNLLGFCFLLLATTIRHRNRAPTPINNSILFRIFVLGLLSVTIQTLIYTGLGYSSPTLTSTMEDIVPAYTFIIAIICRMERLDLKLQSCQAKSIGTVVSIAGALIMTLYKGLPMTIDVMPNNAFLSSQQSKWLLGGFLLAVGCFCGSVSLVIQTWTIKDYPEELMLITISSSFSVILSFIVAFIAEENPKAWILKLDMELVCIFYSGIVVMSTRNVVYVWACRKKGPVYVAMFSPLGIVIALAMGIVFLGDALYLGSIIGAAIIAIGFYAVIWGQAQQETMAYEKYGTSSSIISSSPSSEAPLLPNKIKDTSSFICGDGRDGVKTRDLWDGRGATVRVEG

SEQ ID NO: 122068 - protein, 114 aa, Glycine max
  Coding DNA Sequence Number=SeqID_5290
  Subcellular localization annotation: CTP_CleavageSite=76; ConfidenceScore=5.01e-01
MVGVGVSVSAAMVATLFLEVGLNTLIKAANTNGMSNFVFIVYSNFLALFFLIPSTFLYHRLASFHKLSCHSLTLKKSQEKSSSPNSKLNSLENFSSLLPQVCPLPPFNHVDVTE

SEQ ID NO: 122069 - protein, 63 aa, Glycine max
  Coding DNA Sequence Number=SeqID_5291
MARSTRLVAVSLPRVPFKSKGSLCYINSFGINTCHQALARPTVPWHPSMILNQESFTWSYTKV

SEQ ID NO: 122070 - protein, 390 aa, Glycine max
  Coding DNA Sequence Number=SeqID_5292
  Gene Ontology: Mol. function=3'-5'-exoribonuclease activity; Cellular component=cytoskeleton; Biological process=regulation of actin filament polymerization
  Homolog annotation: Hit_ID=Q01CA0; Match level="QueryCoverage=54%, HitCoverage=66%, E-value=7e-22, Identity=29%"; Hit description=[Z] KOG2826 Actin-related protein Arp2/3 complex
  Pfam annotation: Domain name=P34-Arc; Domain location=74-319; Score =0.0; E_value=2.7e-10; Accession=PF04045.5; Description=Arp23 complex, 34 kD subunit p34-Arc
MSQHQQTCTNHDKIVAYVVTIITKIALTIKCLSIGVPYSVNQDCMKRENVHEKRECTQLEVLLNSQASNPQVAYLSISMPPLCHGVIQNELSSYTIEMVKGLCPNVVGIAEPAKEGYQLTLKLNLNQIPQNKDYDKVIKEISTVHSVILSSQLKEILWNVNFDDALQGMYKPIKLVYHPKDHFFLIRQPQRIIAVFPIRFREKSDVIIATAFFQELVDVGSSDKWAKVPPCNWSAIPPPELRGEAFEDLSTNGGFFTFDISSRHVEGNRLDKTVWNLLNFNAYVRYHVKSTKGFIQRRMRKRLESLVEVLHQTNLEENEQTKQHQVYRYTKKLVRSAKYAVLKQRWGTFGRKIKRIRFRLKIHGFTRFRQQWFRFPKFSTGYTKIVEKSA

SEQ ID NO: 122071 - protein, 38 aa, Glycine max
  Coding DNA Sequence Number=SeqID_5293
MFNEEGFSPILQKYGHYEPQESCLTVNHAITEPHCPTF

SEQ ID NO: 122072 - protein, 254 aa, Glycine max
  Coding DNA Sequence Number=SeqID_5294
  Gene Ontology: Mol. function=methyltransferase activity; Biological process=metabolic process
  Pfam annotation: Domain name=Methyltransf_11; Domain location=113 -194; Score=44.5; E_value=3.7e-10; Accession=PF08241.2; Description =Methyltransferase domain
MHADMQITPTKPFILRCFLISLFLSLPFLFLYLFYPQQQQQQQHHITTKDLRIRPGYSSYESYIQRQLNKTLNPKLRKIWTTRDWDRKIPVFARFFEDLKVNKKLLKNTSKALCIGARVGQEVEALRQIGVVDSVGMDLVPYPPLVMKGDFHNQPFQNDTFDFEFSNVFDHALYPQRFVAEIERTLKPEGVCVLHVALSRRADKYSANDLYSVQPLVELFKRSALVHVRSVDGFGLDTEVAFRKKGEPLRRHRL

SEQ ID NO: 122073 - protein, 270 aa, Glycine max
  Coding DNA Sequence Number=SeqID_5295
  Gene Ontology: Mol. function=NAD+ ADP-ribosyltransferase activity; Cellular component=nucleus; Biological process=guanosine tetraphosphate metabolic process
  Homolog annotation: Hit_ID=Q9FRM5; Match level="QueryCoverage=98%, HitCoverage=92%, E-value=2e-52, Identity=46%"; Hit description =Putative ankyrin protein
  Pfam annotation: Domain name=Ank; Domain location=129-161; Score =34.8; E_value=2.9e-07; Accession=PF00023.20; Description=Ankyrin repeat
  Pfam annotation: Domain name=Ank; Domain location=63-95; Score=20.7; E_value=0.0052; Accession=PF00023.20; Description=Ankyrin repeat
  Pfam annotation: Domain name=Ank; Domain location=96-128; Score=32.9; E_value=1.1e-06; Accession=PF00023.20; Description=Ankyrin repeat
  Pfam module annotation: Pfam domain module=Ank::Ank::Ank; Domain location=129-161::63-95::96-128
MGNPRKPSTADELHMAARSGDLIAVNSILASNPLAVNSRDKHSRTPYRSFGVVLYAVRHELANLDHSLHLAAFSGQAEVVTYLSKHKADVGASAMDDMAAIHFASQKGHLEVVRALLSAGASLKAATRKGMTSLHYAVQGSHMELVKYLAKKGASLGAKTKAGKTPLDLATNGEIRSFLEDFEKSTKNGELGNKDKDKAEESDLKTSTLGSEGDLSSEPAAAAVDEDDNEREKRKGNEVDATEESSQPKKARVNLSHLQSSDDTQEEESL

SEQ ID NO: 122074 - protein, 62 aa, Glycine max
  Coding DNA Sequence Number=SeqID_5296
MEKKVSTEGHGIEVGIVGGKEEGLEGGNMMVGLELMLGVDINERGRRRRKKNRRKMMDRKLT

SEQ ID NO: 122075 - protein, 185 aa, Glycine max
  Coding DNA Sequence Number=SeqID_5297
  Homolog annotation: Hit_ID=Q7XA24; Match level="QueryCoverage=67%, HitCoverage=61%, E-value=1e-34, Identity=60%"; Hit description =Putative kinesin-like protein, identical
  Subcellular localization annotation: CTP_CleavageSite=58; ConfidenceScore=5.62e-01
MKKTGKKTKLTVADLLKTPSPVASPAADSPAIFKRAASSSKGAKRGSRVALATSTSPPCGHRAPSNISDLRNLASSGVDDLKRRIDRSHSEILKDLEASNSRLHKRFKMQNQAYQQVMDEAEKEYKKVSERITESRDATKSSYEEFMAEAQASASRACKTSIAELSQSFAKAIDSLRNRYGISSN

SEQ ID NO: 122076 - protein, 777 aa, Glycine max
  Coding DNA Sequence Number=SeqID_5298
  Gene Ontology: Mol. function=binding; Cellular component=thylakoid; Biological process=photosynthesis
  Homolog annotation: Hit_ID=Q8GZN1; Match level="QueryCoverage=98%, HitCoverage=97%, E-value=0.0, Identity=67%"; Hit description=Pollen -specific calmodulin-binding protein
  Pfam annotation: Domain name=TPR_1; Domain location=238-271; Score =4.0; E_value=1.8; Accession=PF00515.18; Description=Tetratricopeptide repeat
  Pfam annotation: Domain name=TPR_1; Domain location=422-455; Score =14.4; E_value=0.1; Accession=PF00515.18; Description=Tetratricopeptid e repeat
  Pfam annotation: Domain name=TPR_1; Domain location=735-768; Score =26.6; E_value=9e-05; Accession=PF00515.18; Description =Tetratricopeptide repeat
  Pfam annotation: Domain name=TPR_2; Domain location=238-271; Score =11.9; E_value=1.4; Accession=PF07719.7; Description=Tetratricopeptide repeat
  Pfam annotation: Domain name=TPR_2; Domain location=422-455; Score =15.2; E_value=0.24; Accession=PF07719.7; Description=Tetratricopeptid e repeat
  Pfam annotation: Domain name=TPR_2; Domain location=509-542; Score =1.3; E_value=23; Accession=PF07719.7; Description=Tetratricopeptide repeat
  Pfam annotation: Domain name=TPR_2; Domain location=578-611; Score =15.6; E_value=0.18; Accession=PF07719.7; Description=Tetratricopeptid e repeat
  Pfam annotation: Domain name=TPR_2; Domain location=735-768; Score =25.2; E_value=0.00023; Accession=PF07719.7; Description =Tetratricopeptide repeat
  Pfam annotation: Domain name=TPR_4; Domain location=171-196; Score =6.0; E_value=7.3; Accession=PF07721.5; Description=Tetratricopeptide repeat
  Pfam annotation: Domain name=TPR_4; Domain location=20-44; Score=2.4; E_value=20; Accession=PF07721.5; Description=Tetratricopeptide repeat
  Pfam annotation: Domain name=TPR_4; Domain location=422-447; Score =2.0; E_value=22; Accession=PF07721.5; Description=Tetratricopeptide repeat
  Pfam annotation: Domain name=TPR_4; Domain location=578-603; Score =4.2; E_value=12; Accession=PF07721.5; Description=Tetratricopeptide repeat
  Pfam annotation: Domain name=TPR_4; Domain location=735-760; Score =3.5; E_value=14; Accession=PF07721.5; Description=Tetratricopeptide repeat
  Pfam module annotation: Pfam domain module=TPR_1::TPR_1::TPR_1::TPR _2::TPR_2::TPR_2::TPR_2::TPR_2::TPR_4::TPR_4::TPR_4::TPR_4::TPR_4; Domain location=238-271::422-455::735-768::238-271::422-455::509 -542::578-611::...
  Pfam module annotation: Domain location=735-768::171-196::20-44::422 -447::578-603::735-760
MESSEDGSMSYREFHANGSRMVTSEVEAKLDEGNIQEAEDALREGLSLNFELFLDCAFHIANRTYRDLGAQVGMTMGRGGVGFSLSTRLPKSFPPPIPVGIQKLDSSRLRLGIGIAVGWGQGPTYPIPSSNPTFSIGKNLTPINSVFSCQSWDGSGLVPAGMGTLAMPRCKEARALLGKLEYQRGNVEGALRVFDGIDLQAAIQRLQPSFSEKTPVKKGRTRTESPSSVSQHAASLVLEAIYLKSKSLQKLGKFTEAANDCKRILDAVEKIFYLGVPDIQVDNRLQEIVSHAVELLPELWKQAGCYDEAISAYRRALLSQWNLDNDCCARIQKSFVIFLLYSGVETSPPSLAVQIDGSYVPKNNLEEAILLLMIFLKNFCLGKMKWDPSVMEHLTFALSICSGTTVLAKQLEELNPGVYHRIDCWNTLALCYSGAGQNDSALNLLRKSLHKHERPNDLTSLLLAARICSEDPYLAAEGVNHAQRAISNAHGPNEHLKGVALRMLGLCLGKQAKVASSDFERSRLQSKALESLVAAIRLEPNNSDLIFELAVQYAEHRNLPAALRSARHFFNKTGGSVSKAWRLLALILSAQQRFSEAEVVTDAALDQTSRWEQGPLLRLKAKLKISQSRPMDAIETYQYLLALVQAQKKSFGSLQISSKGQVCCTGKIVGPGVLFEGRGQNEEALCATINAILLEPNYVPCKILMGALIQKLGTKHLAIARSLLSDALRIEPTNRKAWYNLGLLHKHEGRISDAADCFQAASMLEESDPIESFSSLP

SEQ ID NO: 122077 - protein, 69 aa, Glycine max
  Coding DNA Sequence Number=SeqID_5299
MERLELDMKSTFASMCKEHRTKVFSEWQVEKGSAQPLSVAVKLTYSKSKLFNAGQSERVKTIEYVCKFV

SEQ ID NO: 122078 - protein, 68 aa, Glycine max
  Coding DNA Sequence Number=SeqID_5300
MTWRVVNGGAILRRVCAPTFMRENDAHCSGHHHDYSRHHHHHQLQYHHQGGVDDDNDNTHGDRGGGGG

SEQ ID NO: 122079 - protein, 191 aa, Glycine max
  Coding DNA Sequence Number=SeqID_5301
  Gene Ontology: Mol. function=structural constituent of ribosome; Cellular component=ribonucleoprotein complex; Biological process =translation
  Homolog annotation: Hit_ID=Q1SI00; Match level="QueryCoverage=99%, HitCoverage=67%, E-value=2e-21, Identity=86%"; Hit description =Ribosomal protein L17
  Pfam annotation: Domain name=Ribosomal_L17; Domain location=17-191; Score=61.9; E_value=2.1e-15; Accession=PF01196.9; Description =Ribosomal protein L17
MTKFRKLGRPTGHRMSMLRTMVSQLVKHERIETTVAKAKEIRRLADNMVQLGKECLYGCYLALWGNDLTGFGHSAIQISWYAMVEREYMGLSIGKNPSLTLARDKANIEYISGGKASPYELAFGVELGSNPYSKMGSQHAARQAASFVRGDDVIHKLFTELAYRYKDRAGGYTRLLRTRIRVGDAAPMAYI

SEQ ID NO: 122080 - protein, 71 aa, Glycine max
  Coding DNA Sequence Number=SeqID_5302
MECSIYGVKIKSVGPGDRGNGKTDMDAGGIDGIGVGAEEGGTSEDGGASDLFPLALRCPLKSGLPELYIKQ

SEQ ID NO: 122081 - protein, 183 aa, Glycine max
  Coding DNA Sequence Number=SeqID_5303
  Gene Ontology: Mol. function=metal ion binding; Cellular component =integral to membrane; Biological process=ubiquitin cycle
  Homolog annotation: Hit_ID=Q9LRB7; Match level="QueryCoverage=35%, HitCoverage=19%, E-value=2e-09, Identity=43%"; Hit description=E3 ubiquitin-protein ligase EL5
  Pfam annotation: Domain name=PHD; Domain location=99-144; Score=-0.8; E_value=0.068; Accession=PF00628.19; Description=PHD-finger
  Pfam annotation: Domain name=zf-C3HC4; Domain location=100-141; Score= 44.6; E_value=3.4e-10; Accession=PF00097.15; Description=Zinc finger, C3HC4 type (RING finger)
  Pfam module annotation: Pfam domain module=PHD::zf-C3HC4; Domain location=99-144::100-141
MGDNEGHGDLLSNNLVILLIAMGSAAFVVSMYHVIAICWCNQRITNQNQQQQQRPSQTTEGTSLASVANMIPTHRYSKKKVDSVVQGRSNCDGGDDGDTCAVCLGDFEDGEELRTMPECMHSFHVACIDMWLSSHSSCPICRSSATPSQEVLHSDHDFNYAYQHQHSLDMSTHQFAVTHVMRR

SEQ ID NO: 122082 - protein, 461 aa, Glycine max
  Coding DNA Sequence Number=SeqID_5304
  Gene Ontology: Mol. function=transferase activity, transferring hexosyl groups; Biological process=carbohydrate biosynthetic process
  Homolog annotation: Hit_ID=Q5BMA3; Match level="QueryCoverage=95%, HitCoverage=69%, E-value=0.0, Identity=71%"; Hit description =Secondary cell wall-related glycosyltransferase family 8
  Pfam annotation: Domain name=Glyco_transf_8; Domain location=295-460; Score=102.8; E_value=1e-27; Accession=PF01501.10; Description =Glycosyl transferase family 8
MEVQTLTTVNELYKRRLPRSKVKDAEKPFHLSVQDRSSRCKLSFLKLILLITICGTFVTLLYSPEVYNTNHLSSSGSRWIWGGSDPRYMSNVATDWDDILKITEKLTGEDELEGIGLVNFNKTELAQWEHLIPEATHVVLPLEYAARNVTWESLYPEWIDEEEETQVPVCPSLPSLRSPGIRLNLITVKLPCRNGGNWSRDVARLHLQLAAASLATSFKGNYPVYVLFVTNCFPIPNLFTCKELVARQGNAWLYKPNLSVLREKVQLPVGSCELALPMRGKELVYNGNAPREAYATILHSAHVYVCGAIAAAQSIRMSGSTRDLVILVDETISSYHRSGLEAAGWKVRTIQRIRNPKAEKDAYNEWNYSKFRLWQLTDYDKIIFIDADLLILRNIDFLFGMPEITATGNNATLFNSGVMVVEPSNCTFQLLMDHINEIESYNGGDQGYLNEYSHGAQIPDT

SEQ ID NO: 122083 - protein, 253 aa, Glycine max
  Coding DNA Sequence Number=SeqID_5305
  Gene Ontology: Mol. function=enzyme inhibitor activity; Cellular component=cell wall; Biological process=cell wall modification
  Homolog annotation: Hit_ID=Q9FXW9; Match level="QueryCoverage=97%, HitCoverage=42%, E-value=1e-113, Identity=75%"; Hit description =Pectin methylesterase-like protein
  Pfam annotation: Domain name=Pectinesterase; Domain location=1-246; Score=427.3; E_value=2e-125; Accession=PF01095.10; Description =Pectinesterase
MGKTVITGSANVGQPGMTTYNSATVGVAGDGFIAKDLTIQNTAGANAHQAVAFRSDSDLSVIENCEFIGNQDTLYAHSLRQFYRSCRIIGNVDFIFGNSAAIFQDCEILVRPRQARPEKGENNAITAHGRTDPAQSTGFVFQNCMVNGTEEYMALYYSKPKVHKNYLGRPWKEYSRTVFIHSFFEALITPQGWMPWSGDFALKTLYYGEFQNSGPGSNLTQRVPWSNQVPAEHVFSYSVQSFIQGDDWNHHLS

SEQ ID NO: 122084 - protein, 224 aa, Glycine max
  Coding DNA Sequence Number=SeqID_5306
  Homolog annotation: Hit_ID=Q84T58; Match level="QueryCoverage=40%, HitCoverage=20%, E-value=8e-15, Identity=46%"; Hit description =Expressed protein
MAEEEKHQQLQQEQDPHKLFRSYIGLSFSMFLAMLANNSVPALQGKVRSLSLRAADAAEELRQMKSRRQEDSKANARVVEIFASHRNAWQAEEKRLLHQIDAAAEEIARLRGRVAELEDAAARAERDVAERDEMIGFMSRRIEDEGLGGREREREREVYGKKSEEWFQKEEDEMVGSTARSLEEEVEVIYEEQHSQHFGNNNGFDSEFMASASKFWAEKASLWQ

SEQ ID NO: 122085 - protein, 59 aa, Glycine max
  Coding DNA Sequence Number=SeqID_5307
MVSSRGNGARRRYFRSLEERLELENADLEMNKKHVHKGDGNDDEDHGNEDGAVMTATIG

SEQ ID NO: 122086 - protein, 183 aa, Glycine max
  Coding DNA Sequence Number=SeqID_5308
  Gene Ontology: Mol. function=transferase activity, transferring hexosyl groups; Biological process=carbohydrate biosynthetic process
  Homolog annotation: Hit_ID=Q5BMA3; Match level="QueryCoverage=98%, HitCoverage=28%, E-value=4e-89, Identity=79%"; Hit description =Secondary cell wall-related glycosyltransferase family 8
MEGTRVYLNEIFTWWHRIPRHMNFLKHFWIGDEEEKKQMKTLLFGAEPPILYVLHYLGVKPWLCFRDYDCNWNADIFHEFASDVAHAKWWKVHDAMPELLQQFCLLKSKQKAQLEWDRRQAEIANYTDGHWQIKVKDRRLKKCIDNLCNWKSMLRHWGETNWTDDEFYTPTPPTVTTTSLSAL

SEQ ID NO: 122087 - protein, 97 aa, Glycine max
  Coding DNA Sequence Number=SeqID_5309
MKLVKDGPEVQKRSMAMPLPVLCVEDGVAILRFSEIFGIHEPLRKGEKREHRHSIPRGEKAMMLTWSFQNLDFFMRMPQWTGKMINNQRTRVIVLNR

SEQ ID NO: 122088 - protein, 246 aa, Glycine max
  Coding DNA Sequence Number=SeqID_5310
  Homolog annotation: Hit_ID=Q67W65; Match level="QueryCoverage=60%, HitCoverage=8%, E-value=8e-46, Identity=66%"; Hit description =Putative HAC13 protein
  Pfam annotation: Domain name=TBP-binding; Domain location=43-98; Score=15.6; E_value=0.0067; Accession=PF09247.1; Description=TATA box-binding protein binding
MGYDSDSPSQDGRDEGEFFFDEIWFVNSMFGEFEMIDDEEEYEDSGKGNRFLGFMFGNVDNSGDLDVDYLDEDAKEHLSALADKLGPSLTDIDLSGKSPQTPPDVVEQDCDVKAEDAVDYEDIDEEYDGPETEAANEEDYLLPKKEFFSSEASVCLESKASVFDDENYDEESEKEQDFVNDDSKVYNIPLAGEQEESFVDASKEESSLEHELHVDSPQTEELDADVQKLEEGNDIKEIECIEINIF

SEQ ID NO: 122089 - protein, 149 aa, Glycine max
  Coding DNA Sequence Number=SeqID_5311
  Gene Ontology: Mol. function=enzyme inhibitor activity; Cellular component=cell wall; Biological process=cell wall modification
  Homolog annotation: Hit_ID=Q9FXW9; Match level="QueryCoverage=78%, HitCoverage=20%, E-value=3e-17, Identity=44%"; Hit description =Pectin methylesterase-like protein
MAVPAAVLVAEGGAHPGAGVFGGAAGEGGGGEGGAVVGVVEDLEAALCGGGAGVVVWGGVDDGLHLGSREEEVGGGGCEGGMDDLEGGGVGGEVGEEGGVALEREARGFAGLVDLSHGGVRVVEEEEDEEEGENGGHGDEKEEEAGSEN

SEQ ID NO: 122090 - protein, 595 aa, Glycine max
  Coding DNA Sequence Number=SeqID_5312
MRNSARTVQRRYDSDHRVCKDRIQELCKEVLCWGIPLRAWDTENAKKIVGSVGEFKDVDDDVELSRFIGENLVRKSDVCMEVASVFSQFDVKLQPVRVKASGGKVVQNFVTCEPTQTVRGGVEKEEQVHAFGGVQGDHTYTEKDMATSAGEPESKSNGSEDKRGERTQSGVLVGPTNVELADKESPFKRITALEQRENNIVTKKENWANSEGPVASKENGSPILMKGGSGLKEEATNTWTMAKDMGVSYEAEEGKMMSKIAILEGKKQRSGGKVGKQYGKLSEIGWISGYVKHCGGIQRKIIGTRFIVLEGVWRGLQQYKKAIRKSGPQSVGARRRTYEGEKLKRLKQHLKAWNKDQFDDVQQKFSTIEKKLNELEVKGENGPLSGEEGDCNSWYYHLLVNWKHRHNMPRGVSVGGAWIEEPKRVKEAVRQFFRTRFQESPELRPLLDGVDFKTIDQSDNVMLIAPFEEAEVLKSEFLRFLGEFHANGIFSKGSNASFLALIPKVQDLQVGVIDRRMLEVFYSLSVGPDGIDEGQNSNKGESIKKKCGSTGFQMSVIIATSTKGTLLTALILLYGSAGGGGFLLLVVAEKHGKGF

SEQ ID NO: 122091 - protein, 207 aa, Glycine max
  Coding DNA Sequence Number=SeqID_5313
  Gene Ontology: Mol. function=transferase activity; Biological process= metabolic process
MTVLNLPVFGSGSAYLLIGCWVLSVFLVPPPHFDNAPRSYFPLGSVITKSLEFLCMTQSGTMDSIVDSLNNAYQDFVVAAANVLEAKENAGSIKTTATDTALENFKQKWELFRVACDQAEEFVESVKQRIGSECLVDEATRPVAGKPGQATMTGLPPISAVRLEQMSKAVRWLVIELQHGSGAGSANSALTHPSAQFDARFSEDAAQ

SEQ ID NO: 122092 - protein, 273 aa, Glycine max
  Coding DNA Sequence Number=SeqID_5314
  Gene Ontology: Mol. function=nucleic acid binding; Cellular component= mitochondrion; Biological process=metabolic process
  Homolog annotation: Hit_ID=Q0WMY5; Match level="QueryCoverage=98%, HitCoverage=61%, E-value=1e-121, Identity=40%"; Hit description =Membrane-associated salt-inducible protein-like
  Pfam annotation: Domain name=PPR; Domain location=122-156; Score =46.6; E_value=8.4e-11; Accession=PF01535.11; Description=PPR repeat
  Pfam annotation: Domain name=PPR; Domain location=157-191; Score =42.7; E_value=1.3e-09; Accession=PF01535.11; Description=PPR repeat
  Pfam annotation: Domain name=PPR; Domain location=21-55; Score=36.2; E_value=1.1e-07; Accession=PF01535.11; Description=PPR repeat
  Pfam annotation: Domain name=PPR; Domain location=56-90; Score=31.7; E_value=2.5e-06; Accession=PF01535.11; Description=PPR repeat
  Pfam module annotation: Pfam domain module=PPR::PPR::PPR::PPR; Domain location=122-156::157-191::21-55::56-90
MAKAVAILDQMNVAGVGPNEHTYTTLMQGYASLGDTEKAFQYFSVLRNEGLEIDVYTYEALLKSCCKSGRMQSALAVTKEMSAKNIPRNTFVYNILIDGGDVWEAADLMQQMRKEGVLPDIHTYTSFVNACCKAGDMQKATEIIQEMEAFGIKPNLKTYTTLINGWARASMPEKALSCFEEMKLAELKPDKAAYHCLMTSLLSRATFAQSYVYSGLLSVCREMIESEMTVDMGTAVHWSRCLRKIERTGGELTEALQKTFPPDWTSHNALDVN

SEQ ID NO: 122093 - protein, 363 aa, Glycine max
  Coding DNA Sequence Number=SeqID_5315
  Gene Ontology: Mol. function=chitin binding; Cellular component =extracellular region; Biological process=chitin metabolic process
  Homolog annotation: Hit_ID=UPI000044A8F0; Match level="QueryCoverage =59%, HitCoverage=99%, E-value=5e-20, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=38; ConfidenceScore=5.04e-01
RTARPHFRRTTRPRLKRATRPCHQRAARPNLQRVAHPRHQRVTSPNFRGLHVLAFIGLHALTFRGLHVLAFIGLHALTFRGLHVLAFIGLHALTFRELHALTFKGLHVLTFGGLHVLALRGLHILAIRGLHALTFRGLHTLAFRGLHPQTSEDYTSSPSEGYTSSNFRGLHILTFRVLHVLTFRVLHVLTFRGLHAIAFRGLRVLTFSGLHIHALRGFKRPQCRSPPAEVSVGLCRHDIGVAPTRHPVDPKEPNRALGFPALVTGLCQSYRAPVPPASSCHRDIGIVLARHPMDPKKANRFYGVPVAPNKFIRPPINRAFIKKYCAPRQAQGETPQQPGEGRQRATDAPPPPLEFTSAHRQKG

SEQ ID NO: 122094 - protein, 48 aa, Glycine max
  Coding DNA Sequence Number=SeqID_5316
MATIALSSRYGSKLAYDTGIGVVFVIGSAVDRLCGRFRDGLCGYLGGG

SEQ ID NO: 122095 - protein, 412 aa, Glycine max
  Coding DNA Sequence Number=SeqID_5317
  Gene Ontology: Mol. function=RNA-directed DNA polymerase activity; Biological process=RNA-dependent DNA replication
MKANMQAMKEQMTTMMEAMMNMRRMIKVITATIVAASTATEVDLTHPPGFNQVNHPASNMVGQGGVALGNAGGPHFEQIQNKHSFPPCGLPPNYTPPNVVHVPDKSQQLQCDHAHLSQPMEETHEVPRGHILDDFEPHLRYAIEGEAFFSVPPPNISEGPQYRPQPQPLHFVIRRVPPTMVVREKFNHIEDRLRAIEGVFDIAIPPKFKGTTYLKNHLKMYCRKMRAYTKDEKLLMHFFQENLTEATATWYTNLEPSRYQYNSNMALDRMYLQNMCKREHESFKEYTQRWRDLAAQVVPSMMDRVMITMIVDTLPVFYYEKVVGYMPSSFGDLVFAGKRIKVGLRRGKFDYSALMDRKSGENRENKKEGETHDVTIVLTRPNFPLAQQYQYSANINPSYYSPSYQPRTPNHP

SEQ ID NO: 122096 - protein, 137 aa, Glycine max
  Coding DNA Sequence Number=SeqID_5318
  Gene Ontology: Mol. function=oxidoreductase activity; Biological process=electron transport
  Homolog annotation: Hit_ID=Q2PHF4; Match level="QueryCoverage=88%, HitCoverage=9%, E-value=3e-29, Identity=54%"; Hit description =Aldehyde oxidase 1
MIELTLRPTPRKVSIFLDRFDVVEVGGIEVGQGLWTKVKQMAAYALGDIQCEGTEGLLDKVHIVQSDTVSLTQGGFTARSTTSMLGCEALRLCCNMLVERLKPLKEMLQEEMDSIKWETLILQAARINKVKELNFEH

SEQ ID NO: 122097 - protein, 159 aa, Glycine max
  Coding DNA Sequence Number=SeqID_5319
MQAVNLSTSSFYVPSNDSTGYLSYSAAVSEDDPSHYFQAKESHLAWSIDPSSGTFCSIAKAKAEAEAARWAKMEVVEILTDRRLGKIEASLTVEGRMPTTNSNTPTAHAKTVSETTTMHVTSLAMSCIMVVVLIEVEIEVEHEAGKVVMAMVLAVESEI

SEQ ID NO: 122098 - protein, 184 aa, Glycine max
  Coding DNA Sequence Number=SeqID_5320
  Gene Ontology: Mol. function=actin binding; Biological process =cytoskeleton organization and biogenesis
  Pfam annotation: Domain name=Transposase_21; Domain location=7-179; Score=0.4; E_value=1.2e-14; Accession=PF02992.5; Description =Transposase family tnp2
MENQKIHACPNDCILYRNDFAEMHCYPTYGVSRYKVNDEECSVGVIINNRRPTKRKYIMLSMMIAGPRQPGNDIDVYLSPLIEDLRKLWEEGVDVWDGNLHKTFKMHAMVFCTINDFPAYGNLSGYSVKGHHDVAPCGACRPWIFFINGFLCFLKFNGSGIEKEERLLEMPLQGEDESRTSSPP

SEQ ID NO: 122099 - protein, 150 aa, Glycine max
  Coding DNA Sequence Number=SeqID_5321
  Gene Ontology: Mol. function=protein-tyrosine kinase activity; Cellular component=integral to membrane; Biological process=protein amino acid phosphorylation
  Homolog annotation: Hit_ID=Q1SGW7; Match level="QueryCoverage=51%, HitCoverage=12%, E-value=6e-19, Identity=63%"; Hit description =Protein kinase
FPFQYVSNGKGGADVVQWVETAISEGRELEVLDPKIAGSGNWLAEMEQLLHIVAACTESNPQHRLDMAEAIRRIMEIKFEAPTTVINRLTAIERQFLWGGNLEGKKIAWVAWSQGPPKQHFSHWWSDLRSVNHHRSMADSSYKVNMEAQK

SEQ ID NO: 122100 - protein, 496 aa, Glycine max
  Coding DNA Sequence Number=SeqID_5322
  Gene Ontology: Mol. function=metal ion binding; Cellular component =intracellular; Biological process=protein kinase C activation
  Homolog annotation: Hit_ID=Q9C6T2; Match level="QueryCoverage=99%, HitCoverage=82%, E-value=1e-171, Identity=57%"; Hit description=PPR -repeat protein, putative
  Pfam annotation: Domain name=PPR; Domain location=155-189; Score =16.2; E_value=0.09; Accession=PF01535.11; Description=PPR repeat
  Pfam annotation: Domain name=PPR; Domain location=257-291; Score =42.3; E_value=1.6e-09; Accession=PF01535.11; Description=PPR repeat
  Pfam annotation: Domain name=PPR; Domain location=292-326; Score=4.7; E_value=2.1; Accession=PF01535.11; Description=PPR repeat
  Pfam annotation: Domain name=PPR; Domain location=328-362; Score=6.2; E_value=1.4; Accession=PF01535.11; Description=PPR repeat
  Pfam annotation: Domain name=PPR; Domain location=394-428; Score=2.5; E_value=3.8; Accession=PF01535.11; Description=PPR repeat
  Pfam annotation: Domain name=PPR; Domain location=54-88; Score=33.8; E_value=6.1e-07; Accession=PF01535.11; Description=PPR repeat
  Pfam module annotation: Pfam domain module=PPR::PPR::PPR::PPR::PPR::PP R; Domain location=155-189::257-291::292-326::328-362::394-428::54-88
MEEFKQVHAHILKLGLFYDSFCGSNLVATCALSRWGSMEYACSIFRQIEEPGSFEYNTMIRGNVNSMNLEEALLLYVEMLERGIEPDNFTYPFVLKACSLLGALKEGVQIHAHVFKAGLEGDVFVQNGLINMYGKCGAIEHASVVFEQMDEKSVASWSSIIGAHASVEMWHECLMLLGDMSGEGRHRAEESILVSALSACTHLGSPNFGRCIHGILLRNISELNVAVKTSLIDMYVKSGSLEKGLCVFQNMAQKNRYSYTVIITGLAIHGRGREALSVFSDMLEEGLAPDDVVYVGVLSACSHAGLVNEGLQCFNRLQFEHKIKPTIQHYGCMVDLMGRAGMLKGAYDLIKSMPIKPNDVVWRSLLSACKVHHNLEIGEIAAENIFKLNQHNPGDYLVLANMYARAKKWADVARIRTEMAEKHLVQTPGFSLVEANRNVYKFVSQDKSQPQCETIYDMIQQMEWQLKFEGYTPDMSQVLLDVDEDEKRQRLKHHSQ

SEQ ID NO: 122101 - protein, 173 aa, Glycine max
  Coding DNA Sequence Number=SeqID_5323
  Gene Ontology: Mol. function=peptide deformylase activity; Cellular component=mitochondrion; Biological process=translation
  Homolog annotation: Hit_ID=Q9FUZ0; Match level="QueryCoverage=82%, HitCoverage=46%, E-value=3e-38, Identity=67%"; Hit description =Peptide deformylase, mitochondrial precursor
  Pfam annotation: Domain name=Pep_deformylase; Domain location=54-159; Score=-15.7; E_value=6.7e-07; Accession=PF01327.11; Description =Polypeptide deformylase
MELLGNLLVTVFIVRWRICLTPFGLVLFPWSFQTCSARAGWFLGLGANNKKTNLPDTVKVGDPVLHEPAQDVDPIEIKLERVQKIIDDMIQVMRKASGVGLAAPQIGIPLRIIVLEDTKEYISYVSKEEAKTQDRRPADLLVCYFNTPFISSLEAGDPESQARQEGQEDCSVF

SEQ ID NO: 122102 - protein, 564 aa, Glycine max
  Coding DNA Sequence Number=SeqID_5324
  Gene Ontology: Mol. function=nucleic acid binding; Cellular component= nucleus; Biological process=regulation of transcription, DNA-dependent
  Homolog annotation: Hit_ID=Q8LRK9; Match level="QueryCoverage=97%, HitCoverage=28%, E-value=0.0, Identity=64%"; Hit description=HAF1
  Pfam annotation: Domain name=ubiquitin; Domain location=167-236; Score=33.6; E_value=7e-07; Accession=PF00240.13; Description =Ubiquitin family
MMEGSWLDKIIWEELDQPSVKPKLIFDLQDDQMHFEVLDTKDGTHLCLHAGAMILTHSLKLSSGDSSELPGHGSQYGWRYVANDKHYSNRKTSQQLKSNSKKRSAHGVKVFHSQPALKLQTMKLKLSNKDIANFHRPKALWYPHDNEVAVKEQGKLPTQGPMKIIIKSLGGKGSKLHVDVEETLSSVKAKASKKLDFKVSETVKIFYLGRELEDHKSLAAQNVQPNSLLHLVRTKIHLWPKAQRVPGENKSLRPPGAFKKKSDLSVKDGHVFLMEYCEERPLLLSNVGMGARLCTYYQKCSPDDQSGSLLRNTDSRLGHIISLDPADKFPFLGDLKPGCSQSSLETNMYRAPIFPHKVPLTDYLLVRSSKGKLSLRRIDKINVVGQQEPLMEVLSPGSKNLQTYMMNRLLVHMCREFQAAEKRHLPPYIGVDEFLSQFPYQSEASFRKKIKEYANLQRGTNGQSILVKKRNFRIWSEDELRKMVTPELVCAYESMQASLYRLKHLGITETHPTNISSAMSRLPDEAIALAAASHIERELQITPWNLSCNFVACTSQVLHTFALV

SEQ ID NO: 122103 - protein, 139 aa, Glycine max
  Coding DNA Sequence Number=SeqID_5325
VPKVLPQDPAEEGSEGSSAGSNGRTMSSANPAEEPAEPSSTVNISWSRKNLWNLLPPTTFPGHGRTCGTFFRKLPIFLAEEHSKLLPRSMFWCFLELVEGEGISEDTHEADVPLRRRPTASARKQRVRLREDVTERPED

SEQ ID NO: 122104 - protein, 1208 aa, Glycine max
  Coding DNA Sequence Number=SeqID_5326
  Homolog annotation: Hit_ID=Q93Y12; Match level="QueryCoverage=39%, HitCoverage=49%, E-value=0.0, Identity=67%"; Hit description=Alpha glucosidase-like protein
  Pfam annotation: Domain name=FAR1; Domain location=549-732; Score= -62.2; E_value=0.041; Accession=PF03101.5; Description=FAR1 family
  Pfam annotation: Domain name=Glyco_hydro_31; Domain location=1-342; Score=304.8; E_value=1.6e-88; Accession=PF01055.16; Description =Glycosyl hydrolases family 31
  Pfam module annotation: Pfam domain module=FAR1::Glyco_hydro_31; Domain location=549-732::1-342
PTSLVKDLHYSGFKAIWMLDPGIKQEEGYFVYDNGSKKDVWVQKEDGNPYVGEVWPVRCVFPDYTQSKVRAWWANLVKDFISKGADGIWNDMNEPSIFKDVTKTMPDSNVHSGDSELGGCQNHSFYHNVYGLLMARSTYEGMKLANEKKRPFVLSRAGFVGSQRYAATWTGDNLSTWEHLHMSISMVLQLGLSGQPLSGADIGGFAGNASPRLFGRWMGVGSLFPFCRGHSEACTTDHVPWSFGEERRYRLIPLIYTLFYFAHTWGTPVATPTFFADPKDPSLRKLENSFLLGPILVFASTLRRQGLDKLEITLPKGIWLNFDFNDAHPDLPALYLKGGSIIPVGLPHEHVEEANPSDDLTLFVALDDHGKAEGVLFEDDGDGYEFTKGNYLLTHYVAELKSSVLTVSVQKTEGSWERPKRRLHIQLLLGGGAMLDTWGTDGEVLQLILPSEDEVSELVSTSEKNYKDRLENATPIPDVEVEVEVEEVSGPMETQILRIPIEQQSDIEDHVSQTPEEASTPTDGATNIADCSDAFKTTELFPSRDAVLNWAREVAKENGFVLTILRSGKYRPYKNTLSKVTSSKKCECPFKLKGKALNKDEGWIVKVMCGYHNHDLGETLVVGHSYAGRLTAEEKSLVIDMTKKMVEPRNILLTLKDHNNDTTIRHIYNARQAYRSSQKGPRTEMQHLLKLLEHDQYVCWSRKVDDSDAIRDIFWAHPDAIKLLGSFHTVLFLDNTYKVNRYQLPLLEIVGVTSTELTFSVAFAYMESDEVDNFTWALQKLRELIVKDNEMPPVIITVRDIALMDAVQVVFPSSSNLLCRFHISKNVKAKCKLIVHPKERYDLVMDAWDSVMNSPNEGEYMQRLTLLEKVCSDFPTFGDYVKNTWLIPHKEKFVMAWVDRVMHLGNTTIDRFETAHWRLENLLQDSGGDMCSCWDAVNNMIKLQHTQIKVSFEKSINIVEYNDPFYSKLRGFVSRNALSYIADHYDRVKTVGIDIDGSLCGCTIRTTHGLPCACELAKYSRTWHPIPLQAIHVHWRTLNFSDQEMNNEGLELALQREVDALHNQFQELDYAGKITLKAKLRELAFPDAILMCPSPENYFDAPKALAHESFAQIPVEIHPFIEDIVDVKQTRNVKGLVDDSSVADGWCGSEKEWCIEKEQCKGGGGAAAHCVALLAISHVLCLCCCFSLNVGEGDEDLFESGKKVESDG

SEQ ID NO: 122105 - protein, 136 aa, Glycine max
  Coding DNA Sequence Number=SeqID_5327
  Gene Ontology: Mol. function=actin binding; Biological process=actin cytoskeleton organization and biogenesis
  Homolog annotation: Hit_ID=Q1SZ88; Match level="QueryCoverage=99%, HitCoverage=7%, E-value=2e-19, Identity=35%"; Hit description=IMP dehydrogenase/GMP reductase
MNHLENPALPGLRGLAEDEEGGEEEGEEGPAAALAVEEDQGAGVGEAGVAKAEEVVEEGEGEEGAALVLLWVVDDECGVQVAEDAGETAAVVAVAKVEGHEGGFREVLVEVREDLAEVEAVHSVRECLRREAGIED

SEQ ID NO: 122106 - protein, 981 aa, Glycine max
  Coding DNA Sequence Number=SeqID_5328
  Gene Ontology: Mol. function=actin binding; Biological process=actin cytoskeleton organization and biogenesis
  Homolog annotation: Hit_ID=Q1SZ88; Match level="QueryCoverage=97%, HitCoverage=87%, E-value=1e-138, Identity=61%"; Hit description=IMP dehydrogenase/GMP reductase
  Pfam annotation: Domain name=FH2; Domain location=229-943; Score =467.2; E_value=2e-137; Accession=PF02181.13; Description=Formin Homology 2 Domain
  Pfam annotation: Domain name=Tropomodulin; Domain location=68-863; Score=-143.3; E_value=0.1; Accession=PF03250.5; Description =Tropomodulin
  Pfam module annotation: Pfam domain module=FH2::Tropomodulin; Domain location=229-943::68-863
MWPGGTLGRSGPHRRGHCLWIVLFSEGFLGLMGAMGAGHCLGFLAGICLADCDVIKIDIQCLVKGDVVLECVHLDLDPEREVMMFRVMFNTAFIRSNILMLNSENLDILWDSKERYPKGFRAEVLFGEVESISPPRAQTSILDGEVKGGLPIEAFSRVQELFSGVEWVESGDAAAAWLLKQLTVLNDAKELSRFQGRGSWYSSPADSDSENNESSTADSSDEAFDVIPKSYADPSKLLISDNPDLVHLAFENNGGDYVNLTSRTPDQSLTDNVSLPHHAPRKEYSPCSSPPSPSPVPATQPFPTPAPPLPTSMPIQPDLAPPLPPHQIDQNVNSASTLPSPPPPIVSNAPSQSPPPPPPPPLPPRSVQTGSAPPPPGPVRTGSVPPPPPPPGSVKTGSAPPPPPPPSPVRTGSAPPPPPPPPCPVRAGSAPSPPPPPPPPPGPVRTGSALPPPPPPPPPPGPVRTGSAPPPPPPPPPGPVRTGSAPPPPPPPSVRTGSTPPPPPPAPKPPGVLPPPPGRGASPMPPPPPAARAPGVAPPPGKASTANVGRGRGTGGTVNAPKKTLLKPLHWVKVARAAKGSLWADSQKQDSGTRAPEIDISELESLFSAASTSDGSSTKGGGRRGPNINKPEKVQLVDLRRAYNCEIMLSKIKIPLPDMLKAVLALDSAILDIDQVENLIKFCPTKEEMEMLKNYTGNKEMLGKCEQFFMELMKVPRVESKLRVFAFKITFSSQVNDLKLNLNTINNAAREVLFNCSWLTNMEVKESGKLRQIMQTILTLGNALNQGTTRGSAVGFKLDSLLKLSDTRARNNKMTLMHYLCKLLAEKMPELLDFDKDLVHLEAASRIQLKALAEEMQAVSKGLEKVEQELAASENDGAISTGFRKVLKNFLDIAEADVRSLISLYSEVGRSADSLSQYFGEDPARCPFEQVTQILVVFVKMFNKSREENERQADAEKKKLEKEALKERTANNLHSKKDGVR

SEQ ID NO: 122107 - protein, 287 aa, Glycine max
  Coding DNA Sequence Number=SeqID_5329
  Homolog annotation: Hit_ID=Q8LRK9; Match level="QueryCoverage=57%, HitCoverage=8%, E-value=5e-22, Identity=40%"; Hit description=HAF1
VTAADQRECQEIWVRQVQSLSAVNGDENESDSEGNSDLDSFAGDLENLLDAEECEEGEEGTNDLKRDKGDGVKGLKMRRRPTLAQAEEEIEDEAAEAAELCRLLMDDYEADRKKKKKAKVMVGEARLVPKMQSKFSFDNAEQVKQITNTLQLDGTNHLKEDAITDLREEENVPAKKSKSLKVNKAKKNDIMPIRGQQEEWCKELWKIKIPSKIAVFAWWLLRDKLPTKKNLLRRQMQIQDMCCPFCRGAEEEAYTTFSPAYRYTDRRIKRQEMEVLVVGDNMGYLEA

SEQ ID NO: 122108 - protein, 57 aa, Glycine max
  Coding DNA Sequence Number=SeqID_5330
MASFFFNALKFGSLLLLHSVNGRRIDYMSDVWWLRLKTKVLPREEPSSTHVEGAVGY

SEQ ID NO: 122109 - protein, 347 aa, Glycine max
  Coding DNA Sequence Number=SeqID_5331
  Gene Ontology: Mol. function=RNA-directed DNA polymerase activity; Cellular component=chromatin; Biological process=chromatin assembly or disassembly
  Subcellular localization annotation: CTP_CleavageSite=32; ConfidenceScore=5.07e-01
MEIWKQSPLPCLRHSRRNWGEVSNPKFASWFPCSSTNCPSWNNCIQNVLNLTKASAFQVLTVSYHDLQWCGVTTGKTELGNESLLNKIVGAPPIHQQEHDLAGDCCNQTKCFRCNVARERIKVDLGQVNQSPRSGREANSFSVKHQIVRAGGERDEEGNRGGKGGRQGEGSESGGEGGGGDGRDRGGRRESWSFSSYKRARPAAWTNLRRNGAGIPTTRLAKSSNSYSLNNEPVGSSYWDGANLVCRACRKIGQEVNWSLLVIHWNQAKALPSISNQVGQCHRIWAPLTSFCGLMQEQVGGGGGGGEKVRRNKTSPRRSDGGEMFAESVMGATTRTPNDRPHGACCI

SEQ ID NO: 122110 - protein, 456 aa, Glycine max
  Coding DNA Sequence Number=SeqID_5332
  Gene Ontology: Mol. function=RNA-directed DNA polymerase activity; Cellular component=chromatin; Biological process=chromatin assembly or disassembly
  Pfam annotation: Domain name=Chromo; Domain location=356-407; Score =14.3; E_value=0.02; Accession=PF00385.14; Description='chromo' (CHRromatin Organisation MOdifier
  Pfam annotation: Domain name=zf-H2C2; Domain location=79-120; Score =12.3; E_value=0.0083; Accession=PF09337.1; Description=His(2)-Cys(2) zinc finger
  Pfam module annotation: Pfam domain module=Chromo::zf-H2C2; Domain location=356-407::79-120
MGFDYTIQYRSGNHNQEADALSRLPEQDQATFMILSMPCLTFMEELRRQLANHQSTNISFNKSLPRGLPLIATLLTEYHATPTRGHTGVAKTIAWVLENFYWSGLHEDVAQFVAKCVDYQVTKYEAKRLAGLLCPLSVPSRPWVDLSLDFIVGLPPYHGNTVILVIVDKFSKGIHLGMLPVTHTALMGPVVHQQILARTLLFEWHPTANELRLSPSNAWGKLLPWVEWSHNTSWNAGTGTTPFEITFGRKSFNFPEYIAGIAKAIRKKLLKAQERMKTYADMKRREAITGKLVKRYYWPFQIKERISPVAYRLQLPKGARIHPVFHCSMLKPFKGSPEKTKPIELPPTFTNNQLLISPLAILDYRRRSSEPNATWKVLVQWHGLSSYETSWEDWPQLCQDFHLEDKVTLQGSRDDTETGAAKGITQAMNTKAETGVQVADKPKRRITKPTYLNDYV

SEQ ID NO: 122111 - protein, 588 aa, Glycine max
  Coding DNA Sequence Number=SeqID_5333
  Gene Ontology: Mol. function=ATP-dependent helicase activity; Cellular component=intracellular; Biological process=DNA recombination
  Homolog annotation: Hit_ID=Q2QZ07; Match level="QueryCoverage=94%, HitCoverage=90%, E-value=1e-178, Identity=69%"; Hit description=ATP -dependent DNA helicase, RecQ family protein, expressed
  Pfam annotation: Domain name=DEAD; Domain location=90-261; Score =116.7; E_value=6.7e-32; Accession=PF00270.19; Description=DEADDEAH box helicase
  Pfam annotation: Domain name=ResIII; Domain location=86-255; Score= -38.0; E_value=0.071; Accession=PF04851.6; Description=Type III restriction enzyme, res subunit
  Pfam module annotation: Pfam domain module=DEAD::ResIII; Domain location=90-261::86-255
MENNEILEELLNIEVEIQDVQEQIRALIERQESLYERKSELSAILEACKESGNEANNAASSAAENWSGEFEWDSEADDVRLNVFGISSYRANQREIINAIMSGRDVLVIMAAGGGKSLCYQLPAVLRDGIALVVSPLLSLIQDQVMGLTALGIPAYMLTSTNKGDEKFIYKTLEKGEGELKILYVTPEKISKSKRFMSKLEKCHHAGRLSLISIDEAHCCSQWGHDFRPDYKSLSILKTQFPRVPIVALTATATQRVQNDLIEMLHIPRCVKFVSTVNRPNLFYMVKEKSSVGKVVIDEIAEFIQESYPNNESGIVYCFSRKECEQVAKELRERGISADYYHADMDVNAREKVHMRKVVELAEMDFLLNAYCTLDPVMLHVRHIVPLLNYVIKCHNNFLRAQWSSTKIQDCRISMTLYDIVCPKDNADEVPFSIILLSHFKSAMALYTLNVTGMCDICAFSSEVKEVDVSEEFQHTPYATNAYIAVGSLAKQILQGKKSVKLEIYTEQRTKDGVRSAKQCLGSSGLELKLDELRKELSSAHGGILPHSVLSTEQIIQLASQKPNSLEQASSKLFGEADWKIEDRKVWK

SEQ ID NO: 122112 - protein, 66 aa, Glycine max
  Coding DNA Sequence Number=SeqID_5334
MYVIVSLGRSLTFKAKVRLQEDFDDANSQAYPRPTQEDFDFKKDLSSWIISSKHQAIQDIQVRLTR

SEQ ID NO: 122113 - protein, 101 aa, Glycine max
  Coding DNA Sequence Number=SeqID_5335
MFLSFSAIKAKTTTKKKAKRPSKVTPKIGEGNWYLARGKGVIGDAIRGFGEGESEGGEGAKGNRIQMKPGFIATEVMEEDETLAEQKRTDGIYLSHASLVE

SEQ ID NO: 122114 - protein, 178 aa, Glycine max
  Coding DNA Sequence Number=SeqID_5336
  Gene Ontology: Cellular component=nucleus
  Homolog annotation: Hit_ID=Q2HVJ8; Match level="QueryCoverage=96%, HitCoverage=27%, E-value=2e-48, Identity=63%"; Hit description =Nuclear protein SET
MQEDEVFKVSSMLEEVQYTTFYFSYFPWNDRLLAPAFVTETVFYLSLLAGPERERQLSDTDVQSAVWEVCGDSGALQSLVDLLHVKMMDLEESSGTEENDLDFLKKTLIIDNHEDSKQCTSNLSTKSNDLEEPKLMTRNKWSAIVYRCGQKQLTRLFLEEAEHALQLSLGEEKVTSPC

SEQ ID NO: 122115 - protein, 151 aa, Glycine max
  Coding DNA Sequence Number=SeqID_5337
  Gene Ontology: Mol. function=protein binding; Cellular component =cytoskeleton; Biological process=signal transduction
  Homolog annotation: Hit_ID=Q9FNP4; Match level="QueryCoverage=78%, HitCoverage=70%, E-value=6e-48, Identity=73%"; Hit description =Arabidopsis thaliana genomic DNA, chromosome 5, P1 clone:MAF19
  Pfam annotation: Domain name=Ank; Domain location=13-45; Score=45.0; E_value=2.5e-10; Accession=PF00023.20; Description=Ankyrin repeat
  Pfam annotation: Domain name=Ank; Domain location=48-82; Score=22.3; E_value=0.0017; Accession=PF00023.20; Description=Ankyrin repeat
  Pfam module annotation: Pfam domain module=Ank::Ank; Domain location =13-45::48-82
MDVNVSAWGPKSKGVTPLHLAAEGGHIGVMDVLLERGADIDARTKGACGWTPLHIAAKERRRDAVKFLLENGAFMPPDISDSRFNPPLHYCPGLEWAYEEMKRLRQEDLSAGETSYSSENYVQNSEPVQKVLLLLCCGNMFYKPEFRIHVF

SEQ ID NO: 122116 - protein, 76 aa, Glycine max
  Coding DNA Sequence Number=SeqID_5338
  Pfam annotation: Domain name=DUF1909; Domain location=2-51; Score= -8.4; E_value=0.054; Accession=PF08927.1; Description=Domain of unknown function (DUF1909)
MTRGKQKIEAQKRNAERNQKGKGSQLEARAVGLKVICPICKDYLCNGCCWVSYPMAWPQPRIKCMLHLHFAMLIGD

SEQ ID NO: 122117 - protein, 124 aa, Glycine max
  Coding DNA Sequence Number=SeqID_5339
MQGKETSDPEHGKQCPFFEELHAVFTQRAHNMQRLLLESETRSAQTNKGVKRSSGEQSSGELSEDDDEVEYDSEEEKPSRSNTRKRKVDKVGVEKSSRANSPSNAAKKIGKENLVDERSIYRGI

SEQ ID NO: 122118 - protein, 169 aa, Glycine max
  Coding DNA Sequence Number=SeqID_5340
  Gene Ontology: Cellular component=nucleus
  Homolog annotation: Hit_ID=Q2HVJ8; Match level="QueryCoverage=100%, HitCoverage=32%, E-value=2e-64, Identity=74%"; Hit description =Nuclear protein SET
MPRSYVFPEMQDAHDICIREADEKRKLIAGSHVKKSDNQTKEGTCNPMTGDTVWVEGLVPGIDFCNHAIRVSYIVTYNLKPIATWEVDGTGLASGVPFSMYLISAAQSPLQIDQEIYISYGNKGNEELLYLYGFVIDDNTDDYLMVHYPAEAINTISFSESKTQLLEVQ

SEQ ID NO: 122119 - protein, 349 aa, Glycine max
  Coding DNA Sequence Number=SeqID_5341
  Gene Ontology: Mol. function=receptor activity; Cellular component =integral to membrane; Biological process=signal transduction
  Homolog annotation: Hit_ID=Q2HVJ5; Match level="QueryCoverage=97%, HitCoverage=84%, E-value=1e-163, Identity=86%"; Hit description=EXS, C-terminal
  Pfam annotation: Domain name=EXS; Domain location=150-322; Score =157.4; E_value=3.8e-44; Accession=PF03124.5; Description=EXS family
MGLYLLQDYDGLALGSKFVGISAIHLKDLEDVSIAWIDAAATCSTWMTIIVPTSMTAYLYLYSHGEVLLYILVAVILIFPFDIFYLSSRYFFLRTLFRIAFPFQPITFPDFFLADILTSMAKVFSDLERSVCRMVNRQVATIAWLEADSVCGSHSVAIPIALVLPYIWRLFQCLRQYRDTKEKNCLFNALKYSTAVPVIFLSALKYHVLHEKWTTLYRPLWLLSSVINSLYSFYWDITRDWDLSGFSRIFKFNKSNPISNLLYGRQWVYFWVIGSNFVLRCSWTYKLSAHLRHNYLTVFTITLLEMFRRFQWVFFRVENEWNKITRSGVQLTEIPREEEKLLGSNIHDV

SEQ ID NO: 122120 - protein, 138 aa, Glycine max
  Coding DNA Sequence Number=SeqID_5342
  Gene Ontology: Cellular component=nucleus
  Homolog annotation: Hit_ID=Q5VRK0; Match level="QueryCoverage=88%, HitCoverage=27%, E-value=1e-31, Identity=49%"; Hit description=SET domain-containing protein-like
MASSEEAKLETFMQWLQANGVELRGCKIKWCDSKRGFGIFSDKDVSDDLAITPMRVLQDPLLGPACRAMFEEGDVDDRYLDILPTTFGNPLWFSDDELQELRGTTLYRATELQYIFLMNTKYLNDIEGACTRYNMKIA

SEQ ID NO: 122121 - protein, 63 aa, Glycine max
  Coding DNA Sequence Number=SeqID_5343
MDYGGGLLKILDGTTPPFKRRSFSLQMCMVLILILALLRLPLAAATLRKFDFKFILVLVVAEH

SEQ ID NO: 122122 - protein, 73 aa, Glycine max
  Coding DNA Sequence Number=SeqID_5344
MLRNFTDYLTIEVKYLEAVKRRFHATKQWSPNEIRVSRSMDTPLKQQPSLGENLENFLAPAGVINVGDHQDHN

SEQ ID NO: 122123 - protein, 75 aa, Glycine max
  Coding DNA Sequence Number=SeqID_5345
  Gene Ontology: Mol. function=structural constituent of ribosome; Cellular component=ribonucleoprotein complex; Biological process =translation
  Homolog annotation: Hit_ID=P16181; Match level="QueryCoverage=50%, HitCoverage=23%, E-value=3e-09, Identity=73%"; Hit description=40S ribosomal protein S11-1
  Subcellular localization annotation: CTP_CleavageSite=45; ConfidenceScore=5.18e-01
MEFVFVEFVSATYQLSSKKTRKGKSPGKGGNRFWKSIVVGFKTPREVIKGDFFVFFSRCQGLLLIVLCVLVSDQC

SEQ ID NO: 122124 - protein, 152 aa, Glycine max
  Coding DNA Sequence Number=SeqID_5346
MTSHSSSATSKGLSNWLAAIWFSAAFRVSKNIIEVPLSYHRQWRPYYPTRYFFSDGLKQFRRTHDIDDSVIMRFFIADKNTSFEVDVIGPIHRQGCPRSVLATRRHIFTPDVTEHMMQHNFPLVLPPAALNFLFGSQKVIPVRRGYGKRNQW

SEQ ID NO: 122125 - protein, 290 aa, Glycine max
  Coding DNA Sequence Number=SeqID_5347
  Gene Ontology: Mol. function=helicase activity; Biological process =viral genome replication
  Homolog annotation: Hit_ID=Q9LTU4; Match level="QueryCoverage=99%, HitCoverage=23%, E-value=2e-78, Identity=44%"; Hit description =Helicase-like protein
MLDENNAHAKSFRMARDRLTGTEVHNVKLKLIFGREKDGRTYNVPSVPDVAALIAEDGYRPDILHRDTLSGKKRKRNCLTMREWFAYRLQCRPNEGQTLLHSRKLFQQFVAEGYTMIESERLSYVRKNQKKLRVDKFCSLQQSSDAGNTKGLSKGKRIILPSTFVGSPRYMDQLYFDGIAICSHVGFPNLFITFTCNPNWPEIHRLLTPLNLTAIDKPEIISRIFKLKYEHMLSDLTKNHLLGKVVAYMYTIEFQKRGLPHVHLLLFLHAINKYPSPNDIDHIISAEIPS

SEQ ID NO: 122126 - protein, 127 aa, Glycine max
  Coding DNA Sequence Number=SeqID_5348
  Gene Ontology: Mol. function=indole-3-acetic acid amido synthetase; Cellular component=cytoplasm; Biological process=auxin homeostasis
  Homolog annotation: Hit_ID=Q05680; Match level="QueryCoverage=99%, HitCoverage=24%, E-value=9e-55, Identity=73%"; Hit description=Auxin- responsive GH3 product
ELQKAVENASELLKEFNTSVAEYTSFADTKSIPGHYVIYWELMMKDSSHPPTNQVLNQCCLVMEESLNSVYRQGRVADNSIGPLEIRVVKNGTFEELMDYAISRGASINQYKVPSPAAPHWTPERRR

SEQ ID NO: 122127 - protein, 59 aa, Glycine max
  Coding DNA Sequence Number=SeqID_5349
MGTIKCNDHGQIKAPKHPDSECLDFLTTLVPHEWAIQQGKFNMQQGQTIILIAKFPDLN

SEQ ID NO: 122128 - protein, 101 aa, Glycine max
  Coding DNA Sequence Number=SeqID_5350
MAVSKLINDVKNYGYLEGKRKVRSGFALNRNRKASWKIPLRLKGFSRCGVSTENNGGLWWLLVAVDDGESAWDVGNGFGRKKEKKWRFSNSNWTTRLKTHK

SEQ ID NO: 122129 - protein, 683 aa, Glycine max
  Coding DNA Sequence Number=SeqID_5351
  Gene Ontology: Mol. function=amino acid-polyamine transporter activity; Cellular component=integral to membrane; Biological process=amino acid transport
  Homolog annotation: Hit_ID=P0AAE2; Match level="QueryCoverage=63%, HitCoverage=95%, E-value=0.0, Identity=84%"; Hit description=Proline- specific permease proY
  Pfam annotation: Domain name=AA_permease; Domain location=1-438; Score=448.9; E_value=6.5e-132; Accession=PF00324.11; Description =Amino acid permease
  Pfam annotation: Domain name=Spore_permease; Domain location=1-333; Score=-158.3; E_value=0.016; Accession=PF03845.4; Description=Spore germination protein
  Pfam module annotation: Pfam domain module=AA_permease::Spore _permease; Domain location=1-438::1-333
MALGSAIGTGLFYGSADAIKMAGPSVLLAYIIGGVAAYIIMRALGEMSVHNPSASSFSRYAQENLGPLAGFITGWTYCFEILIVAIADVTAFGIYMGVWFPAVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNLVGTNGSPFVLTFQHMGITFAAGILNFVVLTASLSAINSDVFGVGRMLHGMAEQGSAPKVFAKTSRRGTPWVTVLVMTVALLFAVYLNYIMPENVFLVIASLATFATVWVWIMILLSQIAFRRRLSPEEVKALKFKVPGGVATTVVGLLFLVFIIALIGYHPDTRISLYVGFAWIVLLLVGWKIKTRRDRQLAQAHYTPVHCGKVWPLRKKRNDDVEGLAPAEEDNEELSLPMQRLRQSPHADVVAWRGEINLMNGQPRRRYSFKLLWADRQLWFTPQGFQRFPPARLEQFAVDVPDSGPQWVPDQVFYQIFPDRFARSEAREAGQDEVYYHHAAGQDIVLKAWDEPLTGEAGGSTFYGGDLDGISEKLPYLKQLGVTALYLNPVFVAPSVHKYDTADYRRVDPQFGGDAALLRLRHNTQREGMRLILDGVFNHTGDSHP

SEQ ID NO: 122130 - protein, 645 aa, Glycine max
  Coding DNA Sequence Number=SeqID_5352
  Gene Ontology: Mol. function=pepsin A activity; Cellular component =cellulose and pectin-containing cell wall; Biological process =proteolysis
  Homolog annotation: Hit_ID=Q1SED9; Match level="QueryCoverage=96%, HitCoverage=96%, E-value=0.0, Identity=72%"; Hit description =Peptidase aspartic, active site
  Pfam annotation: Domain name=Asp; Domain location=92-433; Score= -19.2; E_value=1.8e-12; Accession=PF00026.14; Description=Eukaryotic aspartyl protease
MASLWTQLISMASLLLSLARWVPVSGDSSNVLLLPSPHHEGSRPAMILPLHHSVPDSSFSHFNPRRQLKESDSEHHPNARMRLYDDLLRNGYYTARLWIGTPPQRFALIVDTGSTVTYVPCSTCRHCGSHQDPKFRPEDSETYQPVKCTWQCNCDNDRKQCTYERRYAEMSTSSGALGEDVVSFGNQTELSPQRAIFGCENDETGDIYNQRADGIMGLGRGDLSIMDQLVEKKVISDSFSLCYGGMGVGGGAMVLGGISPPADMVFTRSDPVRSPYYNIDLKEIHVAGKRLHLNPKVFDGKHGTVLDSGTTYAYLPESAFLAFKHAIMKETHSLKRISGPDPRYNDICFSGAEIDVSQISKSFPVVEMVFGNGHKLSLSPENYLFRHSKVRGAYCLGVFSNGNDPTTLLGGIVVRNTLVMYDREHTKIGFWKTNCSELWERLHVSDAPPPLLPPKSEGTNLTKSFEPSIAPSPSQYNLQLGELQIAQIIVVISFNISYMDMKPYITELTGLIAHELDVNSSQVHLMNFSSLGNGSLSKWVITPRPYADFFSNATAMSMIARLSEHRMQLPNSVGSYKLVDWNAEPPLKRTWWQQYYLVVALAVLLTFVLGISTLGIFLIWKKRQQAEHSYKPVDVAVQEQELQPL

SEQ ID NO: 122131 - protein, 122 aa, Glycine max
  Coding DNA Sequence Number=SeqID_5353
AHGGDPQAPDAPPPPHQADPAGSFDTEWYLWHLVRPQAANHRAHMQTHDCLYQLSLSLQSQGFAPFPCLTLDQFRAEVAWPGDWPEAQAREAPAEAPDDADEARMDEEMTDLLDFLGRSGAT

SEQ ID NO: 122132 - protein, 181 aa, Glycine max
  Coding DNA Sequence Number=SeqID_5354
  Gene Ontology: Mol. function=binding
  Homolog annotation: Hit_ID=Q6L4Y6; Match level="QueryCoverage=95%, HitCoverage=40%, E-value=4e-34, Identity=35%"; Hit description =Putative tetratricopeptide repeat (TPR)-containing protein
MPLTDDQEHILALSGLWKIAITNPNDPEFPSLGIFRCMVKLIQKGVNHKDWLLRCQNMYTPYYAAHIIGSYTMNKPKFADKSVKSNVVQPLIELLRARLVGLSKELHFAHWVIWPAMKQLLKPLLNTKLKWERSLGLICKKKFLKDLCGMWGGLANPTSPAGIGLLRTLCDTQIAEKMLQI

SEQ ID NO: 122133 - protein, 226 aa, Glycine max
  Coding DNA Sequence Number=SeqID_5355
MESWLDPGAPTGGAGGPSNDGDGAGAVCFLLFFVFFFDLGAGAGTSALGATTGAGVVGASAGGELTGTGAGGELTGTGAGGELTGVTAGGVAAGGVAAGGVAAGGVATGAGAAALDGGDATVGDEAGGVAVAALGDEAGGDDDVGEATGAGDFGLEGAVAGDAKGVVVAAGGEVVGDAAGDCPPTAATTMAMIARERRLFRSIIEVCLSLRIERVRRFINRGPFPP

SEQ ID NO: 122134 - protein, 97 aa, Glycine max
  Coding DNA Sequence Number=SeqID_5356
  Homolog annotation: Hit_ID=Q1RUD8; Match level="QueryCoverage=83%, HitCoverage=17%, E-value=5e-07, Identity=32%"; Hit description=IMP dehydrogenase/GMP reductase
MMLNALWYYDQPLRCFTFGDFLLVPTVEEFEEILGCPLGGRKPYLFSGFYPSMVRIAKVVKISVQELDRVKQNRNGVVGIPRKHLEEKAKALADQGE

SEQ ID NO: 122135 - protein, 509 aa, Glycine max
  Coding DNA Sequence Number=SeqID_5357
  Gene Ontology: Mol. function=oxidoreductase activity; Cellular component=membrane; Biological process=electron transport
  Homolog annotation: Hit_ID=Q1SYG3; Match level="QueryCoverage=99%, HitCoverage=99%, E-value=1e-118, Identity=43%"; Hit description=E -class P450, group I
  Pfam annotation: Domain name=p450; Domain location=30-506; Score =273.9; E_value=3.2e-79; Accession=PF00067.12; Description=Cytochrome P450
MGLWFYLLACISTYILLQSLHKVIRNKRLPPSPPAIPILGNIFWLLKSSKNFADLEPVLRSLRSKYGNIVSIHIGSTPSIFITCHEAAHRALVKNGTIFADRPLALQTTQVFFPNQYTVTTSPYGHNWRFMRQNLMQVIQPSRLSLYSHCRKWALSILKKHILDEIELGNKAIAIDSYFNSTLYALFSYICFGDKFDEETVRNIQRVQHCFLHNFIKFNVLNFVPVLSKIVFRRLWREILGIRQSQVNVFLPIIKARHEKIKGKVGVKDENEEEFKPYVDTLFDMKLPSNGCKLKDEELVSMCAEFMIGGTDTTVTTWIWTMANLVKYQHIQEKLFDEIKEVVEPDEDIEVEHLKRMPYLKAVVLETLRRHPPGHFILPRAVTQDTVMDGHDIPKNAIVNFLVAEFGWDPNVWEDPMEFKPERFLRHGGDSKFDLKGTIEIKMMPFGAGRRVCPAISMATLHLEYFVANLVRDFKWALEDGCEVDMSEKQAFTIVMKNPLRPCVSLRST

SEQ ID NO: 122136 - protein, 139 aa, Glycine max
  Coding DNA Sequence Number=SeqID_5358
MVKNWDLKQTLARIGTLVVCGRKSESFGFGGREEFEVAETVSRWEGRRDSSVKPEKLMAETCSKTTASWASEDGGVVVVVGVGEVVESHHRCCFVVECGVHPRILRDTLPLFLLGDFFWVANSKIEDFGKAKLSQLTPK

SEQ ID NO: 122137 - protein, 328 aa, Glycine max
  Coding DNA Sequence Number=SeqID_5359
  Gene Ontology: Mol. function=protein serine/threonine kinase activity; Cellular component=integral to membrane; Biological process=protein amino acid phosphorylation
  Homolog annotation: Hit_ID=Q9C867; Match level="QueryCoverage=99%, HitCoverage=59%, E-value=1e-168, Identity=85%"; Hit description =Protein kinase, putative
  Pfam annotation: Domain name=Pkinase; Domain location=64-310; Score =159.2; E_value=1.1e-44; Accession=PF00069.15; Description=Protein kinase domain
  Pfam annotation: Domain name=Pkinase_Tyr; Domain location=64-310; Score=99.5; E_value=1e-26; Accession=PF07714.7; Description=Protein tyrosine kinase
  Pfam module annotation: Pfam domain module=Pkinase::Pkinase_Tyr; Domain location=64-310::64-310
ASATVGALLLVALMCFWGCFLYKKFGKNDRISLAMDVGSGASIVMFHGDLPYSSKDIIKKLETLNEEHIIGIGGFGTVYKLAMDDGNVFALKRIVKLNEGFDRFFERELEILGSIKHRYLVNLRGYCNSPTSKLLIYDYLPGGSLDEALHERADQLDWDSRLNIIMGAAKGLAYLHHDCSPRIIHRDIKSSNILLDGNLEARVSDFGLAKLLEDEESHITTIVAGTFGYLAPEYMQSGRATEKSDVYSFGVLTLEVLSGKRPTDAAFIEKGLNIVGVQMESLDALLSVAIQCVSSSPEDRPTMHRVVQLLESEVVTPCPSDFYDSNSD

SEQ ID NO: 122138 - protein, 71 aa, Glycine max
  Coding DNA Sequence Number=SeqID_5360
MDELKRLSIPSEMLKFFNHSIFPHQGHPTRDIRQGQCTPHEHTQHAHVNAFPTSSTFHFHIILNINIISSL

SEQ ID NO: 122139 - protein, 101 aa, Glycine max
  Coding DNA Sequence Number=SeqID_5361
CCFCFSSSTKKSVARNGKRSTGVLSSEHVVEWGKNDEILSDMSTFSVKEQESRLKKALEEEERVSKEAERLVKWVKQESARIDVSTIKSILSDDENEANVK

SEQ ID NO: 122140 - protein, 313 aa, Glycine max
  Coding DNA Sequence Number=SeqID_5362
  Gene Ontology: Mol. function=DNA binding
  Homolog annotation: Hit_ID=Q1S0F5; Match level="QueryCoverage=62%, HitCoverage=40%, E-value=6e-23, Identity=34%"; Hit description=IMP dehydrogenase/GMP reductase
MGQLQHQAFCKAYGKIWDLATVEVFVEAIASLTKYYDQPLRCFTFRDFQLVPTMEEFEEILGCSLGERKPYLFLGFYPFMERVAKVVKISVQELDRVKQNRNGVVGIPRKHLEGKAKALADQGEWVPFINTFALLIFGVVLFPNMEGLVNLAAIDAFLAYHHSKESPAIAILADHYDTFIRRCKKSSTRIVCCIPALYVWLISHLFRQESRPICPLQGFNDPNARVLQGVRKAWDAAQKKDKELRGSSNGVISGYHKWLRVRTQGLDWPPKLKAAREEEAEAPEESEEVQALKVELEKARAVKEKFKSTTIKV

SEQ ID NO: 122141 - protein, 576 aa, Glycine max
  Coding DNA Sequence Number=SeqID_5363
  Homolog annotation: Hit_ID=Q2QYU1; Match level="QueryCoverage=96%, HitCoverage=92%, E-value=1e-126, Identity=47%"; Hit description =Nodulin-like family protein, expressed
  Pfam annotation: Domain name=DUF1218; Domain location=160-259; Score=- 19.1; E_value=0.08; Accession=PF06749.3; Description=Protein of unknown function (DUF1218)
  Pfam annotation: Domain name=MFS_1; Domain location=11-509; Score= -8.6; E_value=0.00078; Accession=PF07690.6; Description=Major Facilitator Superfamily
  Pfam annotation: Domain name=Nodulin-like; Domain location=7-255; Score=368.1; E_value=1.4e-107; Accession=PF06813.4; Description =Nodulin-like
  Pfam module annotation: Pfam domain module=DUF1218::MFS_1::Nodulin -like; Domain location=160-259::11-509::7-255
MAGQSRKWMILVASIWIQAFTGTNFDFSEYSSSLKSHLNISQLQLNYLATASDMGKVFGWSSGLALIHLPLSLVLLIASSMGFIGYGLQWLAIKNLITLPYSLYFLLCLLSGCSICWFNTVCFVLCIRNFPVNRPLALSLTVSFNGVSAALYTLAANSIDPSSDALYLLLNALVPLLTSLVALVPILLQPPLDSLNRSPEASRRNSVIFLVLNFLAIFTGIYLLLFGSTTCDESTSRLYFGGAILLLISPLCIPGTIYARDWFHHAIHSSFRMEGSGFILVHVDDLELHKELLTCQNSALSLSNGDSHGLLSENGSIYVISQSAKSSDLCCDKMFGQDQLAMLGEEHTAAVVVRRLDFWLYYVTYFCGGTIGLVYSNNLGQIAQSLGLSSSISTLVTLYSAFSFFGRLLSAVPDYIRNKFYFARTGWLAIALVPTPVAFILLAVSDSAAALKTGTALIGLSSGFIFAAAVAVTSELFGPNSVSVNHNILITNIPIGSLLYGFLAALIYDENAYNVPGELMADTLVCMGRKCYFWTFVWWGGMSVLGLTSSVLLFLRTKHAYDRFERHRISAQSVVS

SEQ ID NO: 122142 - protein, 946 aa, Glycine max
  Coding DNA Sequence Number=SeqID_5364
  Homolog annotation: Hit_ID=Q944N4; Match level="QueryCoverage=28%, HitCoverage=54%, E-value=1e-101, Identity=67%"; Hit description =Tobacco mosaic virus helicase domain-binding protein
MRGSGLKEVVGWEEQNSEQHVTGASTLVPSPTTCYQEGSMVSKMISMEERDKEEARRLGNREETKKEQLDKVVCQALWGDWDVSWELQPTCNRIWVADGAKATILNIYSPCDFNNIKRTSERVGICQRGQDERIMKEFNEWIADLEVEDVPWEKIKGVKQRLKAWNQTRFGDTQHKLRRIELELNKLENEGDERQWNDQEAAKTIAGGFQNELLVERFDEKEVKVALWECGNEKSHGPDGLNFKFIKEFWDFIKPDLLRFLDEFYVNRVFLNGSNASFLALIPKAEEAFISILVNGSLIAEFTPQRGLRQRDPLAPLLFHIVAEGLSDDTIFFEATTMENVRAIKQWMNSAASYLNCRTMENVRAIKGDFDKVVAVVFVGRRHRAEEDCMGELGFNLLSTKGKKGVMFWEDDGRKMVGNGNCSGGDSFSKLKWLLSLWRTYTIGNANMLLDRDSTDENQDEVFTKLWKLKIPSDVLGGWVKGIWYIADGEVPKTLPHFSTAVPVYLVDGDNFRCRLGMEIAVEEIPFQRDSTDENQDGVFTELWKLKIPSKASFFAWRLIQDKLTFILQLCLNHAALMGIGVLDKHGEEEAELLYHVISLGTFERVAPEWMKEDIMFSPSMCPIFFERISRGIVDSFNSIFIPDNNNYHDTNSPSSSSSSTNRMEASPPPPPLPPSVSNERVAYKLKGYFDLATQEIAKGVRAEEWGLIDDALLHYRNAHSILLEANSTPVPSYITSSEQQKVQSYREKISKWQSQVSERLQTLARRAGSSSANQSTSKLAQTVAVPIKPSSTRKNVLQKPPQRTGQVNKVGSPKSSQGSGVNYDDKLVEMINTAIVDRSPSVRWEDVAGLEKAKQALMEMVILPTKRRDLFTGLRRPARGLLLFGPPGNGKTMLAKAVASESQATFFNVTAASLTSKWVGEGEKLVRTLFMVAISRQPSVIFIDE

SEQ ID NO: 122143 - protein, 997 aa, Glycine max
  Coding DNA Sequence Number=SeqID_5365
  Gene Ontology: Mol. function=protein serine/threonine kinase activity; Cellular component=integral to membrane; Biological process=protein amino acid phosphorylation
  Homolog annotation: Hit_ID=Q9SD62; Match level="QueryCoverage=98%, HitCoverage=95%, E-value=0.0, Identity=44%"; Hit description =Receptor protein kinase-like protein
  Pfam annotation: Domain name=LRRNT_2; Domain location=8-48; Score =51.9; E_value=2.2e-12; Accession=PF08263.3; Description=Leucine rich repeat N-terminal domain
  Pfam annotation: Domain name=LRR_1; Domain location=101-123; Score =12.5; E_value=1.3; Accession=PF00560.23; Description=Leucine Rich Repeat
  Pfam annotation: Domain name=LRR_1; Domain location=149-171; Score =16.5; E_value=0.099; Accession=PF00560.23; Description=Leucine Rich Repeat
  Pfam annotation: Domain name=LRR_1; Domain location=173-195; Score =10.2; E_value=3.5; Accession=PF00560.23; Description=Leucine Rich Repeat
  Pfam annotation: Domain name=LRR_1; Domain location=221-244; Score =8.5; E_value=7.4; Accession=PF00560.23; Description=Leucine Rich Repeat
  Pfam annotation: Domain name=LRR_1; Domain location=246-268; Score =13.3; E_value=0.9; Accession=PF00560.23; Description=Leucine Rich Repeat
  Pfam annotation: Domain name=LRR_1; Domain location=292-314; Score =0.8; E_value=2e+02; Accession=PF00560.23; Description=Leucine Rich Repeat
  Pfam annotation: Domain name=LRR_1; Domain location=322-344; Score =14.4; E_value=0.41; Accession=PF00560.23; Description=Leucine Rich Repeat
  Pfam annotation: Domain name=LRR_1; Domain location=347-369; Score =13.9; E_value=0.59; Accession=PF00560.23; Description=Leucine Rich Repeat
  Pfam annotation: Domain name=LRR_1; Domain location=371-393; Score =7.7; E_value=10; Accession=PF00560.23; Description=Leucine Rich Repeat
  Pfam annotation: Domain name=LRR_1; Domain location=395-417; Score =15.2; E_value=0.24; Accession=PF00560.23; Description=Leucine Rich Repeat
  Pfam annotation: Domain name=LRR_1; Domain location=419-441; Score =9.8; E_value=4.2; Accession=PF00560.23; Description=Leucine Rich Repeat
  Pfam annotation: Domain name=LRR_1; Domain location=443-465; Score =11.4; E_value=2.1; Accession=PF00560.23; Description=Leucine Rich Repeat
  Pfam annotation: Domain name=LRR_1; Domain location=468-490; Score =12.4; E_value=1.3; Accession=PF00560.23; Description=Leucine Rich Repeat
  Pfam annotation: Domain name=LRR_1; Domain location=492-514; Score =10.7; E_value=2.9; Accession=PF00560.23; Description=Leucine Rich Repeat
  Pfam annotation: Domain name=LRR_1; Domain location=516-538; Score =15.9; E_value=0.15; Accession=PF00560.23; Description=Leucine Rich Repeat
  Pfam annotation: Domain name=LRR_1; Domain location=53-75; Score=4.2; E_value=46; Accession=PF00560.23; Description=Leucine Rich Repeat
  Pfam annotation: Domain name=LRR_1; Domain location=540-562; Score =19.9; E_value=0.0094; Accession=PF00560.23; Description=Leucine Rich Repeat
  Pfam annotation: Domain name=LRR_1; Domain location=564-587; Score =5.0; E_value=33; Accession=PF00560.23; Description=Leucine Rich Repeat
  Pfam annotation: Domain name=LRR_1; Domain location=77-99; Score =11.5; E_value=2; Accession=PF00560.23; Description=Leucine Rich Repeat
  Pfam annotation: Domain name=Pkinase; Domain location=683-976; Score =93.0; E_value=9.3e-25; Accession=PF00069.15; Description=Protein kinase domain
  Pfam annotation: Domain name=Pkinase_Tyr; Domain location=683-982; Score=55.1; E_value=7.5e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::Pkinase::Pkinase_Tyr; Domain ...
  Pfam module annotation: Pfam domain module=location=8-48::101 -123::149-171::173-195::221-244::246-268::292-314::322-344::347 -369::371-393::395-417::419-441::443-465::468-490::492-514::516 -538::53-75::540-562::564-587::...
  Pfam module annotation: =77-99::683-976::683-982
MTVIASGNETDHLALFNFKKSISNDPYGILFSWNTSTHFCNWHGITCNLMLQRVTELNLDGYQLKGFISPHVGNLSYMRNLSLSNNNFHGKIPQELGRLSQLQHLSIENNSLGGEIPTNLTGCTHLNSLFSYGNNLIGKIPIEIVSLQKLQYLSISQNKLTGRIPSFIGNLSSLIVLGVGYNNLEGEIPQEICRLKSLKWLSTGINKLTGTFPSCLYNMSSLTVLAATENQLNGTLPPNMFHTLPNLRVFEIGGNKISGPIPPSITNTSILSILEIGGHFRGQVPSLGKLQNLQILNLSPNNLGNNSTNDLEFLNSLTNCSKLQVLSIAHNNFGGQLPNSLGNLSTQLSELALGGNQISGKIPTELGNLINLVLLGLEQSHFQGIIPSAFGKFQKLQLLELSANKLSGDLPAFLGNLSQLFHLGLGENKLEGNIPSSIGNCQMLQYLYLRQNNLRGTIPLEIFNLSSLTQVLDLSQNSLSGSIPKEVNNLKNINLLDVSENHLSGEIPGTIRECTMLEYLYLQGNSLQGIIPSSLASLKSLQRLDLSRNRLSGSIPNVLQNMSFLEYLNVSFNMLDGEVPTEGVFQNASGLVVTGNSKLCGGISKLHLPPCPVKGKKLAKHHNHKFRLIAVIVSVVGFLLILSIILTIYWVRKRSKRPYLDSPTIDQLARVSYQSLHNGTNGFSATNLIGSGNFSFVYKGTIELEEKVAAIKVLKLQNKGAHKSFIVECNALKNIKHRNLVQILTCCSSTDYKGQEFKAIIFQYMTNGSLDQWLHPSTISAEHPRTLSLNQRLNIMIDVASALHYLHHECEQMIIHCDLKPSNVLLDDDMIAHVSDFGIARLISTSNGTNSEQASTIGIKGTIGYAPPEYGVGSEVSMNGDMYSFGILMLEMLTGRRPTDEIFEDGQNLRSFVENSFPGNLSQILDPSLVLKQGEAPIEEENNQNISPVVQKCLVTLFSIGLACSVESPKQRMNMVNVTKELNKTKRAFLTGKINEK

SEQ ID NO: 122144 - protein, 580 aa, Glycine max
  Coding DNA Sequence Number=SeqID_5366
  Homolog annotation: Hit_ID=Q10SC2; Match level="QueryCoverage=93%, HitCoverage=56%, E-value=1e-121, Identity=45%"; Hit description=FHA domain containing protein, expressed
  Pfam annotation: Domain name=FHA; Domain location=124-200; Score =32.8; E_value=1.2e-06; Accession=PF00498.16; Description=FHA domain
MEEAKVETPMTASRGNIGSGGDNCSQSLSPRARIVSVASNIASQPLHNSDPQVWGVLTAISNNARKRHQVSGNWVLLYEGEPWLNGKVAALVPYDIEVMSWVQIMETISALAAGINILLTADEHRIGRLVEDVRFQIDSNSVSANHCRIYRMKVTNENMENTTSIFLKDTSTNGTYLNWEKLKKNGAAVKVCHGDIISFAAPPQHDLAFAFVYREVLVSSPMPDNAVAKRKAEDFVSENKRLKGLGIGAPEGPISLDDFRSLQRSNMELRKQLENQVVTIDTLRSDNRAAVERHESELKSVKESVEKCYLDQLKELQQMVDLKQKELGDLNRASAEQKHAIEDLDERLSASIQSCAEANSIISSQKVNIAELKEQLDEERTQRKEEREKAAGDLKAAVHRAQSEAQEELKRLSDASLRRERELQETINKLQESEREMSLLVETLRFKLEDTRQKLVASDNKVRQLETQVHEEKLATENEMKKVELEQQETRRLRKELESEKAAREEAWAKVSVLELEINAAMRDLDFERRRLKGARERLMLRISNIDCTYWHRISEDTGQHPSCYFFQLLVCCILWIFVL

SEQ ID NO: 122145 - protein, 665 aa, Glycine max
  Coding DNA Sequence Number=SeqID_5367
  Gene Ontology: Mol. function=nucleic acid binding; Cellular component= intracellular; Biological process=regulation of transcription, DNA -dependent
  Homolog annotation: Hit_ID=Q4RQM6; Match level="QueryCoverage=87%, HitCoverage=88%, E-value=7e-46, Identity=25%"; Hit description =Chromosome 2 SCAF15004, whole genome shotgun sequence
  Pfam annotation: Domain name=Ank; Domain location=430-462; Score =16.7; E_value=0.084; Accession=PF00023.20; Description=Ankyrin repeat
  Subcellular localization annotation: CTP_CleavageSite=15; ConfidenceScore=5.04e-01
MATNLPATKSTTTTSSQEKRHRSIFEVPPNFFDSCRLLPSPHSSVSDHHSVGQTQIIETSSNDDFVLDAPQNAVVSAPRWTCNTCKTQFDSLQDQRSHFKSDIHRFNVKLTIAGKNIVKEEDFEVLTSEFVKDYDVSSISGSESDDDSETESQSQSALHDKLSESFKHKLFFRLQTGQRVSVWKCLIMNVTENVLYDNEKAENEVVEKLKSLTAEPRDNTHLRIVLLVSGGHFAGCVFDGDAVVAHKTFHRYVVRAKAGKKQSSKDASGRAAHSAGASLRRYNELALKKEVHELFAAWKPYFDASNSIFIHAPSSSRQLLYDGERSYFTNQQCDIRNIALTVRRPTFREAKRVYSQLTQVTHEGDEKEVLQRNQEDSVSIHISKINVSPTLSKGDMAELDDKNKAEACSSKQNDELPILSNGESEDELFGKSTPLHQAAQSGDSLKVLEFLEKGLDPCIKDERGRTPYMLAHDKEVRDTFRRFMASNLDKWDWQAAKVPSALTKEMEESQAAKQAEKDAKRKARAKELKKLRKAKEKKAQVEATLPKNDSKTIEKQVTASTSIKGQSQLKSGVQLSKEDQIRMAQAAEREKRAAAAERRIAALKIQANSAITAASMSEPKCGLAGDIYCSCCNSSLDGKVPFHRYNYKYCSTSCMHVHREILEDQ

SEQ ID NO: 122146 - protein, 100 aa, Glycine max
  Coding DNA Sequence Number=SeqID_5368
MDEKEKENARGGAGGTAASLKVQGCMCLEAKGSRAIRSGGGGGARRRRRVAGLVHDVERGRQLEMSNKSRALSFNTQPISHSSFSFLLHCHLKLSAINDL

SEQ ID NO: 122147 - protein, 198 aa, Glycine max
  Coding DNA Sequence Number=SeqID_5369
  Subcellular localization annotation: CTP_CleavageSite=44; ConfidenceScore=5.33e-01
MATGPSQWRATFYVHHQTFNLSTPVSVTCNFAHDSFTKQRHKIYAFTLPTLLSFLQVQSAGNTASPFQLHPLTTKASVFGILCYYLTFRAWLCFPLYATQLSIAMALFGSFSLASLVSLLLSDSWWHIKYMLYFLLVVVELHQMINIAMEIMAHQLYSKGFATYIYGFDRLQQGLIVDMGGSIQATLSIFTTHTLEDV

SEQ ID NO: 122148 - protein, 147 aa, Glycine max
  Coding DNA Sequence Number=SeqID_5370
  Gene Ontology: Mol. function=binding
  Homolog annotation: Hit_ID=Q6L4Y6; Match level="QueryCoverage=84%, HitCoverage=20%, E-value=4e-25, Identity=49%"; Hit description =Putative tetratricopeptide repeat (TPR)-containing protein
QAITQTLLQDYHKVKFGELKSERTKRTLGELWDLKVERVKKESLMSEQEIREKQVLAGILKKEGNREFGSREIEKAVVKYTEALSLCPLKSKKERIVIHSNRVQCHLLLRDPEAALSDTTRALCLSNVASVACLHSKSLWRRSEAWT

SEQ ID NO: 122149 - protein, 255 aa, Glycine max
  Coding DNA Sequence Number=SeqID_5371
  Gene Ontology: Mol. function=binding; Cellular component =intracellular; Biological process=protein amino acid phosphorylation
  Homolog annotation: Hit_ID=Q1SBZ0; Match level="QueryCoverage=100%, HitCoverage=25%, E-value=1e-112, Identity=77%"; Hit description =Tetratricopeptide-like helical
  Pfam annotation: Domain name=TPR_1; Domain location=111-144; Score =27.5; E_value=4.7e-05; Accession=PF00515.18; Description =Tetratricopeptide repeat
  Pfam annotation: Domain name=TPR_1; Domain location=209-242; Score =33.6; E_value=6.7e-07; Accession=PF00515.18; Description =Tetratricopeptide repeat
  Pfam annotation: Domain name=TPR_1; Domain location=43-76; Score =31.6; E_value=2.7e-06; Accession=PF00515.18; Description =Tetratricopeptide repeat
  Pfam annotation: Domain name=TPR_1; Domain location=77-110; Score =22.4; E_value=0.0017; Accession=PF00515.18; Description =Tetratricopeptide repeat
  Pfam annotation: Domain name=TPR_1; Domain location=9-42; Score=32.6; E_value=1.4e-06; Accession=PF00515.18; Description=Tetratricopeptide repeat
  Pfam annotation: Domain name=TPR_2; Domain location=111-144; Score =19.1; E_value=0.016; Accession=PF07719.7; Description=Tetratricopepti de repeat
  Pfam annotation: Domain name=TPR_2; Domain location=209-242; Score =30.1; E_value=7.8e-06; Accession=PF07719.7; Description =Tetratricopeptide repeat
  Pfam annotation: Domain name=TPR_2; Domain location=43-76; Score =23.3; E_value=0.00089; Accession=PF07719.7; Description =Tetratricopeptide repeat
  Pfam annotation: Domain name=TPR_2; Domain location=77-110; Score =15.7; E_value=0.17; Accession=PF07719.7; Description=Tetratricopeptid e repeat
  Pfam annotation: Domain name=TPR_2; Domain location=9-42; Score=26.7; E_value=8.3e-05; Accession=PF07719.7; Description=Tetratricopeptide repeat
  Pfam module annotation: Pfam domain module=TPR_1::TPR_1::TPR_1::TPR _1::TPR_1::TPR_2::TPR_2::TPR_2::TPR_2::TPR_2; Domain location=111 -144::209-242::43-76::77-110::9-42::111-144::209-242::43-76::77 -110::9-42
ILKEDPAYPEALIGRGTAYAFKRELDAAIADFSKAIEFNPSAGEAWKRRGQARAALGEFVEAIEDLTMALEFESNSADILHERGIVNFKFKEFDAAVEDLSACVQLDRDNKSAYTYLGLALSSIGEYKKAEEAHLKSLQIDRNFLEAWAHLTQLIVIWKLDSENPESSFYQDLSKPTKAQECLNQMLQIDGRKAISDLTMSLNVDGANVECLYLRGSCYHAVGRYKEAVKDYDAALDLELDSMDKFVLQCLAFYQ

SEQ ID NO: 122150 - protein, 295 aa, Glycine max
  Coding DNA Sequence Number=SeqID_5372
  Gene Ontology: Mol. function=binding
  Homolog annotation: Hit_ID=Q1SBZ0; Match level="QueryCoverage=98%, HitCoverage=23%, E-value=4e-70, Identity=56%"; Hit description =Tetratricopeptide-like helical
  Pfam annotation: Domain name=TPR_1; Domain location=1-34; Score=24.1; E_value=0.0005; Accession=PF00515.18; Description=Tetratricopeptide repeat
MLAFSNRAFCYSRLELHKHVIKDCNKALQLDPSRLQAYILKGLLLVKFIQFLMNLFNFLYPGKCDLSSFKNNRGGHALSALGRKTDALLVWEQGYEHAQHQSADLKLLLELEELLTTTKQGNSALYETNGSPVSQSESDSPSDGNLTEICENQDRLSVQDELCDNASDKSLILLKSADNFDLRNELNIEDRESNKSDSQVNGSPDVIDKLSYNSESCNDSSDTSESCDKDKVFTNSGESSSDSLDVAEILRKLSSKFNFPHEKIGEARKNKFCVARISKTKSISVDFRLSRGIGE

SEQ ID NO: 122151 - protein, 106 aa, Glycine max
  Coding DNA Sequence Number=SeqID_5373
MVKHVGVKFKKEQKGRSTTRVPSPELQIPFLAIELHRNANDKKGIDEHVVFCFLTSRPSSSILCIHLISCNIGEYIDEAKKDQSMATLIRDLVTGSGLIKWILPHN

SEQ ID NO: 122152 - protein, 145 aa, Glycine max
  Coding DNA Sequence Number=SeqID_5374
MKDDEKRKVQDDQKAKIILPSSLCSYEFFHTARSKSVKEIMLEVTLDVRRARKNTLVSKCEAFRMKNDDKLNIKILNCLTRTWEPKNIAIKESKDLASMSMEALKATEKKKKGVALKASSSKEGHKEDSIDDERCTKFEFDCQEV

SEQ ID NO: 122153 - protein, 290 aa, Glycine max
  Coding DNA Sequence Number=SeqID_5375
  Gene Ontology: Mol. function=hydrolase activity; Biological process =aromatic compound metabolic process
  Homolog annotation: Hit_ID=Q1SBZ4; Match level="QueryCoverage=93%, HitCoverage=89%, E-value=1e-138, Identity=87%"; Hit description =Alpha/beta hydrolase fold
  Pfam annotation: Domain name=Abhydrolase_1; Domain location=44-262; Score=39.9; E_value=8.8e-09; Accession=PF00561.10; Description =alphabeta hydrolase fold
MGIAAEAHNVKILGPGTECIVLAHGFGTDQSVWKHLVPYLVDDYRVILYDNMGAGTTNPDYFDFERHSSLEGYASDLLAILEELQVESCIFVGHSVSAMIGAIASISRPDLFTKLIMVSASPRYLNDVEYYGGFEQEDLNQLFDAMAANYKAWCYGFAPLAVGGDMESVAVQEFSRTLFNMRPDIALIVSRTIFQSDMRQILSLVSVPCHIIQAEKDMAVPVMISEYLHQHIGAESIVEVMATDGHLPQLSSPDIVIPVLLKHIQLDIESRSCATPAKEALRIDIGLEFS

SEQ ID NO: 122154 - protein, 337 aa, Glycine max
  Coding DNA Sequence Number=SeqID_5376
  Homolog annotation: Hit_ID=Q9FN16; Match level="QueryCoverage=84%, HitCoverage=84%, E-value=5e-13, Identity=26%"; Hit description =Arabidopsis thaliana genomic DNA, chromosome 5, TAC clone:K8K14
EEEEEEEEEEEAEIEALSLCDLPVNLVDHEVQSKAKPDSQIIEAQEEDFDFRLWGGPFSTESEMCAADEVFFQGQILPLHLSLKRCESLDHVSVREFRSNSSRSSSSIRSQNSSSSSCSTATTTPRISKPRLQNQNHFHAHPSPQPQLKVTVPRQTSFSNHGRKSSAWDFFRLGVVPAPEIALQDLKVRSTNGVSKNHMGRSTSIGSNNSNANANGSVKTSYSGNKNQVFKKFGGFWSGCKCSVETVQSGMAMIKGGIKSANTTHATKEKVIERKRQKHRQKQGKRTMSRRRTFEWIKELSHNYIIVVETGDSVIKTCYPRENDSFAFSFLFLTDGD

SEQ ID NO: 122155 - protein, 160 aa, Glycine max
  Coding DNA Sequence Number=SeqID_5377
MVKCKCEVPAIMFTLRSMNHPGKRFWRSYTGMNPVLADFFQWIVDIEAGNKVSAKGSELIRYVHENEKVKVKLASLMEEAKTNVEEIANLRERIVAHGEECRASLAEVVHLKSKIGRKKKNIVVERNKVKLLGFVIVVLWMFISLLNIVIIMNVGGHRRN

SEQ ID NO: 122156 - protein, 157 aa, Glycine max
  Coding DNA Sequence Number=SeqID_5378
  Gene Ontology: Mol. function=nucleic acid binding; Biological process= DNA integration
  Homolog annotation: Hit_ID=Q1T4S3; Match level="QueryCoverage=54%, HitCoverage=5%, E-value=3e-16, Identity=48%"; Hit description=Zinc finger, CCHC-type
MTTTMMTHPFSFILSPINQTASVRTKRTSEVVDDVEDDIRAGGDDMGAEKWPPGSTSGWAFEGVSLKMAMLAASTNHMDDSWYSDTSATHHLTHDLGNFMIKNEYNGGDRVHVGDGTGLTISHAGHSSFYSKNSNIRFTLKNLLHVPDITKNLISVS

SEQ ID NO: 122157 - protein, 103 aa, Glycine max
  Coding DNA Sequence Number=SeqID_5379
  Gene Ontology: Mol. function=RNA-directed DNA polymerase activity; Biological process=RNA-dependent DNA replication
  Homolog annotation: Hit_ID=Q1SLU4; Match level="QueryCoverage=73%, HitCoverage=19%, E-value=2e-24, Identity=69%"; Hit description=RNA -directed DNA polymerase
MVILSTTSLLPITTHKSLGLILLSIKKTRDLDQVKCVKDEEGKILVHEKDIKERWKAYFHNLFNDGYGYDSSSLDTREEDRNYKYYRRILKQEVKEALKRMSN

SEQ ID NO: 122158 - protein, 78 aa, Glycine max
  Coding DNA Sequence Number=SeqID_5380
MVEDCGGSVEVRDVREKEDREAATNEDEDVCGWIWLPNGALNDYSHQLFIISSLPVAPYILLMELKTGGMNHGPLLNI

SEQ ID NO: 122159 - protein, 190 aa, Glycine max
  Coding DNA Sequence Number=SeqID_5381
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=endoplasmic reticulum; Biological process=protein metabolic process
  Homolog annotation: Hit_ID=Q1SEC9; Match level="QueryCoverage=98%, HitCoverage=96%, E-value=3e-39, Identity=62%"; Hit description=2OG -Fe(II) oxygenase
  Pfam annotation: Domain name=2OG-FeII_Oxy; Domain location=37-185; Score=2.2; E_value=0.073; Accession=PF03171.10; Description=2OG -Fe(II) oxygenase superfamily
MNKLDLPSVFLICIFFFLAGFSASSLFSPSQEHEYDLRLIPRARLLEKSTHEKTEHHLLKAGDSGDDYITLIPFQGRTQAVNIGVTQGRNGGEYKGNQNKAASFLLYLTDVPEGGETLFPYENGFNRDGSYDFEDCIGLRVRPRKGDGLLFYSLLPNGTIDQTSVHGSCPVIKGEKWVATKWIRDQVLDD

SEQ ID NO: 122160 - protein, 157 aa, Glycine max
  Coding DNA Sequence Number=SeqID_5382
  Gene Ontology: Mol. function=acyl-CoA binding
  Homolog annotation: Hit_ID=Q4L0H4; Match level="QueryCoverage=61%, HitCoverage=28%, E-value=2e-27, Identity=54%"; Hit description =Membrane acyl-CoA binding protein
  Pfam annotation: Domain name=ACBP; Domain location=55-137; Score =34.2; E_value=7.7e-10; Accession=PF00887.9; Description=Acyl CoA binding protein
MECDSRENKVEEVEISQCERYYNEIEESSMNEEMGENKGSVVDEDDWEGIERTELERRFGAAVVFVGSKSNANLSNDVKMKLHGYHRIATQGPCHEPQPMALKFSARAKWIAWRQLGIMSPEEAMEQYISLLSENIPDWIVENPYDNAKPASAKLTL

SEQ ID NO: 122161 - protein, 381 aa, Glycine max
  Coding DNA Sequence Number=SeqID_5383
  Homolog annotation: Hit_ID=Q337A9; Match level="QueryCoverage=93%, HitCoverage=81%, E-value=6e-21, Identity=24%"; Hit description=Major Facilitator Superfamily protein, expressed
  Pfam annotation: Domain name=DUF791; Domain location=3-298; Score= -119.6; E_value=1.8e-05; Accession=PF05631.4; Description=Protein of unknown function (DUF791)
  Pfam annotation: Domain name=MFS_1; Domain location=2-343; Score= -29.6; E_value=0.0072; Accession=PF07690.6; Description=Major Facilitator Superfamily
  Pfam module annotation: Pfam domain module=DUF791::MFS_1; Domain location=3-298::2-343
MEGLWSVFGEYELASYGIGRENMVKSLCYGYTTALFAAPFLGVLSDLIGHKKVSLIFCILHFIVGVWKKISEPPSMFMTSICLSLTNTIFSFSFETWMVTQHEKQGHRLDSLNDAYWLMTFFESACFIASQMFANWLIGNNTEKNTAPSSAAIFFAAICFTFITRGWTENPGSASLKEYSHAFYAYILGDKRIWLLAWAQTCLHFSTGIFWILWAPTVVADGREVQLGLIYPCFLGSRMLGSTAFPCLTSGPSSLRTEDCLVIAYIILALLLSIVAYDYQEIGVLVTLFCLFHACVGFVLPSLARLRTMYVPNELRGGMMGFSLAPANAAILLSVVQGGYYRNVGNAALMAFGVCGLLLAAGCMHALKQWGKQPYNNWHKQ

SEQ ID NO: 122162 - protein, 266 aa, Glycine max
  Coding DNA Sequence Number=SeqID_5384
  Gene Ontology: Mol. function=RNA-directed DNA polymerase activity; Cellular component=chromatin; Biological process=chromatin assembly or disassembly
MNSITIKDRFLMPTINELLDDLDHVSWFSKLDLRQGSDQILMVDDDIVKTMFQTHQGHYEYRVMSFDLCNAPSTFQATMSTLLQPFLHKFVIVFFDVILIYIGVYLGHVIFGKGVELEQSQIKVMLDWPIPSNQKDLCGFLGLTDFYHKFINGYASITSPLNSLLCNCTPEAQLAFDNLKRAMTKALVLVLPNFSLPLVLETDAFGLALMQHGHPITFYMASILTWPQFTILTDHNSPKGSLNDQLDWKILSSCYLAALKELVATT

SEQ ID NO: 122163 - protein, 45 aa, Glycine max
  Coding DNA Sequence Number=SeqID_5385
MWQNQPNNSSYSDSVKALEDDMQHANTLEMNFSHKPWPEMPILII

SEQ ID NO: 122164 - protein, 84 aa, Glycine max
  Coding DNA Sequence Number=SeqID_5386
  Homolog annotation: Hit_ID=O64818; Match level="QueryCoverage=99%, HitCoverage=71%, E-value=5e-15, Identity=83%"; Hit description =Expressed protein
  Pfam annotation: Domain name=DUF1909; Domain location=4-61; Score =4.9; E_value=0.003; Accession=PF08927.1; Description=Domain of unknown function (DUF1909)
MGGGNGQKAKMAREKNLEKQKAASKGSQLDSNKKAMSIQNIKTNWNKKENTAKKRLRVILAVCIKVMVQGVHANIYVHHIGSEV

SEQ ID NO: 122165 - protein, 581 aa, Glycine max
  Coding DNA Sequence Number=SeqID_5387
  Gene Ontology: Mol. function=kinase activity; Cellular component =intracellular; Biological process=plasma membrane repair
  Homolog annotation: Hit_ID=Q1T3X4; Match level="QueryCoverage=84%, HitCoverage=63%, E-value=1e-144, Identity=31%"; Hit description =Prefoldin; t-snare; Protein kinase PKN/PRK1, effector
MSENHVAEQVSDSGHGVVHDESNVDTESNIDTYNQDQGERADLRGPEDGKSTEDAARDDMFVDCPDELSTFDGRQREEDAAAVENEDDRSEENEVMQQQQSHFDKLGNGVGDAYSSGQLEKVVAEKECILKEYQEERQTVTQGVLDLRCQLKTLTGQHNEAQVEDREATDVPLREMIKECLESVKTASEEWSNSETTINNLREHLSTKDREIEDLNAKLAQLMVSNESLQVSSKAQLEKDRIVEIVIDKTISSLATVVTREQVLDDSISGKIVYIEEGTMHVVEKYNQMLSEIYQLGQSFSEVGLETNDQEYGNILADARGGLLELKRKETELVEKLAHLEDENQKLVDELDKEKVMIGTLNTELGKLKIELEQEKAKCANTKEKLSMAVTKGKALVQQRDSLKKSLADKSGELEKCLIELQEKSVALQAAELAKEELSQSKNMVASLENSLLEKNAIFDQVEEILSRAKLNEPEMFDMPEKLRWLVDDRNTLKEAFLELCKLKEAISLVDLPEPVSSSDLESQMNWLADSLLSARGNMHTLQEEISTIKEASRDYVDQLSVSLLLALQEKDYLLSELTDL

SEQ ID NO: 122166 - protein, 110 aa, Glycine max
  Coding DNA Sequence Number=SeqID_5388
MHRLRNYIFPHHSWHQHRCGNGHILHRLPRDDRHRRCNFYIGGGLSDEDMTKSKGKDPLEGLGGPMTRARARKAKEALQQVLSILFEYKPKFQGEKSKVVSCIMAQMEED

SEQ ID NO: 122167 - protein, 604 aa, Glycine max
  Coding DNA Sequence Number=SeqID_5389
  Gene Ontology: Mol. function=kinase activity; Cellular component =cytoplasm; Biological process=phosphoenolpyruvate-dependent sugar phosphotransferase system
  Homolog annotation: Hit_ID=Q1T3X4; Match level="QueryCoverage=99%, HitCoverage=57%, E-value=0.0, Identity=45%"; Hit description =Prefoldin; t-snare; Protein kinase PKN/PRK1, effector
  Pfam annotation: Domain name=ERM; Domain location=216-514; Score= -208.9; E_value=0.1; Accession=PF00769.9; Description=Ezrinradixinmoes in family
  Pfam annotation: Domain name=PLU-1; Domain location=59-338; Score= -129.7; E_value=0.077; Accession=PF08429.1; Description=PLU-1-like protein
  Pfam annotation: Domain name=TolA; Domain location=165-507; Score= -153.9; E_value=0.078; Accession=PF06519.2; Description=TolA protein
  Pfam module annotation: Pfam domain module=ERM::PLU-1::TolA; Domain location=216-514::59-338::165-507
MLKVIKGQGGPLSRASHIDAELFERIQSLLYVRDQGLILYEDILEEEMLIRSDENKLSNELKVASEEIIALKEERSSLLQDLERSEEKTAMLRDKLSMAVKKGKGLFQDRDNLKGLVNEKKSEIEQLKADLQKQESAVSEYRDEINRLSSDVESIPKLEADFLEMKREKNQFEQFLMESNNMLQKVMECIDGVALPVAPVFDEPIEKVKWLAGYVNECQDAKVHIEQELQLVKESASILEIQLAEAQATVKSLERELSSSDDNVSQLAEEKTELEHGKEKVEEELQKVKEKVAEVCNTTKSLEDALSQAEKDISILSEEKEQAQVSRVAAERELEIFKDEAAMQTSKLAEASKTIKDLEDKLSQVEGNANLLTEKYNADQVVKIDMENELKKLQDEASNHASKLAGASATIKSLEDALSKAQDDISALEDANKIAKQEISSLGFKLNSCMDELAGKNGSLENKSLQLIGLLNDLQGLMKDTTLFPRIKQCFESKCETLKNMTLILNKIRDNVAMTAKDSKGQPVMEENPLMRETFLDGPENFEVELDITEIDGADIDTIISSFGKIVKGFQSRNKHIADKFHEFSDCMDEFISPLHEKLLETET

SEQ ID NO: 122168 - protein, 177 aa, Glycine max
  Coding DNA Sequence Number=SeqID_5390
  Gene Ontology: Mol. function=signal transducer activity
  Homolog annotation: Hit_ID=Q1T3X1; Match level="QueryCoverage=49%, HitCoverage=44%, E-value=1e-38, Identity=87%"; Hit description =Regulator of G protein signalling
MKPLSSRCHMKAQWTIPVVCLHSLYIAILVGVTAAVHHIEFSSQLLTNLCSKAVIKASILVVAFFSISSSQPLLSQISLRRRESREFRTMSQALGIPDSGVLAESEPISRIDPNEPLDKLLLNKRFRQSFMAFADSCLAGESVHFFDEVYELSKIPEDDCVKRIYMARHIIEKYIVA

SEQ ID NO: 122169 - protein, 81 aa, Glycine max
  Coding DNA Sequence Number=SeqID_5391
  Homolog annotation: Hit_ID=Q1T3X3; Match level="QueryCoverage=69%, HitCoverage=56%, E-value=6e-24, Identity=89%"; Hit description =Nitrate-induced NOI
  Pfam annotation: Domain name=NOI; Domain location=2-80; Score=124.8; E_value=2.4e-34; Accession=PF05627.2; Description=Nitrate-induced NOI protein
MQYDEKQGKPLPKFGEWDVNDPASAEGFTVIFNKARDEKKIASASGRFPSQRRYDSRKHKDQQKCKSSSSTSKKKWFCFGP

SEQ ID NO: 122170 - protein, 100 aa, Glycine max
  Coding DNA Sequence Number=SeqID_5392
  Gene Ontology: Mol. function=oxidoreductase activity; Cellular component=endoplasmic reticulum; Biological process=metabolic process
  Homolog annotation: Hit_ID=Q1T3X0; Match level="QueryCoverage=86%, HitCoverage=16%, E-value=4e-28, Identity=73%"; Hit description=Short- chain dehydrogenase/reductase SDR
MNSRGECGGIRKNSLIKFLKWVWVMFLRTPKNLIKEYGSWAMITGFTDGIGKAMAFELASKGLNLLLVGRNPLKLEATSKEIRDGHDVEVKFVVIDMQKV

SEQ ID NO: 122171 - protein, 97 aa, Glycine max
  Coding DNA Sequence Number=SeqID_5393
MNALNRYQTRCFRTHQVEPLYRTKHRNLSELFTKNKKQTTHYNDDDDDDDENENGPGVSSVREIGGANGKGGSSEADALECGHDLRKKKGRSESDEA

SEQ ID NO: 122172 - protein, 281 aa, Glycine max
  Coding DNA Sequence Number=SeqID_5394
  Subcellular localization annotation: CTP_CleavageSite=36; ConfidenceScore=5.56e-01
MGSSASKASSSSSSSSSGSFRKGRSKGYRGFPSYCLGATSGSRGIDSDDQNKVNGDDVTYSSGNEIDSDEGKTESFRKVKSDEVPCVPSNIDLEGWGHTTSRTGSSSAHSSSNQSLNPSSRFLSRFSLVPGNISFRLSRTTSLGSSRPCPVSSESLSIFNNEDELNLPPGLPGSLINRNETQHRSDLLNASLASQVPIQCHQEASNNLRSNTPTLVSPGNLVSSRTLSSVQDVARDGNGTREVLDVNLFSPRIHTDSENIEPRLTDRRNGAREPVERNVSF

SEQ ID NO: 122173 - protein, 261 aa, Glycine max
  Coding DNA Sequence Number=SeqID_5395
  Gene Ontology: Mol. function=nucleic acid binding; Biological process= metabolic process
  Homolog annotation: Hit_ID=Q07G10; Match level="QueryCoverage=93%, HitCoverage=40%, E-value=2e-24, Identity=31%"; Hit description=AlkB, alkylation repair homolog 8
  Pfam annotation: Domain name=RRM_1; Domain location=19-90; Score=6.0; E_value=0.039; Accession=PF00076.12; Description=RNA recognition motif. (a.k.a. RRM, R
MGLPRFGRPKNDGELSSNLFVANCGSAVGLSDDDIASVFCKFGELKGVYAADESGTRVIVAYVEEGSAQAALKALHGQSCPELGGRSLHIRYSVLQPTPQDQASDLVPVSITASDVSIPGLFLVHDFISAKEEEELLQAVDCRPWNSLSKRRVQHYGYEFRYDVNEYPPGVGLSPHIDTHSAFEDLIFSLSLSGPCIMEFRRYENGDWLPRVASSAVAKIENPEDQSNFIRRAIYLPPRSLLLLSGEARYAWHHYIPHHKV

SEQ ID NO: 122174 - protein, 172 aa, Glycine max
  Coding DNA Sequence Number=SeqID_5396
  Gene Ontology: Mol. function=metal ion binding
  Homolog annotation: Hit_ID=Q9FH81; Match level="QueryCoverage=89%, HitCoverage=28%, E-value=9e-45, Identity=61%"; Hit description =Arabidopsis thaliana genomic DNA, chromosome 5, TAC clone:K9E15
  Pfam annotation: Domain name=zf-C3HC4; Domain location=117-158; Score= 37.9; E_value=3.5e-08; Accession=PF00097.15; Description=Zinc finger, C3HC4 type (RING finger)
VRALQRLGSRFENLSGHDRSCILSGQHRNGRCACRINSRDTNSNDDTNARASISRIVMLAEALFEVLDEIHQQSVVLSSRPSVSSIGSVPAPNDVVESLPVKLYTKLHKHQEEPVQCYICLVEYEDGDSMRVLPCHHEFHTTCVDKWLKEIHRVCPLCRGDICVSDSLPREN

SEQ ID NO: 122175 - protein, 168 aa, Glycine max
  Coding DNA Sequence Number=SeqID_5397
  Subcellular localization annotation: CTP_CleavageSite=92; ConfidenceScore=5.27e-01
MRRARKTEWGSGAGTCRRCFVVASSFRKSLLPWLSPLVLPSPWSPPTQPPTIVSAANHAVTSHCLRHRHPPSPTSLCISLTLGPQTHLRFVVATEEKEKEENGLVLIFVLLSWDFKEGIRWVHLIQDTTSTLLSPRSVTVGLGDPNRSYFGVLDKQRRCGAGGVSQEL

SEQ ID NO: 122176 - protein, 675 aa, Glycine max
  Coding DNA Sequence Number=SeqID_5398
  Gene Ontology: Mol. function=beta-amylase activity; Biological process=polysaccharide catabolic process
  Homolog annotation: Hit_ID=Q9FH80; Match level="QueryCoverage=85%, HitCoverage=83%, E-value=0.0, Identity=69%"; Hit description=Beta -amylase-like
  Pfam annotation: Domain name=DUF822; Domain location=51-213; Score =215.0; E_value=1.7e-61; Accession=PF05687.4; Description=Plant protein of unknown function (DUF822)
  Pfam annotation: Domain name=Glyco_hydro_14; Domain location=226-647; Score=239.4; E_value=7.9e-69; Accession=PF01373.8; Description =Glycosyl hydrolase family 14
  Pfam module annotation: Pfam domain module=DUF822::Glyco_hydro_14; Domain location=51-213::226-647
MKSVNDDASTQDLDPQSDHSSDYLAHPQPHPQPRRPRGFAAAAAAATTNSAGKGKKEREKEKERTKLRERHRRAITSRMLAGLRQYGNFPLPARADMNDVLAALAREAGWVVDADGTTYRQCPPPSHMGSFAARSVESQLSGGSLRNCSVKETIENQTSVLRIDECLSPASIDSVVIAERDSKTEKYTNASPINTVDCLEADQLMQDIHSGVHENNFTGTPYVPVYVKLPAGIINKFCQLIDPEGIKQELIHIKSLNVDGVVVDCWWGIVEGWSSQKYVWSGYRELFNIIREFKLKLQVVMAFHECGGNDSSDALISLPQWVLDIGKDNQDIFFTDREGRRNTECLSWGIDKERVLKGRTGIEVYFDMMRSFRTEFDDLFAEGLISAVEVGLGASGELKYPSFSERMGWRYPGIGEFQCYDKYLQHSLRRAAKLRGHSFWARGPDNAGHYNSMPHETGFFCERGDYDNYYGRFFLHWYSQTLIDHADNVLSLATLAFEETKITVKVVFLVPAVYWWYKTPSHAAELTAGYHNPTNQDGYSPVFEVLRKHAVTMKFVCLGFHLSSQEANESLIDPEGLSWQVLNSAWDRGLMAAGENALLCYDREGYKKLVEIAKPRNDPDRRHFSFFVYQQPSLLQTNVCWSELDFFVKCMHAFKRWPAPKQHRTILDQCFLQAW

SEQ ID NO: 122177 - protein, 61 aa, Glycine max
  Coding DNA Sequence Number=SeqID_5399
MVLEPYPATTPHPGNHDDSVLYSVTYGRAMVDVLLLTPVTAWLLHQCGALVSQPIAPVTYM

SEQ ID NO: 122178 - protein, 771 aa, Glycine max
  Coding DNA Sequence Number=SeqID_5400
  Gene Ontology: Mol. function=protein serine/threonine kinase activity; Cellular component=integral to membrane; Biological process=protein amino acid phosphorylation
  Homolog annotation: Hit_ID=Q9SD64; Match level="QueryCoverage=99%, HitCoverage=97%, E-value=0.0, Identity=37%"; Hit description =Receptor kinase-like protein
  Pfam annotation: Domain name=LRR_1; Domain location=105-127; Score =12.2; E_value=1.5; Accession=PF00560.23; Description=Leucine Rich Repeat
  Pfam annotation: Domain name=LRR_1; Domain location=130-152; Score =16.6; E_value=0.09; Accession=PF00560.23; Description=Leucine Rich Repeat
  Pfam annotation: Domain name=LRR_1; Domain location=154-176; Score =11.1; E_value=2.4; Accession=PF00560.23; Description=Leucine Rich Repeat
  Pfam annotation: Domain name=LRR_1; Domain location=178-200; Score =15.3; E_value=0.22; Accession=PF00560.23; Description=Leucine Rich Repeat
  Pfam annotation: Domain name=LRR_1; Domain location=202-224; Score =7.2; E_value=13; Accession=PF00560.23; Description=Leucine Rich Repeat
  Pfam annotation: Domain name=LRR_1; Domain location=226-249; Score =16.5; E_value=0.096; Accession=PF00560.23; Description=Leucine Rich Repeat
  Pfam annotation: Domain name=LRR_1; Domain location=251-273; Score =4.1; E_value=49; Accession=PF00560.23; Description=Leucine Rich Repeat
  Pfam annotation: Domain name=LRR_1; Domain location=275-297; Score =2.2; E_value=1.1e+02; Accession=PF00560.23; Description=Leucine Rich Repeat
  Pfam annotation: Domain name=LRR_1; Domain location=28-50; Score=5.9; E_value=23; Accession=PF00560.23; Description=Leucine Rich Repeat
  Pfam annotation: Domain name=LRR_1; Domain location=299-321; Score =11.5; E_value=2; Accession=PF00560.23; Description=Leucine Rich Repeat
  Pfam annotation: Domain name=LRR_1; Domain location=3-26; Score=9.6; E_value=4.5; Accession=PF00560.23; Description=Leucine Rich Repeat
  Pfam annotation: Domain name=LRR_1; Domain location=323-345; Score =16.6; E_value=0.088; Accession=PF00560.23; Description=Leucine Rich Repeat
  Pfam annotation: Domain name=LRR_1; Domain location=347-370; Score =5.1; E_value=32; Accession=PF00560.23; Description=Leucine Rich Repeat
  Pfam annotation: Domain name=LRR_1; Domain location=52-73; Score=5.9; E_value=23; Accession=PF00560.23; Description=Leucine Rich Repeat
  Pfam annotation: Domain name=LRR_1; Domain location=75-100; Score =5.7; E_value=24; Accession=PF00560.23; Description=Leucine Rich Repeat
  Pfam annotation: Domain name=Pkinase; Domain location=463-762; Score =108.9; E_value=1.5e-29; Accession=PF00069.15; Description=Protein kinase domain
  Pfam annotation: Domain name=Pkinase_Tyr; Domain location=463-762; Score=58.9; E_value=4.4e-16; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::Pkinase::Pkinase_Tyr; Domain location=105-127::130 -152::154-176::...
  Pfam module annotation: Domain location=178-200::202-224::226 -249::251-273::275-297::28-50::299-321::3-26::323-345::347-370::52 -73::75-100::463-762::463-762
  Subcellular localization annotation: CTP_CleavageSite=30; ConfidenceScore=5.15e-01
MSCLTTISAADNQFNGSLPPNMFHTLPNLREFLVGGNHFSAPLPTSITNASILQTLDVGKNQLVGQVPSLGKLQHLWFLSLYYNNLGDNSTKDLEFLKSLANCSKLQVVSISYNNFGGSLPNSVGNLSTQLSQLYLGGNQISGKIPAELGNLVSLTILTMEINHFEGSIPANFGKFQKLQRLELSRNKLSGDMPNFIGNLTQLYFLGIAENVLEGKIPPSIGNCQKLQYLNLYNNNLRGSIPSEVFSLFSLTNLLDLSKNSMSGSLPDEVGRLKNIGRMALSENNLSGDIPETIGDCISLEYLLLQGNSFDGVIPSSLASLKGLRVLDISRNRLVGSIPKDLQKISFLEYFNASFNMLEGEVPMEGVFGNASELAVIGNNKLCGGVSELHLPPCLIKGKKSAIHLNFMSITMMIVSVVAFLLILPVIYWMRKRNEKKTSFDLPIIDQMSKISYQNLHHGTDGFSVKNLVGSGNFGFVYKGTIELEGNDVVAIKVLNLQKKGAQKSFIAECNALKNVRHRNLVKILTCCSSIDHRGQEFKALVFEYMTNGSLERWLHPETEIANHTFSLSLDQRLNIIIDVASAFHYLHHECEQAIIHCDLKPSNVLLDDCLVAHVSDFGLARRLSSIAVSPKQTSTIEIKGTIGYAPPEYGMGSEVSTEGDLYSFGILVLEMLTGRRPTDEMFEDGHNLHNYVNISIPHNLSQIVDPTILPKELKQASNYQNLNPMHLEVEKCLLSLFRIALACSKESPKERMSMVDVTRELNLIKSSFSS

SEQ ID NO: 122179 - protein, 137 aa, Glycine max
  Coding DNA Sequence Number=SeqID_5401
MAYFSSWHYNILENYWQLKKHVPIEEEFVSQIRNSSILRNEDYFSSCAMLSLNVKDPRELPWKKTVVLVESISTKTPSDAEEKKYKEVAELGGILEENRDLSSLSRSKLVDSQFDIDGSMVCYHQRLEASSGRQLSF

SEQ ID NO: 122180 - protein, 164 aa, Glycine max
  Coding DNA Sequence Number=SeqID_5402
  Homolog annotation: Hit_ID=Q3ZPN4; Match level="QueryCoverage=35%, HitCoverage=13%, E-value=8e-12, Identity=55%"; Hit description =Anthraniloyal-CoA: methanol anthraniloyal transferase
  Subcellular localization annotation: CTP_CleavageSite=74; ConfidenceScore=5.27e-01
ILGASLALNSSLCHTGNGDIGAPLAISPTMVRNWTSPSESQIVCFMRAAKTNPPRVRRGVVVKELEWMVVVTVTAAEKHNGNLSVNLSSEGRTRLGFRGIYDGFGGPDAPDYLLPNRYTVVHKELKGLLWDDESTPENSMIKEDMLQDVTANVTVTNENDACSH

SEQ ID NO: 122181 - protein, 106 aa, Glycine max
  Coding DNA Sequence Number=SeqID_5403
MEISKSLVSNNNNKKNNCTPSRLVGPDGVGLLVLPRKVELKDDSSLLVATYQPLPAAFTKNSETPKKEKDLKFSEQSSASRACADTSAMSPNGQHCYQKYETIFQR

SEQ ID NO: 122182 - protein, 74 aa, Glycine max
  Coding DNA Sequence Number=SeqID_5404
  Gene Ontology: Mol. function=transferase activity
  Homolog annotation: Hit_ID=Q3ZPN4; Match level="QueryCoverage=97%, HitCoverage=22%, E-value=1e-09, Identity=39%"; Hit description =Anthraniloyal-CoA: methanol anthraniloyal transferase
MSAEYVSSVVDLMVLKGRPNPSYGGPAGAIPFVSFYGRFRDSEGEDWVVVPILLPHHVMKKFLFELVKITVRSL

SEQ ID NO: 122183 - protein, 809 aa, Glycine max
  Coding DNA Sequence Number=SeqID_5405
  Gene Ontology: Mol. function=protein kinase activity; Cellular component=integral to membrane; Biological process=protein amino acid phosphorylation
  Homolog annotation: Hit_ID=Q2R2D7; Match level="QueryCoverage=99%, HitCoverage=92%, E-value=1e-160, Identity=34%"; Hit description =Receptor kinase, putative, expressed
  Pfam annotation: Domain name=LRR_1; Domain location=113-135; Score =9.1; E_value=5.8; Accession=PF00560.23; Description=Leucine Rich Repeat
  Pfam annotation: Domain name=LRR_1; Domain location=138-159; Score =6.3; E_value=19; Accession=PF00560.23; Description=Leucine Rich Repeat
  Pfam annotation: Domain name=LRR_1; Domain location=16-37; Score=3.7; E_value=58; Accession=PF00560.23; Description=Leucine Rich Repeat
  Pfam annotation: Domain name=LRR_1; Domain location=161-183; Score =7.6; E_value=11; Accession=PF00560.23; Description=Leucine Rich Repeat
  Pfam annotation: Domain name=LRR_1; Domain location=191-213; Score =12.8; E_value=1.1; Accession=PF00560.23; Description=Leucine Rich Repeat
  Pfam annotation: Domain name=LRR_1; Domain location=216-238; Score =15.7; E_value=0.17; Accession=PF00560.23; Description=Leucine Rich Repeat
  Pfam annotation: Domain name=LRR_1; Domain location=240-262; Score =12.5; E_value=1.3; Accession=PF00560.23; Description=Leucine Rich Repeat
  Pfam annotation: Domain name=LRR_1; Domain location=264-286; Score =9.8; E_value=4.3; Accession=PF00560.23; Description=Leucine Rich Repeat
  Pfam annotation: Domain name=LRR_1; Domain location=288-310; Score =12.4; E_value=1.3; Accession=PF00560.23; Description=Leucine Rich Repeat
  Pfam annotation: Domain name=LRR_1; Domain location=312-335; Score =20.2; E_value=0.0073; Accession=PF00560.23; Description=Leucine Rich Repeat
  Pfam annotation: Domain name=LRR_1; Domain location=337-359; Score =9.9; E_value=4; Accession=PF00560.23; Description=Leucine Rich Repeat
  Pfam annotation: Domain name=LRR_1; Domain location=361-383; Score =10.0; E_value=3.8; Accession=PF00560.23; Description=Leucine Rich Repeat
  Pfam annotation: Domain name=LRR_1; Domain location=385-407; Score =15.9; E_value=0.15; Accession=PF00560.23; Description=Leucine Rich Repeat
  Pfam annotation: Domain name=LRR_1; Domain location=40-62; Score =16.1; E_value=0.12; Accession=PF00560.23; Description=Leucine Rich Repeat
  Pfam annotation: Domain name=LRR_1; Domain location=409-431; Score =16.2; E_value=0.12; Accession=PF00560.23; Description=Leucine Rich Repeat
  Pfam annotation: Domain name=LRR_1; Domain location=456-480; Score =2.1; E_value=1.2e+02; Accession=PF00560.23; Description=Leucine Rich Repeat
  Pfam annotation: Domain name=LRR_1; Domain location=64-86; Score =10.9; E_value=2.6; Accession=PF00560.23; Description=Leucine Rich Repeat
  Pfam annotation: Domain name=LRR_1; Domain location=88-111; Score =9.6; E_value=4.5; Accession=PF00560.23; Description=Leucine Rich Repeat
  Pfam annotation: Domain name=Pkinase; Domain location=551-784; Score =42.4; E_value=4.4e-11; Accession=PF00069.15; Description=Protein kinase domain
  Pfam annotation: Domain name=Pkinase_Tyr; Domain location=551-798; Score=-14.6; E_value=1.4e-11; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::Pkinase::Pkinase_Tyr; Domain location=113-135::...
  Pfam module annotation: Domain location=138-159::16-37::161-183::191 -213::216-238::240-262::264-286::288-310::312-335::337-359::361 -383::385-407::40-62::409-431::456-480::64-86::88-111::551-784::551 -798
NNLIGKIPIQIGSLQKLEQLSTSRNKLTGGIPSFTGNLSSLTLLDIGNNNLEGDIPQEICLLKSLTFLALGQNNLTGTLPPCLYNMSSLTMISATENQLNGSLPPNMFHTLSNLQEFYIAVNKISGPIPPSITNASIFFLALEASRNNLTGQIPSLGKLQYLDILSLSWNNLGDNSTNDLDFLKSLTNCSNLHMISISYNNFGGHLPNSLGNLSSQLSLLYLGGNQISGEIPAAIGNLIGLTLLTMENNSISGNIPTSFGKFQKMQKINLAGNKLSGEIRAYIGNLSQLFHLELNENVLEGNIPPSLGNCQKLQYLDLSHNNLTGTIPSEVFMLSSLTKLLNLSQNSLSGSIPDKVGNLKNLDLLDMSENRLSSEIPGTIGECIMLEYLYLQGNSLQGIIPSSLASLKGLQRLDLSRNNLSGSIPNVLQKITILKYFNVSFNKLDGEVPTEGFFQNASALVLNGNSKLCGGISKLHLPPCPLKGKKLARHQKFRLIAAIVSVVVFLLMLSFILTIYWMRKRSNKPSLESPTIDHQLAQVSYQSLHNGTDGFSSTNLIGSGSFSSVYKGTLEFKDKVVAIKYMRNGSLEQWLHPSTLNAEQPRTLNLDQRLNIMIDIASAIHYLHHECEQSIVHCDLKPSNVLLDDDMVAHVSDFGIARLLSTINETTSKQTSTIGIKGTLGYAPPEYGMTSEVSTYGDVYSFGILMLEMLTGRRPTDEIFEDGQNLRNFVAISFPDNISQILDPQLIPSDEATTLKENHHNLNPSVEMCLVSLFRIGLACSMESQKERKTMNDVIMELNRIREVLSTCW

SEQ ID NO: 122184 - protein, 650 aa, Glycine max
  Coding DNA Sequence Number=SeqID_5406
  Gene Ontology: Mol. function=protein dimerization activity; Cellular component=nucleus; Biological process=regulation of transcription, DNA-dependent
  Homolog annotation: Hit_ID=Q3Y6G6; Match level="QueryCoverage=99%, HitCoverage=99%, E-value=0.0, Identity=71%"; Hit description=Auxin response factor 1
  Pfam annotation: Domain name=AUX_IAA; Domain location=403-618; Score=- 83.2; E_value=0.0016; Accession=PF02309.7; Description=AUXIAA family
  Pfam annotation: Domain name=Auxin_resp; Domain location=229-311; Score=179.0; E_value=1.2e-50; Accession=PF06507.4; Description=Auxin response factor
  Pfam annotation: Domain name=B3; Domain location=117-207; Score=36.1; E_value=1.2e-07; Accession=PF02362.12; Description=B3 DNA binding domain
  Pfam module annotation: Pfam domain module=AUX_IAA::Auxin_resp::B3; Domain location=403-618::229-311::117-207
MASAAPGATNDALYKELWHACAGPLVTLPREGERVYYFPQGHMEQLEASMNQGLEQQMPSFNLPSKILCKVVNVHLRAEPETDEVYAQITLLPEADQSEVTSPDDPLPESPRCTVHSFCKTLTASDTSTHGGFSVLRRHADDCLPPLDMTQQPPWQELVATDLHGNEWHFRHIFRECGCGRCIFLQIEYAEGENGELRVGVRRLMRQHSNMPSSVISSHSMHLGVLATASHAIATGTLFSVFYKPRTSRSEFIVSVNKYLEAQSHKLSVGMRFKMRFEGDEVPERRFSGTIVGVEDNKSLVWADSEWRSLKVQWDEPSSILRPDRVSPWELEPLVSNPPTNSQPSQRNKRSRPPILPSTMLDSSLQGVWKSPVESAPFSYRDHQHGRDVYPSTNFNSTATGFLGFGGNCSASNKSIYWSSRIENSTESFSPVAVKEFGEKRQGTANGCRLFGIQLHDNSNSNEESLPMVSLSGRVGDDGLLPSLDAESDQHSEPSNVNRSDFPSVSCDAEKSCLRSPQESQSRQIRSCTKVHMQGMAVGRAVDLTRFDGYEDLLRKLEEMFDINGELCGSTKEWQVVYTDNEDDMMMVGDDPWLEFCSIVRKIFIYTAEEVKKLSPKIGLPISEEVKPCKMDSEAVVNPGDQSSILGPGC

SEQ ID NO: 122185 - protein, 499 aa, Glycine max
  Coding DNA Sequence Number=SeqID_5407
  Gene Ontology: Mol. function=pyridoxal phosphate binding; Biological process=biosynthetic process
  Homolog annotation: Hit_ID=Q1SKS5; Match level="QueryCoverage=99%, HitCoverage=46%, E-value=0.0, Identity=86%"; Hit description=SAM (And some other nucleotide) binding motif
  Pfam annotation: Domain name=MTS; Domain location=100-298; Score= -79.6; E_value=0.0078; Accession=PF05175.4; Description =Methyltransferase small domain
MSWMSVDEFLVQCKKSGDAAYASLRSLLERLDNPETRSQARIFLSHLQKRFPTKDSCDQCFETYHFRIEDVSLGQYEGHHGRNKLTMMVIPSIFLPEDWSFTFYEGINRHPDSIFKERTVAELGCGNGWISIAMAEKWLPYKVYGLDINPRAVKVSWINLYLNALDENGQLIYDEENKTLLDRVEFHESDLLSYCREKDIQLERIVGCIPQILNPNPDAMSKMITENASEEFLHSLSNYCALQGFVEDQFGLGLIARAVEEGIAVIKPTGIMIFNMGGRPGQAVCKRLFERRGFRITKLWQTKIIQAGDTDIEALVEIEKNSPHRFEFFMGLSGDQPICARTAWTYGKSGGSISHALSVYSCQLRHPNQVKAIFDFLKHGFQEIGSSLDLSFEDDSVADEKIPFLAYLASRLKNNSYFPYEPPAGSKHFRNLIAGFLKTYHHIPLTSDNVVIFPSRTAAIEHALRLFSPRLAVVDEHLTRHLPRQWLTSSTLEVWNSMP

SEQ ID NO: 122186 - protein, 574 aa, Glycine max
  Coding DNA Sequence Number=SeqID_5408
  Homolog annotation: Hit_ID=Q1T132; Match level="QueryCoverage=27%, HitCoverage=23%, E-value=5e-23, Identity=39%"; Hit description=IMP dehydrogenase/GMP reductase
  Subcellular localization annotation: CTP_CleavageSite=12; ConfidenceScore=5.10e-01
MTYLLYCLWPIQVSLKSATRCTQHYCCIFSFRETLPPAALSSFFLILPRGGCASPTRATASPSFECASSILPQGSALLFFIEIMVRTRGLGRVLGQVTGRGDRDDSDDAPQRRRPTASARRQRVAGFPGGPSDPSVLTTYADHVACSVWTGEERPELKLSSHGRKVHSLGRPVPAIEGLIAGTGLSPLIACSVDTDDRGLLSADFHAFEPLHVDDVVQMLVDLLMVSPEFARAETVQCCGPYVRLQWVRDVYQRRCQAGHWTAAARAYLLHLLGCTLFANKSATNVHVVYLEALRDLSMIDRYAWGVAALCWIYEHFSSVAESTADQDYDEASPRACRWIVTKKTVKSICMPSYREHLNRLRIPDVCWIPYGEHREVRDFHVRSCYSGLLRWGHVAVYYRPERVVWQFGYTQTIPAPPVDSWVSYDDIHDRWMHYEDHIVSAGEVCVVPGACSSDYIDWFFRISHPFMTPGHTVDPLPHGHAPQPRVVPQAPQTDIPRVPEPEASSTSTEEPRHAVEVCDDIAERLERHLSLGVVTPGSSTHEVIEECLRLARSVTQDHLVYVRCRRRRHTDQA

SEQ ID NO: 122187 - protein, 541 aa, Glycine max
  Coding DNA Sequence Number=SeqID_5409
  Gene Ontology: Mol. function=nucleic acid binding; Cellular component= intracellular; Biological process=RNA processing
  Homolog annotation: Hit_ID=Q6ZCC0; Match level="QueryCoverage=85%, HitCoverage=56%, E-value=1e-125, Identity=47%"; Hit description =Putative RNA recognition motif (RRM)-containing protein
MEQNLMLAAEAEREKSKAMSDSDERMKETLALTAEAERDRDNSMSDFDDSDSEDEAQQNLQLESLQTELVTNPSNYDAHLQFGVDDPPFQYITLLRRMGDVDKLSRAREAMSELFPLSPAIWRQWIKDELSLNTATRPEAFSRILKLYERGVFDYLKKVYLLNCRSLNWILKGLDVSVSLWCDYINFVQEFDPMVRQCSPTGISKARDLFESALTAAGLHVAEGSKIWEAYRKYEQAILLTFDDIDAQAKEKQVQSIRSLFHRQLSVPLAGMSSTITAYKTWEVEQGSLQDVESIDLVDIYPHVAASYQKALDMYNARFHLEEQILSPNVSDSERLQHYMNYLKFEQSSGTPARIQVLYERAITDFPITPDLWLDYTCNLDNTLKVGNIVNNVYSRATKNCPWVGELWVRCMLSLERGHASEKDLSERASDYLSPYLKNTEGLLHLHAYWARLETKLGKDITAARGVWENCLKICGSMLESWTGYIAMEVELGHINEARSIYKRCYSKRFSGTGSEDHNDEERQKGEVRAASCDKRGQTQG

SEQ ID NO: 122188 - protein, 124 aa, Glycine max
  Coding DNA Sequence Number=SeqID_5410
  Subcellular localization annotation: CTP_CleavageSite=31; ConfidenceScore=5.05e-01
MQHLIYDQGSMSSYALKGRKPGRIGRNRNAKHSQVASITPSTKQLSFVYYKKEASLPMYSGRSGIQDGLVKDWKQLYSHGKRELQNKFVENPQFDPHDHLLLDGAETLLQLLKTRYSNISGCYM

SEQ ID NO: 122189 - protein, 98 aa, Glycine max
  Coding DNA Sequence Number=SeqID_5411
  Pfam annotation: Domain name=Chromo; Domain location=9-61; Score =46.5; E_value=8.8e-11; Accession=PF00385.14; Description='chromo' (CHRromatin Organisation MOdifier
MNENWQLEPEPEEAVDTRKNEQGVVEVLVKWKDLPDFENSWEPVEKLRSEFPGFLLEGKKSFEGGGIDKQQIVYTRKHGKGSVGDHPTRGVTNLVGNV

SEQ ID NO: 122190 - protein, 153 aa, Glycine max
  Coding DNA Sequence Number=SeqID_5412
  Gene Ontology: Mol. function=nucleic acid binding; Cellular component= intracellular; Biological process=RNA processing
  Homolog annotation: Hit_ID=Q6ZCC0; Match level="QueryCoverage=96%, HitCoverage=19%, E-value=2e-17, Identity=35%"; Hit description =Putative RNA recognition motif (RRM)-containing protein
MVTPRLEELKLFRIQQESKTAEESEKNPKRNAREKRKLGSDITEEQYPTKRFRDVGNPKKAPEENKYQLQNTSQVTKVEGANWKNTKIDDNPSEQQFNHEKNRAYSDQCTVFISNLHPTANYEHIRNFFGDDGGIVAIRILHDKFTGKSRDSI

SEQ ID NO: 122191 - protein, 394 aa, Glycine max
  Coding DNA Sequence Number=SeqID_5413
  Gene Ontology: Mol. function=glutamyl-tRNA reductase activity; Biological process=tetrapyrrole biosynthetic process
  Homolog annotation: Hit_ID=Q6AVG1; Match level="QueryCoverage=76%, HitCoverage=75%, E-value=1e-103, Identity=56%"; Hit description =Expressed protein
  Pfam annotation: Domain name=DUF266; Domain location=161-272; Score =234.2; E_value=2.8e-67; Accession=PF03267.4; Description=Arabidopsis protein of unknown function, DUF266
MGRNQREREKEEGEKHVGLLRLAQILTFLVVFAGGVVIGLTTSSHINGHFISQPYQYISLRNVPSPPPPEPTAMAAADPPLPPNLDLEAFLHPLNLTHCLSDEELFWRASLIPKKESYPFSRIPKVAFMFLTRGPLPMLPLWERFFHGHSSLFNIYIHSPPRFLLNVSHSSPFYLRHIPSQDVSWGTVTLADAERRLLANALLDFSNERFVLLSESCIPVYNFPTVYRYLTNSSLSFVESYDEPTRYGRGRYSRNMLPHIQLRHWRKGSQWFELNRALAVYIVSDTNYYSLFRKYCKPACYPDEHYIPTFLNMFHGSLNSNRTVTWVDWSMLGPHPATYGRANITAGFIQSIRNNGSLCRYNSEITSICYLFARKFDPSALEPLLNLSSEVMNF

SEQ ID NO: 122192 - protein, 86 aa, Glycine max
  Coding DNA Sequence Number=SeqID_5414
MIKNQELKINTYVNNNRDNRAGSQRLEREQKRAGALLENAERCLNTCWRKRTEQSRLQRWVGKCWKSSEKNGVCPGRQHKIRSLKA

SEQ ID NO: 122193 - protein, 104 aa, Glycine max
  Coding DNA Sequence Number=SeqID_5415
MVETNIFTLKFIAFPDSKTYLEESSVVDLGFNELGVIVDLVRAYHEDEDFGALNIWCSSDKVDDVVYICCGFGVAHPKLVNSRDTKIVIISIRKISGKGGDYDN

SEQ ID NO: 122194 - protein, 191 aa, Glycine max
  Coding DNA Sequence Number=SeqID_5416
  Homolog annotation: Hit_ID=Q10EU0; Match level="QueryCoverage=28%, HitCoverage=23%, E-value=5e-08, Identity=46%"; Hit description =Expressed protein
MEKLIRPCDKEYMRITMLKHQDTFKEQVYELHRLYRIQNILMKNMEATRGAQQNPKLNFDLERPAKEDMAEADSDGVLEVINETEIELTLGPSSYKRKKVETPLTSDSAHRLSSSSTGSSLINKTRLKTRHSSYSAAEELSGGLIGLVHVRHSTAGCQSGIRRSYEIEERSRDERTKQPPWFFQVLSLNTN

SEQ ID NO: 122195 - protein, 517 aa, Glycine max
  Coding DNA Sequence Number=SeqID_5417
  Gene Ontology: Mol. function=ribonuclease III activity; Biological process=RNA processing
  Homolog annotation: Hit_ID=Q1SEC6; Match level="QueryCoverage=98%, HitCoverage=96%, E-value=1e-176, Identity=63%"; Hit description =Ribonuclease III
  Pfam annotation: Domain name=Ribonuclease_3; Domain location=181-271; Score=56.4; E_value=9.4e-14; Accession=PF00636.16; Description=RNase3 domain
  Subcellular localization annotation: CTP_CleavageSite=37; ConfidenceScore=5.49e-01
MELSSSFLFSPKPCSCPPPNYSLSPLIRNRNPNFRIVAVALEPQQQQDFPSGNSPQRLLKELAERKKATSPKKGPPRRFILRPPIDDNKLAERFLNSPQLCLKLFPLLSSCLPSSRLNNADKLWIDEYLLEAKQALGYSLEPSETLGDDNPAKQFDTLLYLAFQHPSCERTKARHVRSGHSRLSFLGQYVLELALTEFFLQRYPRESPGPMRERVFGLIGKRSLPKWIKAASLHNLIFTFDDMDKIMRREKEGPVKSVFWALFGAIYLCFGMPEVYRVLFEVFGMDPDAEDCQPKLRRQLEDVDYVSAEFEGKLSWQDIVAYKASYTYALFEHPRLFRACVPPGMHRFRGNIWDYDTRPHVMKTLGYPLEMTDRIPEITEARNVELGLGLQGGFVCLSELQSYLAYSDTFKDLVMAERLLMKHLDAPGLWLQEKHRRLLMNKYCGRYLRAKHLHRVIIFDEKVQDTYEHNRRKRNPATTAVQQALHGLSYLVYGKRDVRRLMFEVFDFEQIQPKEVV

SEQ ID NO: 122196 - protein, 54 aa, Glycine max
  Coding DNA Sequence Number=SeqID_5418
MDMEWKHALPGQKGAFVWSSGSYAMGVLKGKARVARAYAVVYIPEQCDTVFIPN

SEQ ID NO: 122197 - protein, 345 aa, Glycine max
  Coding DNA Sequence Number=SeqID_5419
  Gene Ontology: Mol. function=DNA binding; Cellular component =membrane; Biological process=DNA integration
  Homolog annotation: Hit_ID=Q1SS72; Match level="QueryCoverage=94%, HitCoverage=23%, E-value=2e-76, Identity=41%"; Hit description =Integrase, catalytic region
  Pfam annotation: Domain name=zf-CCHC; Domain location=246-263; Score =9.6; E_value=0.025; Accession=PF00098.13; Description=Zinc knuckle
  Pfam annotation: Domain name=zf-CCHC; Domain location=282-299; Score =12.8; E_value=0.0078; Accession=PF00098.13; Description=Zinc knuckle
  Pfam module annotation: Pfam domain module=Retrotrans_gag::zf -CCHC::zf-CCHC; Domain location=77-192::246-263::282-299
MNEASINNTESYQYLHPSKNPATALVSPVLDSTNYHSWSRSMITALSAMNKVEFIDGSAPEPLKTDRMHGAWRRCNNMVVSWIVHSVATSIRQSILWMDKAEEIWRDLKSRYSQGDLLRISDLQQEASTMKQGSLTVTEYFTRLRVIWDEIENFRPDPICSCNIRCSCNAFTVIAQRKLEDRAMQFLRGLNEQYTNIRSHVLLMDPIPAISKIFSYVAQQERQLLGNTGPGINFEPKDISISAAKTICDFCGRIGHVESVCYKKHGVPSNYGSRNKSNSGRKTCTHCGKIGHTVDVCYRKHGYPPGYKPYNGRTTVNNVVAVESKATDDQAQHHESHEFVCFSPE

SEQ ID NO: 122198 - protein, 667 aa, Glycine max
  Coding DNA Sequence Number=SeqID_5420
  Gene Ontology: Mol. function=DNA binding; Cellular component=beta -galactosidase complex; Biological process=DNA integration
  Homolog annotation: Hit_ID=Q1SLU3; Match level="QueryCoverage=98%, HitCoverage=58%, E-value=0.0, Identity=59%"; Hit description =Integrase, catalytic region
  Pfam annotation: Domain name=rve; Domain location=9-165; Score=108.1; E_value=2.5e-29; Accession=PF00665.16; Description=Integrase core domain
  Pfam module annotation: Pfam domain module=RVT_2::rve; Domain location=167-422::9-165
MPFSPSSSHASHVFDLLHMDIWGSCSKLSMHGHKYFLTIVDNCSRFTWVHLMKSKAETRQVIINFIAFIETQYNGKVKIIRSDNGVEFFMHHYYASKGIIHQTTCVETPEQNGVAERKHQHLLNITRALLFQASLPPSFWNFFISISSTAEPSSYAEASRHDCWIKAMKVELQALQSNNTWRLTRLPPHKTAIGCRWIYKIKYRADGSIERHKARLVAKGYTQMEGLDYLDTFSPVAKLTTVCLLLALAALNQWHLRQLDVNNAFLHGELDEEVYMQIPLGLSVDNPQLVCRLQRSLYGLKQASKQWFMKLSSFLCSHGFQQSNADHSLFLRFTGVITTILLVYVDDIILTGNNMAEIQTMITLLDREFKIKDLGDLKFFLGLEIARTSKGIHLCQRKYTLDILCDSGMLGCKPNSTPMDYSTKLQANFENLLSADSSSSYRRLIGKLIYLTNTRPDITYAVQQLSQYMATPTDTHLQAAFRILRYLKGTPGSGLFFAATGTPQLQAFSDSDWAGCKDSRKSTTGYLVYLGSSLVSWQSKKQSTVLRSSSEAEYRALASTTCELQWLTFLLQDFRATFTQPATLYCDNQSAIQIATNPVFHERTKHIEIDCHIVRQKLNSSLIKLLPVSSSLQLADIFTKALTPTIFQHFCNKLGMMNIHSQLEGGS

SEQ ID NO: 122199 - protein, 61 aa, Glycine max
  Coding DNA Sequence Number=SeqID_5421
  Subcellular localization annotation: CTP_CleavageSite=36; ConfidenceScore=5.04e-01
MWNMKSGCGKQNYSKESKGVTRISPTFPFKFQQLILANTTNSKLLGVDAVSLLNKKISSDI

SEQ ID NO: 122200 - protein, 45 aa, Glycine max
  Coding DNA Sequence Number=SeqID_5422
MPIDLKRKDNQASYFMLRDMGTLPSTSSFVSGIVLKLIQISSTPH

SEQ ID NO: 122201 - protein, 404 aa, Glycine max
  Coding DNA Sequence Number=SeqID_5423
  Gene Ontology: Mol. function=binding
  Homolog annotation: Hit_ID=Q1SRX0; Match level="QueryCoverage=88%, HitCoverage=45%, E-value=2e-49, Identity=36%"; Hit description =Tetratricopeptide-like helical
  Pfam annotation: Domain name=Extensin_2; Domain location=7-342; Score= -138.1; E_value=0.066; Accession=PF04554.4; Description=Extensin-like region
MRYGVGLTSSLREFVTEVFKKAGRSDEIERLLDMNRFAYTPRPSPPRPAYRPPPPPPVRFPSQMAGAAHNPPSGFQTQMAAQWHPTPPPQMTGAHYPPSQMAGAAHNPPSGFQTQMAAQQPPTPPPPQMTGAHYPPSQMAGAAHNPPSGFQTQMAAQQRPTPPPPQMTGAHYPPSQMAGAAHNTPSGAPHQVLGHQRPPLPSQMTGMHQPSWGLSPPMTGPHPGSSPHMTGQSYHPNTSEHPPHMSRVAPQMTEQHYTPSGSSPQMAGHGHQPYGTPHGPQQMEERWYPSSGLSPPMSGSSIPWNGASAKMSPPYHRSAAPSSQVTGPYHPSSSSSSPPHFEESHQQQSEVPEQRTVDLSLPYLKCLVTPISLLFGINQVFGVYMSCVWICILSGSGKCEEADF

SEQ ID NO: 122202 - protein, 96 aa, Glycine max
  Coding DNA Sequence Number=SeqID_5424
MAEIRKKSMAIDTCMIFCPEKEKEKGREKETGKEDEGFHYFLILDCAPFFVLYLIMIWFNFICASYKQPLYIDLTFQGQLPSRNPQLTLTNFPYSL

SEQ ID NO: 122203 - protein, 91 aa, Glycine max
  Coding DNA Sequence Number=SeqID_5425
  Homolog annotation: Hit_ID=Q5JLN0; Match level="QueryCoverage=78%, HitCoverage=17%, E-value=2e-14, Identity=49%"; Hit description =Lysine ketoglutarate reductase trans-splicing related 1-like
MWLLFISSIFQGDRMRNVGVVDSEYIVHLGLPTHGGSNGNEASPGSPGDNRSKVRMQSYIEMQVFGKRWKDAAEKDKCWIDPYAQENKTSH

SEQ ID NO: 122204 - protein, 394 aa, Glycine max
  Coding DNA Sequence Number=SeqID_5426
  Homolog annotation: Hit_ID=Q7XIK6; Match level="QueryCoverage=53%, HitCoverage=48%, E-value=7e-65, Identity=56%"; Hit description =Putative lysine ketoglutarate reductase trans-splicing related 1
  Pfam annotation: Domain name=DUF707; Domain location=27-372; Score =272.6; E_value=7.7e-79; Accession=PF05212.3; Description=Protein of unknown function (DUF707)
MSLFSTYSLPLSSLHPLSSRHTSQVSLLIAFHAIRITTCIHYLVVKGNKWSWLESVEGCEKEVGLGRERIRSLEYLGGILKRPLNLLAMAVGLEQKEIVNKIVEKFLSSDFVVMLFHYDGFVDGWKSLAWSSRAIHVSAINQTKWWFAKRFLHPDIVVEYNYIFLWDEDLLVDNFDPKRYLSIVKEEGLEISQPALDPTKSEVHHPLTVHKAGSKVHRLTLFSQPFAINSVPLVVEGVMTKALLLLALGKNSCTPWVEMMAPVFSKKSWQCVWHLIQNDLIHAWGLDRQLGYCAQAPSGSSGDNRAKIYAPLAPILTLDKGIYYMQVWDFVRVCRNIASLTIILLSFCLHAIHFLKHWCALGCIEFFIWQQKNVRHRFFFFLREGQVNVKRLLV

SEQ ID NO: 122205 - protein, 87 aa, Glycine max
  Coding DNA Sequence Number=SeqID_5427
MKAMCGKEIHWQEERRVTNTYIAYRKEGIETVEQKKKPKEKDKDKGNEHTINTTVACCIKDWIGLIEERRWSRHFPDWELRVLLKLS

SEQ ID NO: 122206 - protein, 297 aa, Glycine max
  Coding DNA Sequence Number=SeqID_5428
  Gene Ontology: Mol. function=ligase activity
  Homolog annotation: Hit_ID=Q1S4D1; Match level="QueryCoverage=99%, HitCoverage=80%, E-value=1e-136, Identity=81%"; Hit description=AMP -dependent synthetase and ligase
MGFAEPCLFLTLVFLLRAPLQNLETGIMSRKWNVKTSGYILLYCLPMFVLQLFVILVGPQLDKNKGFGKMLPHYFSSAVVASGENDTTLCTYPLLSTILHGLFAIILTSYLFWLGSRILKLVINKGLQKRVYTLLFSVSCFLPLRVLFLGLSVLSGPEHVMFEALVFLAFLALVCCVGLCMCTLVYRPVADCLALGNLQDLEARRLNDDHNDTVSLIANQSYLEDNVEDNARSSPGRYSDASTKRGSISFRTLEKGVTSTGTFVELSLFSPSRSATPPGSPPLLGWPMRSPTQVIGP

SEQ ID NO: 122207 - protein, 120 aa, Glycine max
  Coding DNA Sequence Number=SeqID_5429
  Homolog annotation: Hit_ID=Q43001; Match level="QueryCoverage=54%, HitCoverage=7%, E-value=6e-10, Identity=52%"; Hit description=H -ATPase
MEATVIIAKALANGGVKPLDWRDFLLRLSDSLVNSTMSFIKENNANNVVATHMGKVPTIKIARTFSLLFSQRIDDRCVCSSRTAPTTGVLQDFLIENAEGGRCGARRANTPVIGAMREEQ

SEQ ID NO: 122208 - protein, 284 aa, Glycine max
  Coding DNA Sequence Number=SeqID_5430
  Gene Ontology: Cellular component=chloroplast inner membrane
  Homolog annotation: Hit_ID=Q9FNA1; Match level="QueryCoverage=58%, HitCoverage=59%, E-value=4e-34, Identity=45%"; Hit description =Arabidopsis thaliana genomic DNA, chromosome 5, P1 clone:MSH12
  Pfam annotation: Domain name=UPF0114; Domain location=103-253; Score =165.1; E_value=1.8e-46; Accession=PF03350.6; Description =Uncharacterized protein family, UPF0114
  Subcellular localization annotation: CTP_CleavageSite=61; ConfidenceScore=5.81e-01
MKLSQALVRTPFSTTSPALLRTQNSILSSNGKRVFVLGYQSLRLPSCACSNSGSAVSSSPAAAAKETNPSPLPHVASNSGYDSAVTLELPGKLEALEEGIEKVIYRCRFMAILGVFGSLTGSFLCFIKPLVCICASPDPFRFLCGDESGCTFVTASFMQYFVNRSKVIQTLIEAIDVYLLGTVMLVFGMGLYELFVSNLGVDQKPSHRSSLFGLFTLKERPKWLDIKTVDELKTKLGHVIVMLLLIGLFDKSKKAAIHTPVDLLCFCVSVLLSSSCLFLLSKLN

SEQ ID NO: 122209 - protein, 300 aa, Glycine max
  Coding DNA Sequence Number=SeqID_5431
  Gene Ontology: Mol. function=protein serine/threonine kinase activity; Cellular component=cell cortex; Biological process=protein amino acid phosphorylation
  Homolog annotation: Hit_ID=Q1S4D4; Match level="QueryCoverage=97%, HitCoverage=97%, E-value=5e-85, Identity=51%"; Hit description =Protein kinase
  Pfam annotation: Domain name=Pkinase; Domain location=11-232; Score =174.2; E_value=3.2e-49; Accession=PF00069.15; Description=Protein kinase domain
  Pfam annotation: Domain name=Pkinase_Tyr; Domain location=11-232; Score=16.7; E_value=1.7e-13; Accession=PF07714.7; Description =Protein tyrosine kinase
  Pfam module annotation: Pfam domain module=Pkinase::Pkinase_Tyr; Domain location=11-232::11-232
MGAIRQQPSEWVKGKLVGCGSFGTVHLAMNKYTGGLFVVKSPHSGVGRQSLDKEYMAGGNLADMAHKFGGSLDEEVVRVYTREILHGLKHLHQHGIVHCDLKCKNVLLSSSGNIKLADFGSAKRVKEANCWQSIGGTPLWMAPEVLRNESLDFAADIWSLGCTVIEMATGTPPWAHQVSNPTTAVLMIAHGHGIPHFPPHFSKEGLDFLTRCFERHPNKRPTVQDLLTHPFIVSTKQYASSPTSVLEVQNFKDSDDELETCSDQGNHFSITNTTFAFHDDDLKGIPICKPEDISSGNWIT

SEQ ID NO: 122210 - protein, 217 aa, Glycine max
  Coding DNA Sequence Number=SeqID_5432
  Homolog annotation: Hit_ID=Q9FH78; Match level="QueryCoverage=91%, HitCoverage=98%, E-value=3e-51, Identity=51%"; Hit description =Arabidopsis thaliana genomic DNA, chromosome 5, TAC clone:K9E15
  Pfam annotation: Domain name=Hin1; Domain location=58-195; Score =92.2; E_value=1.5e-24; Accession=PF07320.4; Description=Harpin -induced protein 1 (Hin1)
MPSHDHVAERQHHRPIRRRLVNTHHSGKTHPLIWLAAILCTIIAIGVVIAGIVVFVGYMVIHPRIPVMSITNAHLDLLSNDYAGLLQTQLTIIVVAQNGNAKAHATFSDIRFNLSYQGQRIALMRAPPFDVPKNSSKSLNYVVRAASIPLTPQQMEEVDESWKRDVIGFDLKGSARTRWRVGPLGSVKFWCNLECQLKFHPSNGSYIHHSRCTSKSK

SEQ ID NO: 122211 - protein, 282 aa, Glycine max
  Coding DNA Sequence Number=SeqID_5433
  Gene Ontology: Mol. function=isoleucine-tRNA ligase activity; Cellular component=soluble fraction; Biological process=tRNA aminoacylation for protein translation
  Homolog annotation: Hit_ID=Q3H0S3; Match level="QueryCoverage=96%, HitCoverage=25%, E-value=1e-136, Identity=81%"; Hit description =Isoleucyl-tRNA synthetase, class Ia
  Pfam annotation: Domain name=tRNA-synt_1; Domain location=29-282; Score=-187.5; E_value=5.8e-11; Accession=PF00133.12; Description =tRNA synthetases class I (I, L, M and V)
  Pfam annotation: Domain name=tRNA-synt_1g; Domain location=64-269; Score=-295.1; E_value=0.051; Accession=PF09334.1; Description=tRNA synthetases class I (M)
  Pfam module annotation: Pfam domain module=tRNA-synt_1::tRNA-synt_1g; Domain location=29-282::64-269
MTYPKVTTDPTAGQGAVPSSPRFPAIEEGVLAYWAEDDTFRASVAQRDPGSNGENEFVFYDGPPFANGLPHYGHLLTGYVKDIVPRYQTMRGKRVERRFGWDTHGLPAELEAMRLNGIKTTDEIVEMGIDKFNDACRASVLKYTGEWRDYVTRQARWVDFDNDYRTMNPEFMESVLWAFKSLFDKGLVYEGFRVLPYCWNDETPLSNHELRMDDDVYQMRQDPAVTVGFRITTPGPFEGAKLMIWTTTPWTLPSNLAVMVGSDIDYVVVEHDPSTGSGTERL

SEQ ID NO: 122212 - protein, 142 aa, Glycine max
  Coding DNA Sequence Number=SeqID_5434
  Subcellular localization annotation: CTP_CleavageSite=38; ConfidenceScore=5.40e-01
IIFLLTLTFLRSSPYFSLTLSLPHLPPFFLSPLLPPVLQGQQPNLLCFLALVRPQEPHFLCRPRLPSRRRLLPQPLWWRLRKPPRRHGLLYADIESGIAVLRDIDDVWNNVTAGLSIRVLYLAAIVSPRQCPAALGTIAGRS

SEQ ID NO: 122213 - protein, 33 aa, Glycine max
  Coding DNA Sequence Number=SeqID_5435
MAKKTMNDETGDDAFRPTSPGHSPGVGHQTPPP

SEQ ID NO: 122214 - protein, 70 aa, Glycine max
  Coding DNA Sequence Number=SeqID_5436
MDAYCTIKILMFSTNANANVMKNRTDLLIIPLRLCLPRSLYGLWVEESIHIDIPCSHTCLSHIPIVVKIK

SEQ ID NO: 122215 - protein, 72 aa, Glycine max
  Coding DNA Sequence Number=SeqID_5437
MGVLGRDLKVLQRVAEPSAPRDDSRFVVGVGAGRSGSEAQVVMQVRGERSSPLGHALCTTKRRASEGRKYRM

SEQ ID NO: 122216 - protein, 247 aa, Glycine max
  Coding DNA Sequence Number=SeqID_5438
  Gene Ontology: Mol. function=metalloendopeptidase activity; Cellular component=mitochondrion; Biological process=proteolysis
  Homolog annotation: Hit_ID=Q5N6Y0; Match level="QueryCoverage=67%, HitCoverage=26%, E-value=4e-37, Identity=45%"; Hit description =Putative thimet oligopeptidase
MGKEKRRGIILAFTGAAAVLAIAANLAITAIKYQKAKNAKKKDLAGSMVRVNLSASEILKLAEQIIANSNKVHNSVASVPLDKNCKRSNSHWSSVFPKMVSTREDVRKASAEAVRRLDAHFDTCSKREDVYLVIKAFAVSGEWMNAEAKLCSNSDFERNGLNLTASKREELQRLRDQIDELSFKYIQNLNDDSRFILFTKAELAGLPPEFLKQNILASLHPCSQAHLVGKGLAVLLYSSINPLNYEL

SEQ ID NO: 122217 - protein, 454 aa, Glycine max
  Coding DNA Sequence Number=SeqID_5439
  Gene Ontology: Mol. function=metalloendopeptidase activity; Cellular component=mitochondrion; Biological process=proteolysis
  Homolog annotation: Hit_ID=Q5N6Y0; Match level="QueryCoverage=98%, HitCoverage=63%, E-value=1e-145, Identity=54%"; Hit description =Putative thimet oligopeptidase
  Pfam annotation: Domain name=Peptidase_M3; Domain location=1-451; Score=207.9; E_value=2.4e-59; Accession=PF01432.10; Description =Peptidase family M3
MKVGTTRQVVSGAYGNRCGEINVSILERLVQQRHKYARLLGYSCYAEYVIDVRMAKTPKKVFEFLKDISTSLTGLALKELNILKDVKKKEEGEFPFGIEDLLYYVKRVEEQDYDLDFGEIKQYLPISVVLSGIFKIIQDLFGLRFEEIARADVWHGYCYLDLFSREGKYGHTCVLALQNSALTSSGAHQIPVALLISQCQKDADGSSGLLRFSEVVSLFHEFGHVVQQICNRASFTRISGLCVDADFVEIPAQLLENWCYESYSLKLISGFHQDITKPLTDDICKSIKRWRTSFSALKLKQDILCCLFDQIIHSADNIDIQELFKYLHPMSERKFYVNFISQEMLGLPILEGTNPASYFPSTVVGYEAACYSRIWSEVFAADIFTSKFCNDVSNQQAGMQFRNKQYIGLLKQISEKAIVLASAGVKDPIDVLLDFLGREPSIQAYIENKVKYVL

SEQ ID NO: 122218 - protein, 288 aa, Glycine max
  Coding DNA Sequence Number=SeqID_5440
  Gene Ontology: Mol. function=DNA binding; Cellular component=nucleus; Biological process=regulation of transcription
  Homolog annotation: Hit_ID=Q43326; Match level="QueryCoverage=71%, HitCoverage=50%, E-value=6e-80, Identity=71%"; Hit description=Box II Factor
MDHRLDSCIVSMHLIFLTKDHIILNNLKVGFNSYEILLNCHSQASAKTSEDEKTPDNAHGEGIEMVGLNDCHGAGLGGGENMVLTIPVSLLGLLKILILLLVATGRPTLNLERSLDHDGHPLAITTADAVAASGVPPWNWRETPGNGGESQSCCGRVISVKWGDYTRRIGIDGTPEAIKEAIRAAFRLRTKRTFWLEDEDQIIRSIDREMPLGNYTLHIDEGMAIKLPLYDEPDHIPVHTEDKIFYTEDDFRDFLTRRGWICLREFDSYRNIDNMDDLRPGAIYRGVS

SEQ ID NO: 122219 - protein, 84 aa, Glycine max
  Coding DNA Sequence Number=SeqID_5441
MDSGMSWADQWDNNPDPSPASDKDKKGKDGSGKNNKFGKTMLSFKWVKELRKKTQNRKIQVKVRVGTDKMNSSHWIGIWHMFGW

SEQ ID NO: 122220 - protein, 197 aa, Glycine max
  Coding DNA Sequence Number=SeqID_5442
MGAIVLSSRWWETTKGGGADVGAIVGGGLGGDGVGMSAESRSRMILGGHGGKVEGEEGLWQVEAAMGGRSDQLLRAERKGKEREGGAREREGKGIFVHSSSLVVQKDENEVQEYNINATKTDDFVRIKHVYGVEVKLVRGEIQKTKIPTSVESDRPRSPTQLNLRGKRPSLLLCREFMCLSLFKEYFPHLVTYYING

SEQ ID NO: 122221 - protein, 115 aa, Glycine max
  Coding DNA Sequence Number=SeqID_5443
MAWDTLLIRFFVLVVGELKLKTQIKRWCTALHDGGCLAEEGDKGRDGINLVVVKELSIDHVYCMLSVRHQGADTWLERFPKKFVHRASLLTFLISHFYPITHSSSPSYLLLSSVI

SEQ ID NO: 122222 - protein, 514 aa, Glycine max
  Coding DNA Sequence Number=SeqID_5444
  Homolog annotation: Hit_ID=Q651K5; Match level="QueryCoverage=22%, HitCoverage=16%, E-value=6e-15, Identity=44%"; Hit description =AlphaSNBP(B)-like
MAYLNLQIKFPAPSSKLEEQVFSDPAIIQSEYSGLLSSPVVGLLSSPVASVGGRSLTESIQRQDSPAISSKAFPAGLPSHQSVTQPGPSNSSAATQVASHPSFFAAMDWQGPSRISSSSSHSLLQSSSRQPPSLAASLAVQNQMQNAETQVPIKGGWTALSDYGLPVSSAMASLVNQTHPPSLTSLKNSDSLDIPSLLSTKPPVSYSASMTFDGSNMPQFSSTLQDINSIQAQISGNICPDPRSIHPQHSVHRSAPSFVDSTSGSLPTAPSLLTPDQFAYPREQLLSLTHLNPTQKDMGSLTLTSSGSSALMPSPASQAPLLPLPTSVQKLPCTAPQYTEESDLEAINEKFKKNVVWGSFGKATTKIEGVDNASLPALQYTEEFDIEAINEKFKKNVVWGSFGKAITKIEGVEDNASLSLGDRECPGVIPNPKTGYKKDDFFDTISCNSSTGGSRSGPNLFSERMKQDTETSDSFQQRPNFTSGAGRGADFRGANNWGRGYGYNRRGRGPNFPF

SEQ ID NO: 122223 - protein, 191 aa, Glycine max
  Coding DNA Sequence Number=SeqID_5445
  Pfam annotation: Domain name=DUF1218; Domain location=52-166; Score =83.0; E_value=9.1e-22; Accession=PF06749.3; Description=Protein of unknown function (DUF1218)
MVETPPKCKLTFTLIFCIVISHSLGLVSFTLCIASETKRNKKGDLRWNGKLCHLPSSPAFGLGVASLVCLVLSQIVGNSILFRTYCSGGKRNAKFEIPFVARILLLISWLSFGIAVILLIVATSMSRRQAYGEGWLNGECYLVKGGIYVGLAILIIVSVESLMGSALLTMKTNDEADQGNKIHAQTERSDT

SEQ ID NO: 122224 - protein, 650 aa, Glycine max
  Coding DNA Sequence Number=SeqID_5446
  Gene Ontology: Mol. function=binding; Cellular component=COPI vesicle coat; Biological process=protein transport
  Homolog annotation: Hit_ID=Q9C6W3; Match level="QueryCoverage=93%, HitCoverage=60%, E-value=1e-170, Identity=56%"; Hit description =Epsilon-adaptin, putative
MGHNIVHIIVDKYPDDVYHIKSQWRRMYYVSWVVKKEGKEGRDPDDSLKRKTFELLYKMTKSSNVEVIVDRMIDYMISMSDDHYKTYIASRCVELAEQFAPSNYWFIQTMNKVFEHAGDLVNIKVAHNLMRLIAEGFGEDDDAADSQLRSSAVESYLRIIGEPKLPSVFLQVICWVLGEYGTVDGKYSASYISGKLCDIAEAYSNDENVKANAISALMKIYAFEVAAGRKVDILSECQSLIEELLASHSSDLQQRAYELQAFIGLDVQAVETIMPRDASCEDIEVDKNLSFLNGYVQQSLERGAESYIPEDVRAGMGNMKNFRSQDHHETLQHGLRFEAYEVPKPPMQPKVTPVSFASSADIVPVPDVLSSRETHHISSVGSTSEVGSSELKLRLDGVQKKWGKPTYSSSTSSASASYSTSQKPTSGATLVDGATTVNSKVHDTYDSRKTQVEITPEKQKLAASLFGGSTKPEKRSSTSHKVSKSSASAADGSRGSKAAVVPNEVAVEKAIHQPPPADLLDLDEPTVTTAPPSVDPFKELEGLLDPSTNSATNHNVAAATNAPDIMSLYAETTVSGGDSIPVSGGYDVNLLSELSNAATKATREETIVKPLPQSIKGPDAKDSLEKDALVRQMGVKPSSQNPNLFSDLLG

SEQ ID NO: 122225 - protein, 56 aa, Glycine max
  Coding DNA Sequence Number=SeqID_5447
MVRPGLSVMLDISLHVLLINNHMLQVQYLYTKIGIPRLCCMRGMEHELTSETPNFI

SEQ ID NO: 122226 - protein, 559 aa, Glycine max
  Coding DNA Sequence Number=SeqID_5448
  Gene Ontology: Mol. function=protein binding; Cellular component =membrane; Biological process=calcium ion transport
  Homolog annotation: Hit_ID=Q6K5G3; Match level="QueryCoverage=98%, HitCoverage=84%, E-value=1e-116, Identity=43%"; Hit description =Ankyrin repeat-like protein
  Pfam annotation: Domain name=Ank; Domain location=113-145; Score =25.4; E_value=0.0002; Accession=PF00023.20; Description=Ankyrin repeat
  Pfam annotation: Domain name=Ank; Domain location=146-178; Score =29.3; E_value=1.3e-05; Accession=PF00023.20; Description=Ankyrin repeat
  Pfam annotation: Domain name=Ank; Domain location=180-221; Score =12.4; E_value=0.5; Accession=PF00023.20; Description=Ankyrin repeat
  Pfam annotation: Domain name=Ank; Domain location=228-262; Score =15.2; E_value=0.2; Accession=PF00023.20; Description=Ankyrin repeat
  Pfam annotation: Domain name=Ank; Domain location=6-39; Score=2.1; E _value=16; Accession=PF00023.20; Description=Ankyrin repeat
  Pfam annotation: Domain name=Ank; Domain location=79-111; Score=3.5; E_value=9.7; Accession=PF00023.20; Description=Ankyrin repeat
  Pfam module annotation: Pfam domain module=Ank::Ank::Ank::Ank::Ank::An k; Domain location=113-145::146-178::180-221::228-262::6-39::79-111
LIRAGYGGWLLYTAASAGDVDFVKELLGKYPALVFGEGEYGVTDILYAAARSNSCEVFELLLRSALSPPQMEDVYERDMMNRAVHAAARGGNWEMLKRLVRNGSGVLGFRDTQGCTVLHTAAARGQVEVVRNLLASFDVVNLTDDQGNTALHIASYGGHLPVVEILILASPSLALFTNHYGDTFLHMAVAGFRSPGFRRLDKHTELMKRLVSGKIVNLRDIINVKNNDGRTALHVSVIDNIQCEQVELLMSVSSIDLNICDADGMTPLDLLKQRARSASSDILIKQMISSGGVSKCLDVVAGNALCTHQKAHVIGGSPGTSFRIPDAEIFLYTGIENSSDATNYDQASVESYSCSNELNNSDSANSPHNKKSNSVNARRSKFRLHWPRRRETKAAASELEDDDDSHDPFSSSRNLEEFPIPLRQRYSQPCSLPNNKRTQPMRTSLPSPSSNVKFSAGLMQGVIQLKPHSAHSTPSPFQELSVSSLSYIKKQKGVEIMGPSCSNRSIDDGTLLLNYKQCSFNKKLMNGYFSFGAQGLAVEDSNSCAKSNSSYKRLSSIVA

SEQ ID NO: 122227 - protein, 69 aa, Glycine max
  Coding DNA Sequence Number=SeqID_5449
MEQITILGCMCHTRKVIVHALDEKARAYYNLEGLWTPGTIQNEREEDLQKALVKVRRKNNSKKPAQKNA

SEQ ID NO: 122228 - protein, 568 aa, Glycine max
  Coding DNA Sequence Number=SeqID_5450
  Gene Ontology: Mol. function=DNA-directed DNA polymerase activity; Cellular component=nucleus; Biological process=DNA replication
  Homolog annotation: Hit_ID=Q9CAF8; Match level="QueryCoverage=99%, HitCoverage=92%, E-value=1e-128, Identity=46%"; Hit description =Putative DNA polymerase alpha subunit
  Pfam annotation: Domain name=DNA_pol_E_B; Domain location=309-517; Score=102.8; E_value=1e-27; Accession=PF04042.6; Description=DNA polymerase epsilon subunit B
MDDYFDRQLNEPVVQNAEIDGFLLHLQNEKKEDVIKEKEEAGLHIYSIGDVEMILNNDDDTKDNTPGTPINHHQDPLSPAPDTPSLMYENVLSSGKPSKSKLVTPFSKRTDKFAVKFSINTVPNVENDENEDDVVRRVPLFERSSLSIHGSGPKPGCRFLYDRTEDRLNAIENRLRKHTRAFVASGLHEEPTDPTTASQRSIFAVGMICCDGEGRLNEKSVMLQSSIEHSGGECVRLDLQRLSHYSIFPGQIVGIGGHNPSGHCFVATKLVDSIPTSVADEDSNPAKKQAVDKENQPTDLLCKQRKLSMIIAAGPFTTTDNLLFEPLIELLKHAKLRPPQLLVLLGPFVDSEHPDIKKGTVDTSFDEIFEEILKKLEEYVDSATRVLLVPSIRDANHDFVFPQPAFDIKSQIVSLSNPGIFEANKVKVGCCTVDILKQISGEEISRTAADGKPIDRLSRLANHILNQQRNDQNVFQFLSQLLSTLHTSRKCSLGLFACSRSPSTLVCSRHTYPTFRHQVLSSENEGINHTKCIAINPGRLAKGEGGGTFVELDYCGASDQINASIVGI

SEQ ID NO: 122229 - protein, 100 aa, Glycine max
  Coding DNA Sequence Number=SeqID_5451
MPSLPHMRFVFLKPNRTYLSRERKSESLTREWRACKKEDEENENMMARTMEERTEMESATRGRRRKGEKHRWRDDDNATTQGNNERVRRKKGENKRKRER

SEQ ID NO: 122230 - protein, 586 aa, Glycine max
  Coding DNA Sequence Number=SeqID_5452
MGVIELCVEVDVVGASALNVTNSDSLDEEEDIDDICDTDEEVSIGVIVNGGLETMDSDLHKTHQAETQGVSRWIPTAPHFHRQVTNSHEERTRKSILKGIANSLAVQVKLYDECEKLLECRLLKNDVTVTSGETLIFKGYLVDVGDPEGGIKPESDLNVDRKLRNHSRFRTPSDGVKDSKMNEKENVGQVRRPLSPSQKVIREFKKRELLKYGSPKISQETPKPSTEEWLVLYTTQVTQKAKKYHDGFLRLVLHGSSGAQVMLFDTSRKLLDSRFLKKDDVIKSGESIAFDSYLIDIGKQQGSCTPDSNVLADKCTDVKAMKMDRQKTSLKTDTHVVLYDLSKRPIERRFVRKDEVIREGESVYFDGHLVEVGQPEGSHHSPAKLNERGTGNNVERRQLGHGQNGFHKVNPSFAKGKPPNELCLGKDSGLNSLITELEEIKSNRITPPIKPLRDANQILSLLQNPNLKPQESHVTGRSSNGSRQNIGDRESAATSKCLDITSSEDVSNSWLTLLEMGSAAAYSGGSFQFTENVNMSHQSDSQKDAQTNMSSEADFGCQPCLITNGGKSGEEFSCESETFPSFDLGF

SEQ ID NO: 122231 - protein, 782 aa, Glycine max
  Coding DNA Sequence Number=SeqID_5453
  Gene Ontology: Mol. function=nucleic acid binding; Cellular component= intracellular; Biological process=translation
  Homolog annotation: Hit_ID=Q017M9; Match level="QueryCoverage=42%, HitCoverage=57%, E-value=9e-34, Identity=25%"; Hit description=[R] KOG4197 FOG: PPR repeat
  Pfam annotation: Domain name=PPR; Domain location=519-553; Score =24.8; E_value=0.00032; Accession=PF01535.11; Description=PPR repeat
  Pfam annotation: Domain name=PPR; Domain location=554-588; Score =37.0; E_value=6.7e-08; Accession=PF01535.11; Description=PPR repeat
  Pfam annotation: Domain name=PPR; Domain location=589-623; Score =39.0; E_value=1.6e-08; Accession=PF01535.11; Description=PPR repeat
  Pfam annotation: Domain name=PPR; Domain location=624-658; Score =23.4; E_value=0.0008; Accession=PF01535.11; Description=PPR repeat
  Pfam annotation: Domain name=PPR; Domain location=661-695; Score =16.9; E_value=0.074; Accession=PF01535.11; Description=PPR repeat
  Pfam annotation: Domain name=PPR; Domain location=696-730; Score =31.7; E_value=2.5e-06; Accession=PF01535.11; Description=PPR repeat
  Pfam annotation: Domain name=PPR; Domain location=731-765; Score =11.7; E_value=0.31; Accession=PF01535.11; Description=PPR repeat
  Pfam module annotation: Pfam domain module=PPR::PPR::PPR::PPR::PPR::PP R::PPR; Domain location=519-553::554-588::589-623::624-658::661 -695::696-730::731-765
  Subcellular localization annotation: CTP_CleavageSite=48; ConfidenceScore=5.58e-01
MEVNLSLNHHRALTLTTSRTPSLSALRTHFLGSTHTLRPPPPTPLSLRSRNRNKRNNNNNNNNNSNLGLLRFQSPRFVFKASFHSHSVIVVVIVVTLSAVSWLHFTLNKKKNKTTLNHQRRGHAKFALSSQGFNVGNRIIDREILGYTEFQREKNTLTEIGKLKDHHGEDFRVFEDNEIHIPFLKSSVVQEVALAATETSESPSSSVLDSGANNNNNKDNNGSKVLDEAFLSVPFSPSSLQPLEFAEEMAIQVEESQDKVDSDDELPLNMVESEHTASSVSVNNALTTVDEHTKEKIELGAIDNDILFGESVREGLYMFYEVNKPATRSMTPLSSLKSLSPRASFMNKKGLASVMGNGALKGSGLSTDIPLQSAEHVKGAVKISSHNKEGYPPQHVSKNLRKGGISLREMERNSMDHNSKIFLPLNAHSINVHVDQTNGQFRVHDGPKMDPSELLSKYNNLLKVERLHECVELLKDMETKGLLDMTKVYHAKFFNICKKRKAVKEAFDFIRLIPNPMLSTFNMLMSVCASSQDSEGAFQVLQLLKDARLEPDCKLYTTLILTCAKSGKVDLMFEVFHKMVNSGVEPNVHTYGALIDGCARAGQVAKAFGAYGIMRSKNVKPDRVVFNALIAACAQSGALDRAFDVLAEMTAETQPIDPDHVTIGALLKACTKAGQVERAKEVYKMVQKYNIKGCPEVYTIAINSCSQTGDWEFAHTVYNDMTQKGILPDEIFLSALIDVAGHAKKLDAAFDVLQEARKGGILIGIMSYSSLMGACSNVCLVK

SEQ ID NO: 122232 - protein, 50 aa, Glycine max
  Coding DNA Sequence Number=SeqID_5454
MGKWVEEEWEWRENMWRRRVDQGGNYSVKSTYITLHDRVFANEGDEIYKE

SEQ ID NO: 122233 - protein, 144 aa, Glycine max
  Coding DNA Sequence Number=SeqID_5455
  Gene Ontology: Mol. function=protein transporter activity; Cellular component=nuclear pore; Biological process=protein import into nucleus, docking
  Homolog annotation: Hit_ID=Q9FJD4; Match level="QueryCoverage=70%, HitCoverage=11%, E-value=1e-40, Identity=80%"; Hit description =Importin beta
NGILEAYSGIFQGFKGSPKTQLLMSYAPHVLQFLDSLYMEKDMDDVVTKTAIGVLGDLADTLGSSAGPLIQQSVSSKDFLKECLSSDDHLIKESAEWANSCIHLHLLRGGLNCIHESGHHHFWEQEEKQGEMGEGARKEIDDIP

SEQ ID NO: 122234 - protein, 78 aa, Glycine max
  Coding DNA Sequence Number=SeqID_5456
  Pfam annotation: Domain name=PPR; Domain location=25-59; Score=21.8; E_value=0.0024; Accession=PF01535.11; Description=PPR repeat
DGDQFQKALEVLFEMKGLGLRPNSITFSILIVASEKKDDMEAAQMLLSLAKKDGVVPNLIMCRCIIGYEKFLKIQDMI

SEQ ID NO: 122235 - protein, 83 aa, Glycine max
  Coding DNA Sequence Number=SeqID_5457
METSRSSNLCSLMDGFGEYDPRAFSILEESASHGVVPSVSLKVSPVVIDAKELNASTAEVLEKPPKLWSPLYRGGVLKVPHSG

SEQ ID NO: 122236 - protein, 785 aa, Glycine max
  Coding DNA Sequence Number=SeqID_5458
  Gene Ontology: Mol. function=protein transporter activity; Cellular component=nuclear pore; Biological process=protein import into nucleus, docking
  Homolog annotation: Hit_ID=Q9FJD4; Match level="QueryCoverage=83%, HitCoverage=78%, E-value=0.0, Identity=79%"; Hit description =Importin beta
  Pfam annotation: Domain name=HEAT; Domain location=216-252; Score =7.8; E_value=4.8; Accession=PF02985.12; Description=HEAT repeat
  Pfam annotation: Domain name=HEAT; Domain location=298-336; Score =14.6; E_value=0.35; Accession=PF02985.12; Description=HEAT repeat
  Pfam annotation: Domain name=HEAT; Domain location=343-379; Score =20.8; E_value=0.0049; Accession=PF02985.12; Description=HEAT repeat
  Pfam annotation: Domain name=HEAT; Domain location=474-510; Score =16.8; E_value=0.079; Accession=PF02985.12; Description=HEAT repeat
  Pfam annotation: Domain name=HEAT; Domain location=516-553; Score =16.6; E_value=0.088; Accession=PF02985.12; Description=HEAT repeat
  Pfam annotation: Domain name=HEAT; Domain location=566-600; Score =3.3; E_value=17; Accession=PF02985.12; Description=HEAT repeat
  Pfam annotation: Domain name=HEAT; Domain location=611-650; Score =8.0; E_value=4.5; Accession=PF02985.12; Description=HEAT repeat
  Pfam annotation: Domain name=HEAT; Domain location=713-749; Score =2.2; E_value=23; Accession=PF02985.12; Description=HEAT repeat
  Pfam annotation: Domain name=IBN_N; Domain location=152-232; Score =84.9; E_value=2.5e-22; Accession=PF03810.9; Description=Importin -beta N-terminal domain
  Pfam module annotation: Pfam domain module=HEAT::HEAT::HEAT::HEAT::HEA T::HEAT::HEAT::HEAT::IBN_N; Domain location=216-252::298-336::343 -379::474-510::516-553::566-600::611-650::713-749::152-232
MKIDIEQAFQNRAVDGRIVAWRLTLFESTADIVRVCCTANIKKQVLKNRKNLKHWRLCFFPHSARVSESPRSLTWLRLALSIADSTRYLVVTKKCRTSICSSSCIFDLLGHLQTVFECAEAYFLSNGVQMAMEVTQILLNAQAVDGTLRKQAEESLKQFQEQNLPSFLFSLAGELANDDKPAESRKLAGLILKNALDAKEQHRKIEFVQRWLSLDPTLKSQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKEDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAASASSPLTPFFQDIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASQSATEHEEAMLAIGALAYATGADFAKYMTEFYKYLEMGLQNFEDYQSLGGESTALL

SEQ ID NO: 122237 - protein, 73 aa, Glycine max
  Coding DNA Sequence Number=SeqID_5459
  Gene Ontology: Mol. function=RNA-directed DNA polymerase activity
  Homolog annotation: Hit_ID=Q1SZU6; Match level="QueryCoverage=79%, HitCoverage=16%, E-value=2e-10, Identity=55%"; Hit description=RNA -directed DNA polymerase (EC 2.7.7.49)-fruit fly (Drosophila melanogaster) transposable element BS
MVKRIRKVAKETLGESRGYGLKVYHRIQEPKAKQALKRMKNGKALDLHNIPIGVWKSLGEKSISWLTMLINEI

SEQ ID NO: 122238 - protein, 185 aa, Glycine max
  Coding DNA Sequence Number=SeqID_5460
  Homolog annotation: Hit_ID=Q1SKD7; Match level="QueryCoverage=92%, HitCoverage=45%, E-value=9e-15, Identity=28%"; Hit description =Ankyrin
MAPRKLSAKRSRKDTPAEGTSAAPEFDSHHFRSAEHQQGFEAIKGWSFHRERRVQLRDDEYVDFQEEIAHRHWTSLVTPMAKFDPDVVLEFYANVWPTEEGVRDMRSWVRGQWIPFDADALSQFLGDPLVLEEGQECEFSQRRNRADGFDEEAIAQLLCIPGQDFARTAARRWVRIMRTSMTTLT

SEQ ID NO: 122239 - protein, 97 aa, Glycine max
  Coding DNA Sequence Number=SeqID_5461
MERDEKRFEYRICCFSEENNVEEDKEGEIGVVDALIAIGEIKRKMKKKKIASYESRFDEEMSKVGRFEGLGMEGRRKEEEAAQGFLKNVVFIDQDAL

SEQ ID NO: 122240 - protein, 115 aa, Glycine max
  Coding DNA Sequence Number=SeqID_5462
MKIGIPYITHTKEGKGKRSIHSAATTSSLYCLKRGGRASGGGGCGGGSGGGGGVIIVVVFVVVGVRGGDVDAGKAFQRGKESGRDGGAEPHGRLVDLLPRYDTVVVLHRRRPIRS

SEQ ID NO: 122241 - protein, 599 aa, Glycine max
  Coding DNA Sequence Number=SeqID_5463
  Gene Ontology: Mol. function=alpha,alpha-trehalase activity; Cellular component=membrane; Biological process=trehalose metabolic process
  Homolog annotation: Hit_ID=Q9XEY7; Match level="QueryCoverage=95%, HitCoverage=99%, E-value=0.0, Identity=93%"; Hit description =Trehalase 1 GMTRE1
  Pfam annotation: Domain name=Trehalase; Domain location=55-590; Score= 906.3; E_value=1.4e-269; Accession=PF01204.9; Description=Trehalase
MAEYAQNYKVLILTWLSLTLVTVTASHCVMAVTPSTPLLSFLERLQETAFETFAHSNFDPKTYVDMPLKSALTVTEDAFQKLPRNANGSVPVEDLKRFIEAYFEGAGDDLVYRDPQDFVPEPEGFLPKVNQPQVRAWALQVHSLWKNLSRKISGAVKAQPDLHTLLPLPGSVVIPGSRFREVALTLTLLLHFVIIATWPATAYLLLFFGFRGLLASKMHDTAKAIVTNLISLIDKYGFVLNGARAYYTNRSQPPLLSAMIYEIYNSTGDLELVKRSLPALLKEYEFWNSDIHKLTILDAQGCTHTLNRYYAKWDKPRPESSIMDKASASNFSSVSEKQQFYRELASAAESGWDFSTRWMRNPPNFTTLATTSVIPVDLNAFLLGMELNIALFAKVTGDNSTAERFLENSDLRKKAMDSIFWNANKKQWLDYWLSSTCEEVHVWKNEHQNQNVFASNFVPLWMKPFYSDTSLVSSVVESLKTSGLLRDAGVATSLTDSGQQWDFPNGWAPLQHMLVEGLLKSGLKEARLLAEEIAIRWVTTNYIVYKKTGVMHEKFDVEHCGEFGGGGEYVPQTGFGWSNGVVLAFLEEFGWPEDRNIEC

SEQ ID NO: 122242 - protein, 75 aa, Glycine max
  Coding DNA Sequence Number=SeqID_5464
MLLLSNILPSDHNADHPAEVSVGLCHPNIGKDRAHKTPSGPGGAQQGPGVSSSGYGPLSVLQGPRPPQQGHAIVT

SEQ ID NO: 122243 - protein, 118 aa, Glycine max
  Coding DNA Sequence Number=SeqID_5465
  Gene Ontology: Mol. function=catalytic activity; Cellular component =chromatin; Biological process=auxin mediated signaling pathway
  Homolog annotation: Hit_ID=P33080; Match level="QueryCoverage=68%, HitCoverage=89%, E-value=3e-31, Identity=76%"; Hit description=Auxin- induced protein X10A
  Pfam annotation: Domain name=Auxin_inducible; Domain location=1-85; Score=154.7; E_value=2.4e-43; Accession=PF02519.5; Description=Auxin responsive protein
MGFHLRGIKKASFAADQASSNGVDVPKGCLAVYVGEKMKRFVIPVSYLNQPSFQDLLSQTEEEFGYDHPMGGLTIPCREDGYEIRVMGPTGRQGHMMWPWRTFSGINVACPTFQSEST

SEQ ID NO: 122244 - protein, 105 aa, Glycine max
  Coding DNA Sequence Number=SeqID_5466
  Gene Ontology: Mol. function=catalytic activity; Biological process =auxin mediated signaling pathway
  Homolog annotation: Hit_ID=P33083; Match level="QueryCoverage=77%, HitCoverage=92%, E-value=1e-24, Identity=77%"; Hit description=Auxin- induced protein 6B
  Pfam annotation: Domain name=Auxin_inducible; Domain location=1-83; Score=94.2; E_value=3.9e-25; Accession=PF02519.5; Description=Auxin responsive protein
MDFRLPGIKKALFAANQVSSKAGDAPKGYLAVYVGEKMKQFVILVSYLNQPSFHDLLSLAEEEFGYGIPWVVSQFLEAKMSSNGSRTIGSITEDSYYVFLKAGTQ

SEQ ID NO: 122245 - protein, 80 aa, Glycine max
  Coding DNA Sequence Number=SeqID_5467
  Gene Ontology: Mol. function=catalytic activity; Biological process =auxin mediated signaling pathway
  Homolog annotation: Hit_ID=Q1S9X2; Match level="QueryCoverage=100%, HitCoverage=86%, E-value=1e-30, Identity=80%"; Hit description=Auxin responsive SAUR protein
  Pfam annotation: Domain name=Auxin_inducible; Domain location=1-80; Score=144.7; E_value=2.4e-40; Accession=PF02519.5; Description=Auxin responsive protein
MGFRLPAIRRASFKASQVASIFAQVPKGYLAVYVGEKQKRFVIPISYLNQPSFQELLSQAEEEFGYDHPMGGLTIPCSED

SEQ ID NO: 122246 - protein, 131 aa, Glycine max
  Coding DNA Sequence Number=SeqID_5468
  Gene Ontology: Mol. function=catalytic activity; Biological process =auxin mediated signaling pathway
  Homolog annotation: Hit_ID=P33080; Match level="QueryCoverage=94%, HitCoverage=78%, E-value=8e-29, Identity=80%"; Hit description=Auxin- induced protein X10A
  Pfam annotation: Domain name=Auxin_inducible; Domain location=1-90; Score=119.8; E_value=7.6e-33; Accession=PF02519.5; Description=Auxin responsive protein
MGFRLPGIRKASLAANQAPSKSVDVPKGYLAVHVGEKIKRFVIPVSYLNKPLFQDLLSQAEEEFGYDHPMGGHPWDDHIYTLPQLDSIILEMKVGSSMIWESQTASVCLQCTLPDSPLELQLIWKILVSVE

SEQ ID NO: 122247 - protein, 158 aa, Glycine max
  Coding DNA Sequence Number=SeqID_5469
  Gene Ontology: Biological process=auxin mediated signaling pathway
  Homolog annotation: Hit_ID=P33080; Match level="QueryCoverage=98%, HitCoverage=97%, E-value=3e-23, Identity=72%"; Hit description=Auxin- induced protein X10A
  Pfam annotation: Domain name=Auxin_inducible; Domain location=1-76; Score=77.0; E_value=5.8e-20; Accession=PF02519.5; Description=Auxin responsive protein
  Pfam annotation: Domain name=Auxin_inducible; Domain location=79-156; Score=29.8; E_value=2.5e-08; Accession=PF02519.5; Description=Auxin responsive protein
  Pfam module annotation: Pfam domain module=Auxin_inducible::Auxin _inducible; Domain location=1-76::79-156
MAFRLPGIRKASLAAIQGNSKAVDVPKGYLAVYVGDKMKQFMIPVTYLNQPSFQDLLSQAEEEFGRIWESQTASVSLQYTLRDSPLGLPKILKLLGKLQMMLIEYQDANGLGCLSQPLFQGLLSQAEEEFRYDHPMGGLTIPCGEAVFIDTISRLNSC

SEQ ID NO: 122248 - protein, 80 aa, Glycine max
  Coding DNA Sequence Number=SeqID_5470
MEFQFPSKRVRRYHGFSLKACSELQNKERENIGSKGLSKELIQGRLIWLETYKNEMPKSSPNMDVNQEVSTRIKPRLLCK

SEQ ID NO: 122249 - protein, 87 aa, Glycine max
  Coding DNA Sequence Number=SeqID_5471
LKLAAKDKSFIHKGNKNPDPVYAHSGPVLVQMIDPKKEAGPTLVQMAQAEEMALARVEWTLRSLECRPPGPAEAHGLQRPHPLPKEK

SEQ ID NO: 122250 - protein, 67 aa, Glycine max
  Coding DNA Sequence Number=SeqID_5472
MKVGYVLRNAIAHTFTVGICEIIFVEGETESHEDSTSGGFNPFSVSLTFENSIGAVRGKIGGISGNR

SEQ ID NO: 122251 - protein, 348 aa, Glycine max
  Coding DNA Sequence Number=SeqID_5473
  Gene Ontology: Mol. function=protein binding; Cellular component =integral to membrane; Biological process=protein amino acid phosphorylation
  Homolog annotation: Hit_ID=Q9ZTJ9; Match level="QueryCoverage=97%, HitCoverage=79%, E-value=3e-39, Identity=34%"; Hit description=Hcr2 -0B
  Pfam annotation: Domain name=LRR_1; Domain location=119-140; Score =2.5; E_value=97; Accession=PF00560.23; Description=Leucine Rich Repeat
  Pfam annotation: Domain name=LRR_1; Domain location=170-191; Score =12.8; E_value=1.1; Accession=PF00560.23; Description=Leucine Rich Repeat
  Pfam annotation: Domain name=LRR_1; Domain location=196-218; Score =7.3; E_value=12; Accession=PF00560.23; Description=Leucine Rich Repeat
  Pfam annotation: Domain name=LRR_1; Domain location=20-42; Score =14.8; E_value=0.32; Accession=PF00560.23; Description=Leucine Rich Repeat
  Pfam annotation: Domain name=LRR_1; Domain location=220-245; Score =6.8; E_value=15; Accession=PF00560.23; Description=Leucine Rich Repeat
  Pfam annotation: Domain name=LRR_1; Domain location=247-267; Score =7.4; E_value=12; Accession=PF00560.23; Description=Leucine Rich Repeat
  Pfam annotation: Domain name=LRR_1; Domain location=269-291; Score =9.3; E_value=5.2; Accession=PF00560.23; Description=Leucine Rich Repeat
  Pfam annotation: Domain name=LRR_1; Domain location=293-315; Score =12.8; E_value=1.1; Accession=PF00560.23; Description=Leucine Rich Repeat
  Pfam annotation: Domain name=LRR_1; Domain location=317-339; Score =20.8; E_value=0.005; Accession=PF00560.23; Description=Leucine Rich Repeat
  Pfam annotation: Domain name=LRR_1; Domain location=44-66; Score=1.2; E_value=1.7e+02; Accession=PF00560.23; Description=Leucine Rich Repeat
  Pfam annotation: Domain name=LRR_1; Domain location=68-92; Score=7.3; E_value=12; Accession=PF00560.23; Description=Leucine Rich Repeat
  Pfam annotation: Domain name=LRR_1; Domain location=95-117; Score =14.2; E_value=0.49; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=119-140::170-191::196-218::20-42::220-245::247-267::269 -291::293-315::...
  Pfam module annotation: Domain location=317-339::44-66::68-92::95-117
GNTFLGEGMSIPSFLGTMTSLTHLDLSYTGFHGKIPPQIGNLSNLVYLDLSYVVANGTVPSQIGNLSKLRYLDLSANFLLGGGMSIPSFLGTITSLTHLDLSGTGFMGKIPSQIWNLSNLVYLDLMYAANGTIPSQIGNLSNLVYLGLGGDSVVEPLFAENVEWLSSMWKLEYLDLSNANLSKAFHWLHTLQSLPSLTHLYLSDCTLPHYNEPSLLNFSSLQTLDLSGTSYSPAISFVPKWIFKLKKLVSLQLRGNKIPIPGGIRNLTLLQNLDLSFNSFSSSIPDCLYGFHRLKSLDLSSSNLHGTISDALGNLTSLVELDLSYNQLEGTIPTSLGNLTSLVELDLS

SEQ ID NO: 122252 - protein, 154 aa, Glycine max
  Coding DNA Sequence Number=SeqID_5474
  Homolog annotation: Hit_ID=Q1T493; Match level="QueryCoverage=98%, HitCoverage=29%, E-value=2e-07, Identity=22%"; Hit description =Nucleic acid-binding, OB-fold, subgroup
RFKLMINNLVLEIQEFRESLLDLGIEVRSVLTPIGQGSSQVSRSSQLSSKDVFLSKAEEKNISQINATSEITTMVMDNYSWCYLACGQCYKKADIETVSFTCPCGKDNDQPLLRYRVEVMVNHQGEQTKFFIWDRECAQLIGQSTDEVNRLKIE

SEQ ID NO: 122253 - protein, 444 aa, Glycine max
  Coding DNA Sequence Number=SeqID_5475
  Gene Ontology: Biological process=conjugation
  Homolog annotation: Hit_ID=Q88BU0; Match level="QueryCoverage=73%, HitCoverage=49%, E-value=1e-70, Identity=41%"; Hit description =Relaxase/mobilization nuclease MobA, putative
  Pfam annotation: Domain name=RHH_1; Domain location=12-50; Score =19.3; E_value=0.013; Accession=PF01402.12; Description=Ribbon-helix -helix protein, copG family
  Pfam annotation: Domain name=Relaxase; Domain location=106-416; Score= 103.5; E_value=6.1e-28; Accession=PF03432.5; Description =RelaxaseMobilisation nuclease domain
  Pfam module annotation: Pfam domain module=RHH_1::Relaxase; Domain location=12-50::106-416
MSKSEKRQREKLVKCRCTEAEFEAINKKASAAGLTTSEYLRRTALNRKITVRTDIRMMNELLRLGGLQKHLFNQMQQNMTTELSLQFSEVLTSIKLAINALDMTPVPTSFRKLVEYVSTREEKKPGEAVTHDAAHTPGTEYVATPGFGQLVDYVGRKSAAPSSQILSISPEGIQRVLSGEVLCETNCFSLDTAASEMNLTAAQNRHCKDAVYHFILSWQSDEDPSPDAVFRSVRYSLKQLGMEDHQYVAAIHRDTDNVHCHVSANRVHPATFRAQNMWNDADELQKCCRILERELGFKVDNGSWQMNEYGELHRTRRDMPAAPRGAAKREIFSDRESLHGYAVRETRHMLQDFADQDCLNWPLLHNVLYSRGLGLREQQGGLAVYDLLNPDGVCVKASDVHPAIGHTAMVKRWGDFQPAPPTSEPDDHESGILLIDKFYMPQLH

SEQ ID NO: 122254 - protein, 375 aa, Glycine max
  Coding DNA Sequence Number=SeqID_5476
  Gene Ontology: Cellular component=outer membrane; Biological process =protein secretion
  Homolog annotation: Hit_ID=UPI00006A2182; Match level="QueryCoverage =90%, HitCoverage=60%, E-value=7e-35, Identity=30%"; Hit description =UPI00006A2182 related cluster
  Pfam annotation: Domain name=Secretin_N_2; Domain location=207-295; Score=40.6; E_value=5.5e-09; Accession=PF07655.3; Description =Secretin N-terminal domain
MLRKSMLAVLIFSTLLQGCALERINDVQRSAGNTADEASSLIRQAAENRPVVQFQNSQYVSPVPLPVAKYDAPREVVNCNMPYRAIKPQDIWQFSQDIATVCHIRTRVTPDAAAMLGGRGAESGSPTQRLTSVPSPVLPTAGDMRPLDSFGTGTASGAAAGSPGTSRTFSDVTYTGNLGGLLDIVTARLGISWKYEDGMVTFFYLQTARFDIEPSDAKYALNGSVVSGVSNSSSSNGGTGSSSSGSNSGGVSGESGTSLKSDVSMGNNLYDDLKSTAESMLTPGVGRLDMNKTTGTVVITDVPEVVRRVGEYLTSENKALSRQVSLKVVIYTVNTDTSDAIGIDWNVIYKTLAGKYGINLTGPSARCRMQLAELL

SEQ ID NO: 122255 - protein, 227 aa, Glycine max
  Coding DNA Sequence Number=SeqID_5477
  Homolog annotation: Hit_ID=Q88BL3; Match level="QueryCoverage=100%, HitCoverage=56%, E-value=5e-80, Identity=65%"; Hit description=TraW protein
  Subcellular localization annotation: CTP_CleavageSite=19; ConfidenceScore=5.12e-01
VSQATRAAASKLAGGSGVSSAAVRETLASLPTTPRQGGYRSALIHSAYCTAEEAKLYGGTGLCPGVSALPGGDTEARSLYDGAGQPGKAPELTFTQAQTDAAMAYVSNSAKLDAGRTPGKGEIQTATGQEYQGLLTQYKAMQSAAMQPQLDMVAASQPQDATREPLTEARQSPSAESYFQQTASAQAKQTGAMSEREFEAFEVGRRYANTAWVTDLQGMDGDNLTRE

SEQ ID NO: 122256 - protein, 752 aa, Glycine max
  Coding DNA Sequence Number=SeqID_5478
  Homolog annotation: Hit_ID=Q88BL1; Match level="QueryCoverage=78%, HitCoverage=83%, E-value=0.0, Identity=62%"; Hit description=TraY protein
  Subcellular localization annotation: CTP_CleavageSite=62; ConfidenceScore=5.22e-01
MSLAGFMTLIPTASGWSLSQLIMLWAASTMGIGSANLLTDKAADMISSGMSLVVQPTAPSTRSAARAVFEMNLCKYATNRELSSLYQDGQARTALMQTKGGNGDYTTGNGSAVCGSARIPEPSEGVMDSLFGSAVNTASVTAASRSALDTMQSTLDAAAQAYVDAYLSKRDQDSGTLIDPETTIQNAAAAYETTVNNALNQLNYKDSLQSQLTTQLRAYGWISLGAWYNTFATANSKTNEVANASPVTSGTSLHGETGTGDLYHQVFTAYRSQVQNSTYTAPLGTQTAKDDGAASSAVNPDAVFISIFKNPMQRITKAIATVQIGTPADFSSQVNPLIKMQTIGNYTLLATEGALTTYTLAYAAASATDNSVLGSVGRILPFNLTAAAKDVLAQLSPPFYFLLLLLFAVGFSLAVFLPAVPFLYWMVGVFNWLVSVMVGCAAGPMWSATHLGAEEDKGSRSAYGYIFLIDMMLRPSLMVLGFFFASVAVMAGGTLLNLLFGTALANANADSIVGAFIMAGWLLIYARIATFGVTRVFGLQAALADYVITFLGGAGMAGIMGGLVDDVKGMFASAGGGARRTPGLQKATNSEGPGIIIPLGYRRFSIIRRRSQLKKMVVLLTSDERFSPLKQHQVMDAGRGKYLGIDIKSGNILYIHMVKKGVVDVIGLTMRDWKERELEDSTLRINTKNPEVPVLSVNAHPTVTKELFDTLGAMSHSSYPESFPQEPWPLHVSIQSRFVEFEHDVVVPQASN

SEQ ID NO: 122257 - protein, 139 aa, Glycine max
  Coding DNA Sequence Number=SeqID_5479
MRTGERFRPDHHRETSVDHAHYHNSDLPLPKWIVPTRHPVDPEKSNRALSFPALVTGLCQSYRVPVARSKDHAHKTPSGPREVQQGPGVSSSSYEPLSVLQDARPPARDRARKTHSGSEEVPQGPGVSSSDYEPPSILR

SEQ ID NO: 122258 - protein, 161 aa, Glycine max
  Coding DNA Sequence Number=SeqID_5480
MGDLEEVQEQMKADMSALKEQMASMMDAMLGMKQLMESNAATATAVSSTTEADPTLLTAAHHPIPNMVSYVTTRVMFLPSYLKGSLLDIWTWSTRIIESMLRETSTPTPRFPLRGQRPMHYLNPTSRENLEANQRSQYFCPWEGHPWQQKERGNSISSKRG

SEQ ID NO: 122259 - protein, 245 aa, Glycine max
  Coding DNA Sequence Number=SeqID_5481
  Gene Ontology: Mol. function=ATP-dependent peptidase activity; Biological process=ATP-dependent proteolysis
  Homolog annotation: Hit_ID=Q2K363; Match level="QueryCoverage=72%, HitCoverage=78%, E-value=1e-65, Identity=71%"; Hit description=ATP -dependent protease LA 2 protein
  Pfam annotation: Domain name=LON; Domain location=17-238; Score= -38.1; E_value=0.00058; Accession=PF02190.7; Description=ATP -dependent protease La (LON) domain
  Pfam annotation: Domain name=Trm112p; Domain location=192-231; Score =68.5; E_value=2.1e-17; Accession=PF03966.7; Description=Trm112p-like protein
  Pfam module annotation: Pfam domain module=LON::Trm112p; Domain location=17-238::192-231
MHVGNARYVKSDDLPETVPVFPLPGALLLPEGHLPLNIFEPRYLAMIDTALAGHRLIGMVQPALHVIESGLEGGPLSAVGCLGRITSFSETGDGRYIISLTGVCRFRLLEEVEAGKPYRSFRHAPFIADLSGEYDEEAVDRENLLRVFRSFLDANQLEADWESVERAGNRVLVNSLSMIRIAAMDDRMNNVDPKLLELLVCPLTKGRLSYDRARNELISENARLAYPIRDGVPIMLISEARKIED

SEQ ID NO: 122260 - protein, 86 aa, Glycine max
  Coding DNA Sequence Number=SeqID_5482
MKIGLCLMRFGEEMNKIREFEDLRERGAVTRKGRVLQTPLELVGLGSSSSMDSFAFWKMNGSGMEKEEREEMPLQGEDESRRSSPP

SEQ ID NO: 122261 - protein, 138 aa, Glycine max
  Coding DNA Sequence Number=SeqID_5483
  Subcellular localization annotation: CTP_CleavageSite=17; ConfidenceScore=5.48e-01
MVKSSKKRKGTSSTTTAAGHRRHGTSRDPPAPVPPSLSPPRSSILFSFDDQRQRYYSQFRNRVILDPKYLDLEFFYGETFDCYQVFQNSGLFDFMSLKLPYFPELVKVFLLRALLLMTGNLIIQVMMLAELSAMIRLT

SEQ ID NO: 122262 - protein, 201 aa, Glycine max
  Coding DNA Sequence Number=SeqID_5484
  Gene Ontology: Mol. function=actin binding; Cellular component =cytoplasm; Biological process=cytoskeleton organization and biogenesis
  Pfam annotation: Domain name=Transposase_21; Domain location=55-200; Score=163.1; E_value=7.3e-46; Accession=PF02992.5; Description =Transposase family tnp2
MSKCPTCGASRHKVKDDEDCSSDENSKKGPLAKVLWYLPIIPRFKRLFANGDDAKDLTWHANGRNSDGMVYHPADCSQWKKIDGLYPDFGKEARNLRLGLASDGMNPYGNLSTQHSSWPVLLPGNDIDVYLSPLIEDLRKVWEEGVLVFDGFRNETFEMRAMFFCSINDFPAYGNLSGYNVKGHYACPICEEDTSYIQLKH

SEQ ID NO: 122263 - protein, 130 aa, Glycine max
  Coding DNA Sequence Number=SeqID_5485
MKIKGKKKAYAALISWNICLFAKACLHFSGENTETFSSLTSYPELRRSEFLIGGYVGARALLLSTTPPFVVMTQELVARGDTLRLSAPRHSVTPSVIDEQRPIWSSALFPEMSTSSGGDFFKSHKLSRTT

SEQ ID NO: 122264 - protein, 191 aa, Glycine max
  Coding DNA Sequence Number=SeqID_5486
MEGLVDLAVIDAFLAFHHGKESPVVAILAMYDTFDRGCPSIRYKVTARASKMERRIGTNSWLAWRGDRELRGSSNGIIGGYHKWLRVRTQGLDWLPNLKTVRDDEVKASKESDEVQALKADLERARVVEEKFKSIAIKLKPWNEKPRKPERKNTCKQSFEGLYRAAIVSSSSEEVKGIITGQRHDLEGRAK

SEQ ID NO: 122265 - protein, 80 aa, Glycine max
  Coding DNA Sequence Number=SeqID_5487
  Subcellular localization annotation: CTP_CleavageSite=50; ConfidenceScore=5.27e-01
MQNYQHAKRSDSAKARINRKRIMQQKRHGHAQSSSQPTLNCTSEYNMTVSDSSESENSESTQGSGSNFMTPFEDCQSPTN

SEQ ID NO: 122266 - protein, 164 aa, Glycine max
  Coding DNA Sequence Number=SeqID_5488
  Homolog annotation: Hit_ID=P03938; Match level="QueryCoverage=38%, HitCoverage=47%, E-value=5e-19, Identity=74%"; Hit description =Hypothetical 14 kDa protein ycf68
MSPHGGDMDGGEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKNGAPNTYLHRPRLRDRPFHSGVTVGSYHSSLFSCFPGGLEKIAINRIY

SEQ ID NO: 122267 - protein, 107 aa, Glycine max
  Coding DNA Sequence Number=SeqID_5489
MVGAGLKKDLRVSRVVPGGSLNAFLFLLIGVISQRLAMESIDSLPIGWTVGAMIYFTGEVSAQLVELRSCNWVVAITGWMSNCPGEDRNMPLKDSTETKTGCQERRG

SEQ ID NO: 122268 - protein, 288 aa, Glycine max
  Coding DNA Sequence Number=SeqID_5490
  Gene Ontology: Mol. function=chitin binding; Cellular component =extracellular region; Biological process=chitin metabolic process
  Homolog annotation: Hit_ID=UPI000044A8F0; Match level="QueryCoverage =83%, HitCoverage=99%, E-value=2e-36, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=16; ConfidenceScore=5.28e-01
MVKTTCPHLQRATRPRVQRAACPRLQRVARPRLQRATRLRLRGPHVLAFRGLHALFFRGLHVVAFRGLHVVAFRGLHVLAFRGLHALAFRGLHVLTFRGQHALAFRGPNALTFRGPNALAFRGLHVLAFRRLHVIAFRWLPSHAFRGLRVLALRGLHALAFKGLHVLAFRGLHVFAFRGQHVLPFRGLHALTFKGLHILTFRGLHVLTFEGLYALAFRGLHDLAFRELHIPALRGLHVLVFRGLLALALRGLHVFAIRGLHVLTFRGQHHLAFRELHILTFRGALAFR

SEQ ID NO: 122269 - protein, 149 aa, Glycine max
  Coding DNA Sequence Number=SeqID_5491
APTGAEKREELEPEKRHVNRDRILAFKKLNFSLLVAEYEVTSKGREFRSFSLISHVAFLFFFLSIEASIKAPNFAHHFYSKLQKEAIFGVVKRTSTLWDFKFQVEKCEILRVREAKFGVSVNWSLKTCGKAWAEQMRKMSDKGESKSHF

SEQ ID NO: 122270 - protein, 210 aa, Glycine max
  Coding DNA Sequence Number=SeqID_5492
MTSKKRKSTASRPTAQYDTRYTDNILSRNILPERNVKLYHTEFDEFKVELERHNHNLHKRLANLQDGSTNVALVKEFYANLYTIEDQAPKQAREIEARLCIPYKEFVLNAEGQPWKLLRKDLMTLAQTWSVFSYSNLAPTSHTSDLNMDRARLVYGLVTNMDMNIRALISVNFKGARKARVRLPDVPSSSTPPAPSTFTTPTPAPPGPSA

SEQ ID NO: 122271 - protein, 80 aa, Glycine max
  Coding DNA Sequence Number=SeqID_5493
  Homolog annotation: Hit_ID=Q6H6R9; Match level="QueryCoverage=59%, HitCoverage=5%, E-value=7e-12, Identity=75%"; Hit description =Putative cell division protein FtsH3
MHVCVHYGKILPTPYVGGNVLKIMTRPCLKGIEEKTTKLKGSEKALVARHEVSHAVVGTAVANLLAGQPHVEALVIRLLV

SEQ ID NO: 122272 - protein, 375 aa, Glycine max
  Coding DNA Sequence Number=SeqID_5494
  Gene Ontology: Mol. function=oxidoreductase activity; Biological process=tRNA processing
  Homolog annotation: Hit_ID=Q08015; Match level="QueryCoverage=53%, HitCoverage=74%, E-value=7e-70, Identity=68%"; Hit description=tRNA -(ms[2]io[6]A)-hydroxylase
VVLIVTRFGSQQRDVKAIQLVVQVRRQFGEAFTGSRFDVGAADQFVDQRRRIVGADLADHTLGVAAGGDLAIRDPARLHDLQHLREVMQLFLDQQHHAIRQILAVGRAVFRQDLAGELATGGTACPARPALRAETPRRAAAAPTARRRSLCPPRSGGSATCRSARPSARTPGGQSATAAGFPDGARRRSRRQEFHSAGSLKSGLTGIVQPTTLQLERRRGYQGPARTGPQVLIGEGLVAFAVVVFVDVVAVFVILTVFTVRIFEVGAPAIVVDAAAFRQRHQLLDLSVDQFGVQADFADHVAAHHHRTVFHFQLFGVGHFVAQLEGFNGGLLQNLKFLGGQMVLDGVERVRIAAVFQQFFDDQAGLFTLFFQQFA

SEQ ID NO: 122273 - protein, 214 aa, Glycine max
  Coding DNA Sequence Number=SeqID_5495
  Subcellular localization annotation: CTP_CleavageSite=16; ConfidenceScore=5.41e-01
MVTPPSFPSPESTPSPSMMKRTRKATRLRSLSSKPVGLERALVDVTYVNWKQVLVAQKDLIWDDIQAEFDISKAFNKRMKKKIVKWKMTRTKKLGQMTSEAACQILNRIDSLEEQSAQDSIIAHGRQDEELTQNIRDELEQSITEKVTRQLMLSFSHMQSLGIIPPIEPEVALFGAYVSTKGSCVDPSGIYEGSTTMHHVPLSNGLVKEGIEEV

SEQ ID NO: 122274 - protein, 109 aa, Glycine max
  Coding DNA Sequence Number=SeqID_5496
  Gene Ontology: Mol. function=DNA binding; Biological process=DNA integration
  Homolog annotation: Hit_ID=Q1SIT1; Match level="QueryCoverage=68%, HitCoverage=31%, E-value=3e-16, Identity=44%"; Hit description =Integrase, catalytic region
MILEKIVQPNKKDWSTGMDDALWAHRTTYKAPIGMSPYWAGEERKLKLTELDEIRLEAYKEKTKKFHDSLIAKKDFVLRSKVNPHKSLLSGCSGGGDLLTSPYFSSFMT

SEQ ID NO: 122275 - protein, 138 aa, Glycine max
  Coding DNA Sequence Number=SeqID_5497
  Homolog annotation: Hit_ID=Q9AVH2; Match level="QueryCoverage=98%, HitCoverage=54%, E-value=4e-36, Identity=57%"; Hit description =Putative senescence-associated protein
  Subcellular localization annotation: CTP_CleavageSite=37; ConfidenceScore=5.60e-01
MNAWLPQASYPCGNFSDTSSFKFRRTKGSIGHAFTVRIRTGNQNRTSFYPFVPHEISVLVELILGHLRYLLTDVPPQPDSPPDNVFRPDRPAEADLGSKKRGSAPLPIHGISSHLSYTSQVISQSRTRVKLNRVFFPR

SEQ ID NO: 122276 - protein, 84 aa, Glycine max
  Coding DNA Sequence Number=SeqID_5498
CAHKYLGGGCHEALLSVVVSSMTIVEVMEDVRVMEVGGKVIVCEWQLGGSGECCNMTMVNGGGCAIWLLAWEEGGDDYGFLVLE

SEQ ID NO: 122277 - protein, 1352 aa, Glycine max
  Coding DNA Sequence Number=SeqID_5499
  Homolog annotation: Hit_ID=Q1T3W7; Match level="QueryCoverage=81%, HitCoverage=98%, E-value=6e-87, Identity=34%"; Hit description =Mature parasite-infected erythrocyte surface antigen
MATSTPKTNVVFIDTNLDTHLALVVSDLDTVSNLKKSILSEHPLCFPKIGKIQIHGIKVERKGYFYHLTDSMPVRSAFSGVKESWFLTVDVSVLRECAQNDQLFSLGIANNALTVGSPSKRGCTFDNFKLPQLDNRPVENEEIPVASPHVLKHTGKGVKSSGHHDTGTPLPGSIPETEDHCFVNRKLPSLNTECEVDGSGKGIKDDRNVCEEAPVSSAKKIRKSNRKKQDMVQDDNSKDAAAVDNALSFPSKRASSANNELPGSRIECEVDGTNEGIKDACIVHEEGNCKSVSSVKKKQKGKRKKEDAVQHDTSKVNDSSVVGSGDYTIQQDIQVVANPSEDADKEVIKETEILKEHQHADGSNNNTKNDIDVAASANKKHKKRKRSLTVDSKEMFKVETAIQKDEMHKSDEAHKERKESKEQFELKNEKSRDDVEYKQDQVTEDILNTGPPAKKKRNGKEKSGEESLSKANLINDFNVDSTSHHILEDQQKIKNSNADQSAEHFDDTNPPRTSVRGRRKKGKINSSNPYETPVVTSSRKDEEADCSSIQRGVQKEISEDGLSSKDLGMSKATINNMETGTDACKEGFQSTERTTANYKNHSDIGIKAHTADVDEPMELTENNENVVLDQCHKNEADQIEGAEEGREVSPHNDPKLVQLEKSTSSSQDKTDANIGELNVTSKGVDVNGMTEPIKSVKEKRTRKAKNSGGGSALREGIGLVDASEHETVIMKSLSAKNCDPKSGNTETEENPLNQTEGGKNQQEKVQGTSDKEDDSGVDNADSLEQIKTKSNAEHMDKRQRKKSNSKQTSTSKSISSMLTKDQVLDSKKPSPSSGSGTHGKPSVAVTKKSKSTSTKSTNKSSKTNLELVEDSVRLELSDSRFNSGGKDAAQHSTCSPGEKDDDNLEAINGHTHAEDLSSSQQLSSKEKLDVRSDLGKKVPNVHRTGQDSKLSGRSDRAVSLIGENRKAHVNAFGKSMDLEKQRKRAPVSNLKLEGSIKMVQNKAGKASGNNVRGVASKTQQEKSLLSGAIFKDDSSSTSEDEVDNSDASTRTPSYNPLMSDFSDGDSSSGLNSQVDGTKGMSIDDVLRSSSRFKKARTASLLEETQSQPEFVPDSLADNRYKLQAGSGTRKKALERIGCTKFHSLSLSIAKSLYSDLILLSWLSAGCKMLYRTQTIAGVTTNSRSCPLLSLAAASAIIAISLADASGPDIMPDAQSPSPSPTMTPLLLRMRFSWFSAGCRMLNSTHAMAGINGNNNASPRLSPSANSAICDAAKAASQFASEENIAPAMAVPAVEVETWEGGSLGLCNLCDDPVVLMHFELIIAIVVAMVAAIMELECRVSRQREHRGTWHVY

SEQ ID NO: 122278 - protein, 484 aa, Glycine max
  Coding DNA Sequence Number=SeqID_5500
  Gene Ontology: Mol. function=nucleotide binding; Cellular component =integral to membrane; Biological process=protein insertion into membrane
  Homolog annotation: Hit_ID=Q9FYL3; Match level="QueryCoverage=57%, HitCoverage=21%, E-value=2e-83, Identity=62%"; Hit description =Protein ARTEMIS, chloroplast precursor
  Pfam annotation: Domain name=60KD_IMP; Domain location=233-484; Score= 173.7; E_value=4.5e-49; Accession=PF02096.11; Description=60Kd inner membrane protein
  Subcellular localization annotation: CTP_CleavageSite=44; ConfidenceScore=5.25e-01
MAALLPCAPNIVYGPLLGNRSTSHLPHRPHSHAFSGSTTRHFLRGSLTVARFGFKPDFLPEPDEAEGVLRELFGRAEGLLYTIADAAVSSSSSSSSDTVAASYAAKQSNDWLSGIANYMETVLKLRNAKYHYFHFDSSDLISRTRSSCHRKDFEVMMMITSMFGFQFKITFEAKVILPKDQDSCSCAHFTFIRWTYIGMCTATLPTANQTCTILHSNEVLKDGLSALHVPYAYGFAIILLTVLVKAATFPLTKKQVESSLAMRTLQPQVKAIQQRYAGDQERIQLETARLYKLANINPLAGCLPTLATIPVWIGLYRALSSVADEGLLTEGFFWIPSLAGPTTVAARQNGSGISWLFPFVKSSLSVASYPDHREASTFGGAQITILYVPKLNAFWTSEGVLGWSPSPRMVRYIGLPGLACVAGRLSVHLCPNNAVITAELFVIFHVNFQPNDPNMKSSQALTNFLPLMIGYFALSVPSGLSLYW

SEQ ID NO: 122279 - protein, 265 aa, Glycine max
  Coding DNA Sequence Number=SeqID_5501
MGSGFVLSGSRMGDVSMGNKPLDNGGGNDNRPMKISFRDKVMDNIEKPPVKENLAKIVYEDDNPMKPMVIIEDSVFEGLCAPWKDALMGIIGKQLGGVKIQLQDVGITLKDLWNGGNWNWDRAAMIWNLLQLDVQVHALDDNSSTWLQRICLADHGARNKEVFSDLVIRVVLVMNQILSLLEIVTKTCNNNKGSSSGNHLNLESTNSTFHGSSFGNPGKAGFGSLIQDNHGHWIMWNFIQHKCKTSSYIPWHWCGLARRISPSNL

SEQ ID NO: 122280 - protein, 510 aa, Glycine max
  Coding DNA Sequence Number=SeqID_5502
  Gene Ontology: Mol. function=guanyl-nucleotide exchange factor activity; Cellular component=cellular_component; Biological process =intracellular protein transport
  Homolog annotation: Hit_ID=Q2QTS8; Match level="QueryCoverage=99%, HitCoverage=99%, E-value=0.0, Identity=67%"; Hit description =Regulator of chromosome condensation, putative, expressed
  Pfam annotation: Domain name=RCC1; Domain location=165-241; Score =18.6; E_value=0.0068; Accession=PF00415.9; Description=Regulator of chromosome condensation (RCC1)
  Pfam annotation: Domain name=RCC1; Domain location=244-294; Score =6.2; E_value=0.15; Accession=PF00415.9; Description=Regulator of chromosome condensation (RCC1)
  Pfam annotation: Domain name=RCC1; Domain location=299-351; Score =6.5; E_value=0.14; Accession=PF00415.9; Description=Regulator of chromosome condensation (RCC1)
  Pfam annotation: Domain name=RCC1; Domain location=354-403; Score =34.1; E_value=4.9e-07; Accession=PF00415.9; Description=Regulator of chromosome condensation (RCC1)
  Pfam annotation: Domain name=RCC1; Domain location=406-471; Score =9.8; E_value=0.062; Accession=PF00415.9; Description=Regulator of chromosome condensation (RCC1)
  Pfam module annotation: Pfam domain module=RCC1::RCC1::RCC1::RCC1::RCC 1; Domain location=165-241::244-294::299-351::354-403::406-471
MDATTSGTPTIQYHNIPDQPITAIIATPLPTFQRQQRHCFGDSTPGEFPLSANPSIVLHVLTACNLDPQDLAKLEASATCSFFRQPANFAPDSDLSLSELAALDMCQKRAIFKPMTTEQRQDLKLRCGGSWKLVLRYLMAGEACCRREKSQAIAGPGHSIAVTSKGIVYSFGSNSSGQLGHGTTEEEWRPRPIRLEHVYAFGEAEYGVQGSKTVAAPQIVESLKNIFVVQAAIGNFFTAVLSREGRVYTFSWGSDEKLGHHTDQSDVEPHPLLGALENIPVVQIAAGYCYLLCLACQPSGMSVYSVGCGLGGKLGHGSRTDEEYPRLIEQFGLLNLQPMVVAAGAWHAAVVGRDGRVCTWGWGRYGCLGHGNEECESVPKVVEALSNVKAVHVATGDYTTFVVSDDGDVYSFGCGQSASLGHNAAGNDEQGNRHAKVLDPELVTSLKQINERVVQISLTNCNYWNAHTFALTESGKLYAFGAGDKGQLGIELVANQTERGNPERVEIDLG

SEQ ID NO: 122281 - protein, 74 aa, Glycine max
  Coding DNA Sequence Number=SeqID_5503
MLSGNGSFEHTSRDLLKDPNGQIVEKCLVKLQTKVREDPTVNKGWAAFLPRQLHVAFSRSFIKRLPPEASSWLL

SEQ ID NO: 122282 - protein, 457 aa, Glycine max
  Coding DNA Sequence Number=SeqID_5504
  Gene Ontology: Mol. function=pectate lyase activity; Cellular component=anchored to membrane; Biological process=pathogenesis
  Homolog annotation: Hit_ID=Q9FXD8; Match level="QueryCoverage=85%, HitCoverage=95%, E-value=1e-176, Identity=75%"; Hit description =Probable pectate lyase 5 precursor
  Pfam annotation: Domain name=Pec_lyase_C; Domain location=189-374; Score=332.6; E_value=6.7e-97; Accession=PF00544.9; Description =Pectate lyase
MRGRDFTQNHEPVGPTQKKYIMKNSSLKTEVHGRVELQEEVKSQEEIGTGIGVDVYKILHGYWHTIPLSSLLISTTPTPLKFFILRADQASTSINASRRNLAFLSCGTGNPIDDCWRCDPNWEKNRKRLADCSIGFGKHAVGGRDGKIYVVTDPGDHPVNPKPGTLRYGVIQEEPLWIIFKRDMVIKLKQELMMNSFKTIDGRGASVHIAGGPCITIQYVTNIIIHGINIHDCKQGGNAYVRDSPTHYGWRTLSDGDGVSIFGGSHVWVDHCSLSNCRDGLIDAIHGSTGITISNNYLTHHNKVMLLGHSDTFTRDKNMQVTIAFNHFGEGLVQRMPRCRHGYFHVVNNDYTHWRMYAIGGSAAPTINSQGNRFLAPNDNTFKEVTKRENSAQSKWKNWNWRSSGDLMLNGAFFTASGAGASSSYARASSLAAKSSSLVSSITASAGSLSCRKGSRC

SEQ ID NO: 122283 - protein, 96 aa, Glycine max
  Coding DNA Sequence Number=SeqID_5505
MGQWRPMRSCHTVRDCNHKRGKNNERCNDIVWKEEKITKSERGNGNKRSGINPCSSWERCRRIYEPGIREQREKEGGGNCALRGRERECWINKVQT

SEQ ID NO: 122284 - protein, 60 aa, Glycine max
  Coding DNA Sequence Number=SeqID_5506
MDLRGGGLIEFYVMRRVFLDFNLVLVDGDLFHVLEEGIDCQVTVILRIKIYGGESGTWSE

SEQ ID NO: 122285 - protein, 107 aa, Glycine max
  Coding DNA Sequence Number=SeqID_5507
  Gene Ontology: Mol. function=catalytic activity; Biological process =metabolic process
  Homolog annotation: Hit_ID=Q386L9; Match level="QueryCoverage=87%, HitCoverage=30%, E-value=3e-08, Identity=34%"; Hit description =Glycerolphosphate mutase, putative
MNAEIRENMIGVLPKRRILMRHGELQGNWDTTVYTTIPDHNIQSTVQGMAQTLYADEHLHRVIGSHDCSPDWRVQFYVSSYARTRSTLREFRWCFLNKRIISVREES

SEQ ID NO: 122286 - protein, 118 aa, Glycine max
  Coding DNA Sequence Number=SeqID_5508
  Gene Ontology: Mol. function=pectate lyase activity; Cellular component=anchored to membrane
  Homolog annotation: Hit_ID=Q9FXD8; Match level="QueryCoverage=97%, HitCoverage=28%, E-value=3e-43, Identity=68%"; Hit description =Probable pectate lyase 5 precursor
FGYFHVVNNDYTHWQHYAIGGSSSPTIFSQGNRFVAPNDDDHKEVTKHFKSSKSEWRKWNWRSEGDVMLNGAFFTPSGAGATARYDKASSMAARPPMLLSYMTAGAGALRCNKGNLCH

SEQ ID NO: 122287 - protein, 186 aa, Glycine max
  Coding DNA Sequence Number=SeqID_5509
  Gene Ontology: Mol. function=transferase activity; Cellular component= intracellular; Biological process=translation
MDPTIDLDEVLDRMIDEELEDNTDEEIIRLILKIQQQLHGNTTGCSQRRIVVHHNHEEVECLKRFISSIYTIFGNEYLRRPNNEDNERLLQMGATRGFPGMLGFIDCMHWKWKNCPDAWKGQFCRGDHRNPTIILEAVTSQDLWIWHGFFGTVGSNNDITVLNGSNVFDEVLSGRAPTVQFTVNRT

SEQ ID NO: 122288 - protein, 844 aa, Glycine max
  Coding DNA Sequence Number=SeqID_5510
  Gene Ontology: Mol. function=protein binding; Cellular component =cytoplasm; Biological process=steroid metabolic process
  Homolog annotation: Hit_ID=Q2QTR4; Match level="QueryCoverage=99%, HitCoverage=100%, E-value=0.0, Identity=61%"; Hit description =Oxysterol-binding protein, expressed
  Pfam annotation: Domain name=Oxysterol_BP; Domain location=405-818; Score=195.1; E_value=1.7e-55; Accession=PF01237.9; Description =Oxysterol-binding protein
  Pfam annotation: Domain name=PH; Domain location=90-234; Score=59.4; E_value=1.2e-14; Accession=PF00169.19; Description=PH domain
  Pfam module annotation: Pfam domain module=Oxysterol_BP::PH; Domain location=405-818::90-234
MNPLCCIAPVSIDRDRPNHVLAKSPAQCQLGLDASIRTVNHASKSSSSTQDSSVAVDSVKATSAVADLPEEEEPRDSKAFSGGNGGGVAGSVAGILYKWVNYGKGWRSRWFVLEDGVLSYYKIHGPDKILMSPAKDRSVRVIGEESSKFVKKANWNLNLNRASSGGGVGGGNSSNNGKQCKPFGEIHLKVSSVRSSKSDDKRLSIFTGTKTLHLRCVSREDRAMWIEALQSAKDLFPRALTSSDLATSEDIVVSTEKLRSRLSQESISETIINDCESIMLSEVSYLQSKLKFLQQKHVMLLDTLKQLETEKIELETTVVDETKERESYCGQGNRRFSDFYSVMSEGSATDSVADNESQDGADVETDDEDRTYFDTNEFLYSDALRSASYRSREGMGNASIFDRDYICYDGVHGFDKEIKDVSYPYVKRRDNLPEPKEKEKPVGLWSIIKDNIGKDLSGVCLPVYFNEPLSSLQKCFEDLEYSYLVDRALEWGKQGNDLMRILNIAAFAVSSYASTEGRQCKPFNPLLGETYEADYPDKGLKFFSEKGSDLCLLYAANFHLTRSLFQVSHHPMIVACHCEGRGWKFWADSNLKGKFWGRSIQLDPVGVLTLQFEDGETFQWSKVTTSIYNIILGKIYCDHYGTMHIKGSGNYSCKLKFKEQSIIDRNPHQVHGFVQDNRTGEKVAMLIGKWDEAMYYVLGDPTTKPKGYDPMTEAALLWERDNHLPKTRYNLSPFAISLNEILPGLSEKLPPTDSRLRPDQRHLENGEYELANAEKLRLEQLQRQARKMQERGWQPRWFKKEEDGCYRYIGGYWETREKNNWDGIPDIFGQSCDLPSCSEETASY

SEQ ID NO: 122289 - protein, 129 aa, Glycine max
  Coding DNA Sequence Number=SeqID_5511
  Gene Ontology: Mol. function=DNA binding
  Homolog annotation: Hit_ID=Q1S0F5; Match level="QueryCoverage=93%, HitCoverage=32%, E-value=1e-10, Identity=31%"; Hit description=IMP dehydrogenase/GMP reductase
DFQLVPTVEEFEEILGCPLGGRKPYLFFGFYPSTTRVAKANGLSFIDILALLIFGVVLFPNMEGLVDLAVIDAFLAFHHGKESPVVAILAMYDTFDRGGEKSGARIVCCALALYVWLVSHLFLQEGRKN

SEQ ID NO: 122290 - protein, 332 aa, Glycine max
  Coding DNA Sequence Number=SeqID_5512
  Gene Ontology: Mol. function=binding; Cellular component=nucleus; Biological process=traversing start control point of mitotic cell cycle
  Homolog annotation: Hit_ID=UPI0000E477AD; Match level="QueryCoverage =67%, HitCoverage=30%, E-value=7e-36, Identity=36%"; Hit description =PREDICTED: similar to SDA1 domain containing 1
  Pfam annotation: Domain name=NUC130_3NT; Domain location=86-137; Score=80.6; E_value=5.1e-21; Accession=PF08158.2; Description =NUC1303NT domain
MDPDGVVAAEALMASGRSSEKLSLPSLQSKMKCDPEGYESELLLLYNQFNSSLELFQKQAAMNFTSISGIGSDPTVAKDLGDRAMFLAHVTPFYPKHLADFPKKLADLLRCAARTLPSGLRCHLAHALILLSNRKIVDIGETLSLFMELQTLGDRTLKKLAFDHVVHSIRRMNQKHKNEAKNRALQNVLFDLLQKEAEEPAKRALVTLCELHRRKVWFDERTANAICTASFHPTSRIMIATLSFLLDYEKIQDDDDDSDNSDSDDEKTESPQVVLSRETVYKASHQGTAASKKKKKAKLQRAIRSMKRHQRVSSDRSKNSYYSPLNHLKDAQ

SEQ ID NO: 122291 - protein, 432 aa, Glycine max
  Coding DNA Sequence Number=SeqID_5513
  Gene Ontology: Mol. function=1-aminocyclopropane-1-carboxylate deaminase activity; Biological process=metabolic process
  Homolog annotation: Hit_ID=Q9LJG2; Match level="QueryCoverage=95%, HitCoverage=71%, E-value=1e-119, Identity=54%"; Hit description =Genomic DNA, chromosome 3, P1 clone: MJL14
MRLRLPSTSAAMIHSNSLHKQIVSKPELGNEEFTQKVLNNRRWTLPSPEAKIHQLIHTQGPTFLLNTHPSFGDANRVNEQRKYFYVVRDDLLHPLVNGNKARKLDGLLPLLQHYSVTDVVTCGGCQSAHTAAIAVLCAERGIVSHLLLRGEQPEILTGYNLMSTMYGNVTYVPRTVYANREEMLKSYAESVAGNDGSVLWFGDIVQASSATELFTDPNFMQMDVSRSEENHLRKILVVSEGAGDSVALLGVIRLVQYLSQNHLLGKQRLMKFVVDAGTGTTAIGLGLAARCLGLPWEVYAVMLADKIDGYRKQEERLLSEFKKHFNIEFIDHNVNREDAGIVNWVERGRPRKFGNVLEGEVEACQQIAQQTGILVDPVYTLAAWETAMLLSSNEAEGGPEVVLLHTGGTLGMFGLAQRYKKYFGMLKKGHSH

SEQ ID NO: 122292 - protein, 68 aa, Glycine max
  Coding DNA Sequence Number=SeqID_5514
MEESSSTTVGAAVVKPRMVWAQQNWNPLAKQRQLDTLLWKIKNPVKDKFPPARGPYSSDVLKRRALEG

SEQ ID NO: 122293 - protein, 180 aa, Glycine max
  Coding DNA Sequence Number=SeqID_5515
  Gene Ontology: Mol. function=nucleic acid binding; Biological process= multicellular organismal development
  Homolog annotation: Hit_ID=Q9LJG1; Match level="QueryCoverage=87%, HitCoverage=26%, E-value=2e-32, Identity=44%"; Hit description =Similarity to terminal ear1
MQARSIEIERRYCGFGMMMEELTGVTTGSTELNNNLFAVNFLAVHVFQGLGGVSYVEELHESLILFPWETTELVGGEVGVEVEDDEGALVVGVGEGVGVREDVVGREEARVGVEVELHGADGGEGGLCMAEVEEVDGENAVAEGFGLEGSDVSEGLELGSEGGVGGERDRGEEEGAGGGG

SEQ ID NO: 122294 - protein, 238 aa, Glycine max
  Coding DNA Sequence Number=SeqID_5516
  Gene Ontology: Mol. function=transporter activity; Cellular component= integral to membrane; Biological process=transport
  Homolog annotation: Hit_ID=Q6D518; Match level="QueryCoverage=99%, HitCoverage=59%, E-value=7e-71, Identity=57%"; Hit description =Putative transporter
  Pfam annotation: Domain name=MFS_1; Domain location=1-232; Score= -51.7; E_value=0.073; Accession=PF07690.6; Description=Major Facilitator Superfamily
  Subcellular localization annotation: CTP_CleavageSite=76; ConfidenceScore=5.13e-01
MMGLILFGFSCGSMLGVLLAGKLVAHFGTSRVMRTGYLILLGGLVLMTVALTLASSGLVFTSLVLLGGGTALMDVVVNVEGAAFERRIGKSIMTIIHGFFSFGTLIGALAGLAMTAADISTHWHFSVVLLVNLLIAALALRHLPTTSDSERSEQPHHGGFLAQVGRELRDRQLLVLGVVILAMALAEGSANDWLPLLMIDGHNLNHTQSTLVYAGFTAGMTLGRFLGGLVVDRLGRVW

SEQ ID NO: 122295 - protein, 368 aa, Glycine max
  Coding DNA Sequence Number=SeqID_5517
  Gene Ontology: Mol. function=signal transducer activity; Cellular component=membrane; Biological process=signal transduction
  Homolog annotation: Hit_ID=Q6D251; Match level="QueryCoverage=68%, HitCoverage=51%, E-value=4e-49, Identity=45%"; Hit description =Methyl-accepting chemotaxis protein
  Pfam annotation: Domain name=MCPsignal; Domain location=139-334; Score=201.0; E_value=2.7e-57; Accession=PF00015.11; Description =Methyl-accepting chemotaxis protein (MCP) signaling domain
GLKSLTDYYLTHNLSSDEDKRLTELAFANIQRVRERLPAFLTASRAHQNAISLDLIEGQNGIGAAIRQLVTNYQQQLMLNISIGDELRATNLSTFHEVLWTTITGVIATVIIFGLASHSVSSASVEIAAGNEDLSARTEQQAASLEQTAASMTELSETVRQTADNTRQASQLAANASSLSEKSGTSLSTMLSTMDDIRGSSRKVTDIVSMIEGIAFQTNILALNAAVEAARAGEHGKGFAVVAGEPGPAQASDVSSNMQVMNDAIHQVSELMSEIPAAAVEQSQGISQVQQAVNQMDDVTQQNAALVEQASAASQSLQEQAQTLNQLVTRFVLAESGATPVIKPAPASHKAPQPGRLALASDADWQSF

SEQ ID NO: 122296 - protein, 63 aa, Glycine max
  Coding DNA Sequence Number=SeqID_5518
MAYTHIPVKVENPDLAPYTSEPYNAQWNAPGLLRDKHTLRSSRILGEMEVVFVIGSAVDRLCG

SEQ ID NO: 122297 - protein, 400 aa, Glycine max
  Coding DNA Sequence Number=SeqID_5519
  Gene Ontology: Mol. function=DNA binding; Cellular component=nucleus; Biological process=regulation of transcription, DNA-dependent
  Homolog annotation: Hit_ID=Q84WP6; Match level="QueryCoverage=67%, HitCoverage=69%, E-value=3e-90, Identity=61%"; Hit description=NAC domain-containing protein 43
  Pfam annotation: Domain name=NAM; Domain location=15-144; Score =301.4; E_value=1.6e-87; Accession=PF02365.6; Description=No apical meristem (NAM) protein
MPENMSISVNGQSQVPPGFRFHPTEEELLQYYLRKKVSYEKIDLDVIRDVDLNKLEPWDIQEKCKIGTTPQNDWYFFSHKDKKYPTGTRTNRATAAGFWKATGRDKVIYSNGKRIGMRKTLVFYKGRAPHGQKSDWIMHEYRLDDNNTADTNIVSNVMGDAAQEEGWVVCRIFKKKNHLKTLDSPLASGEDRRSHLFDSCDEGALEQILEQMGRSCKEESSYEGNYRNYGRFTRPYETTGLNNGGGYNDRFMKLPSLESPKSASMESHHNTNNNNNMNSNNNNNGDNNENNNNNGYHPMIPVEMGTDNEGSFTTHQVSGGDPNNNNNNMVHPLEVGSGGGGLTNWAALDRLVASQLNGQTDASRQLACAFNDPTMYCTSDHHDLHQIPTLRSSSTSAAHT

SEQ ID NO: 122298 - protein, 101 aa, Glycine max
  Coding DNA Sequence Number=SeqID_5520
MNLFVLKVEETPDTNNLVLLCSEKCHLPRKMEEESLNVEEKNVGGGHVYAGITLGPHKVGRCGQLKKSKGARPHPQLRPLTLKSPWKSTSETTMDHGKKFT

SEQ ID NO: 122299 - protein, 74 aa, Glycine max
  Coding DNA Sequence Number=SeqID_5521
MVVFKRLRILWQRNPSWDMGSKGGFFRYADGFDKLLLLFGTLGCIGGGLQTPMTMLALSSLINDYAGGSVQTML

SEQ ID NO: 122300 - protein, 125 aa, Glycine max
  Coding DNA Sequence Number=SeqID_5522
  Gene Ontology: Mol. function=ATPase activity, coupled to transmembrane movement of substances; Cellular component=integral to membrane; Biological process=transport
  Homolog annotation: Hit_ID=Q1SQG6; Match level="QueryCoverage=98%, HitCoverage=93%, E-value=5e-41, Identity=70%"; Hit description=ABC transporter, transmembrane region, type 1
  Pfam annotation: Domain name=ABC_tran; Domain location=3-116; Score =30.1; E_value=3.7e-10; Accession=PF00005.17; Description=ABC transporter
MYGKKDVSEDEIRKAARLSNVHEFISSMKDVYDTYCGERGVQLSGGQKQRIAIARAVLKDPSILLLDEATSALDSVSENLVQEALEKMMVGRMCVVIAHRLSTIQSVDSIVVIKNGKVMEQGSHS

SEQ ID NO: 122301 - protein, 610 aa, Glycine max
  Coding DNA Sequence Number=SeqID_5523
VLCRCSGEGDINSRIINLFDLIGKYSWDAKVVLVLAAFAVRYGEFWQLKQLYRGNALAALISNIKQLPNNLKPLKLQIKALSLLVKTMMDVAMCIIKFEYLPLQHVEPGNDIFLVRDTKSRIYEAAYWITRSCLACFSQVMDFTAKKHDQVHVSSLEAQIMYSDSAIIAAWELSSLAYRLSGICCNLRRQVDLCHKELERNLYDRLLDLAREENIDNQKTLTLFFPSKNYLPLKDCSTEVKLRGSELKNKTVLLLISKPQLLNPIDIYLLVQQTCDHPLNERLRESYKIVWIPLPSSDTWTEAEESSFNFMSDSLPWNAVRKPRLLSSAVVKYIREQWNYKDEPIMVALDSKGKVTNYNALDMINIWGAQAYPFSASKEEELWQDQNLTMQLLLDGINPLLAYWVEQGKNICLYGSENLVWIQQFNDKITEIKRAGLQLDTIYVGNSQSGENVKQIMARGGEKSLSDPLSFTNVQHFWVRLETMRRSKLRLGKTPSSDHVLAELSTLLDMDDREEGWAVIGCGGSSSTDILRLQGMQVMEFLRKCSEWRENITNLGLHGALRNFLDPHFVEGSCNHSYFVSSRENERPSQGTVMCQVCKRPMKNFVVYQP

SEQ ID NO: 122302 - protein, 179 aa, Glycine max
  Coding DNA Sequence Number=SeqID_5524
  Gene Ontology: Mol. function=transporter activity; Cellular component= mitochondrial inner membrane; Biological process=transport
  Homolog annotation: Hit_ID=Q9SZI9; Match level="QueryCoverage=99%, HitCoverage=46%, E-value=3e-56, Identity=62%"; Hit description =Putative mitochondrial carrier protein
  Pfam annotation: Domain name=Mito_carr; Domain location=37-162; Score= 107.5; E_value=4e-29; Accession=PF00153.17; Description=Mitochondrial carrier protein
GNGASVARIIPYAAIHYMSYEEYRRWIIQTFPHVWKGPTLDLVAGSLSGGTAVLFTYPLDLTRTKLAYQELEGKVLPCAFIYTNYLHLKLQIVSPKKLNASGMVNNEQVYRGILDCLAKTYKEGGIRGLYRGVAPTLVGIFPYAGLKFYFYEEMKRHVPEEYNKSIMAKLTCGSVAGLL

SEQ ID NO: 122303 - protein, 178 aa, Glycine max
  Coding DNA Sequence Number=SeqID_5525
  Gene Ontology: Mol. function=hydrolase activity, hydrolyzing O -glycosyl compounds; Biological process=carbohydrate metabolic process
  Homolog annotation: Hit_ID=Q9LTN0; Match level="QueryCoverage=59%, HitCoverage=24%, E-value=6e-10, Identity=32%"; Hit description =Arabidopsis thaliana genomic DNA, chromosome 3, P1 clone: MTC11
MKGYIRGFLVYVLDQEVVKGLGDNGVMVILDNHVSKPRWCCSDDDGNGFFGDSYFDPDQYGHPFQQKTRPGLSEVEAHKVIFHPIDRAQKVLSVKGRNSTCLQAEGERKETKLGNECSVWEIISDSMLHLSSKINNNASDVDANNNIVTNACKCLSGVKMCDPASQWFKLVDNTRNST

SEQ ID NO: 122304 - protein, 205 aa, Glycine max
  Coding DNA Sequence Number=SeqID_5526
  Homolog annotation: Hit_ID=Q1RUD8; Match level="QueryCoverage=43%, HitCoverage=22%, E-value=1e-07, Identity=32%"; Hit description=IMP dehydrogenase/GMP reductase
IDAFLAYHNHKESPVVAMLADLYDTFDRRCEKSSTRIVCCTPALYVWLVSHLFRQEVRHACPLEEGRTGVLISCGGFLNVPMMGTRGFNKTNVEMLQKVRKAWGVVQKKDKELRDNGPIGGYHEWLKAHVQDEAPEEDEGVQALRTELKQAQTVKERFNLATLKIRKENAKLRDINIATTKALEQETKRARREEHGRNKFRGALW

SEQ ID NO: 122305 - protein, 246 aa, Glycine max
  Coding DNA Sequence Number=SeqID_5527
  Gene Ontology: Mol. function=molecular_function; Cellular component =nuclear pore; Biological process=poly(A)+ mRNA export from nucleus
  Homolog annotation: Hit_ID=Q00XF1; Match level="QueryCoverage=79%, HitCoverage=83%, E-value=4e-28, Identity=32%"; Hit description=[A] KOG2412 Nuclear-export-signal
  Pfam annotation: Domain name=GLE1; Domain location=1-164; Score=77.2; E_value=5.2e-20; Accession=PF07817.3; Description=GLE1-like protein
MVVVAYCANPANVPFASAYVIVLVTSQVPHAMDILLAELHRACIYTVPKHLVYKKSAYQSKEAYFRSIGYREDDEKMESTEDYLKRLESYMKMYGALVQTEITNCQNFHGLKEGWAWLARFLNTHPANQYTAVSLNAFLQMAGFALYNRYKSQFLKMLNVVSENFLVDLKSQNIPELARTVTEIQTYIDDKKFLQEPEGRSLQSDLLSTKILQEADRWIPKPKKSSGRSAIVFILRSFTSLTVYTN

SEQ ID NO: 122306 - protein, 331 aa, Glycine max
  Coding DNA Sequence Number=SeqID_5528
  Gene Ontology: Cellular component=nuclear pore; Biological process =poly(A)+ mRNA export from nucleus
  Pfam annotation: Domain name=TolA; Domain location=75-331; Score= -152.3; E_value=0.067; Accession=PF06519.2; Description=TolA protein
  Subcellular localization annotation: CTP_CleavageSite=64; ConfidenceScore=5.14e-01
MALPLNPNLIGPSTILFRNSTLWRLSSPLMLLLPPNVLHLSINQYRSGVFSGKEIQRGRAFVLRADEFDMEDSESDDDDHVDRALVVTDSGKRFTCDELYLSVSDDDSDIASGFEVRPYLMDELGEVEGALLELTHEHQLRVKDEIRNKISALETALVNETQNSTSSFLRVEKYKETRLDLDKKFDTQYQRRIAEALDNHLTAVQRDRELRSQIEERKIRSDAAYEEAKRKVAFEKQQQEKAKAEAEAKLRAEEAKREAESKAAMEAKKQAAIEAEKSAAVEAERRAEKEATETSKRVTSGGTQQATAHPTGTASSLSNAETKESGIAFLY

SEQ ID NO: 122307 - protein, 536 aa, Glycine max
  Coding DNA Sequence Number=SeqID_5529
  Gene Ontology: Mol. function=metal ion binding; Cellular component =cytoplasm; Biological process=vesicle-mediated transport
  Homolog annotation: Hit_ID=Q08ET6; Match level="QueryCoverage=78%, HitCoverage=88%, E-value=1e-143, Identity=60%"; Hit description=RING- finger protein
  Pfam annotation: Domain name=Copine; Domain location=143-319; Score =258.2; E_value=1.7e-74; Accession=PF07002.6; Description=Copine
MHLELETWTILVAIVCILVFLLKEFVMGGKSSKGSGRRYDFGASSSSRDNSYGGYPPQSPYTSYQTPQHPCASASASAPFYDYAQPKRKLDKKYSRIADNYRSLDEVTAALANAGLESSNLIVGIDFTKSNEWTGKRSFNRKSLHDIRSGQNPYEQAISIIGKTLSAFDEDNLIPCFGFGDASTHDQDVFSFFSEERFCNGFEEVLTRYRQIIPSLKLAGPTSFAPIIEMAMTIVEQSGGQYHVLLIIADGQKKTTSAQFYQYLDKLHQASKTDTQLVAQVTRSVDTQHGNLSPQELNTINAIVKASEYPLSIVLVGVGDGPWEMMREFDDNIPSRVFDNFQFVNFTEIMRRNVDPARKETDFSLSALMEIPSQYKATLELGILGSRRGHSPDRVALPPPLYSRTSSSISTKSTRSNSFQQRTPTHTSYDSGVHTETSSSSLYDNKVCPICLTNAKDMAFGCGHQAGAAKGCADLVRLFSRWFLVHKNCTRNFEAKLVFPVTVRKKCSQKELAFPVVYICSSCVLEGIMFLNKLLV

SEQ ID NO: 122308 - protein, 638 aa, Glycine max
  Coding DNA Sequence Number=SeqID_5530
  Gene Ontology: Mol. function=protein tyrosine/serine/threonine phosphatase activity; Biological process=protein amino acid dephosphorylation
  Homolog annotation: Hit_ID=Q762M8; Match level="QueryCoverage=99%, HitCoverage=77%, E-value=1e-180, Identity=52%"; Hit description=MAP kinase phosphatase
  Pfam annotation: Domain name=DSPc; Domain location=109-248; Score =132.4; E_value=1.3e-36; Accession=PF00782.11; Description=Dual specificity phosphatase, catalytic domain
  Subcellular localization annotation: CTP_CleavageSite=58; ConfidenceScore=5.41e-01
MLGEAGKKDKAPPGGVAWKTYSRSVSWTDRSPNSRKPPTNSKTRPLLPPLQPLSINKRNVEEWPSAGSDDLGVWPLPQTPRGSSTSSSQQQPTKDFLFKRDKLAFFDKECSRIAEHIYLGSDTVAKNHELLRQNGITHVLNCVGFVCPEYFKGDFVYKTLWLQDSPTEDITSILYDVFDYFEDVREQGGRVLVHCCQGVSRSTALVIAYLMWREGQSFEDAFQFVKTARAVTNPNMGFACQLLQCQKRVHAMPASPNSVLKMYRMAPHSPYDPLHLVPKMVNQPGSQALDSRGAFIVHECSLSVIRYEGAKGPILTIHEGEEPPGFWIALSIEQRISGDSEKEVVIMEEPSEGMESAVEPVDSGMTTGPRKIDAYDLDFEIFHKALAGGVVPPFSLSDPGSETCLPAREQGWARLRRKFASGLLTSPKFICDADSTPCNDHQPSVSEEAAYEPLSPSSIPPCGSPDSFECYPNREKGSPEAMDFSVHGVASSLPLSPTGTSNPFPCFISCIPKFNSKSPTLSPSSSDYASSFTFSPSSTNWSDLSLVSSRQPSPSGLESAEPFYVKDASFSENSTLLHKDVSSPLEEFSANHTFGGANSNLQLKGSFLSIAERRGNHPPPLMLLPSASESSHVPKTNV

SEQ ID NO: 122309 - protein, 138 aa, Glycine max
  Coding DNA Sequence Number=SeqID_5531
  Gene Ontology: Cellular component=chloroplast
  Homolog annotation: Hit_ID=P03938; Match level="QueryCoverage=43%, HitCoverage=45%, E-value=6e-11, Identity=86%"; Hit description =Hypothetical 14 kDa protein ycf68
MSPHGGDMDGGEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKNGAPNNVSSQTKNYEIAPFILG

SEQ ID NO: 122310 - protein, 49 aa, Glycine max
  Coding DNA Sequence Number=SeqID_5532
MDPGEGAADVDVGVGAADEEGSSAGLALALLAPQIETIRSSGFQQFFLM

SEQ ID NO: 122311 - protein, 352 aa, Glycine max
  Coding DNA Sequence Number=SeqID_5533
  Homolog annotation: Hit_ID=Q93ZR2; Match level="QueryCoverage=95%, HitCoverage=86%, E-value=1e-149, Identity=71%"; Hit description =Putative storage protein
  Pfam annotation: Domain name=DUF707; Domain location=49-345; Score =714.9; E_value=5.6e-212; Accession=PF05212.3; Description=Protein of unknown function (DUF707)
MLNLPSGLLPSIDLSYIEDRYTGRQAWSFMNNGNKRSSSQVQLSNDTSKIWVPSNPRGAERLPPGIVEAESDYYLRRLWGKPSEDLTSRPNYLVTFTVGYDQKNNIDAAVKKFSGNFTILLFHYDGRTTEWDEFEWSKQAIHFFPLRWYAKRFLHPDIVAPYDYIFIWDEDLGVEHFNAEEYIKLVRKHGLEISQPGLEPNRGLTWQMTKRRGDQEVHKVTEEKPGWCSDPHLPPCAAFVEIMAPVFSRDAWRCVWHMIQNDLVHGWGLDFALRKCVEPAHEKIGVVDSQWIVHQGIPSLGNQGESQTGKAPWQGVRERCRKEWTMFQSRLANAEYAYHNSIGIDTSNSTAH

SEQ ID NO: 122312 - protein, 685 aa, Glycine max
  Coding DNA Sequence Number=SeqID_5534
  Homolog annotation: Hit_ID=Q2QTN6; Match level="QueryCoverage=47%, HitCoverage=61%, E-value=8e-50, Identity=37%"; Hit description =Expressed protein
MAETVRLRVVFEDRGMLSKSKKKQGLKRCWFLLKPQHTAISDVASHLLNTFRLHRTCPHGIVLSMDGFVLPSFESTCILKDKDIVCVKRKGSVSTDDNKPAMLPPAACENQSIELPKLLTIEGLQEESGGEETMSHKDGDDQLEDAVYVESESDRNVVSKKRKASKKLKSPSQKKIKLSTAENLSVIPQVHEEENGSSEGHIHHQLSVVKKDKKKHSNLSSQSNKSSNLNKQKNDKSDPTSDETRFVQPQDESETKKLPSRSARRKKAKRRWLRELKLENEMKEKKWFYGAIVLWNSLVRNHDFVCYCGISIDGCGTACDLFPNQSQCPTPPMHPHQTPVLEKDGQELPIKDNNCVVSDVHQKPDEESGEEDDIVPVEIRPGHIRFEPLKKDQDQAVTQDQFPVEIFQWNGITNKKKGQKWGKERMSFRKQDGYEHSSQDCPTVRNAEKEQPSNAIDFDKLKPYYTSLPKEGDVIAYRLIELTASWTPELSSFRVGKISRYDAKSNRIWLEPVLEYPFDFKKKIDEDASSVQYNPSPYQENGSLEIEYTSLADVRMVKHGNPDLKTVVVSSDAWVKTTKATNDITKEKLAAKATNGSTDEKLAADQTTMGSCQPERGHITAKENGEVNVWDEINEALKAKKAKLSKEDGWSRGGESSSTRSWSHRAMRCSALGPTMALLRSNNGL

SEQ ID NO: 122313 - protein, 163 aa, Glycine max
  Coding DNA Sequence Number=SeqID_5535
MAFDAILSRKGPVTRAMSKRLQEDWARATKEGPRVLMNLSDAILPRKGLVTRAMSKRLQEDWAIAAEEGPRVLMSLRGLLFAGMQPSLDRLEVLNTHRWVIRKVPQHSGRRRETRGMRVPRKEYARSRHQRLFEENVGKTGKDAIYELLSERFGSCIYAQGRY

SEQ ID NO: 122314 - protein, 157 aa, Glycine max
  Coding DNA Sequence Number=SeqID_5536
MEVNAAIVVAASTATKVDPAHPSGLNQVNPPVSDIVGQGGEALGSTGDPYFVMSTTLHPYPLRANNPNLIMHMSLNPWGETHEAPRDHNLAGFEPHLEYATEGQAVWGVPLPDTLEGPQFHPQPQPLHFAVGRVPPAMVERGKFDHIEERLRDIEGG

SEQ ID NO: 122315 - protein, 361 aa, Glycine max
  Coding DNA Sequence Number=SeqID_5537
  Homolog annotation: Hit_ID=UPI00005F9392; Match level="QueryCoverage =42%, HitCoverage=86%, E-value=4e-38, Identity=52%"; Hit description =COG1335: Amidases related to nicotinamidase
  Pfam annotation: Domain name=Isochorismatase; Domain location=1-150; Score=-8.8; E_value=1.4e-05; Accession=PF00857.11; Description =Isochorismatase family
MVVDMQNGVLATPRYDRAGRCARINQLMAAADQVIFIQHSGPDLAADSADWQIVAELEQPAGALYITKTACDSFWQTGLAAQLEQHQIESFVICGCATDYCVDTTIKVGASLGYHVTVAADAHTTADRTHVSAQQLINQHNEVWADLIMPGNPHDTCLYGVSHMRAYIPQPGANDNTLWRVAGLPPRGIELTRMLEAGLPVAVIDDIRHWSAMTRAEIMKVTGINERNIARRKSTGKSLSPDESERVARFVRVMDAAVQLFAGNKEEATQWLSRPVKGLGNVAPITLLTTESGALDVLDLIGRLEHGYPTVYVATSVSLAALEVLVHIGRESVLDEYTLLSIDIPDAEVAYLAEAFLPPDW

SEQ ID NO: 122316 - protein, 133 aa, Glycine max
  Coding DNA Sequence Number=SeqID_5538
AAISAVSGNKQVFPPYGLPPNYTPPNENVNNFTSIPIESQQPQSDHAHVSQPMGETHEMRHHNLADFQPCLGYATEGQADHQEERLRAIEGGEDYAFANLEELFLVPNIITPPKFKVPDFVKYKGATCPKNLQ

SEQ ID NO: 122317 - protein, 140 aa, Glycine max
  Coding DNA Sequence Number=SeqID_5539
GTERGVHEKVEHDKEEEREIGLEDVGKGVFRMEGSLLELGEPLKFGRVEDLGPILVTRGVDRLRKGNAQTKSRGRREKQQKELETNFNMMDQDNKNIKQPQEGVVGVREGAMLFGEADLLEFPLNGRKVTWYKDDGSSMT

SEQ ID NO: 122318 - protein, 198 aa, Glycine max
  Coding DNA Sequence Number=SeqID_5540
  Gene Ontology: Mol. function=pepsin A activity; Biological process =proteolysis
  Homolog annotation: Hit_ID=Q8H9F4; Match level="QueryCoverage=53%, HitCoverage=20%, E-value=2e-12, Identity=41%"; Hit description=41 kD chloroplast nucleoid DNA binding protein
MPPVASAVQVVPSLVVARMGLTWLGAASTNCGMQEERGVVLHKFHTSSHVFTAFGTLHSSRHLHLCQVSIAQRENWVGPPLSTLNYIIVIRLGTSEKTLQMVFDTGSHLTWTQCYQCKSCYEQANARFNPLNSSTYEASDYLDDTCKDLISSGQGPLQMSRHWHWRVVQCLAGASGGTSCTAIGASGTQPRQPHSHHN

SEQ ID NO: 122319 - protein, 83 aa, Glycine max
  Coding DNA Sequence Number=SeqID_5541
FFRKLPDETSSGNLRMTIFRKPPDDDLPDEVCGAILPLHCLLGAPAIMLGARSNSPESPVLSEWPNSTHRKVQNAFLFSYPKA

SEQ ID NO: 122320 - protein, 68 aa, Glycine max
  Coding DNA Sequence Number=SeqID_5542
MWRVFQQWEEVEDVFIPLERETGEKIQICEDENGRGCGGYHRREKKITKERVKEGKKYGIIREAKRDG

SEQ ID NO: 122321 - protein, 57 aa, Glycine max
  Coding DNA Sequence Number=SeqID_5543
MARRRMLHQWLEWMIGCNCKVNGGQERRHGNGTGIVSPILDPDFPKCLRTRISYPTD

SEQ ID NO: 122322 - protein, 708 aa, Glycine max
  Coding DNA Sequence Number=SeqID_5544
  Gene Ontology: Mol. function=binding; Cellular component =intracellular; Biological process=metabolic process
  Homolog annotation: Hit_ID=Q654C7; Match level="QueryCoverage=90%, HitCoverage=94%, E-value=1e-123, Identity=30%"; Hit description =Putative pentatricopeptide (PPR) repeat-containing protein
  Pfam annotation: Domain name=PPR; Domain location=180-214; Score =23.7; E_value=0.00067; Accession=PF01535.11; Description=PPR repeat
  Pfam annotation: Domain name=PPR; Domain location=281-315; Score =39.2; E_value=1.4e-08; Accession=PF01535.11; Description=PPR repeat
  Pfam annotation: Domain name=PPR; Domain location=382-416; Score =29.6; E_value=1.1e-05; Accession=PF01535.11; Description=PPR repeat
  Pfam annotation: Domain name=PPR; Domain location=483-517; Score =40.6; E_value=5.4e-09; Accession=PF01535.11; Description=PPR repeat
  Pfam annotation: Domain name=PPR; Domain location=518-552; Score=1.0; E_value=5.6; Accession=PF01535.11; Description=PPR repeat
  Pfam annotation: Domain name=PPR; Domain location=554-588; Score=8.2; E_value=0.8; Accession=PF01535.11; Description=PPR repeat
  Pfam annotation: Domain name=PPR; Domain location=620-654; Score =10.7; E_value=0.4; Accession=PF01535.11; Description=PPR repeat
  Pfam annotation: Domain name=PPR; Domain location=78-112; Score=12.1; E_value=0.27; Accession=PF01535.11; Description=PPR repeat
  Pfam module annotation: Pfam domain module=PPR::PPR::PPR::PPR::PPR::PP R::PPR::PPR; Domain location=180-214::281-315::382-416::483-517::518 -552::554-588::620-654::78-112
MTAVFSRNLDSPLTYSSPGTATECRELIQQAKQEQLAQNAYSVHNMLELNSELKQLVKQGQLCKSRYMFDKMTHRDEISWTTLIAGYVNASDSYEALILFSNMWVQPGLQRDQFMISVALKACGLGVNICFGELLHGFSVKSGLINSVFVSSALIDMYMKVGKIEQGCRVFKKMTKRNVVSWTAIIAGLVHAGYNMEALLYFSEMWISKVGYDSHTFAIALKASADSSLLHHGKAIHTQTIKQGFDESSFVINTLATMYNKCGKADYVMRLFEKMKMPDVVSWTTLITTYVQKGEEEHAVEAFKRMRKSNVSPNKYTFAAVISACANLAIAKWGEQIHGHVLRLGLVDALSVANSIVTLYSKSGLLKSASLVFHGITRKDIISWSTIIAVYSQGGYAKEAFDYLSWMRREGPKPNEFALSSVLSVCGSMALLEQGKQVHAHVLCIGIDHEAMVHSALISMYSKCGSVEEASKIFNGMKINNIISWTAMINGYAEHGYSQEAINLFEKISSVGLKPDYVTFIGVLTACSHAGMVDLGFYYFMLMTNEYQISPSKEHYGCIIDLLCRAGRLSEAEHMIRSMPCYTDDVVWSTLLRSCRVHGDVDRGRWTAEQLLRLDPNSAGTHIALANIYAAKGRWKEAAHIRKLMKSKGVIKERGWSWVNVNDKLNAFVAGDQAHPQSEHITTVLELLSANIGDARQEIRSLNDDVED

SEQ ID NO: 122323 - protein, 154 aa, Glycine max
  Coding DNA Sequence Number=SeqID_5545
MPPTRHPLDPDKSNRALGFPALITSLYHSFGVPVTPRKVIRPPITRAFIEKYCMPRQVQGDATTSSGHRRSATTSSGRSRWITRHGALSTALGSPAGGQPPGAEQFGAEVAWPGDWLEAQAREEPAGSPGEAEEAHMDEEMNDLLDFLGGSGAT

SEQ ID NO: 122324 - protein, 55 aa, Glycine max
  Coding DNA Sequence Number=SeqID_5546
MWGARVLVSIEIWVSEKNVVVVVLKKRWVGKWEEQEAIHEILHNQEQFGWNHYKI

SEQ ID NO: 122325 - protein, 145 aa, Glycine max
  Coding DNA Sequence Number=SeqID_5547
MKNWLGRGEGRGARGLKSLLVPIRSVAVQEEEKLFCLSSECYLLQYCGDEEKHAYLSDSRTTPILEKRKKVMQSYRPRVLDRRLQEAWARATKEGPGVLMNLRLLNEVFSKKLLKEVFSKKLLKEVFSKKLLKEVFLRKLPKEAT

SEQ ID NO: 122326 - protein, 204 aa, Glycine max
  Coding DNA Sequence Number=SeqID_5548
  Gene Ontology: Mol. function=metal ion binding
  Homolog annotation: Hit_ID=Q1SDL8; Match level="QueryCoverage=45%, HitCoverage=40%, E-value=2e-21, Identity=49%"; Hit description=Zinc finger, RING-type; RINGv
  Pfam annotation: Domain name=zf-C3HC4; Domain location=90-131; Score =35.7; E_value=1.6e-07; Accession=PF00097.15; Description=Zinc finger, C3HC4 type (RING finger)
MEVTQYTFLVVLVWSSLCTNAQWNNPINYSPFDEINKGENSKLRACCCSSSGRRNTTKLVAAATETIEKCPVFEYSTAKELKVGNGTEECAVCLVEFEDSDTIKMLPKCQHVFHQHCIDTWLPSRMTCPICRQKLTSEDNTVIDVVDVVVPTEQQEHDDTESTESEVAVTAAEEQPQPDETAEHETDTDHSTVVEQVVEFEVVA

SEQ ID NO: 122327 - protein, 254 aa, Glycine max
  Coding DNA Sequence Number=SeqID_5549
  Gene Ontology: Mol. function=hydrolase activity, hydrolyzing O -glycosyl compounds; Cellular component=chitin- and beta-glucan -containing cell wall; Biological process=carbohydrate metabolic process
  Homolog annotation: Hit_ID=Q6YTT8; Match level="QueryCoverage=91%, HitCoverage=46%, E-value=1e-84, Identity=61%"; Hit description =Putative 1,3-beta glucanase
  Pfam annotation: Domain name=Cellulase; Domain location=4-253; Score=- 18.9; E_value=3.9e-06; Accession=PF00150.8; Description=Cellulase (glycosyl hydrolase family 5
RHRNSFITIEDFKFLYKHGINTVRIPVGWWVAYDPDPPSPFIGGSLEALDNAFSWAQEYDIKCIIDLHAAPASQNGMEHSASRDGFTGWPTSPDYISDSLHAIDFLVSRYAKNPALLGIELLNEPSAATVSLDVLISYYKQGYQIVRKYSSSAYVIICQRIGVADPMELYQANIGSHNLVLDLHFYNLFDTFFDNMSAMDNIQYIYKSRVGQLQALNNSNGPLVLVGNSPSKWSLNILGWLGLTCTWFCLLSLL

SEQ ID NO: 122328 - protein, 311 aa, Glycine max
  Coding DNA Sequence Number=SeqID_5550
  Gene Ontology: Mol. function=phospholipid binding; Cellular component= coated pit; Biological process=endocytosis
  Homolog annotation: Hit_ID=Q1SDM1; Match level="QueryCoverage=99%, HitCoverage=98%, E-value=3e-94, Identity=59%"; Hit description =Phosphoinositide-binding clathrin adaptor, N-terminal
  Pfam annotation: Domain name=ANTH; Domain location=24-277; Score= -37.5; E_value=7.1e-06; Accession=PF07651.6; Description=ANTH domain
  Pfam annotation: Domain name=ENTH; Domain location=24-150; Score= -17.0; E_value=0.00088; Accession=PF01417.11; Description=ENTH domain
  Pfam module annotation: Pfam domain module=ANTH::ENTH; Domain location=24-277::24-150
  Subcellular localization annotation: CTP_CleavageSite=59; ConfidenceScore=5.07e-01
MTKLKELIGIMKDKASQGKAAILSKRATLSLLRATSHDSFAPPTRDHLSTLLSSGDGSRATASDAVDLLTGRLQTTQSSAVALKCLIVVHHVIRRGSFIMRDQLPYSGGRNHLNLSKFRDKSSPVCWELSLWVRWYAKHVEQLLWASRIVGFLPTEKEKASGLTNEELLRETEALLTVLEGIGNIPNAASMEGNRLVSEVATLVEEDGVAVLSEIFLRVNEFRERLVCLGFGEVVELVYVLNRLGKCKEILVITEKQKLWDLVRELKVKIEKMEVYREEGKRTVTTQRATKSDRFALTLVNSVDLGRFPSA

SEQ ID NO: 122329 - protein, 319 aa, Glycine max
  Coding DNA Sequence Number=SeqID_5551
  Gene Ontology: Mol. function=metal ion binding; Cellular component =integral to membrane; Biological process=defense response to fungus
  Homolog annotation: Hit_ID=Q1SGA9; Match level="QueryCoverage=30%, HitCoverage=27%, E-value=7e-33, Identity=61%"; Hit description=Zinc finger, RING-type; RINGv
  Pfam annotation: Domain name=zf-C3HC4; Domain location=140-181; Score= 29.2; E_value=1.5e-05; Accession=PF00097.15; Description=Zinc finger, C3HC4 type (RING finger)
MGMGRRTNYSSIPSPLHSPIPLSSIPWVPSLIHGDHMHLNLAPIVIIVLAGTTCIIMFLITLFKILRYYYPNRYNVSRSNPPILFDIRGDFPFSDDEEREQAIRHPIWFILTEGLQQSIIDSITVCKYRKEEGLTKESECLVCLGEFQQEESLRVLPKCNHAFHVPCVDTWLRSHKTCPLCRAPIVLDVASVGGGTESDSSVSDMNECIEESNYSGGEEEDSSEEGRDDGIQVLNESGKVSGHSSILIGSASDDVTAQEFDDEIELKMKRSVSVDSSFPSMVLRDVLDLNLDTESLVIEKVSISSNKDVIALQERNFSL

SEQ ID NO: 122330 - protein, 810 aa, Glycine max
  Coding DNA Sequence Number=SeqID_5552
  Gene Ontology: Mol. function=solute:hydrogen antiporter activity; Cellular component=integral to membrane; Biological process =regulation of pH
  Homolog annotation: Hit_ID=Q1S3D8; Match level="QueryCoverage=98%, HitCoverage=98%, E-value=0.0, Identity=61%"; Hit description=WD-40 repeat
  Pfam annotation: Domain name=Na_H_Exchanger; Domain location=72-471; Score=91.4; E_value=2.8e-24; Accession=PF00999.11; Description =Sodiumhydrogen exchanger family
MGTNDTLFSINKTIYNKVVFDDYNSDPDGRFLFYNITIDMPSKIVSDGIWGNRDYGALISRATMPLLETQILCIFVITQCFHLVLRRLGFPYFVSQMMAGFVLGPSLKIEALRKFKMMLFPYGSEDVLNLVSGFGYALFLFLNGVKMDFSMITRTGKKAWTIALSSLMIPTFIGLFVCYSFMGQAQKALGEFDGGKLPVIVIGHSGCSFPVVASLLSDLEILNSELGRLALSAALVMDVISQVVRGLGTAVVSSLRLDSHDHAPGKGPKLATYTAIKFFIFIALTIVIARPAMRWIVRNTPEGRPVKKAYMYIVFLMTLCAGLLGVWANQTVLGGMLLFGLLVPEGPPLGSQLVKQFEMINSWFLLPIFVTCCAMKVDISTLKSGTLVLVVVSIIVCVHLVKMLLTVGICRYCNMPKTDGLCLALMLSCKGVVDYVTSIFLFDSMLMSNETVSMTAISVLVLGSIARIGVKSLYNPARKYAGYQKRNILSLKPNSELRVVACIQKPSHINSVKNALEIWCPTITNPLVVHVLHLMELVGRSSPIFISHRLQERVSHPSHINYSEDVIVAFDLFEHDNAGTTSVSTYTAISPPRFMHDDICYLALDKLASIILLPFHIRWGEDGGIESTDVNMRALNSKVLERAPCSVGILVNRGSSSSSMKQIAVIFLGGSDDREALCLAKRAIKDCDCNLVVYHLVSSQNEVANWDLMLDDEVLKSVRGYYGTIENVSYEKVAIEEPSQTSAFVSDIANQHDFFIVGRRNGIKSPQTAALESWTEFSELGVIGDLLASSDTNTNASILVVQQQQMPKSL

SEQ ID NO: 122331 - protein, 1676 aa, Glycine max
  Coding DNA Sequence Number=SeqID_5553
  Gene Ontology: Mol. function=ATP-dependent helicase activity; Cellular component=intracellular; Biological process=SRP-dependent cotranslational protein targeting to membrane
  Homolog annotation: Hit_ID=Q1SDL2; Match level="QueryCoverage=98%, HitCoverage=93%, E-value=0.0, Identity=65%"; Hit description=Von Willebrand factor, type C; Zinc finger, RING-type; Zinc finger, C6HC- type; Zinc finger, ...
  Homolog annotation: Hit description=C2H2-type; ATP-dependent helicase HrpA
  Pfam annotation: Domain name=DEAD; Domain location=263-433; Score= -31.1; E_value=0.0024; Accession=PF00270.19; Description=DEADDEAH box helicase
  Pfam annotation: Domain name=DUF1605; Domain location=791-904; Score =64.1; E_value=4.6e-16; Accession=PF07717.6; Description=Domain of unknown function (DUF1605)
  Pfam annotation: Domain name=HA2; Domain location=659-755; Score =75.1; E_value=2.2e-19; Accession=PF04408.13; Description=Helicase associated domain (HA2)
  Pfam annotation: Domain name=Helicase_C; Domain location=506-599; Score=65.6; E_value=1.6e-16; Accession=PF00271.21; Description =Helicase conserved C-terminal domain
  Pfam annotation: Domain name=zf-C3HC4; Domain location=1523-1565; Score=29.1; E_value=1.6e-05; Accession=PF00097.15; Description=Zinc finger, C3HC4 type (RING finger)
  Pfam module annotation: Pfam domain module=DEAD::DUF1605::HA2::Helicas e_C::zf-C3HC4; Domain location=263-433::791-904::659-755::506 -599::1523-1565
VELRLGRCPLHRDDVEALIDECRSSHDSFTFYPTDDVAAVLNYRSWEQARDAVVWFWEARLAEKHDFTPALDSNVVVVKDDVDCRLRPVFARHVKGLMMMEEGKEVKFGMDECERLAKEISRLSSSLSKPLRIGTQNELMKKKKGLVDEKNLVERRLKEFESAMQCLLKYLEDGGDDVEGVKVFRFDGGFDWKRIHCLIKRECRRLEDGLPIYAYRRDILQEIHYQQWQLLGVWEIVGKCHRNCGHKDSKFLDIAWEIGSNVTAIAVAENLDVVAEIATQTGGIFCVFPGLAGISGGKSTQLVQFLADSGVGSDKSIVCTQPRKIAAKAVAQRVQQESSGCYEGQSIKYCSTFLSSREFDSRITFMTDHSLLQHYMSDNNLSGVSCIIIDEAHERSLNTDFLLTLLKSLLCRRVEMRLIIMSATADAKQLSDYFFGCGIFHVLGRSFPVDIKYVPSDCGGDSGSAVVASYVSDVVRMATEIHKTEKEGTILAFLTSQIEVEWACEKFQAASAVALPLHGKLSSDEQFRVFQNYPGKRKVIFSTNLAETSLTIPGVRYVIDSGVVKDSRFDPSSGMSVLKVCWISQSSADQRAGRAGRTEPGVCYRMYLEADYQSMDLNTEPEIRKVHLGVAVLRILALGVKDMQDFDFVDAPSPSSIDMAIRNLIQLGAIELNNNAHDLTSEGWCLVRMGIEPRLGKLILGCFKHGLGREGIILAAVMANASSIFCRVGSEFDKQRSDCLKVQFCHCDGDLFTLLSVYKEWEALPRERKNKWCWENSINAKSIRRCQDTILELETCLEREHDIVTPSYWLWDPCMPSNHDKNLKRVILSSLVENVAMYSGCNQLGYEVAQTGQHVQLHPSCSLLVFAEKPSWVVFGELLSISNQYLVCVCAFDFQSLFNLCPAPLFDVSKMEERKLLMKTLSGLGCILLKRFCGKANCDLLALVSRIRKACMDERIFIEVNVDKNEIHLYATSNEMDIALGLVNGVLEYERKLLRTECMDKFLYHGSGFSPPVALFGSGAEIKHLELEKRSLSVDVCHPNINEIDDRELLMFFEKNTSGCICAVHKFTGNMRDGDRDKWGRIIFMSPDVVRRAAELDGQEFCGSSLKIVPSQLGWDKTFSFPAVKARISWPRRLSRGFAIVKCDIKDVNYILRDFYNLAVGGRYVRCEIGKKSIDSVVINGLDKELSEAEIVDVLRTATSRRILDFFLVRGDAAGNPPCSALEEALLKEIYPFLPKRNPHIIPCRVQVFAPEPKDSFMRALITFDGRLHLEAAKALEQIEGKVLPGCLSWQKIKCQQLFHSSIIFPTPVYHVIKEQLDEVLASFRNLKGLECNLGRTVNGSHRVKITANATRTVAEVRRPLEELLRGKTIEHDSLTPVVFQLMLSRDGFSLKNSLQQETGTYILFDRHNLNLRVFGSPNKVALAQEKVIQSLLSLHEEKQLEIHLRGMDLPPDLMKQMIKNFGPDLRGLKERVPGVDLTLNTRRHIVILHGSKELKPRVEEIIFEIARSSHHLVERFENGPSCPICLCEVEDGYRLEGCGHLFCRLCLVEQFESAINNQGTFPVCCTHRDCGDPILLTDLRSLLFGDKLEDLFRASLGAFVATSGGAYRFCPSPDCPSIYRVADPESAEFKEDPDSSLKEWCRGKEQMGATTLSASCDFSAMQALHYVFKSSSIRL

SEQ ID NO: 122332 - protein, 812 aa, Glycine max
  Coding DNA Sequence Number=SeqID_5554
  Gene Ontology: Mol. function=solute:hydrogen antiporter activity; Cellular component=integral to membrane; Biological process =regulation of pH
  Homolog annotation: Hit_ID=Q1S3D8; Match level="QueryCoverage=99%, HitCoverage=98%, E-value=0.0, Identity=58%"; Hit description=WD-40 repeat
  Pfam annotation: Domain name=Na_H_Exchanger; Domain location=71-471; Score=71.5; E_value=2.7e-18; Accession=PF00999.11; Description =Sodiumhydrogen exchanger family
MGTNETLLSINRTIFINATFDNYNSDPDRKFIYYNVSIDMPSKIVSDGIWGNKNYGALLSRSTMPVLELQILTIFVITQCFHFVLRRLGFPYFVSQMMAGFVLGPSLKIEALAKFKVMLFPYGSEDVLNLVTGIGYLFFLFLNGVTMDFSMITKTGKKAWTIALSSLMIPTFIGLFVCYSFMGYLQQSLGEFDGGKLPVIVVGHSGVSFPVVASLLSDLEILNSELGRLALSSAFSMDVISEVMRGFGTAVVSSLKLDSHDKGEGKGPKLALITSINYVAFMTLTIVIARPAMRWVVRNTPEGRSVKKTHTSMVILMAILVGLFGVVANQTVLGGVLLVGLLVPEGPPLGSELVKQLEMFNTWFLVPIFVTCCAMKVDVSTPISSELVLVVVTIVVVVHLVKMLITVGICRYCNMPKTDGFCLALLLSCKGVVDFVNDVFLFDSFLMSNETISMMAISVLVLGSIARIGVKSLYDPARKYAGYQKRNILNLKPNSELRVVACIHKPSHINSVKNVLDICCPTTANPLVVHVLHLIELVGRSSPIFISHRLQERLSSGHNYSEDIIVTFDLFEHDNAGTASVSTYTAVSPLRFMHDDICYLALDKLASIILLPFHIRWGEDGGVESTDENMRTLNSKVLERAPCSVGILVNRSSSSSTHQSPLMKQIAMIFLGGADDREALCLARRTIKDYDCNLVVYHLVSSQSEANWNLMLDDEVLKSVKGYYGTIENVSYEKVSIEQPSETTAFVSDIANRHDFFIVGRRNGIKSPQTAALESWTEFSELGVIGDLLASSDTNTNASILVVQQQQMPKSS

SEQ ID NO: 122333 - protein, 358 aa, Glycine max
  Coding DNA Sequence Number=SeqID_5555
  Gene Ontology: Mol. function=sequence-specific DNA binding; Cellular component=nucleus; Biological process=regulation of transcription, DNA-dependent
  Homolog annotation: Hit_ID=Q1SDL0; Match level="QueryCoverage=87%, HitCoverage=100%, E-value=5e-91, Identity=61%"; Hit description =Leucine zipper, homeobox-associated; Homeodomain-related
  Pfam annotation: Domain name=HALZ; Domain location=159-203; Score =71.6; E_value=2.5e-18; Accession=PF02183.8; Description=Homeobox associated leucine zipper
  Pfam annotation: Domain name=Homeobox; Domain location=104-158; Score= 75.4; E_value=1.8e-19; Accession=PF00046.19; Description=Homeobox domain
  Pfam module annotation: Pfam domain module=HALZ::Homeobox; Domain location=159-203::104-158
  Subcellular localization annotation: CTP_CleavageSite=63; ConfidenceScore=5.30e-01
MGEEGEEVVRKQGQRGVDGDKWLTSSSSSSSSSSNNNKIPSFPLMKRLNSSDSSTALMTIFPSSSTEEHSPRNSHHMYGREFRSMLDGLDEEGCVEEPGHQSEKKRRLSVEQVKALEKNFEVENKLEPERKVKLAQELGLQPRQVAVWFQNRRARWKTKQLERDYGVLKANYDALKLNFGTLNQDNEALRKQIKELKSRLLQEENTAGSGVSVKEEEITTMPADSEEKTMEQSKSDPPSETSNINPSSESSEEDHLNYECFNNNSDDCVVGGSAAASLLQVDFMKDGSSDSDGSSAILNEDTMYLPSSMNCFQFQKPYHHAQYVKTEEHNFLSADEACNFFSDEQAPTLQWYCPEQWS

SEQ ID NO: 122334 - protein, 218 aa, Glycine max
  Coding DNA Sequence Number=SeqID_5556
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=2e-20, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=27; ConfidenceScore=5.07e-01
RTTRPHLQSVARPHPLRPHVLTFRGLHAFTFRGLHVHTFRGLHALTFRGLQALSLRGLQVLAFRGLHTLTFRGLQRTACPRLQRVARPPLHRTALPHLQRATRSHLQRNTRPHLQIATRSFLQRTTCPRLQRVAHPHLMRTARAHLQGLCALTFRGLQDLTLRGLHTLTFRGLHVLAFRGLHALTFRGLHVLTFRGLHTLTFRGLHILTFRVLHALTL

SEQ ID NO: 122335 - protein, 145 aa, Glycine max
  Coding DNA Sequence Number=SeqID_5557
MPYACDTRLDVPNQFVSRYERPTLLLDLLQKHVQGLKIWGVRYRQLDNGGCSFQEPMNRQTAFRSYPLGWCKPTDGHHAQKIKLPIIIQCTFKWYTVTRQLEKKSISMNLGSMIEREEKRLVYRVCCSSDENNEEEEMEEGIGVS

SEQ ID NO: 122336 - protein, 81 aa, Glycine max
  Coding DNA Sequence Number=SeqID_5558
MFGLHVWFRVGGTSAVLFCVMARSPDKIKSIDGSKETLKLSVRISDLWFIGTPNKSEQAEMVFVDSDGDEIHAACEQDQLK

SEQ ID NO: 122337 - protein, 127 aa, Glycine max
  Coding DNA Sequence Number=SeqID_5559
  Gene Ontology: Mol. function=sugar porter activity; Cellular component=integral to membrane; Biological process=carbohydrate transport
MQNPKTTTVLCDTEPEPVSILTFPAFFLILMAPTHSTSIDINGEDAPQFLTGFAENIGLENVRTATIVSAAIAAHTRSCLLQAWALEMQGKQVDAMVELSKICLLLRIFPPEESLFKIVIEGPIRPT

SEQ ID NO: 122338 - protein, 129 aa, Glycine max
  Coding DNA Sequence Number=SeqID_5560
  Gene Ontology: Mol. function=serine carboxypeptidase activity; Cellular component=cellulose and pectin-containing cell wall; Biological process=proteolysis
  Homolog annotation: Hit_ID=Q2R3G8; Match level="QueryCoverage=96%, HitCoverage=23%, E-value=1e-43, Identity=69%"; Hit description =Serine carboxypeptidase family protein, expressed
MQNLEIPTISILGALAKSGIRVLVYSGDQDSVIPLTGTRSLVNGLAKDFGLNTTVSYRAWFEGRQVKTEDLECIKILKKVAGWTQVYGDILSFATIRGAAHEAPFSQPERSLVLLKAFLEGKPLPEPFL

SEQ ID NO: 122339 - protein, 78 aa, Glycine max
  Coding DNA Sequence Number=SeqID_5561
VQIHECLYQLSLSQQSQGFAPFACPTLDQFRAELAWPGDWPEDQTEEAPAGAPDGAEDTRMDEEMTDLLGFMRGSGAT

SEQ ID NO: 122340 - protein, 53 aa, Glycine max
  Coding DNA Sequence Number=SeqID_5562
REATWKRLEELAAKKAASGEAVLIGKAPTRNSAAYTFVPKKHIWALPLLMNFQ

SEQ ID NO: 122341 - protein, 560 aa, Glycine max
  Coding DNA Sequence Number=SeqID_5563
  Gene Ontology: Mol. function=two-component response regulator activity; Cellular component=nucleus; Biological process=two -component signal transduction system (phosphorelay)
  Homolog annotation: Hit_ID=Q1T3X9; Match level="QueryCoverage=96%, HitCoverage=92%, E-value=0.0, Identity=72%"; Hit description =Response regulator, RegA/PrrA/ActR type
  Pfam annotation: Domain name=Myb_DNA-binding; Domain location=176 -226; Score=44.4; E_value=3.9e-10; Accession=PF00249.21; Description =Myb-like DNA-binding domain
  Pfam annotation: Domain name=Response_reg; Domain location=2-105; Score=42.4; E_value=1.5e-09; Accession=PF00072.14; Description =Response regulator receiver domain
  Pfam module annotation: Pfam domain module=Myb_DNA-binding::Response _reg; Domain location=176-226::2-105
MSQVMWSLHHATVIMNLVTTCCLARHALSLLRERKDGYDIVISDVNMPDMDGFKLLEHVGLEMDLPVIMMSVDGETSRVMKGVQHGACDYLLKPIRMKELRNIWQHVLRKRIHEAKEFESFESFESIHLMRNGSELSDDGNLFAVEDVTSTKKRKDADNKHDDKECLDPSSTKKARVVWSVDLHQKFVKAVNQIGFDKVGPKKILDLMNVPWLTRENVASHLQKYRLYLSRIQKENDQRSSSSGLKHSDFPLKDMRSFGFQNSVNNQQQNDVAIDSYNHSDGSLQLQNVETKSHEADPKGIVSQSTIAKKGRILTGNIADTNMRESLRVGLNQTFAPLESEENHAVFDCSMPTPYTWTEVPHMQLKEEHKSIVHLEDSFNQLPLHGKQQQHIQVDQSQSVASISSAPLITEEEVAACKEPKPLFADYKNDYANSVSSIGNAVGTFPIQPGSLIMNGQSSEPISTTNSGLKTQGYNNLSSISDLEIYQSNLLLGGEVASAPSLDEDLHFYWLQGECYNNMNFSLQNIGMSEYYDPGLISEAPTHLYDSADYSVIDQGLFIA

SEQ ID NO: 122342 - protein, 601 aa, Glycine max
  Coding DNA Sequence Number=SeqID_5564
  Homolog annotation: Hit_ID=Q1T3Y0; Match level="QueryCoverage=99%, HitCoverage=96%, E-value=1e-158, Identity=50%"; Hit description =Targeting for Xklp2
GNPILALGESISFGRFMTESLDWEKWSTFSHNRYVEEAEKYSKPGSVAAKKAYFEAHYKRKAAERAAAVIQEANAQANGTFEAQVHEGNCADSSSETSSNVENTVAANEQPDNETVNYQVVECADRDQHKCDARQSDLDISNVEGAEDVPRHHTATDLNVESCRFVDNSNSNQLYLVEDNTDIAVPAEEMTLDHVPVDQEVLALPVKGREVNSSPKLSTKTGVANHSRSFDERKAAVPPRSGINSGPMGKKSVGGLVEKKRLTAQSVHMSINLPSGTGETRKRTAAASQSRNGLNNFSTSKKSVGGLVEKKRITAPSLYMSINLPSGAGITSKTATVVTKPRNGINFAAKSLKSVGDSVEKGPTKRSLHMSINLPSGAGETSKTASVLEQNRIKKNHSNIPKNNPGALRTSTKVSHGLLNQASANPPSRDRSCLKSSSPTKSNPQSATISAPFRFRSEERAFLQRMDETKSKEEEKVKLQRTLKVNNFIITVLLGKTEHDHKKLQQSSGSISKLNEDKPGESQSPSNQTRKISLTLPRSPKLGRKASSSSSTVQDKSLGNSWKPPISTSKRTTEKNNRTTRQSVTLLSNNTRENASPNIQQ

SEQ ID NO: 122343 - protein, 341 aa, Glycine max
  Coding DNA Sequence Number=SeqID_5565
  Gene Ontology: Mol. function=structural molecule activity; Cellular component=flagellin-based flagellum; Biological process=ciliary or flagellar motility
  Homolog annotation: Hit_ID=Q1LLE7; Match level="QueryCoverage=95%, HitCoverage=51%, E-value=3e-73, Identity=47%"; Hit description =Flagellin-like protein precursor
  Pfam annotation: Domain name=Flagellin_N; Domain location=42-178; Score=178.5; E_value=1.6e-50; Accession=PF00669.10; Description =Bacterial flagellin N-terminus
MPITLSVYLSVSPEMISLQTNLSALNASKQSARSGAALGDAIRHLSSGMRITSARDDAAGQAIGNRFSSQQNGLAVAQRNTGDGLSLVETAESALDEINNRLQRIRQLAVQGLNSTNSQSDSDAIQAEINLNLKEIDRLNTSSSFTGIRLLDGSAGKLGFQVGANDNEKISLDLSAPGFSVEALGLKDLVISGISGKVTNVTTLTGIATNMAFSNPAITVNYLPASGSPQLVRSSGDNRQYVQSSDADGKPVYYLAAVSARWDTATAAGNVSISRSNPAPLYSNVSSIASRTIPAVNYQDSSGSALSTTPAATLTQDNGQYYIEQNNSWYRATLSFGNSGA

SEQ ID NO: 122344 - protein, 257 aa, Glycine max
  Coding DNA Sequence Number=SeqID_5566
  Gene Ontology: Mol. function=transferase activity; Cellular component= membrane; Biological process=teichoic acid biosynthetic process
  Homolog annotation: Hit_ID=Q8GPA4; Match level="QueryCoverage=59%, HitCoverage=58%, E-value=6e-15, Identity=30%"; Hit description=Eps7G
RSGGAPAAETAAIERDVFINEGAAQAVAVQPFVDVVHDKQQVFEIGDLFVEPQPVLTNDIAAKHLVADTVARVVIEQIVNRRRHRQRVRLFTVGGKIQRCAVRVEQPAARGANAPVACRRDARVGLADKVELRITGVALQDRQRVIAGAVINKNGLKANLILLQQAVDASFQISCGVIHRHNDANQHVVNGSLSGDLKGKNRRLPPLAYSDQRAGVLFGAFSGVKKGRCTPQSSVIYQPVSPNISCTATRTGTADRG

SEQ ID NO: 122345 - protein, 67 aa, Glycine max
  Coding DNA Sequence Number=SeqID_5567
  Gene Ontology: Mol. function=two-component response regulator activity; Biological process=two-component signal transduction system (phosphorelay)
  Homolog annotation: Hit_ID=Q1T3X9; Match level="QueryCoverage=98%, HitCoverage=11%, E-value=3e-19, Identity=70%"; Hit description =Response regulator, RegA/PrrA/ActR type
MDNGCFSSPRRDFPAGLRVLVVDDDPTWLKILEKMLKKCNYEGCGHICHGSVSKECASFFRENKSFY

SEQ ID NO: 122346 - protein, 116 aa, Glycine max
  Coding DNA Sequence Number=SeqID_5568
  Gene Ontology: Mol. function=ATPase activity, coupled to transmembrane movement of substances; Cellular component=integral to membrane; Biological process=transport
  Homolog annotation: Hit_ID=Q7FMW3; Match level="QueryCoverage=86%, HitCoverage=59%, E-value=1e-26, Identity=42%"; Hit description=MDR -like ABC transporter
MKECSWLDMLGRLVIPFIKGWLLTLVLLCCIPPLVISGSMMSFTFAKLPSHGQAAYSEAATVVERTIDSIQQVASFTGESQAIAQYNQSLTKAYRTAVQDGVVAGLGLGSILNQSL

SEQ ID NO: 122347 - protein, 51 aa, Glycine max
  Coding DNA Sequence Number=SeqID_5569
RKFSSTVLRKGIDSPIPTEENRPFDRETRKLRSLGLIKPLNIVNKLLANPL

SEQ ID NO: 122348 - protein, 675 aa, Glycine max
  Coding DNA Sequence Number=SeqID_5570
  Gene Ontology: Mol. function=RNA-directed DNA polymerase activity; Cellular component=nucleus; Biological process=RNA-dependent DNA replication
MVRLWNKLKRLQQDMRRFSKPLSNLKQNLIKAKEDLQFAQENLRNNNMNGDSIDRVRQLTEEVINLNDLEEKMLMQRAKVDWIRKGDGNNSFFHAIIKSRNNRRNIYMLQKTDGTLLENQSEIEDEIMDFYKKLMGTEDSQLHHIDIDAMRNGKQVNMEQRRYLVSNITEQDIERALKGIGDDKSPGIDGFGAKFFKASWCIVKEDVIAAILEFFNTGRLYRGFNNTVVTLIPKGDNARYVKDYRPIAGCTTVYKIIAKIITERLGKILPSIISHSQAAFVPGQNIHNHILLAYELLNGYGRKGGTPRVMMQLDLHKAYDMVNWRAMECILKEIGLPMQFVSWIMTGVSTVSYRFNVNGTYYDIMQAKRGIRQGDPMSPMLFVIIMEYLHRTLVKMQQNPDFNHHSKWLKVNPAKCQMFFGGMDGCSKENLRRITDFAEGKLPVRYLGVPLSCKRLTIQQYMPLIDKIVDRVKHWTSKLLSYAGRIQLVKSITSAIAINSENLWVLWVHTYYLKGNDAITAFVRPNSSWILKNIMKQRHKLGQIQQHWDQALSRQKFPMSAMYHGLTEEHQRVSWSGTREIWGNILDWLGRRHDPREWDMELAWIIENTKGKGWKSALLKMATAETVYNVWHYRNSMCFGTAVDKQVIERNIIDNIVYRSWQYPTLRSHVAKLMM

SEQ ID NO: 122349 - protein, 164 aa, Glycine max
  Coding DNA Sequence Number=SeqID_5571
  Gene Ontology: Mol. function=carbon-sulfur lyase activity; Cellular component=nucleus; Biological process=metabolic process
  Homolog annotation: Hit_ID=Q6ERD5; Match level="QueryCoverage=67%, HitCoverage=83%, E-value=2e-39, Identity=57%"; Hit description =Putative nuclear protein p30
  Pfam annotation: Domain name=DUF636; Domain location=30-125; Score =72.5; E_value=1.3e-18; Accession=PF04828.4; Description=Protein of unknown function (DUF636)
MDVEKVVHTGGCHCKSVRWKVVAPSSVVAWDCNCSTCYMRANTHFIVPANNFELLGDSEKFLTTYTFGTHTAKHTFCKICGITSFYCPRSNPDGVAVTFRYFDGKNWDSAYTQTALSGKLTSQEMAELESFALAYAIRGVRYMEGMLLYYFLLGKLHNEVHRSY

SEQ ID NO: 122350 - protein, 123 aa, Glycine max
  Coding DNA Sequence Number=SeqID_5572
  Gene Ontology: Mol. function=sodium:hydrogen antiporter activity; Cellular component=integral to membrane; Biological process=sodium ion transport
  Homolog annotation: Hit_ID=Q8ZPF4; Match level="QueryCoverage=83%, HitCoverage=21%, E-value=5e-46, Identity=86%"; Hit description =Putative Na+/H+ antiporter
VGQLIAATVATTILVTGATSDGKLALLVPAELFKDAYRRMGLDNKNLSRTIEDAGTVIEPLLPWTSAGVYMATTLGVSTLDLLPWAVQCYAAIFFALFYGFTGIGIARTAAPTEQAQKRAVAE

SEQ ID NO: 122351 - protein, 194 aa, Glycine max
  Coding DNA Sequence Number=SeqID_5573
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=4e-18, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=10; ConfidenceScore=5.26e-01
VRKCCPLKVRARNALKVRARSPLKVMACNPLKAMTCNPLKVRACSTLNVRTCCPLKVRSCSPLKVRLRSPLKVRTCGPQRVRACNTLKVRMCNPMKVRACNPLKARTCSSLKVWASNPLKARTCSPLKERACSQLKVRTCRPLKVSARSPLKMRTCNPFKGRGCNPLKARTCSPLKVRVRSPLKVRTCSPLKVR

SEQ ID NO: 122352 - protein, 351 aa, Glycine max
  Coding DNA Sequence Number=SeqID_5574
  Gene Ontology: Mol. function=RNA-directed DNA polymerase activity; Cellular component=intracellular; Biological process=RNA-dependent DNA replication
MWFIPISMLIALSGKCQSSIICRLGIYEPVEHNNPALSPNFESPVYEAEEEEDDEIPEELARLLEYEKKTIRPHEEVVEVINLGTEEDKKEVKIGASLEATVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGYNQIKMAVEDREKTSFITPWGTFCYRVMPFGLINAGATYQRGMTTLFHDMMHKEIEVYVDDMIVKSGTEEEHVEYLLKMFQRLRKYQLRLNPNKCTFGVRSGKLLGFIVSQK

SEQ ID NO: 122353 - protein, 83 aa, Glycine max
  Coding DNA Sequence Number=SeqID_5575
  Gene Ontology: Mol. function=protein binding
MEVHSVLEASYLVYEGLNHSNQVNPWPCTAIRHDESLFEGSASPCLKLRSAFLSFSLQVILSLAALLALKWRVVAVDNIKRRT

SEQ ID NO: 122354 - protein, 276 aa, Glycine max
  Coding DNA Sequence Number=SeqID_5576
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=5e-39, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TSAPRATRLTIRGLHALTFRGLHVLTLRGLHVLTFRGLHVLAFRGLHVLAFRGLHILAFRGLHVLTVGGLHTLTFSGHTLAFRGLHVLAIRGLDVLAFRGLHVLTFRGLHALTFRGLHAIAIVGLHALTFRELHVLTVGGLHALTFSGLHALAIRGLHVLAIRGLHILAFRGLHVLTFRGLHTFAFVGLHVLTFRGLHALTFRGIHVFTFKGLHTLIFKGLYVLPLRGLHVLAFGGLHALTFKGLHVPLFRGLHALAFGGRHVLAFGGLHTVASLN

SEQ ID NO: 122355 - protein, 105 aa, Glycine max
  Coding DNA Sequence Number=SeqID_5577
  Subcellular localization annotation: CTP_CleavageSite=64; ConfidenceScore=5.01e-01
MPEISFLMVVVLEAGKIFSKNTLLRSSQLVMDLGARMFKITNHRMHRLTNNRMLRMLKRSAKVVAKSVAKHYSQQNTKTETGKVLNKKTKAKHHTKQNNKTLNNT

SEQ ID NO: 122356 - protein, 162 aa, Glycine max
  Coding DNA Sequence Number=SeqID_5578
REFAKCNLQWLSARKNLEEDELSSSLSAPLQVIKRTASYHPLSETSVLSQNPLMRAKLSRSVLSARARTKATYLSLKSDLQREYGTFLEKLWMHEVSFKTRKGKQGSKGLSKELIQGKSIWLEAYKNKIASIISKYACELGRINKNQAKAIVQAINGAKHTK

SEQ ID NO: 122357 - protein, 111 aa, Glycine max
  Coding DNA Sequence Number=SeqID_5579
MGPKFTDCIIYGDNDGHQKDDLAAKYGIDAATWEEFAKSRQTPNWQDILNTTIGRLEHPGRVRVAGTGVTISQYYGQASHGSNSSSISISQQQLAQIVLPYQSVNNNWLKS

SEQ ID NO: 122358 - protein, 222 aa, Glycine max
  Coding DNA Sequence Number=SeqID_5580
  Homolog annotation: Hit_ID=Q1STZ2; Match level="QueryCoverage=94%, HitCoverage=47%, E-value=4e-11, Identity=27%"; Hit description=IMP dehydrogenase/GMP reductase
WDQHLAGIGGRTINWFPRWKEGKEGVLFSCGDYPNIPLIGTRGCINNNPALAIRQLGYPMRGAPIEESLSPFLVRDFGTQSFKIIQRVHKAWESPLRKDKELRGIHNGIIGGYHEWLKVHTRGLDWLSKLKIINEENFEALEEDEEVRALKTELGKAILAKEKFKLVATDVRKECAELREENAATARALEQETKRARRDKFRGALWGSNSELKLRREERDQS

SEQ ID NO: 122359 - protein, 438 aa, Glycine max
  Coding DNA Sequence Number=SeqID_5581
  Gene Ontology: Mol. function=nucleoside-triphosphatase activity; Cellular component=membrane; Biological process=heme transport
  Homolog annotation: Hit_ID=Q56993; Match level="QueryCoverage=45%, HitCoverage=89%, E-value=2e-66, Identity=62%"; Hit description=Hemin transport system ATP-binding protein hmuV
  Pfam annotation: Domain name=ABC_tran; Domain location=179-328; Score= 1.2; E_value=1.3e-07; Accession=PF00005.17; Description=ABC transporter
RSTAAPVLAVDDGQPQPVAVADPGGFRLADPACGAADAAAGAPTEPVAVGGRRGPLPRGERPARQAAAAVVERLADRRGGSDERRDRLCRPGGAASGAHAPRRRSPLAAALLRAGRRLPAAGQRYAGAHAGGAGRNAGGADDQPDRRSLFLVAGDAPAGASRLGTRRLINDVSLSLAGGEMVAIIGPNGAGKSTLLRLLTGYLTPNCGECRLLDRPLEHWAPQQLAKVRAVMRQYSDLAFPFSVEEVVSMGRSPHGKRDEHQAIQQVMAQTDCLALAQRDYRQLSGAVATAAVPRLAVPRRTDLGAGSVSPAAHPAPAALADAPTAAGRAVGGERHAAGSVANGDPHPLVSGRSRRGASSRSVAAAGACPSPAAARRDRHTPAHRRTAAAEPDAIAANGPRRLSPRPQSPAAPDSCAGSAADSPPSSPVAAPHRSPAP

SEQ ID NO: 122360 - protein, 345 aa, Glycine max
  Coding DNA Sequence Number=SeqID_5582
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=1e-18, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAFKGLHVLAIRGLHILAFRGLQVLAFRGLHALAFRGLHAHTFIGLHALNFKGLHVLALRTTCPHLQTPACPHTQRATRPRLQRTTRTRLEDYTSSPLEGCTPSPSEDYKSSPSEDCTSSPSEDYTSSPSEDYTAARPHLQRASRPRHQKTTRPRLYRTTRPRLHKTTRLPLQSDTRPRLHRTHVLTFRGLHALALRGLQVLAFRGLHVLAIRGLHAQTFIGLHVLALRNTRPHLQRATRPHHQRTKRPRLQRATHPRLQRTTRLHALTFRGLHVLILKGLHALTFRGQNVLTFRGLHALTIRGLHVLAFTLLRVLSIRGLHALAFRGLDILAFRGLDVLA

SEQ ID NO: 122361 - protein, 94 aa, Glycine max
  Coding DNA Sequence Number=SeqID_5583
MGLSRTPNVSIYYGTQSDIQGLIGHPSKKLYSFEFARCRNVPFCGRAKARLTGALSKGGKMRGVATNVYLWKTSEKPKKTGQNENSKFGSCIYA

SEQ ID NO: 122362 - protein, 494 aa, Glycine max
  Coding DNA Sequence Number=SeqID_5584
  Gene Ontology: Mol. function=protein binding
  Homolog annotation: Hit_ID=Q10GD4; Match level="QueryCoverage=92%, HitCoverage=93%, E-value=2e-86, Identity=37%"; Hit description =Leucine Rich Repeat family protein, expressed
  Pfam annotation: Domain name=F-box; Domain location=107-154; Score =24.5; E_value=0.00037; Accession=PF00646.23; Description=F-box domain
  Subcellular localization annotation: CTP_CleavageSite=52; ConfidenceScore=5.58e-01
ASDAAKRGKKRGSYNCGRCGLPKKGHNCTVKTPASTAAATPDSSLSIVSLPSSSAVPSLRQSPSNLGRALSFDDFDEPALVVDRYEPDEKVDSDVFDETNPDLDLDADAGGLPASLMWEVMRRLPPPGLLSAAKVCKGWRDTTKRLWRAVEELKIRVPANVPVRFVASMLQKCPGIVRLSLRMESDFDSTMLACIAFSCPNLECMKILTFDAAIIRINGSCPRLQNIHIASIRLSHSAVLALTAAQLRGLRMLSLVLGSEITDASVAAIASSYPNLELLDLSGSGVSDSGISMICNVFPDTLTRLLLALCPNVTSSGIQFATFQLPHLEIMDCGMTICDPNTENPTADENNCNLQKTSGVNVHLINQKLIIKHSRLKKLSLWGCTGLDALYLNCPRLIDLNLNSCSNLHPGRLLLQCPNLENVHASGCQDMLIGAIQSQVHDASAEMENHSQSKRLPDGSKRIRVPHLLSEEEFPEPEKKRRKIERQLCNVLLD

SEQ ID NO: 122363 - protein, 149 aa, Glycine max
  Coding DNA Sequence Number=SeqID_5585
MLQSGLIYQVLAQTIQAHKYLTSCHLSIFADGTKDETTIWKLPPNGPPDSYTGAYGGIIHDLKGKILSYFSKRLGYCSVILAKLWSLKYGIQSALSKMDVLEVVQMVEGIKNAPQSLRPLILDIRRMLLAHGRLYSLVHIKREANFAAD

SEQ ID NO: 122364 - protein, 103 aa, Glycine max
  Coding DNA Sequence Number=SeqID_5586
  Homolog annotation: Hit_ID=Q6CQF2; Match level="QueryCoverage=37%, HitCoverage=48%, E-value=1e-09, Identity=74%"; Hit description =Kluyveromyces lactis strain NRRL Y-1140 chromosome D of strain NRRL Y- 1140 of Kluyveromyces lactis
MVAQARAVDMLVETSSSRLWMAARALGVPRHLRAPGVGLWAPHSARLETRTKESDMCASQRASKPHTCRDPKDGELCLSGAKPEETLVEARSDTDVQIVRLTW

SEQ ID NO: 122365 - protein, 36 aa, Glycine max
  Coding DNA Sequence Number=SeqID_5587
MGGGNESSSLSRVFGSVYVRLGSTWFVYHKGQTQAF

SEQ ID NO: 122366 - protein, 130 aa, Glycine max
  Coding DNA Sequence Number=SeqID_5588
MKLPENAQQLPLADMDKSSEQAAATEPQSRRRRSNSAWEEEEEEATSSFVNPNFFGEEEATLRQNRGGACHPARPGEQGCFLQKQLPSGGRNWKAQLSKKLRKLTDCAKTPPFDFRHITEFHGSRKPASF

SEQ ID NO: 122367 - protein, 251 aa, Glycine max
  Coding DNA Sequence Number=SeqID_5589
  Gene Ontology: Mol. function=CDP-diacylglycerol diphosphatase activity; Cellular component=membrane; Biological process =phospholipid biosynthetic process
  Homolog annotation: Hit_ID=Q1A4U8; Match level="QueryCoverage=88%, HitCoverage=89%, E-value=7e-74, Identity=56%"; Hit description =Putative CDP-diacylglycerol pyrophosphatase
  Pfam annotation: Domain name=CDH; Domain location=1-250; Score=241.4; E_value=1.9e-69; Accession=PF02611.6; Description=CDP-diacylglycerol pyrophosphatase
MKRLFRLLIILLVILLLAAVLWWFFGRGNPNALWQIVSQQCVPNQQQNNDPAPCLKVDLTQGYVLFKDSKGPYHDLVMPTEKVSGIESPALQTEHAPPYFAQAWNNREHISGELGKPLKDAWLSLAVNSKYGRSQDQLHIHVACLRQDIYNALGQQAEQLDQQWRPLAVKLVGHQYLARKLAGTDLTQEDPFRLLHNYVVEQGDSIGNYGLALAVSPQGEMLLLANRLKLTDLNLGSAGEIQDYHCAVAGN

SEQ ID NO: 122368 - protein, 205 aa, Glycine max
  Coding DNA Sequence Number=SeqID_5590
  Gene Ontology: Mol. function=hydrolase activity; Cellular component =integral to membrane; Biological process=aromatic compound metabolic process
  Homolog annotation: Hit_ID=Q1BIQ3; Match level="QueryCoverage=98%, HitCoverage=74%, E-value=1e-56, Identity=55%"; Hit description =Alpha/beta hydrolase fold
MGKSLHYLDVGSGFPLLLGHSYLFDLNMWAPQFEALAKRYRLIVPDLWGHGDSPALPAGRNSLSDIAADHLALMNRLDIEEFGIVGLSVGGMWGAELAALAPERVKVLALMDSYLGDETPEARQRYMGMLAAVEQAGAITSPLLEYIAAQFYSDEVPDALSQPLLAHLQSLPAARLRESIVPLGRMIFGRPDKLALLENITAASI

SEQ ID NO: 122369 - protein, 98 aa, Glycine max
  Coding DNA Sequence Number=SeqID_5591
  Homolog annotation: Hit_ID=Q870E2; Match level="QueryCoverage=45%, HitCoverage=5%, E-value=4e-07, Identity=57%"; Hit description =Transposase
MRSDTNIGVQGRASFLLIACEKSGEYRPKKNDLVRTCTGSRKCGCPFKLRANTYKTNRYKLSLLDIVGVTPTGMTFSVAFAYLEGEYLNNVVWALQQF

SEQ ID NO: 122370 - protein, 112 aa, Glycine max
  Coding DNA Sequence Number=SeqID_5592
  Subcellular localization annotation: CTP_CleavageSite=21; ConfidenceScore=5.03e-01
MARKPRQDFSVSKVRFFLTFVTEYGSQSKRETPQNFRTALSLPLPHVAFLLLHSPLKPQQSSNLWCSFLLQIAKEGHFRGREVRGYEWDFENPGLGGLLSLLNFVGMGFWEI

SEQ ID NO: 122371 - protein, 136 aa, Glycine max
  Coding DNA Sequence Number=SeqID_5593
MSHHSSSVNGEGTSHKDPLSRILDELSSLKLCKEKIERKGKGKGKERTSLPEEKKKERKPQEANINLSYFHGKDNVEAYLDWEIRVEQQLKRKFTSKSYGSHSYPKKDQGQGILGATPSKPKDDKGKTIEKQPPKA

SEQ ID NO: 122372 - protein, 380 aa, Glycine max
  Coding DNA Sequence Number=SeqID_5594
  Gene Ontology: Mol. function=transferase activity, transferring hexosyl groups; Cellular component=integral to membrane; Biological process=carbohydrate biosynthetic process
  Homolog annotation: Hit_ID=Q2R1U9; Match level="QueryCoverage=91%, HitCoverage=64%, E-value=5e-98, Identity=49%"; Hit description =Glycosyl transferase family 8 protein, expressed
  Pfam annotation: Domain name=Glyco_transf_8; Domain location=57-345; Score=244.2; E_value=2.8e-70; Accession=PF01501.10; Description =Glycosyl transferase family 8
MEASLSKVYRAFPDCSAVGAKLHTMLRQAEEQVRSQRHQATYLVHLAARTAPKGLHCLSMRLTAEYFALRPEERKLPNENKIYHPDLYHYAVFSDNVLACAAVVNSTISTAKEQEKLVFHVLTKSLNLPAISMWFLINPPAKATVHILSIDNFEWSSKYNTYQENNSSYPRFTSELNYLHFYLPDIFPALNKIVLLDHDVVVQQDLSELWNINMKGNVIGAVGTCQEGKIPFYRIDMFINLSDPLIGKRFDANACTWAFGMNLFDLQQWRRHNLTAVYQNYVQMGLWNIGSLPLGWLTFYNKTELLDRQWHVLGLGYSSDVDRNEIEQASVIHYDGLRKPWLDIAMGRYKMQSPGIVQNSKFPLPDMTGILLSTSLMAHS

SEQ ID NO: 122373 - protein, 184 aa, Glycine max
  Coding DNA Sequence Number=SeqID_5595
  Gene Ontology: Mol. function=receptor activity
  Homolog annotation: Hit_ID=Q2KK36; Match level="QueryCoverage=76%, HitCoverage=79%, E-value=2e-19, Identity=35%"; Hit description =Prenylated rab acceptor family protein
  Pfam annotation: Domain name=PRA1; Domain location=15-166; Score =180.1; E_value=5.6e-51; Accession=PF03208.9; Description=PRA1 family protein
  Subcellular localization annotation: CTP_CleavageSite=13; ConfidenceScore=5.15e-01
MSFINPSPSSTSRAIAPSGFATRRPWEEFFALHSFTRPYTLGEASLRVKRNLGHFRVNYAMAVLLVVFLSLLWHPISLIVFLAVFTAWFFLYFFRDGPVVVLRHELDDRLVLAALTAVTVAALVLTGVWLNVVVALLVAAAAVAVHAALRSTDDLYVEELEVSDGGLVSVVGGSPTKRTGSTRI

SEQ ID NO: 122374 - protein, 365 aa, Glycine max
  Coding DNA Sequence Number=SeqID_5596
  Gene Ontology: Mol. function=metal ion binding; Cellular component =integral to membrane
  Homolog annotation: Hit_ID=Q2KK36; Match level="QueryCoverage=38%, HitCoverage=79%, E-value=5e-19, Identity=35%"; Hit description =Prenylated rab acceptor family protein
MTGRRTKPARKASGLQGSSFSIEKLIKKEEELLEDHQDNSCSPDTSNKSAKNGGQNGAEPHEAKWDLWKTLNYLAEAASRSKPFKSNVQASDAKLESMKVTDSDAKVLKAKIKEKKRKAKVEDEKIITDHVSSDTAKPNKLRRVRPRKEPVFGESRISPQAVLDATDRNLLWNDSIWFSLAASENQEGDAPLPQIPSNYVRIKATTNNRNQTSIGNFQFLHVQIVGAPKRRMHSHRRRCDEQRHHHVEPDAGEDEGRNGDGGERREDEAVVELVAEHDDGAVAEEVEEEPRGEDGEEHDEGDRVPEEAEEHDEEHGHGVVHAEVAEVALHAERGLAEGVGARERVEREELLPWPARGEAGGSDCT

SEQ ID NO: 122375 - protein, 560 aa, Glycine max
  Coding DNA Sequence Number=SeqID_5597
  Gene Ontology: Mol. function=ATP-dependent helicase activity; Cellular component=nucleus; Biological process=mRNA catabolic process, nonsense-mediated decay
  Homolog annotation: Hit_ID=Q9C718; Match level="QueryCoverage=77%, HitCoverage=93%, E-value=0.0, Identity=75%"; Hit description=DEAD -box ATP-dependent RNA helicase 20
  Pfam annotation: Domain name=DEAD; Domain location=142-313; Score =246.6; E_value=5.1e-71; Accession=PF00270.19; Description=DEADDEAH box helicase
  Pfam annotation: Domain name=Helicase_C; Domain location=347-423; Score=128.6; E_value=1.7e-35; Accession=PF00271.21; Description =Helicase conserved C-terminal domain
  Pfam annotation: Domain name=ResIII; Domain location=138-308; Score= -29.6; E_value=0.014; Accession=PF04851.6; Description=Type III restriction enzyme, res subunit
  Pfam module annotation: Pfam domain module=DEAD::Helicase_C::ResIII; Domain location=142-313::347-423::138-308
VNSTLSREVEWSNPRLLQDSNVGVIFNSCHCSQSSCDSGLGAPTGFGGSVQHSSSNRRDYDDGGSPKRNLSLDGLPHFEKNFYVESPAVRAMTDAEVNEYRQQREITVEGRDIPKPVKSFHDAGFPEYVMEEITKAGFTEPTPIQSQGWPMALKGRDLIGIAETGSGKTLAYLLPSIVHVNAQPILNPGDGPIVLVLAPTRELAVQIQQEATKFGASSRIKSTCIYGGVPKGPQVRDLQKGVEIVIATPGRLIDMLESNHTNLQRVTYLVLDEADRMLDMGFDPQLRKIVSQIRPDRQTLYWSATWPKEVEQLARKFLYNPYKDIMDGSRILIFMDTKKGCDQITRQLRMDGWPALSIHGDKSQAERDWVLSEFKSGKSPIMTATDVAARGLDVKDVKYVINYDFPGSLEDYVHRIGRTGRAGAKGTAYTYFTAANARFAKELIAILEEAGQKVSPELAAMGRGAPPPPSGSERQEKKRMSEEGPPKLYTDKPRKVCGFGNSAIEAVSGATEIKRVLLAGGDGDTRRYSAATSATAKGTLYSALQIRLAYAFGCESWCRR

SEQ ID NO: 122376 - protein, 423 aa, Glycine max
  Coding DNA Sequence Number=SeqID_5598
  Gene Ontology: Mol. function=oxidoreductase activity, acting on paired donors, with incorporation or reduction of molecular oxygen, NADH or NADPH as one donor, and incorporation of one atom of oxygen; Cellular component=...
  Gene Ontology: Cellular component=membrane; Biological process =brassinosteroid biosynthetic process
  Homolog annotation: Hit_ID=Q94IA6; Match level="QueryCoverage=94%, HitCoverage=95%, E-value=1e-130, Identity=53%"; Hit description =CYP90D
  Pfam annotation: Domain name=p450; Domain location=37-420; Score =25.8; E_value=3.8e-12; Accession=PF00067.12; Description=Cytochrome P450
MDNIWIVFVTVFLLCTVILYRNRLSLMLKSKRKNKLPLGTLGWPFIGETVEFVSCAYSDRPESFMDKRRRMYGKVFKSHIFGSPTIVSTDADVNKFILQSDAKVFVPSYPKSLTELMGESSILLINGSLQRRIHGLIGAFFKSQQLKAQITRDMQKYAQESMASWREDCPIYIQDETKKAKKTMVKLVKRIILAKRNSGICKVPEDVVDVLLSDVSEKLTDDLIADNIIDMMIPGEDSVPLLMTLATKYLSECPAALQQLTEENMKLKKLQDQDGESLSWTDYLSLPFTQTVISETLRMGNIIIGVMRKALKDVEIKGHLIPKGWCVFANFRSVHLDDKNYECPYQFNPWRWQDKDMSSCNFTPFGGGQRLCPGLDLARLEASIFLHHFVTQFRWHAEEDTIVNFPTVRMKKRMPVMVRRVES

SEQ ID NO: 122377 - protein, 83 aa, Glycine max
  Coding DNA Sequence Number=SeqID_5599
MALLLDMSTLKAANADAVFEDLIWWHLTGDWEEDNDLEGSLYLHGETKSLAIIFLVEASFMMMNQVDSSSFDDDKDDDKKPKE

SEQ ID NO: 122378 - protein, 426 aa, Glycine max
  Coding DNA Sequence Number=SeqID_5600
  Homolog annotation: Hit_ID=Q1SRP4; Match level="QueryCoverage=40%, HitCoverage=42%, E-value=1e-29, Identity=42%"; Hit description =Integrase, catalytic region
MKFGSAFMSIFTNKLSPQQGNFALNFEQRLLRICAIADSLASVGSPIMLQEHIDSILEGPSLNYHPPLLKASFNHRGHTPPYQKSLRHTENCLTATKIAPLPITVTEKEFFKGGGDHCSPMPLFIQTHKALGFAKRVRAMIATQTLEHTCDLSPDYQPINQVEVPLLAHESRLNKFKKSLSDSPSINLTQVPNKQDPENFSNFKVGLAVEEVTMVVLTATTIVMVASVLVLAVVAMAAEDKCYVDQCYFSANNNWIPDSDALFHVIGESQNIQFEPFEGPGQIFIGNNQGLPISTSGSSSFISPYNTKVSLSLQHLLHVPNITKNLISVSQFAKDKVLLQGNVGPDGPYSFSNIKFQHPWSASSALACISTAEKSSLTSCNKSEKSIVNSCTRTSSLWHDRLGHPNSHVLQLVLQHRKIPTSNKNS

SEQ ID NO: 122379 - protein, 74 aa, Glycine max
  Coding DNA Sequence Number=SeqID_5601
MEACEDQNAILPEVSNNFSNDESPSDSSDLPKETKDHLPPLPNIDKVEAILKYEFKNKCLLEEVFTYTSYPNDK

SEQ ID NO: 122380 - protein, 240 aa, Glycine max
  Coding DNA Sequence Number=SeqID_5602
  Gene Ontology: Mol. function=electron carrier activity; Cellular component=cytoskeleton; Biological process=electron transport
  Homolog annotation: Hit_ID=UPI00006A17C9; Match level="QueryCoverage =50%, HitCoverage=100%, E-value=6e-16, Identity=33%"; Hit description= UPI00006A17C9 related cluster
LHALAVRGLHVLTFRGLHVLAFKGLHVLTFRGLHVLTFRGLHALAFGGLHVLTFRGLHALTFRGLRILTFRGLHALGFRGVHVLTFRGLHVLAFRGLHFLHFRGLHVLTFRGLHSLAFSELHIRTLREFKGPVLSFYQFLGHPLIPPARSRHHDIEIAPARHPVDPEKFNRVLGFPALITGLCQFYRVPVAPNKVIRPLLTGLSSRSTAPLSRRRARHHSSWQQEHHRHLQSPSAHPQKG

SEQ ID NO: 122381 - protein, 255 aa, Glycine max
  Coding DNA Sequence Number=SeqID_5603
  Gene Ontology: Mol. function=protein binding; Cellular component =cytoplasm
  Homolog annotation: Hit_ID=Q9FI69; Match level="QueryCoverage=81%, HitCoverage=63%, E-value=1e-42, Identity=49%"; Hit description =Arabidopsis thaliana genomic DNA, chromosome 5, TAC clone:K19E20
  Pfam annotation: Domain name=Sld5; Domain location=17-250; Score =66.9; E_value=6.5e-17; Accession=PF05916.2; Description=Synthetic lethal mutants of dpb11-1 five
MASNSAAEGVSMGDDYEALIATTDAELLKRAWRNEKAAPEILRYESDLVSRVKKVIQFLEETVEEKSSGGTNPLSVSLYQMDLDRTLFLLRSYLRIRIQKFKTLENDRRGRGEPKFLDVATEIVAANRFLKPWEGIRGKRIELIEKFVFHIQKTEELWNRLSKDEKDFAKACENDLKQHLDESVLLKLPKDYKSVLRQSSMSEEDDMVPEPQLDTFVLCRSKEYLTGIQLEDGPVDDRQILLYLDELILLCLEKG

SEQ ID NO: 122382 - protein, 175 aa, Glycine max
  Coding DNA Sequence Number=SeqID_5604
  Gene Ontology: Mol. function=receptor activity
  Homolog annotation: Hit_ID=Q2KK36; Match level="QueryCoverage=91%, HitCoverage=89%, E-value=1e-29, Identity=45%"; Hit description =Prenylated rab acceptor family protein
HDNNLWHDPNLAASEPGVHLTREAADQGRAGDAAAVEGDVQLQIAEGPWRRRAGGTIADSDQRVVFPHELRNGDAADSVSEPLVAPDLPDRVPRPHGGVAVPLLPPRRAACGAGPPRGRPPRAARHGAAHGGAAASHRRHREHSRGGGGRGGGGGGARSVQEDGGFVLGRRGRSC

SEQ ID NO: 122383 - protein, 72 aa, Glycine max
  Coding DNA Sequence Number=SeqID_5605
MSEGFKKKKNFNIVCSNKIREGWNYLQLTRLDKGGEVWGWIGCGMSWGDMVRARCNQPRVLRVVQCEGRMWG

SEQ ID NO: 122384 - protein, 133 aa, Glycine max
  Coding DNA Sequence Number=SeqID_5606
MLGVSTSLLIHHREATWSCWSYLKGKDQLSALFPNPDNHHPWVVREFSSRIHLCGQIINIILAIVFHKVSYVVTKILANNLRHEPYRDIVHLNTIRDHKERNQCRIFLSFIAPSIRMSLSKLHGPPSRTQLWS

SEQ ID NO: 122385 - protein, 72 aa, Glycine max
  Coding DNA Sequence Number=SeqID_5607
MSKGLSIRQVVQNLQPCESGSSEKMSMYGRNDLLDNKTMEKEQSQNMQQLDKVVLPCPLDETQQSWLLGSDE

SEQ ID NO: 122386 - protein, 59 aa, Glycine max
  Coding DNA Sequence Number=SeqID_5608
MLSSGFDDTPQSKSKATATWIVVKCNRQKGSAACGYYVMHRMSTIILGSFKNNWKTIIA

SEQ ID NO: 122387 - protein, 124 aa, Glycine max
  Coding DNA Sequence Number=SeqID_5609
  Gene Ontology: Mol. function=ATPase activity; Cellular component =integral to membrane; Biological process=transport
  Homolog annotation: Hit_ID=Q84U31; Match level="QueryCoverage=97%, HitCoverage=69%, E-value=9e-33, Identity=64%"; Hit description =Multidrug resistance-associated protein-like protein
MCLLNEAISGLPYLLDSSVSNEGENWSMGQCQLFCLGRFLLKRNRILVVDSIDSATDAILQRVLRHEFSECTVINVAHRVPTVIDSDMVNCWSMMNHQNLWRPNLLHCPTFVAEYCSSCSRNSL

SEQ ID NO: 122388 - protein, 121 aa, Glycine max
  Coding DNA Sequence Number=SeqID_5610
MTKTDRDCCWLYSNFTDPEILRLLVLSMLSLNDYPVSYHIKISLRIFLYDSDDNGDDNDVSSGTNNRDISDDDNNNSDDDNVGGGDINGDSDIDSDDNDDVVVVVNIGGDRPWCWWRWHWW

SEQ ID NO: 122389 - protein, 206 aa, Glycine max
  Coding DNA Sequence Number=SeqID_5611
MKHATKIEVTQFEVTAIAAAIADKITAGTVITKVAHINPILTEKRPKAASPRNVLEDRFGILTPLNQNRTLISHSLILPCKIFLPAVTNSNHPPTFDNIFKVGRSMPLFGIDNYDTEIKAKEQALKQNIELHVQKASNLSDNHHASAVTKGQKQVPQSRLRGKSGLGHRTWHSRNSRLMHHLAVHDFYSSSKSYTSSSISPVHLSA

SEQ ID NO: 122390 - protein, 95 aa, Glycine max
  Coding DNA Sequence Number=SeqID_5612
MVVVHPLTCQVAVSITLWICMHAFGGACNHDMSEWCALCCCLTSESTSLTCQKVVRLLWWPCIRVMFDPFDQQLHRRQPCGRGLVTLVGQHRPNE

SEQ ID NO: 122391 - protein, 280 aa, Glycine max
  Coding DNA Sequence Number=SeqID_5613
  Gene Ontology: Mol. function=kinase activity; Cellular component =cytoplasm
  Homolog annotation: Hit_ID=Q8S5U3; Match level="QueryCoverage=63%, HitCoverage=43%, E-value=2e-52, Identity=55%"; Hit description =Putative sugar kinase
  Subcellular localization annotation: CTP_CleavageSite=59; ConfidenceScore=5.41e-01
PPHISARKSSGQAARIPPHPAALNAPLQGASHSPFRLRNCWEGRSGFPSHDVVKRRPVNCNTTHYRANWSSTAVAAALELVDPPGCRNSIFDPGPRGKSLSTGTPDEQRALNQLLRMSDVLLLTSDEAEELTGIEDPILAGQEFLKRGIRTKWVNVIDSVGCGDSFVAAIVYGFIHNMPLVNTLAIANAVGAATAMGCGAGRNVATLENVVNILRSSNLNEDDEFWIEIFEKNVVAQEITYLSNVMNGNKNRLNLVSFDKVASELLPKLELPQTVGNVPT

SEQ ID NO: 122392 - protein, 357 aa, Glycine max
  Coding DNA Sequence Number=SeqID_5614
  Homolog annotation: Hit_ID=Q58T16; Match level="QueryCoverage=39%, HitCoverage=21%, E-value=4e-28, Identity=49%"; Hit description=FLK
  Pfam annotation: Domain name=KH_1; Domain location=258-304; Score =44.4; E_value=3.9e-10; Accession=PF00013.19; Description=KH domain
MAAKFPEPPSPINFVEDVLDVGVGMVGPIGHEGGVVVCAVFAVRDAHAKVEEAFVGDRGSCSARCSPGLDEDDDGSGVLEGENEEEKKVEERAAEMSGEVFDGQDAGYVPENPEFPQNHSDEYDGGNVIDDSGFPQLQPDEHDNGGFPQLQPDEYDAGGFPQLQPDEHDAGGFLQLQPDEHNAGNLAEDGNIPEHNFDGNDVEGLPGNPDLPSQEHAEEQNIGGDVTENFGSEEKRGPEEDLKGGEVKKWPGWPGENVFRMLVPVQKVGSIIGRKGEFIRKITEDTKARIKILDGPPGTSERAVGGELRNKMNGLGWKSGDWAKWGEFGCHMQFGCYLCNAKSCTMSFLWQPAAVML

SEQ ID NO: 122393 - protein, 74 aa, Glycine max
  Coding DNA Sequence Number=SeqID_5615
MFACWEICKKAGLGVGGVIGGASGMSMPTFQLPKKHVTDLESDSLEPLPVINQSWHEPTLESALGIGMALRTLF

SEQ ID NO: 122394 - protein, 139 aa, Glycine max
  Coding DNA Sequence Number=SeqID_5616
  Gene Ontology: Mol. function=zinc ion binding
  Homolog annotation: Hit_ID=Q1RX12; Match level="QueryCoverage=69%, HitCoverage=10%, E-value=2e-31, Identity=63%"; Hit description=Zinc finger, RING-type; Transcription factor jumonji, jmjC; Cupin region; Zinc finger, FYVE/PHD-type
MCHVWSTIDTCKSKCTRAALKNLNLVEDRSIPRVQAHFFPKNINTDVSYSNMRKAASWEDLTDNYLFCSKAVDPQYKDLRHFQWHWEKGEPVIVSNVLECTSGLSWEPLVMWRALRHVTNTKHGQHLAEKTIDCLDWTE

SEQ ID NO: 122395 - protein, 302 aa, Glycine max
  Coding DNA Sequence Number=SeqID_5617
  Gene Ontology: Mol. function=transporter activity; Cellular component= outer membrane-bounded periplasmic space; Biological process=sulfur metabolic process
  Homolog annotation: Hit_ID=Q1LNM3; Match level="QueryCoverage=91%, HitCoverage=81%, E-value=3e-77, Identity=51%"; Hit description=ABC transporter, substrate-binding protein, aliphatic sulphonates precursor
  Pfam annotation: Domain name=Lipoprotein_9; Domain location=30-264; Score=-140.3; E_value=0.083; Accession=PF03180.4; Description=NLPA lipoprotein
  Pfam annotation: Domain name=NMT1; Domain location=54-249; Score=7.9; E_value=7.2e-07; Accession=PF09084.1; Description=NMT1THI5 like
  Pfam annotation: Domain name=OpuAC; Domain location=28-255; Score= -7.3; E_value=5.4e-05; Accession=PF04069.3; Description=Substrate binding domain of ABC-type glycine betaine transport system
  Pfam annotation: Domain name=SBP_bac_3; Domain location=23-259; Score= -69.6; E_value=0.0018; Accession=PF00497.10; Description=Bacterial extracellular solute-binding proteins, family 3
  Pfam module annotation: Pfam domain module=Lipoprotein_9::NMT1::OpuAC: :SBP_bac_3; Domain location=30-264::54-249::28-255::23-259
MKAQRFALSALALSFGLLATHAFAANPETVTIGYQKANIFALLKYRGTLDETLKKEGIAVRWVEFPAGPQMLEGLNVGSIDLAATGDAPPAFAQAAKADLIYLGHSPANPKTEAIVVPKDSPIKSVADLKGKRVGLNKGSDVNYLLVKALEDAGLNYKDVTPVYLPPADARAAFQKGAIDAWVIWDPYLAEVEANAGAREVRNAEGLVPHYTFYLASRPFAENHPQTAKQVVDELSKLSDWANQHQDEAAAILAKSTGLDKSIWQTTLQRLPYGASRMSPQVFAEQQALADTFTRVGLLPVK

SEQ ID NO: 122396 - protein, 550 aa, Glycine max
  Coding DNA Sequence Number=SeqID_5618
  Gene Ontology: Mol. function=transporter activity; Cellular component= membrane; Biological process=transport
  Homolog annotation: Hit_ID=Q7WHX5; Match level="QueryCoverage=94%, HitCoverage=77%, E-value=4e-59, Identity=29%"; Hit description =Putative membrane protein
  Pfam annotation: Domain name=DUF939; Domain location=14-275; Score= -162.5; E_value=0.019; Accession=PF06081.2; Description=Bacterial protein of unknown function (DUF939)
  Pfam annotation: Domain name=FUSC; Domain location=350-468; Score =46.9; E_value=7.1e-11; Accession=PF04632.3; Description=Fusaric acid resistance protein conserved region
  Pfam module annotation: Pfam domain module=DUF939::FUSC; Domain location=14-275::350-468
  Subcellular localization annotation: CTP_CleavageSite=74; ConfidenceScore=5.03e-01
MKWFSRSAVLFSAKTCLAAFLAFYLALELNLDKPAWSLTTVYVASQLYSASTVSKSVFRFFGTVLGGLFTLLIYPATVQSPMLFSLCISLWVAVCLYLSLHDRTPKSYVFMLAGYSAAIMGFPDVTSPGAITYTVISRIEEITVAIVCSSLVHRLIFPVSMRHLLEQSVGLWYQNARKLCSELMTAMPAAKSLEREDILVQMANYPLNVETLITHCVYEGDAARRLVRLVSVQYQHLSYLIPTLTAIESRLNLLAQQQIRFPDYVATAFQQFLQWLNGDAQQPVRDRLTGAQEQLQQAWRAGQLNSEESILLIGLLERLLNFVRIADAYHSVSERVSDWTPAVKPGKASRAHKHVDKGLLLLSCFTAFIATFASCLFWIGSGWRDGSTAPMMAAVLCSFFAGLDSPIAPMKLFLKGVLISMAISLIYVTLLIPQAVTFEALVICLAPGLFALGLVIANPSTNLIGLIVATQIPAYSECHDLHAGGHCCCAGADAADSQQTPGVDGHACASQRHSRSAAVYYRAAHEHRHADGAAAICRTHAGQGKRDSAA

SEQ ID NO: 122397 - protein, 131 aa, Glycine max
  Coding DNA Sequence Number=SeqID_5619
  Homolog annotation: Hit_ID=Q0M6D6; Match level="QueryCoverage=40%, HitCoverage=24%, E-value=5e-09, Identity=59%"; Hit description=O -methyltransferase, family 3
AIYPEILQLVQPWLRPGALIVADDADFSPEYLEMVHGSRLYTSLPFADGVEVAAMKVTVPLLVIAFASAKAGAFQAKIDPLKLALKPANALASTDQAQPLAIAEAHARLAAAVSGCQCPFCTQMRLVNSGL

SEQ ID NO: 122398 - protein, 449 aa, Glycine max
  Coding DNA Sequence Number=SeqID_5620
  Gene Ontology: Mol. function=transporter activity; Cellular component= 1-2nm peptidoglycan-based cell wall; Biological process=transport
  Homolog annotation: Hit_ID=Q0K083; Match level="QueryCoverage=87%, HitCoverage=86%, E-value=5e-38, Identity=39%"; Hit description=ABC -type transporter, permease component: PAAT family
  Pfam annotation: Domain name=BPD_transp_1; Domain location=15-216; Score=108.0; E_value=2.8e-29; Accession=PF00528.12; Description =Binding-protein-dependent transport s
  Pfam annotation: Domain name=BPD_transp_1; Domain location=247-449; Score=81.2; E_value=3.2e-21; Accession=PF00528.12; Description =Binding-protein-dependent transport s
  Pfam module annotation: Pfam domain module=BPD_transp_1::BPD_transp _1; Domain location=15-216::247-449
MSYQWLTLWRYADTFLEAAWLTLQVTLLAFALAVALGLLAALAKSSPLAPLRWISHCYVEFIRNTPVLLQIFIIFFGLPSLGITMSAFTAGVLALGINVGAYLSETFRAGIQSVAKGHLEAAYILGIPRHQIFLSVVLPQAARAVWPAIINNLIQLLLGTSLLSAIALPELTGTATVINARTLLYIQTFSVVALVYLVLSNLFSWLGTMAGRRLFHPPLVTPVKKSGWRETGECVMSELIISSLPILLKGLVITLLLSIAAIAGSTLLGLLAAVLRTSRLPIAREIAVLYTELFRGTPVLITLMFIYFGVAYFGYEINLFAAGILGLSIYQGAYIAEVFRAGIEAVPKGQWEVSWILGLSKRQTFLSVVLPQTRGIVLPPLVGQYLSLIKDTSIVSMIGMSELMHQGQAIVDRIGQPVVVYGLVALLYFAVCFPLSRWVQHHQTRSQLS

SEQ ID NO: 122399 - protein, 742 aa, Glycine max
  Coding DNA Sequence Number=SeqID_5621
  Gene Ontology: Mol. function=transferase activity; Cellular component= membrane; Biological process=phosphate transport
  Homolog annotation: Hit_ID=Q6U5T1; Match level="QueryCoverage=54%, HitCoverage=99%, E-value=1e-180, Identity=76%"; Hit description=CobW
  Pfam annotation: Domain name=CobW_C; Domain location=602-717; Score =124.4; E_value=3.2e-34; Accession=PF07683.4; Description=Cobalamin synthesis protein cobW C-ter
  Pfam annotation: Domain name=Peripla_BP_2; Domain location=32-294; Score=5.7; E_value=4.9e-05; Accession=PF01497.9; Description =Periplasmic binding protein
  Pfam annotation: Domain name=cobW; Domain location=351-557; Score =327.1; E_value=3.1e-95; Accession=PF02492.9; Description=Cobalamin synthesis proteinP47K
  Pfam module annotation: Pfam domain module=CobW_C::Peripla_BP _2::cobW; Domain location=602-717::32-294::351-557
MGILVSTAACATDYPLTVTDMDGHTQTISKEPQHIILQDGRDVLTLALLDRDNPFKRYATWDMLKRRWPEATKIVDMGFSDQGQVNLESVLAQKPDLMIAQLRAKPALEQSGVLSTLNNLHIPVLFVDYELHPAQNTAPSVTLLGKVLNRESEAKAYTDFYQQRFDRITQAVAKVKNKPTVFIEPIAGNSDNCCFTHSHNGWGGLVEAVGGKNIGSALLPGNAGFVALEKIIAMKPDVYIMTGSKRPNSNVLPFGYGVQPQEVRATFQTLLQRTGLAQIAPVKQGRVYGVYHHFYNHPYNIIGMEILAKDLYPQQFDDLKPVADFHTLVKTFTQLPDDAIELSYPDNQRLPVTVLSGFLGAGKTTLLNHILNNREGRRVAVIVNDMSEVNIDAALVREGGAALSRTDEKLVEMSNGCICCTLREDLLLEVNRLAKEGRFDHLVIESTGISEPLPVAETFTFADEEGQSLSAVAALDTMVTVVDGYNFLRDYDSSESVRSRGESLGEEDERTVVDLLIDQIEFCDVLILNKTDLIDAAEQARLTAILHSLNPRARIIRAQFGQVALDQVLNTGLFDFDAAAQAPGWLKELRGEHTPETEEYGIRSFVFRARRPFHPQRFYQVITQHMQGVVRSKGYFWLATRPRHAGSWSQAGGVTRQGLAGMWWACVPEDRWPQDADTLHYIRENWHEGTGDARQEMVIIGIDMDETVLRQQLHHALLTDEEMALGPDGWAQLPDPFQPWFD

SEQ ID NO: 122400 - protein, 130 aa, Glycine max
  Coding DNA Sequence Number=SeqID_5622
  Gene Ontology: Mol. function=hydrolase activity; Cellular component =mitochondrial matrix; Biological process=mitochondrial genome maintenance
  Homolog annotation: Hit_ID=Q1R1F4; Match level="QueryCoverage=98%, HitCoverage=99%, E-value=8e-53, Identity=76%"; Hit description =Endoribonuclease L-PSP
  Pfam annotation: Domain name=Ribonuc_L-PSP; Domain location=15-126; Score=64.3; E_value=4e-16; Accession=PF01042.11; Description =Endoribonuclease L-PSP
MTIKRYGIEGGTGTGGQKLPFARAVEADGWLYISGQTPMRDGEVVEGGIIEQTQLAFDNCLTIMREAGYRVEDVVHVTAVLTDARYFSSFNKVFSEIFSGHPPARICSVQDLVVDCKVEVDMKCFRADRK

SEQ ID NO: 122401 - protein, 250 aa, Glycine max
  Coding DNA Sequence Number=SeqID_5623
  Gene Ontology: Mol. function=DNA binding; Cellular component =intracellular; Biological process=regulation of transcription, DNA -dependent
  Homolog annotation: Hit_ID=Q2K1L6; Match level="QueryCoverage=87%, HitCoverage=74%, E-value=7e-47, Identity=43%"; Hit description =Probable transcriptional regulator protein, IclR family
  Pfam annotation: Domain name=HTH_IclR; Domain location=11-98; Score =43.0; E_value=1e-09; Accession=PF09339.1; Description=IclR helix -turn-helix domain
  Pfam annotation: Domain name=IclR; Domain location=124-249; Score =32.0; E_value=8.1e-07; Accession=PF01614.9; Description=Bacterial transcriptional regulator
  Pfam module annotation: Pfam domain module=HTH_IclR::IclR; Domain location=11-98::124-249
MPDEKTSRARGVDRVIDIFRQLHIARQPMAMRDLIEATGAPRSSIYELVSLLSEAGLVELDAEGAVFFGREMHYYGADYMAHNDLIRRAHQLMVEIVARHGETVQLCMLEGNKYTVVLSESNAHPFKITSDIGVRVPITWTATGRLLLSNWSDSAILDLIPEEDYRLASGQILDKQTFLEEIHRAGQLGYCMTEGLSESFTCCMAAPIRSRSGQAVAAICFMVSRDTPAERRQMLLQELIASGQKLSDFT

SEQ ID NO: 122402 - protein, 288 aa, Glycine max
  Coding DNA Sequence Number=SeqID_5624
  Gene Ontology: Mol. function=signal transducer activity; Cellular component=integral to membrane; Biological process=regulation of transcription, DNA-dependent
  Homolog annotation: Hit_ID=Q4K817; Match level="QueryCoverage=93%, HitCoverage=83%, E-value=6e-30, Identity=28%"; Hit description =YaiC/YhcK/ArdA family protein
  Pfam annotation: Domain name=GGDEF; Domain location=144-276; Score =120.7; E_value=4.2e-33; Accession=PF00990.12; Description=GGDEF domain
  Pfam annotation: Domain name=MASE2; Domain location=2-138; Score=1.0; E_value=0.00016; Accession=PF05230.2; Description=MASE2 domain
  Pfam module annotation: Pfam domain module=GGDEF::MASE2; Domain location=144-276::2-138
MQRGLAFSALLFVNAFFWPWLAYQRALRAEDSTGTERQNLTLDAAFGGIWVALMALSPMPSFVIMAVLASDRYAAGGGAQLIAAIQAFLCGFIMVWLLDGTSVNLAFSTQTVWLTLPLATCYMLVLSVASYNLTWHLRTRNRELERIALMDPGLKIPNRRLFERRLESEFHSTRRGDSSGYLLLLDVDHFKVVNDSWGHEAGDFLLAEISTLLRNYVGQQDIPARFGGDELGVIVHQASDESVYRYCAAVSAESLSDWLRHADEALYEVKRAGRNGVRLWQTPLARAS

SEQ ID NO: 122403 - protein, 726 aa, Glycine max
  Coding DNA Sequence Number=SeqID_5625
  Gene Ontology: Mol. function=oxidoreductase activity
  Homolog annotation: Hit_ID=Q13NX7; Match level="QueryCoverage=47%, HitCoverage=98%, E-value=1e-94, Identity=51%"; Hit description=Zinc -containing alcohol dehydrogenase superfamily
  Pfam annotation: Domain name=ADH_N; Domain location=404-521; Score =127.9; E_value=2.8e-35; Accession=PF08240.2; Description=Alcohol dehydrogenase GroES-like domain
  Pfam annotation: Domain name=ADH_zinc_N; Domain location=551-686; Score=136.1; E_value=9.8e-38; Accession=PF00107.16; Description=Zinc- binding dehydrogenase
  Pfam annotation: Domain name=AlaDh_PNT_C; Domain location=524-691; Score=-62.9; E_value=0.1; Accession=PF01262.12; Description=Alanine dehydrogenasePNT, C-terminal domain
  Pfam annotation: Domain name=Hydrolase; Domain location=3-239; Score =30.5; E_value=5.9e-06; Accession=PF00702.16; Description=haloacid dehalogenase-like hydrolase
  Pfam annotation: Domain name=Hydrolase_3; Domain location=6-262; Score=219.0; E_value=1.1e-62; Accession=PF08282.2; Description =haloacid dehalogenase-like hydrolase
  Pfam annotation: Domain name=S6PP; Domain location=2-265; Score= -74.9; E_value=2.1e-05; Accession=PF05116.4; Description=Sucrose-6F -phosphate phosphohydrolase
  Pfam module annotation: Pfam domain module=ADH_N::ADH_zinc_N::AlaDh _PNT_C::Hydrolase::Hydrolase_3::S6PP; Domain location=404-521::551 -686::524-691::3-239::6-262::2-265
MAVKMIAVDMDGTFLDDNKQYNAQRFARQYALLKEKGIRFVVASGNQYYQLQHYFPAIKDEIAFVAENGAWVSDSNEEIFCGELAPERVHQVLDILAKEPEISTVVCGRNGAYVHKSMPDEVVAMLANHYRRLEKRDSLYDIDDTIFKFSLNLAHEGVEALLARLHSELNAIENIMHPVSSGFGFVDLIIPGCHKAHGIALLQEKWGIDDCEVLAIGDSANDIEMLRQACYSFAMANAAAPVAAVARYRTESNNDEGALNVIARLLARETPFGRAFSAGVPPAARRLASISSSAAWFSNPTDTSAQSAGRRSCPARSAGYAAVHRYGRAVPASDTTRAAPLCSTSPKTDPSDGAVANPHRKPSAAFIQPTSEFEEGIMKINALVAQDAAQPLAAGQITLRPLQQQDVKIEILYCGVCHSDLHMARNEWAVSRYPLVPGHEIVGRVLETGTQVTRFKAGDVVGVGVMVDSCRACHFCQQQEEQYCEAGFTATYNGIDKYTNDSTWGGYAQNVVVDQHFVVSIPQNLALAGVAPLLCAGVTVWSPLRHFGVKAGDNVGVVGLGGLGHMAVKLASALGAEVTLFTTSPEKGADARRLGATRVVVSRDAAQMAACQTSLDFIIDCVAAPHDLDPYLATLKTNGRLVLVGIPDQPHQPPNVTPLVFRRLSISGSSIGSIKETQEMLDFCGEHNITADIELIAGEEIETAFARMLKGEVKYRFVIDMLATRW

SEQ ID NO: 122404 - protein, 278 aa, Glycine max
  Coding DNA Sequence Number=SeqID_5626
  Gene Ontology: Mol. function=protein dimerization activity; Biological process=proteolysis
  Homolog annotation: Hit_ID=Q35QX3; Match level="QueryCoverage=57%, HitCoverage=36%, E-value=2e-36, Identity=49%"; Hit description =Similar to Acetylornithine deacetylase/Succinyl-diaminopimelate desuccinylase and related deacylases
MAEVMQRRPAGHHRAGFAPAHQHPFRRERRQRFAHRTDRDTELRRQTVFTGQNGARRQFALQDGFTDIALHYFVQRSAFAFVQATELRNVENSSLQRALTHIADDQAQILDDLQRMLAVDTCFPPGLGYAEFADLLSTMLQPMQFSLQRVSVPDALWQTPDGSARGERVNLLAALDAGASENCNLYFHTDTVPAGDGWRFPPLALSVAENKLFGRGAADMKGTIVAALAAVRAAQRYQLSLRYNPVFLLCTDEEGGLYPGIRYLAEQQLFHGHLLSST

SEQ ID NO: 122405 - protein, 101 aa, Glycine max
  Coding DNA Sequence Number=SeqID_5627
  Homolog annotation: Hit_ID=Q6DAD0; Match level="QueryCoverage=71%, HitCoverage=89%, E-value=3e-19, Identity=70%"; Hit description =Putative plasmid stability protein
  Pfam annotation: Domain name=PhdYeFM; Domain location=8-71; Score =18.3; E_value=0.0026; Accession=PF02604.10; Description=Phd_YefM
MPFQILSNTAASITDLKRDPMGTVRSAEGETIAILNRNEPAFYCVPPAFVPSAEKEWKKLGHPVREQFKKKLDETITVMVLGVGKREGSQVYADTEYRLPE

SEQ ID NO: 122406 - protein, 406 aa, Glycine max
  Coding DNA Sequence Number=SeqID_5628
  Gene Ontology: Mol. function=signal transducer activity; Cellular component=membrane; Biological process=signal transduction
  Homolog annotation: Hit_ID=Q6D415; Match level="QueryCoverage=96%, HitCoverage=61%, E-value=1e-102, Identity=55%"; Hit description =Putative methyl-accepting chemotaxis citrate transducer
  Pfam annotation: Domain name=HAMP; Domain location=80-149; Score =48.6; E_value=2.1e-11; Accession=PF00672.15; Description=HAMP domain
  Pfam annotation: Domain name=MCPsignal; Domain location=180-402; Score=328.9; E_value=8.8e-96; Accession=PF00015.11; Description =Methyl-accepting chemotaxis protein (MCP) signaling domain
  Pfam module annotation: Pfam domain module=HAMP::MCPsignal; Domain location=80-149::180-402
MNTLLTQLPAEQQGGFNALWQDTERFKDLSLQAAAIYGQLRVAENTVKVAGDNSSAAIKQIIALVKARNDELANGSAALSLLMGSLAIALGVLVAWTIIRQITRPVFHNLALAERIASGDLSSQFVTNRQDELGQLTSAMGRMNARLRGMIGEVLHSVSNVSQAASTIHQGNLELSSRTAQQSAAVVETAASMEQLTATVKNNASNARLASQIAAEATHNASQGGIAVHNVVSTMGEISDSSKKIAEITAVINSIAFQTNILALNAAVEAARAGEQGRGFAVVASEVRNLAQRSAGAAKDIERLIGESVGRISNGHQQVARAGETMEQIVSSIARVNEIMAEISAASDEQSRGIEQIARAVGELDGTTQQNASLVSASSHSAQALEEQAFMLQRLVSQFRLQGAAS

SEQ ID NO: 122407 - protein, 226 aa, Glycine max
  Coding DNA Sequence Number=SeqID_5629
  Gene Ontology: Mol. function=transcription factor activity; Biological process=regulation of transcription, DNA-dependent
  Homolog annotation: Hit_ID=Q1MF05; Match level="QueryCoverage=91%, HitCoverage=97%, E-value=1e-70, Identity=67%"; Hit description =Putative TetR family transcriptional regulator
  Pfam annotation: Domain name=TetR_N; Domain location=41-87; Score =62.6; E_value=1.3e-15; Accession=PF00440.13; Description=Bacterial regulatory proteins, tetR family
MNYSHFTIRVQEQTMAAQRNAKISERKKPQQARSSELVAAILQAATQVLEQEGATRFTTARVAERAGVSIGSLYQYFPNKAAILFRLQSEEWQRTGDLLGSILRDSASTPRQRLHQLTWAFLHSECEEAAMRTALNDAAPLYRDAPEVQAARANGENVMCEFLQQLLPQRDAAEVARAADLINSTLGDVGKHFSESPRSAAEIQAYARDMADMFCAWIREKGAELQ

SEQ ID NO: 122408 - protein, 267 aa, Glycine max
  Coding DNA Sequence Number=SeqID_5630
  Gene Ontology: Mol. function=transcription regulator activity; Cellular component=intracellular; Biological process=regulation of transcription, DNA-dependent
  Homolog annotation: Hit_ID=Q35QX2; Match level="QueryCoverage=88%, HitCoverage=85%, E-value=7e-59, Identity=51%"; Hit description =Regulatory protein GntR, HTH
  Pfam annotation: Domain name=GntR; Domain location=35-98; Score=92.5; E_value=1.3e-24; Accession=PF00392.11; Description=Bacterial regulatory proteins, gntR f
  Pfam annotation: Domain name=UTRA; Domain location=121-261; Score =103.9; E_value=4.7e-28; Accession=PF07702.3; Description=UTRA domain
  Pfam module annotation: Pfam domain module=GntR::UTRA; Domain location=35-98::121-261
MNSWGQSVIGNMQKNYDAHDVPQFSRLNEGEGAPLYEVVKRYISESILQGELPAGTILPSENSLAAKFGVSVGTVRKALAALTTEGMLMRRRKTGTVVTGWAPLHNLSHFFHYFRLHDKSGGLLQSETRLLEYQHSRASADEADKLQIAPGDAVIRLKRLRRVKGIAAMHETLVLPAARLPDFPPAEQLPQLLYRYLFEQYDVRVAAVREQISATLATEEDASLLELVLPHAVMVIDEVSFDQSATPVILAHHRFSTEHFMYVNEIR

SEQ ID NO: 122409 - protein, 61 aa, Glycine max
  Coding DNA Sequence Number=SeqID_5631
MTINCLRMSSGSPPMDDQKVRNDHNLSPHVIGLTASGLQKEQNDHNLSLRATVHDRCGWQK

SEQ ID NO: 122410 - protein, 370 aa, Glycine max
  Coding DNA Sequence Number=SeqID_5632
  Gene Ontology: Mol. function=transporter activity; Cellular component= membrane; Biological process=transport
  Homolog annotation: Hit_ID=Q35QX4; Match level="QueryCoverage=87%, HitCoverage=63%, E-value=1e-108, Identity=60%"; Hit description=Twin- arginine translocation pathway signal
  Pfam annotation: Domain name=SBP_bac_5; Domain location=91-370; Score= 153.8; E_value=4.5e-43; Accession=PF00496.12; Description=Bacterial extracellular solute-binding proteins, family 5
  Subcellular localization annotation: CTP_CleavageSite=37; ConfidenceScore=5.41e-01
MCAMKGLNRRQFIASSTALTGAALLPWSFSASAAAVASATPGGTPRKGGLLRISVDQAVSVLNPHQVRVNPEYLVAELLYSGLTRLTQAMKAEGDLAQSWQPNDDLTQWTFTLRPDLRFSDGSPLTAADVVASLQALLDPKNASPALHNIGPIKTVSAKDNNTILIETEAPYADLPVMLAYPDAKIIPAHIAQGQYDKLSSASLGAGPFQLVSYDPERKIVVKRNPHYYDATRPYLDGVEVVVYPDAIAESSALIAGDTDLMLSAQSSEFARLAKSAGVLPLRVASGQFLNVNMGCDQKPFNDVRVRQALALCVDRQASVDFVADGLGSPGNDTPINAAYPYYAQLTQKALDYSKAKALLAEAGYPNGLD

SEQ ID NO: 122411 - protein, 229 aa, Glycine max
  Coding DNA Sequence Number=SeqID_5633
  Gene Ontology: Mol. function=transporter activity; Cellular component= integral to membrane; Biological process=transport
  Homolog annotation: Hit_ID=Q35QX5; Match level="QueryCoverage=81%, HitCoverage=59%, E-value=7e-62, Identity=64%"; Hit description=ABC transport protein inner membrane component
  Subcellular localization annotation: CTP_CleavageSite=31; ConfidenceScore=5.18e-01
MEIASGSNGATCAPPATISSASSRISTPAAPCGERSNRFSISGIGNPLIEHDVGQIREEIHHGIGCREDHHAGLNSGQIARLYRDNQLPANTGNGKNLLHHHNPAQQIADVERHNGDGGQQAIAHRMAPQDASARQAFQPRGANVVGVQHVNHFRAHHARNVCHQNQRNGDRRQNQVLNTADKIFAERHVAGGGQNLPDIGKQQQHQRGGDEFRKRDAHVRDHADQHIG

SEQ ID NO: 122412 - protein, 226 aa, Glycine max
  Coding DNA Sequence Number=SeqID_5634
  Gene Ontology: Mol. function=nucleoside-triphosphatase activity; Cellular component=membrane; Biological process=peptide transport
  Homolog annotation: Hit_ID=Q35QX7; Match level="QueryCoverage=99%, HitCoverage=92%, E-value=8e-79, Identity=51%"; Hit description=ATPas
  Pfam annotation: Domain name=ABC_tran; Domain location=3-200; Score =187.0; E_value=4.4e-53; Accession=PF00005.17; Description=ABC transporter
MPGEVLGLVGESGSGKTTLGWAIMRWLASNAREQAGDIRLNGESLLQLPAHQLMALRGKKLGMIFQDPSASLNPTLTLGEQVTEVLRRHRGLSAREAQQLGESLLRDVELKHPARMMQRYPHQVSGGEKQRILIATAFACQPDCLIFDEPTTALDVISSAQILDLYERLRAETGVASLYISHDLALVAKVADRVCVLEQGRIVEQAATRTLFSAPAHAYTRKLIAA

SEQ ID NO: 122413 - protein, 43 aa, Glycine max
  Coding DNA Sequence Number=SeqID_5635
PGDGQQRATDAPLSPLEFTSAHPPKAIKRPAQDVKEALLGGNL

SEQ ID NO: 122414 - protein, 128 aa, Glycine max
  Coding DNA Sequence Number=SeqID_5636
MEFAYRDGQNQRTPLPTLCPISTPAYVSEHPLQGFDFMPSGFSNNVLVPRVFPTLMSVNADETFQRDLETKHIQQEPDKEEIIREILVNKMTLTQRQELDEEANGDEESIGTSMQNWRGYHFGEFQCL

SEQ ID NO: 122415 - protein, 136 aa, Glycine max
  Coding DNA Sequence Number=SeqID_5637
  Subcellular localization annotation: CTP_CleavageSite=29; ConfidenceScore=5.25e-01
MGFAGALRNIVRPLSVASSRALMPRISINASMAPFCPAFPSPCKPPQWLHPLWNQFHSLTDTRFPKRRPSEKPRRKRASLRPSGPYAWVQYTPCQPILPNKPNEGSVKRRNEKKRMRQRRAFILVRSPFTLHTLNF

SEQ ID NO: 122416 - protein, 46 aa, Glycine max
  Coding DNA Sequence Number=SeqID_5638
MWEQLRLISPELLMHASLLLLVATKMFAAKGPEQQFTIMTKIRSAN

SEQ ID NO: 122417 - protein, 85 aa, Glycine max
  Coding DNA Sequence Number=SeqID_5639
  Gene Ontology: Mol. function=phosphoenolpyruvate-protein phosphotransferase activity; Cellular component=chromosome; Biological process=phosphoenolpyruvate-dependent sugar phosphotransferase system
  Homolog annotation: Hit_ID=Q8GU55; Match level="QueryCoverage=76%, HitCoverage=9%, E-value=3e-21, Identity=53%"; Hit description=SMC2 protein
MAKLEPPEGCSFLDGLEVDAALDLSHTQNIGRMTKAHFPHSEFIVVSLKEGMFNNTNVLFRTKFVDVFASSICYKSYTYVHLQGK

SEQ ID NO: 122418 - protein, 246 aa, Glycine max
  Coding DNA Sequence Number=SeqID_5640
  Gene Ontology: Mol. function=nucleic acid binding; Biological process= DNA integration
  Homolog annotation: Hit_ID=Q1S0A6; Match level="QueryCoverage=82%, HitCoverage=19%, E-value=5e-19, Identity=41%"; Hit description=Zinc finger, CCHC-type; Peptidase aspartic, catalytic; Polynucleotidyl transferase, Ribonuclease H fold
MSRKTISLYDITANDNPGSLLMQVQLKGKNFDEWACSLRSALKNLWEELGNHVQIPAFTCGGCTCNLASKLEKKLEEEKIHQFLMGLDKTVYGTVRSNMLAQDPLPKRPHGRGKAEKGRTYGARGCGAVSKANAAQASTSEPKPNIVITDADKSAVSGLDAEQWQTLVNLLNDVKIGLVEKLTGKRNLEQWIIETGASRHIIGKIECLTDVTTILDYPVGLLDEKQMSATREGTMMLSDTLKLSNC

SEQ ID NO: 122419 - protein, 82 aa, Glycine max
  Coding DNA Sequence Number=SeqID_5641
MVSVIWETDRNIITGSKPKSKWNEPSLVYSRKSKGNRGTSDTRTHQRPCANIKHFFLLRHGSLKLPLTFSIPSSIPWPAWRE

SEQ ID NO: 122420 - protein, 89 aa, Glycine max
  Coding DNA Sequence Number=SeqID_5642
  Subcellular localization annotation: CTP_CleavageSite=72; ConfidenceScore=5.73e-01
MPPSYSLLGKLPSRINNASKLSSHKPPSSPLTVSATVSSMLSKTSTFNVIELTIQQNNDERCHYSMEMVVKEAAAEWQQQCLIRQLIHC

SEQ ID NO: 122421 - protein, 77 aa, Glycine max
  Coding DNA Sequence Number=SeqID_5643
MVNKVKTTPRLKVALGVEEWEEWMVLFLTNPSHSQHNTITSNMVAIMKRWREESAKSLMLISVSNKANLLKVLLQWS

SEQ ID NO: 122422 - protein, 611 aa, Glycine max
  Coding DNA Sequence Number=SeqID_5644
  Gene Ontology: Mol. function=amylo-alpha-1,6-glucosidase activity; Cellular component=membrane; Biological process=carbohydrate metabolic process
  Homolog annotation: Hit_ID=Q5JLH8; Match level="QueryCoverage=98%, HitCoverage=78%, E-value=0.0, Identity=67%"; Hit description =Putative ERD4 protein
  Pfam annotation: Domain name=DUF221; Domain location=140-570; Score =641.0; E_value=9.9e-190; Accession=PF02714.6; Description=Domain of unknown function DUF221
MAYAFTFWTCYVLLKEYGKVATMRLGFLAAEKRRPDQFTVLVRNIPPDPDESVSELVEHFFLVNHPDHYLTHQVVYDANKLAKLVEKKKKFKNWLVYYQNKLERTSKRPEIKTGFLGLWGKKVDAIDHHITEIDKLSKEIVEERENVTNDPKAIMPAAFVSFKTRWAAAVCAQTQQTRNPTLWLTEWAPEPRDVYWRNLPIPYVSLTVRRLIIAVTFFFLTFFFMIPIAFVQTLASLDGIQKAAPWLKPLVDIPFIKSFIQGFLPGIVLKLFLIFLPTILMIMSKFEGFGSISSLERRSASRYYLFNFVNIFLGNILTGTAFQQLSSFIHQPADQYPVTIGTAIPLKASFFITYIMVDGWASIAAEVLMLKPLIVYHLKNFFLVKTEKDREEAMDPGSIGFNTGEPRIQLYFLLGLVYAAVTPAVLPFITVFFGLAYLVFRHQIINVYNQEYESGAAFWPDVHFRIVMALIVSQIVLMGLLTTKKAASSTPFLIVLPILTIWFHRYCKGRFESAFVKFPLQEAMMKDTLERATEPNLNLKGYLQNAYVHPVFKDSMDDDDDEEDRLSIDLETESVTVRTKRQSRRNTPLPSKNNDASSPSLSDGIGNHPEP

SEQ ID NO: 122423 - protein, 130 aa, Glycine max
  Coding DNA Sequence Number=SeqID_5645
  Subcellular localization annotation: CTP_CleavageSite=31; ConfidenceScore=5.05e-01
MEGITDKLVLNPKTLCQSLTRQTLQARSSCTASKEGAFKQGLASSIKLPNSMFTFIHQVQPIIEKVNSDDEEPVVAAKDLAMEFYDGPPPSLEYKFSKTPMDSSSDDESRDDFFHKIENEEEAAKQKREK

SEQ ID NO: 122424 - protein, 179 aa, Glycine max
  Coding DNA Sequence Number=SeqID_5646
ESDGSIDDEVTFMSRKFKKMMEKKGKFQHSFRRKDSRFEKKNKEKSNEIIYFECGKLGHMKKLRKEVECHTKEFGKFLESSKTLTTLLKFHQHPLDKSSLGFEKGTTFSKSQPILHKFDFYGKSGHSKFKCIYKKKQMCKGWGFSWYRDSGWSQYMMGERSMFLDLKPHEGGPVAFGGI

SEQ ID NO: 122425 - protein, 878 aa, Glycine max
  Coding DNA Sequence Number=SeqID_5647
  Homolog annotation: Hit_ID=Q5ZC01; Match level="QueryCoverage=94%, HitCoverage=97%, E-value=8e-45, Identity=39%"; Hit description=IFA -binding protein-like
  Pfam annotation: Domain name=DUF593; Domain location=543-636; Score =158.6; E_value=1.6e-44; Accession=PF04576.6; Description=Protein of unknown function, DUF593
MKGFVSLLTSAACEWLLIFLLLLDALLSYMLTKFASYCQLQMPCLLCSRLDHILRRERPEFYENLFCSNHKSEISSLILCHIHGKLADGHRMCDDCLLSVTAKTKCNAKTQRLLVGKFGLVLGGSGFKSPSLSKDLFFGSKGARLCTRQCTCCGKLWKSDQNSPRSIHLKSHGRAVLKPYIPLPCAPTQRRLNHQDNLKKMRDKFPGSEGKSSFRPLSHVGYTELRLNSNSESEFPFSDDDDDVSSVYHENIEASNDPIAVTSAPSSKCIPCDLNPKEPIDSSAKSMPLPSDQCGEPNVSKQQDVNANCAVENNLQQANQESFSSDPAELISIEEVSPPPIVKNVPHRESEFEDSKITSHSKDSLPGPLSEFMTLNGTYVHAGASSEKSADVAQARDTGMVSEKNEEVLQKIGTEETASTDTHPVVCDSAPINPKEENSSNMNKSSVTTKEREQTGFIKEKPTTEEVNNVKEEQEQSPSDKSSPNGSNTSSNVPVNHVHSPKADVEASSLNKVQVFRKSSSVESGLDSLDESNISEIEGESNDDRLRRQIEYYKKCMHSLQKELEEERNAYAVATNEAMSMITRLQEEKAALQMEALQYLRMMEEQAEYDNDELEKVNGLLTEKEKEIQDLEAELEFYRSNMADEEPMIHNMHKESWDLKGENVTTQNTVVHNIINTVSSSKNAEVSKVGDGDVTGETAFLEFEEEKEYISQCLKNLEENVHQISLHAPNDRSEKLEVSKSNQQGASNGEGPQLDDGSAEDDDACSLSAENNHSKSPEPQISTPRREVELVILENQISDLNDRLEALEFDHDLLEHLTNSLQNGNDGNQFIQDIAHRLHEWCRGGFAVVTRLELRFGFRSSQGRVCAMSRNGKGTSNA

SEQ ID NO: 122426 - protein, 430 aa, Glycine max
  Coding DNA Sequence Number=SeqID_5648
  Gene Ontology: Mol. function=nucleic acid binding; Cellular component= beta-galactosidase complex; Biological process=DNA integration
  Homolog annotation: Hit_ID=Q1S1G2; Match level="QueryCoverage=74%, HitCoverage=22%, E-value=5e-99, Identity=56%"; Hit description =Integrase, catalytic region; Zinc finger, CCHC-type; Peptidase aspartic, catalytic
MDSLPTLTIKVENLSLIVVEKFEHVVIGLAMLLKVTENGQQQAPENQDLRFSPQQFQALLALIQQPNNGTSASSKSCVNQIGSMSSSIIASIYVVKLPNGQQVAATHSGVGSKTRRKIGTIDVHDGLYTLVLQPGYTQLEGVDFLDTFSPVAKLTIVQLLLALAAIHKWHLKQLDVNNAFLHGELLEEVYMQPPLGLHVSKPGQFCRLQRSLYGLKQASRQWYAKLSSFLTSHGYKQSAFNHSLFLKFSTNNITALLVYADDIVLTGNDLHEISRITALMDNTFKIKNLGDLKFFLGLEAFTCVNKYVLDLLSNNGMLASRPVSTPMDYHTRLHSSSGTLLTDPLIYQRLLGRLIYLTTTRPDIAFVVQHLSQFVSSPTIAHHQAAFRVLRYLKGTPGLGVFLSADSSLQLKAFSDSDWAGCVDSCRSII

SEQ ID NO: 122427 - protein, 717 aa, Glycine max
  Coding DNA Sequence Number=SeqID_5649
  Gene Ontology: Mol. function=nucleoside-triphosphatase activity; Cellular component=nuclear envelope; Biological process=protein metabolic process
  Homolog annotation: Hit_ID=Q39889; Match level="QueryCoverage=100%, HitCoverage=81%, E-value=0.0, Identity=82%"; Hit description=Heat shock protein
  Pfam annotation: Domain name=AAA; Domain location=202-368; Score= -6.2; E_value=0.00062; Accession=PF00004.19; Description=ATPase family associated with various cellular activities (AAA)
  Pfam annotation: Domain name=AAA_2; Domain location=568-704; Score =297.0; E_value=3.5e-86; Accession=PF07724.4; Description=ATPase family associated with various
  Pfam annotation: Domain name=AAA_5; Domain location=572-713; Score =16.7; E_value=9.5e-05; Accession=PF07728.4; Description=ATPase family associated with various
  Pfam annotation: Domain name=Clp_N; Domain location=17-67; Score =35.8; E_value=1.5e-07; Accession=PF02861.11; Description=Clp amino terminal domain
  Pfam annotation: Domain name=Clp_N; Domain location=96-146; Score =49.0; E_value=1.5e-11; Accession=PF02861.11; Description=Clp amino terminal domain
  Pfam annotation: Domain name=Sigma54_activat; Domain location=181 -282; Score=-183.6; E_value=0.03; Accession=PF00158.16; Description =Sigma-54 interaction domain
  Pfam module annotation: Pfam domain module=AAA::AAA_2::AAA_5::Clp _N::Clp_N::Sigma54_activat; Domain location=202-368::568-704::572 -713::17-67::96-146::181-282
MNPDKFTHKTNEALVSAHEIATSNGHAQFTPLHLASSLISDKDGIFSQALSNAAGEESARAAERVINNALKKLPSQSPLPDEVPASNALVKAIRRAQTLQKKRGDTHLAVDQLILGLLEDSQIAELLNEAGVAASKVKSEVERLRGKEGKKVESATGDSTFQALKTYGRDLVEQAGKLDPVIGRDEEIRRVVRILSRRTKNNPVLIGEPGVGKTAVVEGLAQRIVKGDVPSNLSDVKLIALDMGALVAGAKYRGEFEERLKAVLKEVEDAEGKPMLARGQLRCIGATTLEEYRKYVEKDAAFERRFQQVYVAEPSVVDTISILRGLKERYEGHHGVRILDRALVVAAQLSSRYITGRHLPDKAIDLVDEACANVRVQLDSHPEEIDNLERKRMQLEVELHALEKEKDKASKARLVEVRKELDDLRDKLQPLMMKYKKEKERIDNIRRLKQKREELNFALQEAERRYDLARAADLRYGAIQEVESAIQELEGNNEGNVMLTETVGPEHIAEVVSRWTGIPVTRLGQNDKERLIGLADRLHQRVVGQDQAVNAVAEAVLRSRAGLGRPQQPTGSFLFLGPTGVGKTELSKALAEQLFDDENQLVRIDMSEYMEQHSVSRLIGAPPGYVGHEEGGQLTEAIRRRPYSVVLFDEVEKAHTSVFNTLLQVLDDGRLTDGQGRTVDFRNTVIIMTSNLGAEHLLTGLSGKSSMQVARDRVMQE

SEQ ID NO: 122428 - protein, 503 aa, Glycine max
  Coding DNA Sequence Number=SeqID_5650
  Homolog annotation: Hit_ID=Q2QN51; Match level="QueryCoverage=98%, HitCoverage=72%, E-value=1e-106, Identity=46%"; Hit description=Leo1, expressed
  Pfam annotation: Domain name=Leo1; Domain location=43-402; Score =402.2; E_value=7.5e-118; Accession=PF04004.4; Description=Leo1-like protein
MVGSPRDEKDETRDLHSAPEIRDVFGDFDDDEEEEMGYAIQQDIEQDSNRYPMEEEGSYGKNLRPEDILADEDHQYESEEENIEIKTKEKPLGPPLELEVPLRPPPALPEKMNMIKVSNIMGVDPKPFDPKTYVEEDTFVTDESGTRKRIRLENNIVRWRTTKNPDGTTSCESNARFVRWSDGSLQLLIGNEVLDISVQDAQHDQAHLFLRHGKGILQSQGRLLRKMRFMPSSLSSNSHRLLTALVDSRHKKVFKVKNCITDIDPEREKEEKEKAESQNIRANVLLNRKREKVNRKYTPAVERRRQLSPGFLEDALDEEDEADYYDNRRSQHRFEDDLEAEARAEKRIMNAKKSQGPKDIPRKSSFPPAKSSRNPMGYPDDEREESEYETEEEDERPPSRKRDEDTEPEYEDEEEEEEHYEEAEQVNDASDEEEEEDYCTCVLCVLVHLVGGCSYDECMEPKQKNKEFRGSAKRKGFESDEDSPPRKTTTHRRMAVVYDSDED

SEQ ID NO: 122429 - protein, 99 aa, Glycine max
  Coding DNA Sequence Number=SeqID_5651
  Subcellular localization annotation: CTP_CleavageSite=22; ConfidenceScore=5.32e-01
MATTPCSPPPTGAASHSSSPLKQTSKATCLRSLETRPVGAERPLVHVDPAIGNADGPHKKKLRTYLEIISRDKVDVTYENWKQVLAAQKDLIWEDIQVN

SEQ ID NO: 122430 - protein, 66 aa, Glycine max
  Coding DNA Sequence Number=SeqID_5652
MANFSRRILFMVLVIIFIIMVALSQRGEGCRPLHDDEQGSGEFDGLLLQFLPRGPLKPSAPDPIHP

SEQ ID NO: 122431 - protein, 68 aa, Glycine max
  Coding DNA Sequence Number=SeqID_5653
MENGGCRVVEVAKDCPSWPENAGDVAREGCVHWKGEQSVLLHKSVHHAPATPPIAPLFNAIDNYDMHI

SEQ ID NO: 122432 - protein, 1651 aa, Glycine max
  Coding DNA Sequence Number=SeqID_5654
  Gene Ontology: Mol. function=protein binding; Cellular component=cell surface; Biological process=homophilic cell adhesion
  Homolog annotation: Hit_ID=Q9FF08; Match level="QueryCoverage=99%, HitCoverage=93%, E-value=3e-89, Identity=31%"; Hit description =Arabidopsis thaliana genomic DNA, chromosome 5, P1 clone:MXM12
MPGNEVGDRVHNFFGQENLSQGQYHSQAVDGNWPGLSNNLWAGSQRSTGVPFISNLKNFNQQQSDPEQGHASSPRLRHGLNLSQPSFRPESGRNLLPNQQSAVNGYIQGQQVFQTRQNEANILGVDTESDWNSLSRGIPVLESQGSGLELYKKNLARNDAAESPVNFDFFGGQQQIGGRHGGMLQPLPRQQSGINEMHLLKQQAVLNQMQELQRQQQFHHLEAKQQNSIAPTSSISKQAVASHSASLISGIPINEVSNIIWQPEVMPTNANWLQHGASPVLHGSSNGLVLSPEQGQALRLMGLVPNQGDQSLYGVPISGSRGTPNLYNVQADKPAVPQVSIPHQYSHVHGNKPALQHISAGDNSFSPHQYTAFPDQLNTNDGTSVSRQNVQGKNMFGSTAHSINNGLNMENLQQMNSEQRIAPMQDFHGRQELAGSLEMSQDKMLVQAPPSQNMATLDPTEEKILFGSDDSLWDGFGSNMGGFSMLDGTDSFSGIPSIQSGSWSALMQSAVAETSSSDIGKQEELSGLSFRNLGQSSGNEQPSTIDSSKQQSIWTDSNLQSASNINSRLFLWPDGVSRPNASENYSGVSGFHQSGPDTLHEQHNRLQNNSQRSIPQFLERGKWLDCSPQQKQLAEGGHIFGNAANSSGIEKNQQTILSCNSSGDPFNKSNGWDIMKLPFDRSSNFKTHESENLSQPHHEKAMCEEMGQIPAMWEPDSDTNSSVGMEHVKSAGNMQVCGEDSGTNGIATLPNSGTAWFSQQSSKQLPNFDVWRDAESAGSYRRNEVPGKYKHHMEKNPLVLESSKDGNVEGAAHDLENSNKKEKSADSLGSNPSNPRAGGMRENSSFDGNDLHSPKLSGQGNRRPPVSRKFQYHPMGDLGVEVEPYGIGNKHVKNSQPMPHQPLGGQSKYGHSDRKYNEMNKGDSKSLENNALKSIHPGQMSKKLTSFDRSVGNYASQKTASSRVPETDSSDGSGAHPPENQSFFSQGIGLQLAPPTQRLPVVSSYGSSETDHTTPHVSETRDKDHTWLGTNQTFPSLDPSHGELRSNISSTAGQIFDKASQYGMLGNIPQAFTSGFPFSRIHTQNQNLASLGGQVANTQSANVTFTASMNQTDEYCEKAQTSQSELASAQDMSQLSAIDEDRLRDPAIQILTAETGTQPSVTFSASLHGTPSKVTHNVWTSFSSKQHPNASRFLSQPQQINDCEMISSSQKPGDEGLEKDGNDHSGTGPCSAYSNNSVGNSLKEISVLQTLPESVVASEQAACSSHLKETVGKPTLDASQPSPTATPRDIEAFGRSLRPNIVLNHNFSLLDQVQSARNMETDPSNRDVKRLKVSDNIVVEKQLVDSNHGQQLSYGYDNVIKDGWSGNNSMPSSDPNMLSFSTKPLDGQYTNASSQEEVGYGQKIALNVADSNKAASVKSDYSLVNPQMAPSWFERYGTFKNGKMLPMYNAQKMTAAKIMDQPFIVANQSDSLRFHNSVEQIQSVSDAQLSNASESPMPALAASKHADSQLSTPAVEPDLLIMRPKKRKSATSELIPWHKELLEGSERLRDISAAELDWAQSASRLIEKVEDSVEVVEDLPAVVKSKRRLVLTTQLMQQLLSPPPAAVLVADVQLHHESVVYSVARLALGEACSSISWSRCDTLLPPGNKNL

SEQ ID NO: 122433 - protein, 158 aa, Glycine max
  Coding DNA Sequence Number=SeqID_5655
  Gene Ontology: Mol. function=motor activity; Cellular component =myosin complex; Biological process=gene conversion at mating-type locus
  Homolog annotation: Hit_ID=Q5R216; Match level="QueryCoverage=87%, HitCoverage=9%, E-value=4e-58, Identity=78%"; Hit description=Myosin XI
MDMEAPTDGVDDMTKLAYLHEPGVLHNLETRYMMNEIYTYTGNILIAINPFQNLSHLYDTNVMQRYKGATIGGLGPHVFAIAEAAYRAMINEEKSNSILVSGESGAGKTETTKMLMQYLAYLGGNTSSEGRTVEKQVLEALALGQSKNNLEMPGNIVS

SEQ ID NO: 122434 - protein, 537 aa, Glycine max
  Coding DNA Sequence Number=SeqID_5656
  Gene Ontology: Mol. function=protein serine/threonine kinase activity; Cellular component=myosin complex; Biological process =protein amino acid phosphorylation
  Homolog annotation: Hit_ID=UPI000034F472; Match level="QueryCoverage =63%, HitCoverage=22%, E-value=1e-132, Identity=66%"; Hit description= XIC; motor/ protein binding
  Pfam annotation: Domain name=AT_hook; Domain location=105-117; Score =14.9; E_value=0.061; Accession=PF02178.9; Description=AT hook motif
  Pfam annotation: Domain name=IQ; Domain location=370-390; Score=14.1; E_value=0.51; Accession=PF00612.17; Description=IQ calmodulin-binding motif
  Pfam annotation: Domain name=IQ; Domain location=393-413; Score=20.4; E_value=0.0064; Accession=PF00612.17; Description=IQ calmodulin -binding motif
  Pfam annotation: Domain name=IQ; Domain location=418-438; Score=25.0; E_value=0.00028; Accession=PF00612.17; Description=IQ calmodulin -binding motif
  Pfam annotation: Domain name=IQ; Domain location=441-461; Score=12.5; E_value=1.5; Accession=PF00612.17; Description=IQ calmodulin-binding motif
  Pfam annotation: Domain name=Myosin_head; Domain location=4-354; Score=-179.0; E_value=6.2e-09; Accession=PF00063.11; Description =Myosin head (motor domain)
  Pfam module annotation: Pfam domain module=AT_hook::IQ::IQ::IQ::IQ::My osin_head; Domain location=105-117::370-390::393-413::418-438::441 -461::4-354
MSKLPSAKVVYMNNDFGVINLKIIYVKLQVNENKVGVAEMRMLRWMCGKTRQDKIRNGAIRERVGVTPIVEKMVENRLRWFGHVERKPVDSVVRRVDQMERRQTIRGRGRPKKTIREIIKKDLELNDLDRSMKPGGIIALLDEACMFPKSTHETFSQKLYQTFKDHKRFIKPKLARSDFSVVHYAGEVQYQSEQFLDKNKDYVVPEHQDMLSASKCSFVSGLFAPLSEETAKSAKFSSIGSRFKLQLQQLMDALNLTEPHYIRCIKPNSLLKPFIFENMNVIQQLRSGGVLEAVRIKCAGFPTHWTFHDFLTRLGILAPEVLQGNFEEKDSCKKILEKIGLTGYQIGETQIFLRAGQMAELDARRAFLLSNSAIVIQKHTKTHFSQKRYIALQKSSVFLQSICRGELARRSYYHMKREAGAVRIQKYMRGTLARKWYTEIKISAIVLQTGFRAVAACNKFRYRKQISASTTIQVFETPAQNESPSMEECSNPVQEESSSPFQDDESIEAIRDSSIPLKDTEKIEVLTIEIKNLKIIS

SEQ ID NO: 122435 - protein, 301 aa, Glycine max
  Coding DNA Sequence Number=SeqID_5657
  Gene Ontology: Mol. function=motor activity; Cellular component =myosin complex; Biological process=signal transduction
  Homolog annotation: Hit_ID=Q67VX5; Match level="QueryCoverage=98%, HitCoverage=20%, E-value=1e-140, Identity=80%"; Hit description =Putative myosin heavy chain PCR43
  Pfam annotation: Domain name=Myosin_head; Domain location=1-301; Score=26.9; E_value=2.1e-15; Accession=PF00063.11; Description =Myosin head (motor domain)
MQSNPVLEAFGNAKTVRNDNSSRFGKFVEIQFNKYGRISGAAIRTYLLEKSRVCQISDPERNYHCFYLLCASPPEEKEKYKLGDPRSFHYLNQSNCYELVGVNAAQEYLSTKRAMDIVGISQEEQDAIFRVVAAILHLGNIKFAKSEETDSSVLEDEASRCDPNCLEGALRERVMITPEEIIKRSLDPLGATVSRDGLAKTLYSRLFDWLVQKINISIGQDPSSKCLIGVLDIYGFESFQTNSFEQFCINFTNEKLQQHFNQHVFKMEQEEYTKEGIDWSYLEFVDNQDVLDLIEKVSSNF

SEQ ID NO: 122436 - protein, 168 aa, Glycine max
  Coding DNA Sequence Number=SeqID_5658
  Homolog annotation: Hit_ID=Q9M2K0; Match level="QueryCoverage=99%, HitCoverage=10%, E-value=2e-08, Identity=29%"; Hit description =Myosin heavy chain MYA3
MLQEEKQRGDEYERKYVEAQGSSEELRKKLAETEKRVHQLQDSLNRKMDRIKEGARQIQNNCVWAAAGVLHQYGIFLMNISKASFMMISSMSSQVAELKAILSTSSRLSSTFRPIARVDIASSNSDTSSTDSDFTFPAPVSNTELLSSPESNSFQLVVQDVTAGDGSG

SEQ ID NO: 122437 - protein, 227 aa, Glycine max
  Coding DNA Sequence Number=SeqID_5659
  Gene Ontology: Mol. function=nucleic acid binding; Cellular component= intracellular; Biological process=regulation of transcription
  Homolog annotation: Hit_ID=Q9FIY6; Match level="QueryCoverage=26%, HitCoverage=47%, E-value=6e-10, Identity=52%"; Hit description =Arabidopsis thaliana genomic DNA, chromosome 5, TAC clone:K9D7
  Pfam annotation: Domain name=zf-C2H2; Domain location=33-55; Score =20.0; E_value=0.0083; Accession=PF00096.16; Description=Zinc finger, C2H2 type
MEFSYQEDSSKSSSNEIDRSSEQNDETGTGRSFECVFCKRGFNTAQALGGHMNIHRKARANNSKAKPNFPPSSSSKVDHHESNNYANPSYLTRGNHYSSTLPDHREVDDVNYNYYHQLYFPSPACGAKSPSHVQYSSEVLCVENQRDPHLLFGQDWRQRGLSLYTNPLCVHENKDKIENNSEEDDLDLELRLERWVAGWKQKEARFLAWRLLQGRLQVRVSDEGRYF

SEQ ID NO: 122438 - protein, 33 aa, Glycine max
  Coding DNA Sequence Number=SeqID_5660
MEELCESGISLLPDPGKLWHMAEILSILTSKDQ

SEQ ID NO: 122439 - protein, 36 aa, Glycine max
  Coding DNA Sequence Number=SeqID_5661
MAEIGPVNYNAKLQFFQLSEGPLHVILSLHVGAVSL

SEQ ID NO: 122440 - protein, 40 aa, Glycine max
  Coding DNA Sequence Number=SeqID_5662
MAEEFVKGSVHQNGVAVITLDRPKAFLRVIDDGRKSINMQ

SEQ ID NO: 122441 - protein, 98 aa, Glycine max
  Coding DNA Sequence Number=SeqID_5663
MGSYLAHGPKIYLKAHENPRAFSCISGPIFLESSIQCPWGQPTAPSYSLHIFNIYFVLEIFSEMESTLVEMLVDWYCQHDLWTMNSTLRAFGNIREVL

SEQ ID NO: 122442 - protein, 93 aa, Glycine max
  Coding DNA Sequence Number=SeqID_5664
  Homolog annotation: Hit_ID=Q1T099; Match level="QueryCoverage=45%, HitCoverage=6%, E-value=1e-13, Identity=81%"; Hit description=AAA ATPase; DEAD/DEAH box helicase, N-terminal
MESVFSLFVAARTDFIQFLVQSVGYNYICLWAYDSISPKIVLDDCMTGGKEARKQNRTLTKFFPNKITIHMPQDEALLESWKQQLDREVETQN

SEQ ID NO: 122443 - protein, 54 aa, Glycine max
  Coding DNA Sequence Number=SeqID_5665
MKLNEERRRNTQEKDLLLRQEELDNLLFRISQISPLGVHSWLLEDAISNKYLLT

SEQ ID NO: 122444 - protein, 243 aa, Glycine max
  Coding DNA Sequence Number=SeqID_5666
  Gene Ontology: Mol. function=oxidoreductase activity, acting on NADH or NADPH, quinone or similar compound as acceptor; Cellular component=photosystem II; Biological process=mitochondrial electron transport, NADH to ubiquinone
  Homolog annotation: Hit_ID=P31174; Match level="QueryCoverage=64%, HitCoverage=100%, E-value=2e-91, Identity=100%"; Hit description =NAD(P)H-quinone oxidoreductase chain J, chloroplast (EC 1.6.5.-) (NAD(P)H dehydrogenase, chain J)
  Pfam annotation: Domain name=Complex1_30kDa; Domain location=171-239; Score=129.6; E_value=8.6e-36; Accession=PF00329.9; Description =Respiratory-chain NADH dehydrogenase,
  Pfam annotation: Domain name=Oxidored_q6; Domain location=1-70; Score= 77.8; E_value=3.5e-20; Accession=PF01058.12; Description=NADH ubiquinone oxidoreductase, 20 Kd
  Pfam module annotation: Pfam domain module=Complex1_30kDa::Oxidored _q6; Domain location=171-239::1-70
MAPSLVRLYEQMPEPKYVIAMGACTITGGMFSTDSYSTVRGVDKLIPVDVYLPGCPPKPEAIIDAITKLRKTNTKFIKKFRRSKKMQGRLSSWLVKHGLIHRSLGFDYQGIETLQIKPEDWHSIAVILYVYGYNYLRSQCAYDVAPGGLLASVYHLTRLEYGIDQPEEVCIKIFVARKNPRIPSIFWVWKSADFQEKESYDMLGISYDNHPRLRRILMPESWIGWPLRKDYIAPNFYEIQDAH

SEQ ID NO: 122445 - protein, 144 aa, Glycine max
  Coding DNA Sequence Number=SeqID_5667
MDMNLGYFISHQISLIAQHDTSRLGFPTLITALCKAKGVQSDSRSLENLSPAINLAYIKKKCWNLDYPTVTFREPRKARGVHMAQEEETSTDQILEPSPTPITNDAIPSAPASELEQPISQDSPVAQVLDLNEHAQEQPQEQDI

SEQ ID NO: 122446 - protein, 90 aa, Glycine max
  Coding DNA Sequence Number=SeqID_5668
  Subcellular localization annotation: CTP_CleavageSite=67; ConfidenceScore=5.04e-01
MGMNMKMSYRVMLVLFSLFMFVIPSMLSNDSCGSGFVPLTPIRCPGRSHAWLPHPRLPHPRFPPEISASSFEVARPVPPSFNRPRNIHYP

SEQ ID NO: 122447 - protein, 72 aa, Glycine max
  Coding DNA Sequence Number=SeqID_5669
MPKSSPNMHVNQEVSTRVKPRLLCKQPMGQNTPNKIDDDGSKSHRGEKQGFQFTKCQETPISKTITHYLYIT

SEQ ID NO: 122448 - protein, 136 aa, Glycine max
  Coding DNA Sequence Number=SeqID_5670
  Homolog annotation: Hit_ID=Q1SH90; Match level="QueryCoverage=59%, HitCoverage=88%, E-value=3e-25, Identity=76%"; Hit description=Rapid ALkalinization Factor
  Subcellular localization annotation: CTP_CleavageSite=26; ConfidenceScore=5.31e-01
VRRACDQIRTHSSPAARDDRAASGVRVNGASGPVAVVGVVRSTRTRWARDSVRGKSAVGDSDIAVGHSNASDMRFKPVSSICACTPTSEVKAMQKSSDRARGTGDRGSHAPKLCVGWHPAVEKGVWRIDEVLMKSM

SEQ ID NO: 122449 - protein, 119 aa, Glycine max
  Coding DNA Sequence Number=SeqID_5671
  Homolog annotation: Hit_ID=Q1SH90; Match level="QueryCoverage=74%, HitCoverage=80%, E-value=1e-27, Identity=74%"; Hit description=Rapid ALkalinization Factor
  Pfam annotation: Domain name=RALF; Domain location=57-117; Score =11.0; E_value=0.0015; Accession=PF05498.2; Description=Rapid ALkalinization Factor (RALF)
MASSLPLLNLLTLALSLLFCIALTSEVGVQAQMEETGLNLMSEALEWPTAMSLYDEDSEEEDVQNGYSRRSLFWRRMKYYISYGALSANRIPCPPRSGPEAPFTLTPEAALSSRAAGDE

SEQ ID NO: 122450 - protein, 76 aa, Glycine max
  Coding DNA Sequence Number=SeqID_5672
MSMATDALSYDVKESTCQIGSDNNSVITDPRIKAIVIHSNWNHSTVEFEINNSTETKLIHNSPVHQPPPTQKTILT

SEQ ID NO: 122451 - protein, 134 aa, Glycine max
  Coding DNA Sequence Number=SeqID_5673
  Gene Ontology: Cellular component=endoplasmic reticulum; Biological process=ER to Golgi vesicle-mediated transport
  Homolog annotation: Hit_ID=Q9M2J9; Match level="QueryCoverage=88%, HitCoverage=94%, E-value=2e-44, Identity=78%"; Hit description=Bet1 -like SNARE 1-1
  Pfam annotation: Domain name=SNARE; Domain location=49-111; Score =58.1; E_value=3e-14; Accession=PF05739.9; Description=SNARE domain
MWLMFTEKQVLCIDGRNNRVALFDGIEEGGIRASSLYSSSSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 122452 - protein, 213 aa, Glycine max
  Coding DNA Sequence Number=SeqID_5674
  Homolog annotation: Hit_ID=Q9SLB7; Match level="QueryCoverage=89%, HitCoverage=92%, E-value=2e-39, Identity=44%"; Hit description=LOB domain-containing protein 16
  Pfam annotation: Domain name=DUF260; Domain location=16-117; Score =222.2; E_value=1.2e-63; Accession=PF03195.5; Description=Protein of unknown function DUF260
  Subcellular localization annotation: CTP_CleavageSite=38; ConfidenceScore=5.11e-01
MASATGSGSSSGFGSPCGACKFLRRKCVTDCIFAPYFCSEQGAAKFAAIHKVFGASNVSKLLLRIPAHGRFEAILTIAYEAQARLRDPVYGCVSHIFALQQQVACLQAQVMQMKAQLDQNHMEPRNFENHWSENVAQSFNPFCPTSMNNLISPQSSLDSLGYSSINDGMSMLDVQSSREEYFALQACNSKKRSYNNDLGELQELALRMIRNCD

SEQ ID NO: 122453 - protein, 313 aa, Glycine max
  Coding DNA Sequence Number=SeqID_5675
  Gene Ontology: Cellular component=outer membrane
  Homolog annotation: Hit_ID=Q6H7M7; Match level="QueryCoverage=78%, HitCoverage=47%, E-value=4e-23, Identity=33%"; Hit description =Putative outer envelope membrane protein OEP75
MAAKLDVGVDFTRKLCSSCMLSPRRLSSILVSMATGSLRLKHPGLFYFRDLLDMSWHKGLHDSDLLLTYRYHRPLHIGPPSLTIKHSVSPEVGIHGIPMNKFSHSLSRGVRLSKLSIGFDYIAPSESDSSKAKATGVYFKRFHFTHDGGRSISTDQDGFQLTRSGGPSDNIIVISQESRYEDESDHGFTNFSVQMELGTPIPPILLSYYRFEVSAARGIKLGPTIFFSRMSGGTVMGSFAPYQAFAIGGPSSVRGYGEGAVGVGQSCLVSTSELSIPLLLYLEKSCPPVWSPYIDCLGTLKINMGQGLPNCVR

SEQ ID NO: 122454 - protein, 216 aa, Glycine max
  Coding DNA Sequence Number=SeqID_5676
  Gene Ontology: Mol. function=histone-lysine N-methyltransferase activity; Cellular component=nucleus; Biological process=chromatin modification
  Homolog annotation: Hit_ID=Q9M2J7; Match level="QueryCoverage=63%, HitCoverage=64%, E-value=2e-45, Identity=64%"; Hit description=LOB domain-containing protein 29
  Pfam annotation: Domain name=DUF260; Domain location=44-145; Score =236.6; E_value=5.2e-68; Accession=PF03195.5; Description=Protein of unknown function DUF260
MVINDHDHQHKAEEILIEPETINSKLESSNSKIEKVKMTGTGSPCGACKFLRRKCVRGCVFAPYFCQEQGATHFAAIHKVFGASNVSKLLAHLPVSDRCEAAVTISYEAQARLQDPIYGCVSHIFALQQQVVNLQAQLAYLKEQAAQSCLNGTINENPNEKLLEKSSAALPQDLQSWFQLENSNLGPEFLPNMCTNLSTQHYGNNALMMEDLNPIG

SEQ ID NO: 122455 - protein, 153 aa, Glycine max
  Coding DNA Sequence Number=SeqID_5677
MFDFVSRSGDIFVHWIRHRRLTFCSNRVNCTVGTNYKTARISNYYYPIPYKAQSRSEGVASSPKIRDLHSYMLYLKCLRITVFALDNKLTTKGYNLAQSRNVYGNHMTNARKCFMQHCTMSHSSCPRPILLRKATPISLTIPPQFTPLLISSE

SEQ ID NO: 122456 - protein, 219 aa, Glycine max
  Coding DNA Sequence Number=SeqID_5678
  Homolog annotation: Hit_ID=Q1S2A8; Match level="QueryCoverage=58%, HitCoverage=19%, E-value=1e-21, Identity=48%"; Hit description =Remorin, C-terminal region, putative
  Subcellular localization annotation: CTP_CleavageSite=48; ConfidenceScore=5.57e-01
MKKSSGSSQKLGSFLSPGAPNYSEKSIGSQKGWSSERVLLQPSSSNIRNASVANLTPFNSGRTIPSKWDDAERWICSPVSGYSNNKTNSYAQLQQRRPKSKSGPIMPPGTGYYSNYSPTIPLRQGLVVKNFMMGGSPFSTGVLAPDAISLHHYYSHEAVFGHRYDFDNSMQCSSPLLNENSVALPSVSSAPMWSELLCDPSSPNSQGMDNDVLLRMQTF

SEQ ID NO: 122457 - protein, 425 aa, Glycine max
  Coding DNA Sequence Number=SeqID_5679
  Subcellular localization annotation: CTP_CleavageSite=35; ConfidenceScore=5.11e-01
YHYSSINKTAMVDVDRRMTGLNPAHIAGLRRLSARASAAPSVPVRNGVVSFASLADKVINHLRDSGIHVQHGLSDTEFARAEAEFGFVFPPDLRAVLAAGLPVGPGFPDWRSGGARLHLRASLDLPIAAISFQIARNAVWSKSWGPRPCEPEKALRVARNALKRAPLLIPIFNHCYIPSNPSLAGNPIFFVDENRIFCCGLDLSDFFDRESLFRSSEADPILLKKQRSVSEKSTGVSVSAAFSRRSLDSGTRTPRWVEFWSDAATDKRRRNSSSSSLSASSSPERFFEMPRSKVPGWVEEYIGQIGSVLKAGGWSESDINEMVEVSASGFFEGEMVVLDNQALLDALLLKADKFSDSLRKAGWSSEEVSEALGFDFRPEKERKPAKKLSPQLAERIEKLAQSVSRSCFSLFWVENDEELGKRVVL

SEQ ID NO: 122458 - protein, 183 aa, Glycine max
  Coding DNA Sequence Number=SeqID_5680
  Gene Ontology: Mol. function=RNA-directed DNA polymerase activity; Biological process=RNA-dependent DNA replication
  Homolog annotation: Hit_ID=Q1S4Z4; Match level="QueryCoverage=66%, HitCoverage=19%, E-value=5e-16, Identity=35%"; Hit description=RNA -directed DNA polymerase
MIRGIELEGAWVEELSVVKEEASKFFKKRFREYNWEMPQLDGVVFKKISREDNYMLVGGILKNDVFNFLQDFHSSGSFSKGANASFIALIARLISHKKGDYRPISLVGCMYKVVTKILAKRLQKFLHVGRNGVEVILLQYTDNTIFVGELNLENVVVVKSILRRFLWECEDGREKISWVSWEK

SEQ ID NO: 122459 - protein, 296 aa, Glycine max
  Coding DNA Sequence Number=SeqID_5681
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=58%, E-value=1e-153, Identity=87%"; Hit description =Photosystem II P680 chlorophyll A apoprotein
  Pfam annotation: Domain name=PSII; Domain location=1-295; Score =457.6; E_value=1.6e-134; Accession=PF00421.9; Description =Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIWSYEGVAGAHIVFSGLCFLAAIWHWVYWDLEIFCDERTGKPSLDLPKIFGIHLFLAGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQ

SEQ ID NO: 122460 - protein, 93 aa, Glycine max
  Coding DNA Sequence Number=SeqID_5682
MKNNATTGEGEYADEITTNEILDVCISFLNDHLEETLGSTKIEENHSKFINLTQGKVFGKLGFWLKACSMAGHDICQGLVWFRDKRECPTLFP

SEQ ID NO: 122461 - protein, 303 aa, Glycine max
  Coding DNA Sequence Number=SeqID_5683
MTMLAQTWSVLSFSNLIPTSHTSDVTLDRAKLIYGIIMKMDMNLGYLISHQISLIAQHDTSKLGFPALITALCKARGVQSDSRSLESLSPAINLAYIKKNYWNLDDPKVTFRGPRKARGKRSEAPTTSAPPETPTPSSSTSSLPPILTPIILPSSTQRPLPAPISAGPSDSIFTPQMLYSMLQSIHKGQSIIMQSLQGLGLPSIMSMDEFDAQVAWPGAQPSPSGRGGASATQEPIPEHTAAATVVEGEDELTPPKPFYFDAGVYMAQEEETSTDHIHEPSSTPVPDDAIPSAPASELEQPIP

SEQ ID NO: 122462 - protein, 144 aa, Glycine max
  Coding DNA Sequence Number=SeqID_5684
  Subcellular localization annotation: CTP_CleavageSite=32; ConfidenceScore=5.19e-01
MAEPSKKRNGTSSRSQRHSGSQETPIPSSIPSGSLFSSEEQRIRYTNLFSSRSIIDPKFIDMDLFSNESFECFQAFENSNLIPFTSLKLPVYSDLVKAFYSNLEIQEGTLMSEVYGIKMVIDQSLFYDLTKLPSEGVPFEGCTD

SEQ ID NO: 122463 - protein, 77 aa, Glycine max
  Coding DNA Sequence Number=SeqID_5685
MNVLSVLVALSLFIAAVKFLDFQMITLSGPCRAKRAKRALCAKPKGHSGEAELSPTCYAKPIPSSVLKMVDLGLSPA

SEQ ID NO: 122464 - protein, 138 aa, Glycine max
  Coding DNA Sequence Number=SeqID_5686
MFGILYHIWYNYEWPPSIKFEAINTFRVKSIASNSMKVVGFDKEASQTPHLFITNIFQQHKVPVIDFTGYDDDENCCHGLYIFNRQTDVKGHKKEWYSRDPKVRVRYFCNGDLLVAKVANWRDTIMFDFQDGPLTPDC

SEQ ID NO: 122465 - protein, 722 aa, Glycine max
  Coding DNA Sequence Number=SeqID_5687
  Gene Ontology: Mol. function=transcription regulator activity; Cellular component=nucleus; Biological process=regulation of transcription
  Homolog annotation: Hit_ID=Q2VWB7; Match level="QueryCoverage=98%, HitCoverage=98%, E-value=1e-60, Identity=29%"; Hit description=Prf interactor 30137
  Pfam annotation: Domain name=HLH; Domain location=537-587; Score=4.4; E_value=0.049; Accession=PF00010.16; Description=Helix-loop-helix DNA- binding domain
MGSNLHRLLRSFCLGTDWKYAIFWKLKQRARMILTWEDAYYDNPSICESSENKSCHNSLEQIGSADFSHDPLGLAVAKMSYHVAVTGKHRWICVDNHVTSSGPSFEFADGWQSQFSAGIRTIVVVAVVALGVVQLGSLNKVTEDMGVVSCIRSLFLSTQDYTISHVHNQVQNSVKNSSSVLDTKTSKSMPALHDTEKTMKHEALDILMPFQCPRKNYSPHAVHQKMVVDVAKHDFPELNSDRSSILLQSMSNMMNVEQQKLVGMRPVNESKFEGNSGCEDKSLESGKNVSSFLHNLVMDNNGVNDLACPSENVGVDPVSFSSGFLDAAVCVSDKFQYVDINEKGVLNVPRPSDANFQIKSEKSKFQTEPCYKDTSYTMKFPAGYELHEALGPSFLKGSKCFNWAAEANQDVKNAEMSDEISCSQLTSEFRPEHLLEAMVANISHSNNNVNSELSFSTSMQAAIASGRNPEGSVHTINSEGCSIDQLPFVKEDKHYSLSSSGICGVMSPKGFSSTCPSSCSEQFERSSEPTKNSKKRARPGESCRPRPRDRQLIQDRIKELRELVPNGAKCSIDSLLECTIKHMLFLQNITKHADKLNKFADTKTKLHHMEKDIPGQQGSSWAMEVGGHLKVSSILVENLNQNGQMFVEMVCEECSHFLEIADAIRSLGMTILNGATEAHGEKTFVCFVVEAGSEGQNNRNLHRLDILWSLVQLLQSKSTMYS

SEQ ID NO: 122466 - protein, 63 aa, Glycine max
  Coding DNA Sequence Number=SeqID_5688
MEKKPQSSRLYGNSNHKFLAFELHSLEKKKKLTVLLYFSSFFHFSMEECKHAVQFSKGHRHNG

SEQ ID NO: 122467 - protein, 364 aa, Glycine max
  Coding DNA Sequence Number=SeqID_5689
  Gene Ontology: Mol. function=RNA-directed DNA polymerase activity; Biological process=RNA-dependent DNA replication
MVWFCISTLSIKVLWNGEVLDDSFRPTRGICQASIDQVEIIKPCLDIFCESSGAKDGLFVRRLVMLFQHTNKLGKYLGVQLHHERVSRSTTRSVIEKMKRRLRSWKVCKNFLWGDIDHSRSMHLVSWNQDLCTKNSHLWVKNNIRWRVGDGHDVLFWIDSWVLGVGSLLGKQISTLGNQDLTMNVSDFVGEDGRWDINLRLQFLPSSMCASIHNGATEDSPVQFNTALERYWKASVGLKDDFSIGPDSINHSSIHSWGSPSLGRIKVNIDGAIQIRDHPATCGGVARNHHYGHCMYRFMIHLGNVHVIFEELWVIFHGLKLALDRGQDNNLVVKEAFSSNDPSCVHTSSPLKRGARLLMETTLV

SEQ ID NO: 122468 - protein, 134 aa, Glycine max
  Coding DNA Sequence Number=SeqID_5690
  Subcellular localization annotation: CTP_CleavageSite=4; ConfidenceScore=5.08e-01
MSVTAFLDASSSELVCSQSFNLNTILSHTILFNSLRRMTIVHYHHAKLRLLFHSSLSVSASSRMSQHHRVKANVVDINVDDMDRDTVTYEARTRHRSAASRVEDAPDTQTGATPVQRGVRCRRRRRTRLDARNT

SEQ ID NO: 122469 - protein, 70 aa, Glycine max
  Coding DNA Sequence Number=SeqID_5691
MEKDSWGGGKDEHNDNEDSATLTSSMKVQNIFVNPGRQATILYLASLATMRRATKEDANGVCGSYRGGSR

SEQ ID NO: 122470 - protein, 132 aa, Glycine max
  Coding DNA Sequence Number=SeqID_5692
  Gene Ontology: Mol. function=phosphopantetheinyltransferase activity; Cellular component=integral to membrane; Biological process =macromolecule biosynthetic process
  Homolog annotation: Hit_ID=Q8H012; Match level="QueryCoverage=99%, HitCoverage=17%, E-value=7e-29, Identity=55%"; Hit description =Putative endosomal protein
MFIGGLVPFSAIVLQLHQAYASMWGYKIYTLPSILFATFIPVILIIALVSIGLTYIQLSAEDHEWWWSLYIGDERIRGNGHIRQPLLLWKTPSENISAVWWLNSHFHVWVLRLLLCEIKYEWILAAILLYWL

SEQ ID NO: 122471 - protein, 596 aa, Glycine max
  Coding DNA Sequence Number=SeqID_5693
  Gene Ontology: Mol. function=transcription factor activity; Biological process=regulation of transcription, DNA-dependent
  Homolog annotation: Hit_ID=Q710F0; Match level="QueryCoverage=95%, HitCoverage=94%, E-value=1e-81, Identity=37%"; Hit description=CDT1a protein
  Pfam annotation: Domain name=CDT1; Domain location=113-246; Score =131.8; E_value=1.9e-36; Accession=PF08839.1; Description=DNA replication factor CDT1 like
  Subcellular localization annotation: CTP_CleavageSite=56; ConfidenceScore=5.72e-01
MNKSSDATASPTCRGRYKKPNFRSSKSQPPSPVQFSSKTPEKPPQRIRNRGVALSVADIRKAACKRLQDQKQCTEMTSAPSSSSLNKSVRRQISLWPSSPSKPKTTDDESNKLPEKYEILDEFFDRLDTLVSLHRLKRWTPTFTSISSRIESLTDRRFTHSHLAQLKFILPNAIVLKKHLVLDERTSCMKPDIHISLDPDAVEADDAKLPPQRGRVSLKKVFRARLRDFCESHPEGDEIPEGTLPEPFNRPKKDSVLDMLETRLPTKLPPCMRYSDIVNNAESANLDEKLSVLVNTSVELPNEHLAAPSHMSPSFRADDVQKNPLLDLLQPLAFPVSESSRNENTPFVDTESHLKTSPAKLASEASSSESCLTICAPLESSCAHPATPSKTTEYTENKDGSLKSIDAMSTPAKLVSTPIRLMSATPALRSPKRHYMSPDDHSISSLNKLARRPPRSRSLKFDTPVKNKDDIFDTLQESTIQSIREKERLAMEKRDPAITEAKKRKKNIASLPKLFDMIRGLLRQRNCITKAELVSKIISSRCDIADRSEVEEQLNLLQELAPEWISEKQVSSGDLLLFINKMLSPETVRASLEEAT

SEQ ID NO: 122472 - protein, 149 aa, Glycine max
  Coding DNA Sequence Number=SeqID_5694
MAIEGFTMRRGERKGVNEIPRRGGSVVVSSVPWTGSLFITVEVGFGPSYQGDLSKANRSSYWRFRELTKSPVLLATPCTCSFVQSLGNGFCGFCASAPYVRSLGNRQSKLRFQHRLEIASFTGGTLLNLKSPAAAAGCHPRVRCPRCRQ

SEQ ID NO: 122473 - protein, 639 aa, Glycine max
  Coding DNA Sequence Number=SeqID_5695
  Gene Ontology: Mol. function=identical protein binding; Cellular component=integral to membrane; Biological process=protein transport
  Homolog annotation: Hit_ID=Q3T8Z0; Match level="QueryCoverage=97%, HitCoverage=60%, E-value=1e-156, Identity=64%"; Hit description =Autophagy protein 9
  Pfam annotation: Domain name=APG9; Domain location=197-637; Score =580.0; E_value=2.3e-171; Accession=PF04109.6; Description=Autophagy protein Apg9
MFNKPRGASAFNVLNWKRQGESSVTTGLLQDVPPEIELSDYRRIPSPGSESPSDLLNGESLNVEPIADLDFFFERLYSYYCEKGLWCIIIKWIVELLSLGFTICFSGFFLLYVDWNGLRNAKCGMNAVESGRKPCDLAKEALHEHPLTPFTLSKAIIVGYLGIFSIYWIFCFLRFFVQLKDTLDIRQFYYNNLRVTDNDIQTMPWATILEKVVLVQSSRQLCVVKDLSAHDMVMRLMRKENYLIGMLNKGVLSFPISQWVPGAGPTVKSGTNGTQYRLMLPKTLEWTLNWCILQSMFDRNFCVRRDFVSNPKTLKKRLMIVGIVMLLLSPFLVIFMLVYLFLRHAEQFYNHPSTASSRRWSNLSRWVFREFNEGIKVILDIVLKKTKNLISLSSITLVSHFFLLHISRPRAPISPISPSWTCCKVAKNDGDARKFVDEMRWWHNGELQRQSGNGSLVDHLFRHRINSSVLHASNYIKQFPSPIISIISKFISFVSGGFAAILIIIAFIEESLLEGHIFGRNLFWYAAVFGTITAIRRAAIADELLVIDPEGAMSMVVEHTHYMPKRWRGKESTEMVRIEFETLFQYSGMMLLEEMASIFLTPYLLLLVVPKRVDDILQFIADFTVDVEGVGHVCRLAWN

SEQ ID NO: 122474 - protein, 356 aa, Glycine max
  Coding DNA Sequence Number=SeqID_5696
  Gene Ontology: Mol. function=phosphopantetheinyltransferase activity; Cellular component=integral to membrane; Biological process =macromolecule biosynthetic process
  Homolog annotation: Hit_ID=Q8H012; Match level="QueryCoverage=92%, HitCoverage=55%, E-value=4e-86, Identity=47%"; Hit description =Putative endosomal protein
  Pfam annotation: Domain name=EMP70; Domain location=51-355; Score =145.9; E_value=1e-40; Accession=PF02990.7; Description=Endomembrane protein 70
MAKPHHLFLLLLLLCATLEFSSSSPSDHLYNVGELVPLFVNKVGPFNNPSETYEYYDLPFCTPDPIVRKKESLGEVLNGDRLSNALYEFKFRVDKIDETLCQKNLTIDQIATFKRAINRDFYFQFYLDDLPLWGFIGKLEEDGWTPGGGGPNYYLFTHVQFDVLYNGNRIIQVNAFGDPNRAADITKDVGVDVKFTYSVIWNATKVRFENRMDRYLRASLMPVHQQVHWFSFVNSIVIILLLIGLLALLYMRHLRSDLKKYSNANEEDNEVGWKSLQHGDVFRPPPNSSLLFAVVGTGTQLLILLCVLLFLALIGTLYPYNRGGLLNWLVLLYALSSVFAGYTAASFHGLFAENGW

SEQ ID NO: 122475 - protein, 338 aa, Glycine max
  Coding DNA Sequence Number=SeqID_5697
  Gene Ontology: Mol. function=metal ion binding; Cellular component =integral to membrane; Biological process=ubiquitin cycle
  Homolog annotation: Hit_ID=Q9LSW9; Match level="QueryCoverage=89%, HitCoverage=94%, E-value=2e-49, Identity=35%"; Hit description=RING -H2 finger protein ATL5K
  Pfam annotation: Domain name=C1_4; Domain location=131-175; Score= -12.4; E_value=0.085; Accession=PF07975.2; Description=TFIIH C1-like domain
  Pfam annotation: Domain name=PHD; Domain location=131-176; Score=5.5; E_value=0.016; Accession=PF00628.19; Description=PHD-finger
  Pfam annotation: Domain name=zf-C3HC4; Domain location=132-173; Score= 36.1; E_value=1.2e-07; Accession=PF00097.15; Description=Zinc finger, C3HC4 type (RING finger)
  Pfam module annotation: Pfam domain module=C1_4::PHD::zf-C3HC4; Domain location=131-175::131-176::132-173
MALRKNHSYNNKLGYEAFPPIKTQAGTLQHPPQPASSDYAFPILVIVVLSILATVLLLLSYFTFLTKYCSNWRQVNPMRWISILRARHDEDPFIAFSPTMWNRGLDDSIIREIPTFKFIKEEGEDQSVYYGCVVCLTEFKEHDVLKVLPNCNHAFHLDCIDIWLQTNSNCPLCRSGISGTTHCPLDHIIAPSSSPQDSQLLSNMGSDEDFVVIELGGEHGAALPQVQQQERNDSRGSLAHRNHSTRKCHHVSIMGDECIDIRKKDDQFHIQPIRRSFSMDSAHDRQTYLDAQVIIQQSRLQNEASASEDCNSRCRRPFFPFCYGKGSKNAVLPLENDV

SEQ ID NO: 122476 - protein, 159 aa, Glycine max
  Coding DNA Sequence Number=SeqID_5698
  Homolog annotation: Hit_ID=Q40538; Match level="QueryCoverage=22%, HitCoverage=64%, E-value=5e-07, Identity=86%"; Hit description =Nicotiana tabacum (clone 5) activating factor DNA sequence
MDKVLSNGFSDRSVPEDYIFPLELRPGNLKIPFNSNIPVIDLNEAQNGDRTNTIQKIIKAAEEGLVSCDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 122477 - protein, 263 aa, Glycine max
  Coding DNA Sequence Number=SeqID_5699
  Gene Ontology: Mol. function=oxidoreductase activity; Cellular component=cytoplasm; Biological process=flavonoid biosynthetic process
  Homolog annotation: Hit_ID=Q8LKP6; Match level="QueryCoverage=93%, HitCoverage=72%, E-value=3e-68, Identity=51%"; Hit description =Putative flavanone 3-hydroxylase
  Pfam annotation: Domain name=2OG-FeII_Oxy; Domain location=112-211; Score=150.0; E_value=6.2e-42; Accession=PF03171.10; Description=2OG -Fe(II) oxygenase superfamily
MDEAGGVFKELFEMPAEEKQKMCSNDPSKTCKMFTSNVNYATEKVHLWRDNFRHPCHPLEQWQHLWPENPTNYRECVGEFSVEVKKLASRILSLISEGLGLKSGYFENDLTGSMVLSINHYPPCPEPSLALGITKHSDPNLITILMQDHVSGLQVFKDGNWIAVEPIPNAFVVNIGHQLRIISNGKLLSAEHRAVTNSSDTRTSAAFFVAPSEECIIEPAQALTAEHHPPIFKSFKYKDFISYYFAKTGDTEVVLKSFKAHKN

SEQ ID NO: 122478 - protein, 327 aa, Glycine max
  Coding DNA Sequence Number=SeqID_5700
  Gene Ontology: Mol. function=protein dimerization activity; Cellular component=nucleus; Biological process=regulation of transcription, DNA-dependent
  Homolog annotation: Hit_ID=Q93XM6; Match level="QueryCoverage=91%, HitCoverage=63%, E-value=1e-113, Identity=69%"; Hit description=BZIP transcription factor
  Pfam annotation: Domain name=bZIP_1; Domain location=47-102; Score =19.6; E_value=0.0011; Accession=PF00170.11; Description=bZIP transcription factor
  Pfam annotation: Domain name=bZIP_2; Domain location=49-99; Score =15.0; E_value=0.022; Accession=PF07716.5; Description=Basic region leucine zipper
  Pfam module annotation: Pfam domain module=bZIP_1::bZIP_2; Domain location=47-102::49-99
MADKDAFCYPYHVDDCTSPQENLPNKGPSHSEMLPKNSRKGAGSTSEKPLDAKTLRRLAQNREAARKSRLRKKAYVQQLESSRLKLTHLEQDLQRARSQGVFMGCGGAGGSLSSGAAMFDMEYARWLEDDQRHMMELRSGLQVPLPDGELRVIVDGYLSHYDEVFRLKGVAVKTDVFHLINGMWTSPAERCFLWIGGFKPSELITMLIPQLEPLVEQQIMGIHGLRHSLVQAEEALTQGLEQLQQSLVDTIAGSPVADGVQQMVAAMGKLGNLEGFVSQADNLRQITLHQLCRLLTVRQAARCFLVIGEYYGRLRALSSLWASRPRE

SEQ ID NO: 122479 - protein, 980 aa, Glycine max
  Coding DNA Sequence Number=SeqID_5701
  Homolog annotation: Hit_ID=Q9FMQ6; Match level="QueryCoverage=94%, HitCoverage=71%, E-value=1e-159, Identity=38%"; Hit description =Arabidopsis thaliana genomic DNA, chromosome 5, P1 clone:MWD9
MMNASRLKSGPGGMKSEGSSELTNTSVRVMLTSEQGISLHREHIAEQRVLAKGSNRGNTQEDPASSPNTLIKNKVSRAPRTGSVSALESSNIQPSSTTFPGSSIHPMTQWVGQRPPKNSRSRRVKVVSPASRNLEVQVSSEGCLTSDFNVKASSDGNNGFQLASSVDNSTPKYKRPPDDISSPFGLSESEESGAGENKIKEKAVNGSDFAMAADKAGASVFQMKKNKISTDESGDSVQRQGRSGRNLSLVRPGLPCGREKSENVPTMKPVQDMKPNDKSRTKYGRPPSKKQKERKILTRVGKQLNISSPDFGGEPDDDHEELYKAANAAHNASNLACSGPFWKKMESIFASISLDDASYLKQQLNISEEFDKSLSNMFGIDHDLLSVVINNKPTQGSEERKRSHCDEESTKFDALGVKKDMERLDKVTPVFQRLLCALIEEDESEESYHQSDAKNISRQCASDDSHCGSCNQIDFEPKDRDRMDSEVESEVDLQVQKNCMLDRLSCDKSTTSNTFRYPNTSSSLQSTGVWQGDEEFSLSDITLTSEICSNDLDQLQPAELTVPSFPSSDGQYQLMPLDDRLLLELQSIGLYPEILPDLAEEDEAINQDIVKLEKALYEQNGSKKNNLDKIDRAVQEGRDVERQKIEQAAFDHLIEMAYRKRLSYMQVVHKFACRGSKNSKGAVHKVSKQVASAFLKRTLGRCKRYEEAGVNCFSEPTLQNIMFTPPSCEKDAQPADCMVSGTASNTCNKASVQIEARKSGAVSSASEKYDCHRDYADRGMVDSFQGSIQSSEQASSKNGSMFIKEKKREMLVNGGVSGSSSRASNLDGAVHGGVKGKRSERERNQSRDQSRQNSIGRAGRMSLDSSQNENKPKAKKQKSTASGHDRFMEAKESARLPIHDTINNDSKDGATLSGNQDTSQIKESNDFGNLPLPDLSSIEEFGGAQDLSSWLNFEEDGLPDHDSIGLDIPMDDLSDLNMLM

SEQ ID NO: 122480 - protein, 119 aa, Glycine max
  Coding DNA Sequence Number=SeqID_5702
MNIVDKQRIFHLYVEYLVVEAEIIHCVPSYFRDDMFMIQLVITLQVTTMKEETNDTEEFDGEFVNLEEINIRSRVRKKRGRQFDGGATSSVENNDDNDVDYQSGKLDSGQSQMGKIMQF

SEQ ID NO: 122481 - protein, 161 aa, Glycine max
  Coding DNA Sequence Number=SeqID_5703
MASRKRARIEDIPSSSNLSPSTAAMEPDAQQAHSLIPMLQSLFRGQLMIVYNQQELVHNRPIISMEQFLEKVAWPEAQLPLERAHKVVPPGPVLARTEPTSIEPQPPVVDPPTSPELETLSPPAPPLIIIPDDSADEAAASPDSPSCNIDDGSAFSDWMDC

SEQ ID NO: 122482 - protein, 173 aa, Glycine max
  Coding DNA Sequence Number=SeqID_5704
  Gene Ontology: Mol. function=sequence-specific DNA binding; Cellular component=nucleus; Biological process=regulation of transcription
  Homolog annotation: Hit_ID=Q5JM93; Match level="QueryCoverage=51%, HitCoverage=24%, E-value=8e-20, Identity=56%"; Hit description =Putative WRKY DNA-binding protein 49
  Pfam annotation: Domain name=WRKY; Domain location=126-167; Score =4.1; E_value=0.00022; Accession=PF03106.6; Description=WRKY DNA -binding domain
MVESAMSKTMMEEVVMASSWSEGSEDDDLVRELLDDGSPLLIEPPNTTTKLASSSDDQDQAFNRFISNIYSGPTISDIENALSVTNQRDHHFPQLSSARVSILERGLSKIENKYTLKIKCFGNGMGDDGYKWRKYGQKSIKNSPNPSTLALLQKSFTARQKGHAERVLNLELI

SEQ ID NO: 122483 - protein, 175 aa, Glycine max
  Coding DNA Sequence Number=SeqID_5705
  Gene Ontology: Mol. function=sequence-specific DNA binding; Cellular component=nucleus; Biological process=regulation of transcription
  Homolog annotation: Hit_ID=Q5JM93; Match level="QueryCoverage=92%, HitCoverage=53%, E-value=5e-20, Identity=33%"; Hit description =Putative WRKY DNA-binding protein 49
  Pfam annotation: Domain name=WRKY; Domain location=5-43; Score=45.6; E_value=1.7e-10; Accession=PF03106.6; Description=WRKY DNA -binding domain
MMNYRSYYRCTNPRCSAKKQVERSNEDPDTLIITYEGLHLHFAYPYFLMGQQQQSHSYPPIKKSKPTSPQAQDQTHRADYVHEAHQTEEAQSNATMGVMPSSTSLDSTLDMAQESLGSQGLLEDMVPFMVRNPSNNVNSAHTKFSCSSYRSPPTSPLWASTYSTTCYTVGLNSST

SEQ ID NO: 122484 - protein, 280 aa, Glycine max
  Coding DNA Sequence Number=SeqID_5706
MADVYSAPEEIHGLLSYCQHMIDLMEHMKVDMSAFKEQMTSMMEAMLGMKQLMESNAATATATSTAAEADPALPTAAHHPVPNMVGRERSTSGHISNPHPGYNRGEPPRHPDMVHENPREHAQRDVDSYSPFPAEGPVPNALPQPNITREPRNHPMQPMFLSVGGPPLAAEGKGKLNLIEERLRAVEGFGDYLFIDMTDLCLVLDVVILLKFKAGATIIWYTNLEASRIRTWKDLITAFLRQYQYNSDMAPDRTQLQNMIKREHESFKEYTQRWRDLATQ

SEQ ID NO: 122485 - protein, 134 aa, Glycine max
  Coding DNA Sequence Number=SeqID_5707
  Gene Ontology: Mol. function=pyridoxal phosphate binding; Biological process=amino acid and derivative metabolic process
  Homolog annotation: Hit_ID=Q0LJD6; Match level="QueryCoverage=87%, HitCoverage=25%, E-value=2e-29, Identity=55%"; Hit description =Pyridoxal-dependent decarboxylase
  Subcellular localization annotation: CTP_CleavageSite=13; ConfidenceScore=5.18e-01
MASESGRLATVVSASRPMPSMLSAFTLLECGLAASTWTGPSAARPCWAISTPCCCPSHCRPMASPAKLAMVAPLTRLPLNASGRPSRDFNCVTAASSIAAAIVSWLSWLFWSVTLTSQSAATAAGVPPPVTKPK

SEQ ID NO: 122486 - protein, 211 aa, Glycine max
  Coding DNA Sequence Number=SeqID_5708
MDLVGPPKECIGENQLPLSGVIPGKKVQTGDAQKENPTKGPFEALSAGKSSHIVGSGPPKECIGENQLPLSGVIPGKKVQTGDAQKENPTKGPFEALSAGKSSHIVGSGPPKECIGENQLPLDGVIPGKKVQTHDAQKENPTKGAPFEALSAGKSSPIVDSGDIRRADAECNKSNIEKSDLRSVQENLNLHCKFLPSSFPAWRYVPLFPCH

SEQ ID NO: 122487 - protein, 82 aa, Glycine max
  Coding DNA Sequence Number=SeqID_5709
MGGKCAESPPTFIRGKRRKNRKRRGLRTLSVKGSGVVFTHGEGTYQLKIEERTKNDEERWKIFAKSPTKTSRKHYGSASAYS

SEQ ID NO: 122488 - protein, 324 aa, Glycine max
  Coding DNA Sequence Number=SeqID_5710
  Gene Ontology: Mol. function=nucleoside-triphosphatase activity; Cellular component=membrane; Biological process=protein folding
  Homolog annotation: Hit_ID=Q6ETV8; Match level="QueryCoverage=93%, HitCoverage=44%, E-value=2e-80, Identity=48%"; Hit description =Putative endopeptidase Clp ATP-binding chain
  Pfam annotation: Domain name=AAA_2; Domain location=140-305; Score =289.0; E_value=8.9e-84; Accession=PF07724.4; Description=ATPase family associated with various
  Pfam annotation: Domain name=AAA_5; Domain location=144-301; Score =18.0; E_value=7.5e-05; Accession=PF07728.4; Description=ATPase family associated with various
  Pfam annotation: Domain name=CobU; Domain location=145-281; Score= -84.2; E_value=0.068; Accession=PF02283.6; Description=Cobinamide kinase  cobinamide phosphate guanyltransferase
  Pfam module annotation: Pfam domain module=AAA_2::AAA_5::CobU; Domain location=140-305::144-301::145-281
MDAANLFKPMLARGQLRCIGATTLEEYRQYEEKDAAFERRFQQVFVAELSVVDTISILRGLKERCEGHHGVWILGRALVDIFRTKQIDLVDEACANVRVQLDSRPEEIDNLERKRMQLEVELHALEKEKDKASKARLVEQPTGSFLFLGPTGVGKTELAKALVEQLFDEKNQLVRVDMSEYMEQHSVSRLICAPPGYVGHEEGGQLTEAVRRRPYSVLLFNEVEKAHTSVFNTLLQVLDDGRLTDGQGRAVDFRNTVIIMTSNLGAEHLLTGLFGKSSMQVARDRVMQVRSLCFLFNMYDRVSLAVKKMKIEQIDDDEDGEMEE

SEQ ID NO: 122489 - protein, 57 aa, Glycine max
  Coding DNA Sequence Number=SeqID_5711
  Gene Ontology: Mol. function=N-acetyltransferase activity; Biological process=metabolic process
MPVSPSRDQLVRFGHALFEYGLTASIYDVMVIPSLQRMGIGQMIVKKIVRYAVVDET

SEQ ID NO: 122490 - protein, 113 aa, Glycine max
  Coding DNA Sequence Number=SeqID_5712
MRGVEGVTVWPGDPPRHSPLMHDDTFVELDIPQHPVAAVAIDEALAIAPTHEACQAITGRLKLLLNLRIVTKGTKTFSVMEDCLRIAKGVIAKRNVYVQLRRRWRMEDADEDL

SEQ ID NO: 122491 - protein, 82 aa, Glycine max
  Coding DNA Sequence Number=SeqID_5713
MENGVYMLGVAEDGDKNGTVRQCNAELVDIHGFGSGRESVGRVVAINEEVLETVRVHMAWVGRNHVTIFVLCVWATQEVWSG

SEQ ID NO: 122492 - protein, 97 aa, Glycine max
  Coding DNA Sequence Number=SeqID_5714
MDCEDGANKEVQELVVGVRRPKGFFPLGGSGTSLASMESLSMPQVQEVVLSADMQCERYQKRVTDIIAKMNGAFDSQEEERGNAYIIHKRWSLLVST

SEQ ID NO: 122493 - protein, 173 aa, Glycine max
  Coding DNA Sequence Number=SeqID_5715
EKVVSVFGPGNLRVSQDWVGNEWIYVRERPDLVASVLSSLKTKQNSNNSQSTGATTRDVIQSGQSDTCLDSDKDRPRKPEVVPDLLKNDLLSQLRWKTTRKRRRWSSATSYQKPQCTDTHQKRSPNVVTSNAPDSFVIPASLKVDHDDCKYVGDPSIFSSSVVPSLTNMVMCR

SEQ ID NO: 122494 - protein, 117 aa, Glycine max
  Coding DNA Sequence Number=SeqID_5716
MDPTVEIGFDAGKERKLSGEAKLRKCPGDLVELRVCQFFGQKKKNADGNRWCRPKLPVEKRKNGKTRSLSMPGGRIAKVKRVLLGAHSIFAAHSIFAGPPSTQDERAMSFTLCYKIK

SEQ ID NO: 122495 - protein, 425 aa, Glycine max
  Coding DNA Sequence Number=SeqID_5717
  Gene Ontology: Mol. function=RNA binding
  Homolog annotation: Hit_ID=Q69N36; Match level="QueryCoverage=94%, HitCoverage=42%, E-value=3e-46, Identity=31%"; Hit description =Agenet domain-containing protein / bromo-adjacent homology (BAH) domain-containing protein-like
  Pfam annotation: Domain name=Agenet; Domain location=373-425; Score =34.7; E_value=3.2e-07; Accession=PF05641.3; Description=Agenet domain
  Pfam annotation: Domain name=BAH; Domain location=150-264; Score =31.7; E_value=2.6e-06; Accession=PF01426.8; Description=BAH domain
  Pfam module annotation: Pfam domain module=Agenet::BAH; Domain location=373-425::150-264
MGTTSCEKKSVVYVSWDEVFVSNDKGRREVHYLLKRRGGGSDLAVLGKEKSLLRHMSYRYAIRNAALFKPYLKLRSRREVVDWLDSIVSDSSSGDAVMVGKHGYEPEIGALKDNQLQKMHSCTKEFSWIGLPWTCKKRRKHYQAYKRNGFQISVHDFVFVLAEEDKRLVAYLEDLYEDSRGNRMVVVRWFHKIDEVGIALPHSFSDREVFFSLYLQDLSIECIDGLAFVLSPGHYKKFQNEACRTHLEPFMCNHQFDNDDVKPFDITRIKGYWKQEILRYMYAQLDLKSSGSSGQSDVSLELDENHTSTAFVRPKKRLCLTEAADAKEAADLVGLSTENLNNSNTGNNSGKLVGHTNKTATIKGKNEHASHHLIVGSQVEVLSQDSGMRGCWFRASVIKKHKDKVKVQYQDILDAVDETKKLEVC

SEQ ID NO: 122496 - protein, 100 aa, Glycine max
  Coding DNA Sequence Number=SeqID_5718
MIYVNPDPGSQAAGGGTRRRVRCQADIPYGHPHLSSTKANEFDGFYSRLPETFKPDDTRDSSLLGGDDQAIACGNVMGVQIATKSTWAFMRVPTKGGAFW

SEQ ID NO: 122497 - protein, 663 aa, Glycine max
  Coding DNA Sequence Number=SeqID_5719
  Homolog annotation: Hit_ID=Q2QN51; Match level="QueryCoverage=80%, HitCoverage=77%, E-value=1e-111, Identity=45%"; Hit description=Leo1, expressed
  Pfam annotation: Domain name=Leo1; Domain location=215-575; Score =402.7; E_value=5.2e-118; Accession=PF04004.4; Description=Leo1-like protein
MGGEEKRHQMMQNLFGDQSEEEEELDVDSEHESNPQLNYPSVHPNSTNPNLFLTPRLDPEPFPNSFRGEGVGEQEGEVEGQGEVEIESDGDGEPDRESEGEREQSSQEVEVVEREEESEGRDSDSDAKDGGYSQHGVTSKRRDDVVESGSERSEENQYAHHDDGEEVDEARSPSGSPRDEKDETRDLHAAPEIRDVFGDFDDDEEEDIGYAVQQDIRQDSNRYAVEEEGSYGKNLRPEDILADEDNQYESEDENIEIKTKEKPLGPPLELEVPLRPPPALPEKMNMIKVSNIMGVDPKPFDPKTYVEEDTFVTDESGTRKRIRLENNIVRWRTTRNPDGTTSCESNARFVRWSDGSLQLLIGNEVLDISVQDAQHDQAHLFLRHGKGILQSQGRLLRKMRFMPSSLSSNSHRLLTALVDSRHKKAFKVKNCITDIDPEREKEEKEKAESQNIRANVLLNRKREKVNRKYTPAVERRRQLSPGFLEDALDEEDEADYYDNHRSQRRFEDDLEVEARAEKRIMNAKKSRGPKDIPRKSSFPPAKSSRNPMGYPDDEREESEYETEEEEDERPPSRKRDEDTEPEYEDEEEEEEHYEEAEQVNDASDDGEEEDYCTCVLFVLEPKQKSKEFRGSAKRKGFESDDDSSPRKITTHRRMAVVYDSDED

SEQ ID NO: 122498 - protein, 85 aa, Glycine max
  Coding DNA Sequence Number=SeqID_5720
MSYENEGEDNSKLRVKINEYVNLHDPLIVCGLNALHGLGLAGEVKVVVPHDDTGGHDKLAMEAKGANIVEEKEREKPMEGKEAGG

SEQ ID NO: 122499 - protein, 174 aa, Glycine max
  Coding DNA Sequence Number=SeqID_5721
  Gene Ontology: Mol. function=protein dimerization activity
  Homolog annotation: Hit_ID=Q8LNK9; Match level="QueryCoverage=53%, HitCoverage=12%, E-value=1e-15, Identity=50%"; Hit description =Putative transposable element
MEQSTCSNIRQVVCITPKTCGLQAAKRGGIWLPLDIILMALRTCKVKFWGFIYVLAPHSSDRLCNALVDCLMDWNIDTKLSTITLDNCSTNDIMINKIKDELQLGNLLRCRKRGTNRIAAFGTGYSARPKSHLGFDGCLLDPETKPQERAKWSFMKISDPKFAQASIQLAWAKM

SEQ ID NO: 122500 - protein, 68 aa, Glycine max
  Coding DNA Sequence Number=SeqID_5722
MAKSYVESKVVTEFEFASLMNEIGSNDEGEMGRGGETRHPTEGGARSEFLTPNQDQGARMVWDVGGRE

SEQ ID NO: 122501 - protein, 92 aa, Glycine max
  Coding DNA Sequence Number=SeqID_5723
  Homolog annotation: Hit_ID=Q1RT79; Match level="QueryCoverage=71%, HitCoverage=18%, E-value=5e-08, Identity=58%"; Hit description =Terpenoid cylases/protein prenyltransferase alpha-alpha toroid; Bacterial adhesion
MMSGGHVHHYSVQRGHPVEVIDDRGSIDCMHWEWKNYLVAQKGQFYRGDAPHHKTYGFDMHILGFWVQTMTSKCSKESPVFNEIMKGEAYTV

SEQ ID NO: 122502 - protein, 84 aa, Glycine max
  Coding DNA Sequence Number=SeqID_5724
MAICRAIGNRQSNWRVPTAEGACHGSEGQSASRQSRPNRQWQWRFALGMDRQPCWRVAPKYASSIIKAQSESAPATLPSWLSPR

SEQ ID NO: 122503 - protein, 50 aa, Glycine max
  Coding DNA Sequence Number=SeqID_5725
MVGYEHNWTFQGGGMSTRMMAHVEFESSYGDKNEGLGKVGSRIRLLMLKL

SEQ ID NO: 122504 - protein, 104 aa, Glycine max
  Coding DNA Sequence Number=SeqID_5726
MKDAKVVMTRSKKVQNDFEKKEDSSPKVTNDILTIKDETPKKVKKLGITNLEPTNITLYLANHSVVYPRKAIEDVLVKVDKFIFRVDFVIVDIKADEDAHVILG

SEQ ID NO: 122505 - protein, 69 aa, Glycine max
  Coding DNA Sequence Number=SeqID_5727
  Subcellular localization annotation: CTP_CleavageSite=33; ConfidenceScore=5.18e-01
MGMSPPPLGPLNHSQNQLTLSGWLPFPTLILPRAQPRRVALSGWLAKPDDWLSEMVKISISQTCLIVMP

SEQ ID NO: 122506 - protein, 167 aa, Glycine max
  Coding DNA Sequence Number=SeqID_5728
MIETSMRAGNAEVYGFLERQSIQRSRQSPDNHLKGIINSALKGLDDTPQPKSKAGARWIVVKCNRQKGSTECGYCVMHWMSIIILGSFKNNWETQKRQKKLAKAIANKDKALETFGLAIKVKRILREQKGKVQTKKPAHQKKEEEKIVIEEQWMKKKHEVPRPSLPV

SEQ ID NO: 122507 - protein, 1788 aa, Glycine max
  Coding DNA Sequence Number=SeqID_5729
  Homolog annotation: Hit_ID=Q9FF08; Match level="QueryCoverage=100%, HitCoverage=99%, E-value=3e-84, Identity=30%"; Hit description =Arabidopsis thaliana genomic DNA, chromosome 5, P1 clone:MXM12
MPGNEVGDRVHNFFGQENLSQGQYHSQAVDGNWPGLSNNLWAGSQRSTGVPFISNLKNFNQQQSDPEQGHASSPHLRHGLNLSQSSFRPESGRNLLPNQQSAVNGYIQGQQVFQTRQHDILGVDTESDWDSLSRGIPVLESQGSGLELYKKNLARNDAAESPVNFDFFGGQQQIGGQHGGMLQPLPRQQSGVNEMHVLKQQAVHNQMQELQRQQQFHQLEAKQHDSMAPTSSISKQVVASHSASLISGIPINEASNLIWQPEVMPTNANWLQHGGSPVLHGSSNGLMFSPEQGQTLHLMGLVPNQGDQSLYGVPISSSRGTPNLYNVQADKPAVPQVSIPHQYSLVLGNKPALQHISAGDNSFSPHQYAACPDQVNTNDGTSVSRQDVQGKNMFGSTAHSINNGPNMENLQQMNPEQRILPMQDFHGRQELAGSLEMLQDKMLVQAPPSQNVATLDPTEEKILFGSDDSLWDGFGSNMGGFNMLDGTDSFSGIPSIQSGSWSALMQSAVAETSSSDIGKQEELSGLSFRNMGQSSGNEPPSTIDSSKQQSIWTDSNLQSASNINSRLFLRPDDGSRPNASENYSGVSGFHQSGPDTSREQHKRLQNNSQRSIPQFLESGKWLDCSPQQKQLAEGGQIYGNAANSSGIEKNQQSMLSGNSSGDPFNKSNGWDIMKSPFDRSSNLKTHESENSLQPHHEKAMCEEMGQVPAMWEPDSDTNSSVGMEHVKSAGNMQVCGEDSGTNGIAALPNSGTAWFSQQSSKQLPNVDVFRDAESAGSYRRNEVPGKYKHHMEKNPLVLESSKNGNVEGEMHDLENSNKKEKSADSLGCNPSHPRAGGMRENSSFDGNDFHNPKLSGQGNRRPPVSRKFQYHPMGDLGVEVEPYGIGNKHVINSQPMPHQPLGVFKGQDQSYLGQSKYGHSDRNYNEMNKLGPVKWGYGIATNTSLSNCHLSSRVPETESSDGSVAHPPQNQSFLSQGIGLQLAPPTQRFPVVCSHGSSETDHTTPHVSETRDKDHTWLGTNQTFPSRDPSHGELRSNISSTAGQIFDKVSQYGVLGNIPQSFTSGFPFSRIHSQNQNLANLGGQVANTQPANVAFTASMNQTDEYCEKAQTSQSELASAQDMSQLSDIDEDRLRDPAIQILTAEAGTQPSVTFSASPHGTPSKVAHNVWTSFSSKQHPNASRFLSQPQQINDCEMITSSQKPGDEGLEKDGNDHSGTDPCIAYSNSSVGNSLKEISAQKTLPESVVAAEQASCSSYLKETVGQHMFDASQPSPTATPRDIEAFGRSLRPNIVLNHNFPLLDQVQFTRNTETDPSNRDVKRLKVSDNMVVDKQLVDSNHGQQLSYGYDNVVKDGSGNNSMPSSDPNMLSFSTKPLDRQDTNASSQEKVGYGEKIALNVDDSNKATSVKSNYSLVNPQMAPSWFERYGTFKNGKMLPMYNVQKMTAAKIMDQPFILPNQSDSLCFHNSVEQIQSVSDAQLSNASESPMSASAASKHVDPQLLTPAVEPGLLVTRPKKRKSATSELIPWHKELLQGSERLRDISVAELDWARSANRLIEKVEDSVEVVEDLSAVVKSKRRLVLTTQLMQQLLSPPPAAVLVADVKLHHESVVYSVARLALGEACSSISWSRCDTLFPPGNKNLLSEKCKSSDKIDHYILKVTDFVGRARKLEDDILSGFGVGLYVPLSGIDYLGDSALSNVPQNSDHCISMVIMRRLHEMTHPTTGGNILSCNSEDLERYSVINRFAKFHGRGQNDGAEASSSSGANTNAQKSFPLKYVTAVPLPRNLPDR

SEQ ID NO: 122508 - protein, 65 aa, Glycine max
  Coding DNA Sequence Number=SeqID_5730
  Subcellular localization annotation: CTP_CleavageSite=51; ConfidenceScore=5.39e-01
MGCSQNGTTQNTHTHTQSQFPPRAPAPAELKPNTHSRDNTQDRKHARNSVSQAAFVSISPRKTAE

SEQ ID NO: 122509 - protein, 34 aa, Glycine max
  Coding DNA Sequence Number=SeqID_5731
MVSAIKNLEVQVGQLAERSTWSFVANTEENSKEE

SEQ ID NO: 122510 - protein, 400 aa, Glycine max
  Coding DNA Sequence Number=SeqID_5732
  Gene Ontology: Mol. function=steroid hormone receptor activity; Cellular component=membrane; Biological process=regulation of transcription, DNA-dependent
  Homolog annotation: Hit_ID=Q7CJ42; Match level="QueryCoverage=58%, HitCoverage=56%, E-value=1e-114, Identity=85%"; Hit description =Putative transport protein
MILFSQIAFRRSLSKEQVKQLASRCVAGCHLGGGDRVPGVHHRPDRLLPDHARLAVRRPGLGGIAAGGVLVQGQPSEKTRTVGDAARLNGKTPAKAGVFLAFVFHFILPGGARFDMHVAAVKAFLLFLAGAARQHLANVAGHAAFVQRSAVQAADKQQGGHQGKQPHAAQVIAGWRLMHAQAELVDHRQNMIENIRLNAFILRPDRGVGEGVDFQRQAFRRRRQLAHHQRHVLVNARVSAQVGFQIGAQRAEVGQAAAVERRGQIDGNLLIVPAQLLGFIIQVAVQQRVALQAALFLFRQEVHAAGVDIQAALDAAPAGFRHRPPVFERVGDQRVGGNGGDGVVPVTHFDRGQADVGDRAVGAVFRHFQPVADLQHIVGGELDAGHQAEDRILEHQHQDR

SEQ ID NO: 122511 - protein, 79 aa, Glycine max
  Coding DNA Sequence Number=SeqID_5733
MSVVKALIDLGANISQMALSMTQLATGGDCSQFSSETAWVCYRGGARTRHGEQLTTYSQYLHTYPDHDTIATKLSTPGG

SEQ ID NO: 122512 - protein, 199 aa, Glycine max
  Coding DNA Sequence Number=SeqID_5734
  Homolog annotation: Hit_ID=Q1SQ35; Match level="QueryCoverage=41%, HitCoverage=79%, E-value=2e-19, Identity=60%"; Hit description=Pol -related
  Subcellular localization annotation: CTP_CleavageSite=50; ConfidenceScore=5.06e-01
LKIKAYHDKKLQRQNFQPGQQVLLFNSRLRLFPGKLKSKWSRPFVIKEVRLHGAVELVDLTTDTPEKRWIINGGTRSGKVIGLESIALSTHLHAQRQADSTHTKRGILAKRTSSDQSLEAESGCIGLGNLGVGGKSEVKVGKHALGLSQGGQVLPQNLPRSPVDIQHESPSWGAQLGCDGVMVWVGVEVLGVGGQLLPL

SEQ ID NO: 122513 - protein, 80 aa, Glycine max
  Coding DNA Sequence Number=SeqID_5735
EYVSSVEGGQLGMVGSCVICGCGESICTIARTPPSTTYDGVVLGDMSWGSGDLGDVRRAPGSQPIKEQRPQSKEACVVAG

SEQ ID NO: 122514 - protein, 89 aa, Glycine max
  Coding DNA Sequence Number=SeqID_5736
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=22%, E-value=2e-21, Identity=62%"; Hit description =Integrase, catalytic region
MNKGTKILLQNANEDFCLDIRLWVVGSAHAELGATQLKKVLARKCLLTGGPCWIQGFTEIHGVCKQCPRKAQRPCRRCNEVGEHRDGFP

SEQ ID NO: 122515 - protein, 230 aa, Glycine max
  Coding DNA Sequence Number=SeqID_5737
  Homolog annotation: Hit_ID=UPI0000612705; Match level="QueryCoverage =37%, HitCoverage=91%, E-value=3e-11, Identity=30%"; Hit description =UPI0000612705 related cluster
  Pfam annotation: Domain name=PT; Domain location=3-38; Score=5.6; E _value=0.18; Accession=PF04886.3; Description=PT repeat
  Pfam annotation: Domain name=PT; Domain location=51-86; Score=2.7; E _value=0.39; Accession=PF04886.3; Description=PT repeat
  Pfam module annotation: Pfam domain module=PT::PT; Domain location=3 -38::51-86
TSSPSEDYTSSPSEGYTLSPSEEYTSSPSKGCTPSPSEDYTSSPSAGYTPSPSEDYTSSPSQGYTPSPSEDYTSSPSEDYTSSPSEGCTPSHVLAFRGLHILAFRGLHICAFRGLKVSMHVAQLISDAIHYCRDHAHKTPNGPGGAQQGPGVSSSGYGPLSVLQGARPPQQGIVPARHLVDPKKSNRVLGFPALITGLYQFYGVPVAPTKVIRPPNNRAFIKKYYAPRQA

SEQ ID NO: 122516 - protein, 217 aa, Glycine max
  Coding DNA Sequence Number=SeqID_5738
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELAGSPRNALRRSS

SEQ ID NO: 122517 - protein, 119 aa, Glycine max
  Coding DNA Sequence Number=SeqID_5739
  Subcellular localization annotation: CTP_CleavageSite=15; ConfidenceScore=5.35e-01
MIESSKFFYHISRAKAGSGQSHSGCTTTTTSHPSSSLLLFCRPIFLLFSAGAALADDAEPPPQPAPHHPEPAPGCLARSPALFYRGGDTFGAGNDDVAKTRADDDYVADITAPQGSWAP

SEQ ID NO: 122518 - protein, 105 aa, Glycine max
  Coding DNA Sequence Number=SeqID_5740
MKTVSNVKPKRVNWKSKEACLVRPRLSENNTLSANMIIQESMANSRKSHTLSVRITVILAKRDKCAQHEGCMKTKLIHTYKRRRENKGETHRNFKRIQFFIEGKD

SEQ ID NO: 122519 - protein, 90 aa, Glycine max
  Coding DNA Sequence Number=SeqID_5741
MTKILSYVGVHSVISLILAFILNRAAHHHRQKGITKCGYYVMHWMSTIILGSFRNNWETYFNEVRPLEAERFKALRIQWAQYYLKVRNQT

SEQ ID NO: 122520 - protein, 131 aa, Glycine max
  Coding DNA Sequence Number=SeqID_5742
  Subcellular localization annotation: CTP_CleavageSite=27; ConfidenceScore=5.63e-01
MVKNQSNQISLPTPQRDTCPTLPRKVELMMGSGRSRRRLPVNVLSCRRFRKTGSRKYLRSIRLRQERGLRTIGRIELAYGRIEVRATRFLDLAQFLTKLHKISSTSSNMDNRSKEQLCACKVYVAGHLALG

SEQ ID NO: 122521 - protein, 178 aa, Glycine max
  Coding DNA Sequence Number=SeqID_5743
  Homolog annotation: Hit_ID=Q1SFC5; Match level="QueryCoverage=84%, HitCoverage=20%, E-value=4e-30, Identity=44%"; Hit description =Asp/Glu racemase
MSQGQAVPFAGKWQRFTVRNDGEKVVPEPYGDTEQTETWESEVMIPFAVERTVYAFGGPLPDKASLSSKMNKVFPCYQTCEPRIFDSEPYNFNCLSKPHKLFRSAPSIAHRDYLPWLDRVEQAYEDFWKTYGIFDLIQFSRSGPEYRPEMLIAAMHFFESSTNTFQFKCGMMTPTLLD

SEQ ID NO: 122522 - protein, 432 aa, Glycine max
  Coding DNA Sequence Number=SeqID_5744
  Gene Ontology: Mol. function=RNA binding
  Homolog annotation: Hit_ID=Q1T290; Match level="QueryCoverage=77%, HitCoverage=85%, E-value=3e-53, Identity=41%"; Hit description =Cyclin-like F-box
  Pfam annotation: Domain name=F-box; Domain location=85-132; Score =37.1; E_value=5.9e-08; Accession=PF00646.23; Description=F-box domain
MTRQVWAIMVKQALWVTFGYYLWILNFFHLRGKLPCERNSHLTRRFLKYKCEVSMEGKETEGMLKMTTDKRQQKRSRSDREEERDRLSELPDCVVLHIMEFMDTKYAVQTCVLSKRWKDLWKRLTYRGFNTTLFNNVVKFNKFVSGVLSGRDGSVSLLNLEFTRRGMAEPKLFNRLMKYAVLHNVQQFTVSLNLSFRQSFEFRPYIFSCESLTFLKLSFNSFDTSIVALPGSLNMPALKSLQVEAVSFTARDNDYAEPFSTCNVLNTLILDGCSLHKDAKFLSISNSSLSSLTISGSFEGGASKIALSTPNLSSLTVTGHNNHTISSACNLSFLEEVTIDTLGYTLFPNTDLLIISWLQVLTNVKILRLYSGTLLTILRDISNPVSVSTQPPCFVQLKSLILENQPSADISFEQLKRAVEYLLQNSPQRRID

SEQ ID NO: 122523 - protein, 32 aa, Glycine max
  Coding DNA Sequence Number=SeqID_5745
MVSKQIDPGTCHLSNVEVKQHGPMAVVNGGAS

SEQ ID NO: 122524 - protein, 250 aa, Glycine max
  Coding DNA Sequence Number=SeqID_5746
  Gene Ontology: Mol. function=binding; Cellular component=membrane; Biological process=transport
  Homolog annotation: Hit_ID=Q1SUF7; Match level="QueryCoverage=93%, HitCoverage=91%, E-value=1e-104, Identity=48%"; Hit description =Mitochondrial carrier protein
  Pfam annotation: Domain name=Mito_carr; Domain location=107-216; Score=55.0; E_value=2.5e-13; Accession=PF00153.17; Description =Mitochondrial carrier protein
  Pfam annotation: Domain name=Mito_carr; Domain location=23-102; Score= 74.9; E_value=2.6e-19; Accession=PF00153.17; Description =Mitochondrial carrier protein
  Pfam module annotation: Pfam domain module=Mito_carr::Mito_carr; Domain location=107-216::23-102
MAVQSSTSSESQASENVMHRHFFLWREFLWGAVAGAFGEGMMHPVDTVKTRLQSQAILNGIQVDGLKGFYRGVTPGIIGSLATGATYFGVIESTKKWIEDSHPSLRGHWAHFIAGAVGDTLGSFVYVPCEVMKQRMQIQGTIASWSSVVVNDGIAIKPGTQIYGYYTGMLHAGCSIWKAQGLKGLYAGYLSTLARDVPFAGLMVVFYEALKDAKDYVEQRWISSPNWHVNNSVEGLVLGGLAGGMSSALP

SEQ ID NO: 122525 - protein, 76 aa, Glycine max
  Coding DNA Sequence Number=SeqID_5747
  Homolog annotation: Hit_ID=Q1RV57; Match level="QueryCoverage=80%, HitCoverage=13%, E-value=4e-24, Identity=82%"; Hit description =ENSANGP00000004406, related
MGNKLNIPYLFARLILGEDHMYQRPVYIRTKECSVNSPDYGPLPPDSPGWCLAPFDPEGILRSKSIPCSLLLSFLL

SEQ ID NO: 122526 - protein, 167 aa, Glycine max
  Coding DNA Sequence Number=SeqID_5748
  Homolog annotation: Hit_ID=Q9FNQ3; Match level="QueryCoverage=64%, HitCoverage=29%, E-value=3e-09, Identity=31%"; Hit description =Arabidopsis thaliana genomic DNA, chromosome 5, P1 clone:MAF19
MPSVLQLESLPVLNALTDIFQDNSPRLQDIALYFFPSELTERSRKNLDSILKFLNAEKSMLRSYINGVELLVFTSNQLDMDSKGAIAAVNAGHFLWGMFRQKKIDKAIERVPDMEPVDMDIDMIGGKDVVERADVVRNCKPKSASLMEDYNKLDVPPGFEEFTKMSK

SEQ ID NO: 122527 - protein, 292 aa, Glycine max
  Coding DNA Sequence Number=SeqID_5749
MLFPPHFSYCMRFNTLIVPIDWICEPCKSKDVSTSPHEVNQGIGLRASKMRQPVKTGKVKFLPEDEVLRLYSGNFPLATTRKTSVGSKNVVSKIPSQTPKPYPCISPPKVLGKLSRNDEVHKKSMTNQHASCSLSKGPPKECIGENQLPLGGVIPGKKVQTGDAQKENPTKGPFEALSAGKSSHIVGSGPPKECIGENQLPLSGVIPGKKVQTGDAQKENPTKGPFEALSAGKSSHIVGSGPPKECIGENQLPLSGVIPGKKVQTGDAQKENPTKGPFEALSAGKSSHIVGS

SEQ ID NO: 122528 - protein, 257 aa, Glycine max
  Coding DNA Sequence Number=SeqID_5750
GAWERYEQNVHSLNILPKRNVNLYITEYDEFRRELERRCWHKALTRQLDDRIDVALVKEFYANLYDPKDKSPRQVRVWGKLIKFDGDSLNTFLETLVGASWKLLWKDLTTLAQTWSVLSYSNLTLTSHMSDLNMDRARLVYGLVMKMDMDVGSFISGQISQMAQSNSSRLGFPALITTLCIARGVVLDSLTFESLSPAINLAYIRKNCWNSDDPMITFMGTRKARARVPTDASTPPALTPVPAPSSPSTQSTDILVS

SEQ ID NO: 122529 - protein, 44 aa, Glycine max
  Coding DNA Sequence Number=SeqID_5751
TKPNSVHLRYCFMFQCTLRVRLIASEPKLRSCLMDEGLTGVCGA

SEQ ID NO: 122530 - protein, 177 aa, Glycine max
  Coding DNA Sequence Number=SeqID_5752
MERIASLAQYYDQPLRCFIFGDFQLSPMVEEFEEILGCPLGGRKPYLFSGFYPSLARISKKVQISAQELDRQRQVENGGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGVC

SEQ ID NO: 122531 - protein, 61 aa, Glycine max
  Coding DNA Sequence Number=SeqID_5753
TSSKGIRPPTNRAFIKKYCVSRQAQGETPQQLGDGQQRATDAPPSPLEFTSAHPHKGRKIP

SEQ ID NO: 122532 - protein, 104 aa, Glycine max
  Coding DNA Sequence Number=SeqID_5754
MRLSASSMSDKRLETNSAPLVIQEQRVECKSRGGRRQIMVIPYTCSPSRGERVRWHAETIYGHSASCRPGSIVSNNTKRQIIVIMRLVSTKRNKFDSIRMMCRY

SEQ ID NO: 122533 - protein, 83 aa, Glycine max
  Coding DNA Sequence Number=SeqID_5755
MDIKSNFLSSKITFKNEKNILQRELRAAPIIIFKLMSSRCLEECTPDMHLEQIVAKVLRIVICWNKKKLTLRERKQVTCHKNL

SEQ ID NO: 122534 - protein, 46 aa, Glycine max
  Coding DNA Sequence Number=SeqID_5756
MEIFELGIAKSNSKVQRKGILGWKTLRSKIVSKFEISVEAAMEKVV

SEQ ID NO: 122535 - protein, 76 aa, Glycine max
  Coding DNA Sequence Number=SeqID_5757
MYIKKAPGQGLLYEDKGIIQISRYCDANWDGCPIDSDAILPGKGLVTRAMSKRLQEDWARAAEEGLRVLMNLKVDF

SEQ ID NO: 122536 - protein, 181 aa, Glycine max
  Coding DNA Sequence Number=SeqID_5758
  Homolog annotation: Hit_ID=Q8SAE5; Match level="QueryCoverage=37%, HitCoverage=20%, E-value=3e-13, Identity=64%"; Hit description =Ankyrin-kinase
  Subcellular localization annotation: CTP_CleavageSite=78; ConfidenceScore=5.06e-01
SQSLTLTHLTVLQLPLFFSASHSHSPCRAISGGEGRDLDGAHGNFGGRSLFFSFVTSFLLLFCGILSPRGRQHEKHCGAAKARHLAAVLVWVIMKEPLTEVHMPGLAGSAVEQPALQHRQLLFMACHDDAKGVRDLLNEGLRRDLHPWKRVFGESTILRISLAMAVEDKWCMVIEGRGFAA

SEQ ID NO: 122537 - protein, 401 aa, Glycine max
  Coding DNA Sequence Number=SeqID_5759
  Homolog annotation: Hit_ID=Q017M3; Match level="QueryCoverage=28%, HitCoverage=12%, E-value=2e-07, Identity=32%"; Hit description=[S] KOG1032 Uncharacterized conserved protein
  Pfam annotation: Domain name=C2; Domain location=17-103; Score=35.7; E_value=1.6e-07; Accession=PF00168.20; Description=C2 domain
  Pfam annotation: Domain name=GRAM; Domain location=199-263; Score =26.7; E_value=8.1e-05; Accession=PF02893.10; Description=GRAM domain
  Pfam module annotation: Pfam domain module=C2::GRAM; Domain location =17-103::199-263
MGQQPKVDSHTSLVYLIKVELFTAKDLVGAKLIGKPDPYAVITCGNEKRFSSMVPGSRNPMWGGGKGEVFNFSVDELPVQRECWGSTYSGNDGAISSQMVWACGEGIGILCSRKLPAFMRSTNGDHLMKIRRMINVTIYDWYKCRDNAILGSVTVPLKSNGQTGPVWHTLDSPSGKSLIDWTDRIHCYGEATVVHQKPGPLQTIFDLHSDEVIDHRYICALETSFLYQGDMYVSAWNICFYSNMFSKEMKIQRSELALINPAITIILRKGAGGHGVPPFSPLGSPDGRVGCMFASFVDRNKALENLQRASKNFHEILEAGKENAEPELRALSDSARGSKALDKALEESMPKTGKLQPFIKEEALVGMNDEVLPCIDEQFSNLLLNDDGSNFSSKSFHMEGC

SEQ ID NO: 122538 - protein, 159 aa, Glycine max
  Coding DNA Sequence Number=SeqID_5760
KECTLRRPYQMLARARVMSEIEEVQEQMKVDMKAMKEKMTTMMEAMISMRKMMEVNTTTVVATSTATEVDLTHPPGFNQVQNKHSFPPYGLPPNYTPPNVAHTPDENTHEAPQDHTLADFEPHLGCATEGQAFGRGYAFAHMAELCLVPDVVIPPKFRV

SEQ ID NO: 122539 - protein, 407 aa, Glycine max
  Coding DNA Sequence Number=SeqID_5761
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=85%, E-value=7e-84, Identity=35%"; Hit description =Leucine-rich repeat
  Pfam annotation: Domain name=LRR_1; Domain location=118-140; Score =1.5; E_value=1.5e+02; Accession=PF00560.23; Description=Leucine Rich Repeat
  Pfam annotation: Domain name=LRR_1; Domain location=142-164; Score =8.2; E_value=8.3; Accession=PF00560.23; Description=Leucine Rich Repeat
  Pfam annotation: Domain name=LRR_1; Domain location=166-188; Score =9.4; E_value=4.9; Accession=PF00560.23; Description=Leucine Rich Repeat
  Pfam annotation: Domain name=LRR_1; Domain location=17-39; Score =11.7; E_value=1.9; Accession=PF00560.23; Description=Leucine Rich Repeat
  Pfam annotation: Domain name=LRR_1; Domain location=190-213; Score =6.1; E_value=20; Accession=PF00560.23; Description=Leucine Rich Repeat
  Pfam annotation: Domain name=LRR_1; Domain location=215-238; Score =6.2; E_value=20; Accession=PF00560.23; Description=Leucine Rich Repeat
  Pfam annotation: Domain name=LRR_1; Domain location=263-286; Score =5.6; E_value=25; Accession=PF00560.23; Description=Leucine Rich Repeat
  Pfam annotation: Domain name=LRR_1; Domain location=288-310; Score =4.1; E_value=49; Accession=PF00560.23; Description=Leucine Rich Repeat
  Pfam annotation: Domain name=LRR_1; Domain location=312-335; Score =4.1; E_value=50; Accession=PF00560.23; Description=Leucine Rich Repeat
  Pfam annotation: Domain name=LRR_1; Domain location=361-382; Score =9.3; E_value=5.1; Accession=PF00560.23; Description=Leucine Rich Repeat
  Pfam annotation: Domain name=LRR_1; Domain location=41-63; Score =21.1; E_value=0.004; Accession=PF00560.23; Description=Leucine Rich Repeat
  Pfam annotation: Domain name=LRR_1; Domain location=65-87; Score =15.3; E_value=0.23; Accession=PF00560.23; Description=Leucine Rich Repeat
  Pfam annotation: Domain name=LRR_1; Domain location=89-111; Score =1.1; E_value=1.7e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=118-140::142-164::166-188::17-39::190-213::215 -238::263-286::288-310::...
  Pfam module annotation: Domain location=312-335::361-382::41-63::65 -87::89-111
VDSRGSHIPDCLYGLHRLKSLDLNSCDLHGTISDALGNLTSLVELDLSHNQLEGNIPTSLGNLTSLVELHLSYSQLEGNIPTSLGNLCNLRVINLSYLKLNQQVNELLEILAPCISHGLTRLAVQSSRLSGNLTDHIGAFKNIVQLDFSKNLIGGALPRSFGKLSSLRYLDLSMNKFSGNPFESLRSLSKLLSLHIDGNLFHGVVKEDDLANLTSLTEFVASGNNFTLKVGPNWIPNFQLTYLEVTSWQLGPSFPSWIQSQNQLHYVGLSNTGIFDSIPTQMWEALSQVGYLNLSRNHIHGEIGTTLKNPISIPTIDLSSNHLCGKLPYLSSDVLQLDLSSNSFSESMNDFLCNDQDKPMLLEFLNLASNNLSGEIPDCWMNWTSLVDTCSLYKFVTTYSQEYFQPV

SEQ ID NO: 122540 - protein, 139 aa, Glycine max
  Coding DNA Sequence Number=SeqID_5762
  Gene Ontology: Mol. function=sugar porter activity; Cellular component=integral to membrane; Biological process=carbohydrate transport
  Homolog annotation: Hit_ID=P0AEP1; Match level="QueryCoverage=99%, HitCoverage=29%, E-value=9e-46, Identity=69%"; Hit description =Galactose-proton symporter
MTLFVCFLAALAGLLFGLDIGVIAGALPFIAKDFNVTAHQQEWIVSSMMFGAAVGAVGSGWMSSRLGRKKSLMAGAILFVIGSLWSAMAPNPEMLIAARVVLGLAVGVASYTAPLYLSEIAPEKIRGSMISLYQLMITI

SEQ ID NO: 122541 - protein, 70 aa, Glycine max
  Coding DNA Sequence Number=SeqID_5763
MTLPNIITAIQSSITDNGVMPIINALWYRCHVYQFNGEVQYRRCGAMSNLTLTCTNTPLKCGVVHCSLTC

SEQ ID NO: 122542 - protein, 176 aa, Glycine max
  Coding DNA Sequence Number=SeqID_5764
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=99%, HitCoverage=15%, E-value=2e-87, Identity=81%"; Hit description=DNA -directed RNA polymerase beta'' chain
MDSVGIRSANPYLATPGATVHGHYGEILSEGDILVTFIYEKSRSGDITQGLPKVEQVLEVRSIDSISMNLEKRVDTWNGRITKILGIPWGFLIGAELTIAQSHGMSNVFLPGELIGLLRAERAGRSLEEAICYRVLLLGITKTSLNTQSFISEASFQETARVLSKAALRGRIDWLK

SEQ ID NO: 122543 - protein, 104 aa, Glycine max
  Coding DNA Sequence Number=SeqID_5765
MANKNISSNEASTPTLIPKTIPKLQNSLRVGKGNISSKGLSKELIQGRLIWLEAYKNKMPKSSPNMHAKQEVSTRVKPRLLCKQSMGQNTPNKIDDDGSNSHQG

SEQ ID NO: 122544 - protein, 52 aa, Glycine max
  Coding DNA Sequence Number=SeqID_5766
MASEVGAAINPYIFRHRCWADNGSSIVSKDRAMMLTGSLTPRKMAIAVAAVK

SEQ ID NO: 122545 - protein, 55 aa, Glycine max
  Coding DNA Sequence Number=SeqID_5767
MGHLRFVILFGRNNQHENTEKGVPMNPKRIKVIPEWPAPPSVLRKKAQRFKNLGI

SEQ ID NO: 122546 - protein, 287 aa, Glycine max
  Coding DNA Sequence Number=SeqID_5768
  Homolog annotation: Hit_ID=O42388; Match level="QueryCoverage=32%, HitCoverage=76%, E-value=2e-31, Identity=74%"; Hit description =Ubiquitin-ribosomal protein fusion protein
  Pfam annotation: Domain name=ubiquitin; Domain location=6-70; Score =75.3; E_value=1.9e-19; Accession=PF00240.13; Description=Ubiquitin family
MQIFVKTLTGKTITFKVESRDTIDNVKGKIQDKEDQQCLIFVEKQLEDGRTLADYNIKKESTFHLLLKLRGGIIKPSFMALARKYNLDKMIFHKGTDTEGLGEEDNGGGMGNEIGGTSGVLVLGGCEAGLKGMEENRPGVFHVLYSKNWVILNIQPNGLEPSKRGTSNFIQWGYKEGEDDGMVVDEEGEGIGDLGVARVVISVSRYLRASGLRHSNKSTKLLGYSSQSWTSRARTSLEKRKWKGPYGKRKIFLVADKIKELPLCQPSQQKRLYETFEILQKIDYKDI

SEQ ID NO: 122547 - protein, 279 aa, Glycine max
  Coding DNA Sequence Number=SeqID_5769
LGRIDGDPVLRETRIWATWEYVSSDGGGQQGMGSGDLGDVRRAPGSQQIKGTKTTKQGGLWWLASCESCVIYGLWPLVIDYQGLENEVRKLGELLVIDYQGDVIDYQASERNWNTVEASGNRLPACVIDYTEGWIVMAAQLIRDRVEMECLEGAWETLEGNTRCRFRGTIRFTATSLVHPDEPARTLQLTVEWILPTPTPYRLVEPVQVIEVTSSEEDPEEDPKELPPEPAVDALDFLEGDEDPLLEVDSPEEVMSASEADSTEDSGPGEMAISGGSSS

SEQ ID NO: 122548 - protein, 82 aa, Glycine max
  Coding DNA Sequence Number=SeqID_5770
MPKNKQRNLGLIEYNEGTKGVKLKKGSILIRHYEKFFVKEGEFVDNMHGRLEVLLNGIKDVGHTNTKAQINLKVLDSFPKVW

SEQ ID NO: 122549 - protein, 243 aa, Glycine max
  Coding DNA Sequence Number=SeqID_5771
APLEEEIVPVISRGFNKTNVETLQKVRKAWEVLQKKDKELRGSNNGPIGGYRKWLKAHVQGLDWLPSLRTAKREEDEAPEEDEEVQALRTELKQAQTVKERFKSAALKIRKENAELRDINIATTKALEQETKRARREEHGRNKSKRSLSQRLCETETNMLAIITKYQEELSLATTHEHRVADGYAQVYAEKEARGRVIDSLHQEATMWMDRFALTLNGSQELPRLLAKAKAMADTDGARPGFK

SEQ ID NO: 122550 - protein, 171 aa, Glycine max
  Coding DNA Sequence Number=SeqID_5772
MEKQFVGKVHGCWNWSENWVKQYEWKEVQFGLRKKSETKLHYVPVLVFNYTILMLEIVAEEDKLKVEKAKFEAQWELLHEKKEELWKEAEYIVEENKAVSEIRYLSIHPMWWHQSLCNWQKHTSSCNNSHRTNFSNGSPCGGIFLQFSVSIYPSRDFAENQRKNKALNVES

SEQ ID NO: 122551 - protein, 138 aa, Glycine max
  Coding DNA Sequence Number=SeqID_5773
MDKFFWALMSDGRFYTKSTYDLLACPNVQSDPSLRNCLWKIPGRPTTRDLPKNKYCHIRGMAEHNDWPLCDLEPDSELHLRPNVFNMDLATWVELNITLKGVMGVMWIGIFALLKLLTKYGTGKGIGFLIGNLHHQHF

SEQ ID NO: 122552 - protein, 53 aa, Glycine max
  Coding DNA Sequence Number=SeqID_5774
LRGTRRSKKVILRININQKLPLLKGSWEFRQGPLHIQMVIERFRLGRVDNPHG

SEQ ID NO: 122553 - protein, 251 aa, Glycine max
  Coding DNA Sequence Number=SeqID_5775
  Gene Ontology: Mol. function=DNA binding; Cellular component=nucleus
  Homolog annotation: Hit_ID=Q0PJJ0; Match level="QueryCoverage=50%, HitCoverage=45%, E-value=5e-21, Identity=72%"; Hit description=MYB transcription factor MYB118
MGLWHMCLLIQSAKLLILTHKRHQKMVQHFMHPCHATFWFSSFGATTSFRWLYFIKKYACTWSTFTYYTKWNCQPHIMLYDITNLDDIGSKGITKITNNSLRGVGNSTKTLPTSEIAKQGKQAPVLHDRSSPRLASGSPGPPNNFMVKKPTCLGKLQLPQSNLFPINRCSKGGFKGEKVQKVRELREERKKTKKEEKMRPKRYRIAIMIIPYIVPCTMFFVRPSGSPLLLCAHPSSPSIIGDLIFLYKIQS

SEQ ID NO: 122554 - protein, 88 aa, Glycine max
  Coding DNA Sequence Number=SeqID_5776
MSEFTSNCPPRILASLHQLDFAPYVSGSYNAQWNAPKFLNDKHMLHSSCILGKMEVEESLLGLWLPLHYCLDMRMVFGIGCATCGFCG

SEQ ID NO: 122555 - protein, 61 aa, Glycine max
  Coding DNA Sequence Number=SeqID_5777
MKKFLNKKKEEDPVTIPKNGKKGIREVIVSNVRLRAFFMIKSPTLELIFSMIEVDFGFQGV

SEQ ID NO: 122556 - protein, 53 aa, Glycine max
  Coding DNA Sequence Number=SeqID_5778
VLSLCEEIDRKRLRNFFAIVYPLSTVLAPSAQSSHAKLSLLALSAKTPDWLAE

SEQ ID NO: 122557 - protein, 236 aa, Glycine max
  Coding DNA Sequence Number=SeqID_5779
  Gene Ontology: Mol. function=protein binding; Cellular component =integral to membrane
  Homolog annotation: Hit_ID=Q1HTV4; Match level="QueryCoverage=90%, HitCoverage=84%, E-value=1e-75, Identity=63%"; Hit description=Green ripe-like 1
  Pfam annotation: Domain name=DUF778; Domain location=27-229; Score =308.2; E_value=1.5e-89; Accession=PF05608.2; Description=Protein of unknown function (DUF778)
MYLNASYDVEHSHSTQRIQHELWPLDPIDPKKAKFPCCLVWNPLPVVSWLAPFIGHVGICREDGVVLDFSGSYLVNVDDFAFGPVARYLQLDHRQVAFAPTGLSSQNLQVMSPICILECCFPPNLSAHTCKHGYLHAEYGTAITWDHALQTSLLYFENKTHNLFTCNCHSFVANCLNRLCYGGSMSWNMVNVGALVLFKGHWVDFRCFYGWMALLTWATILLFTLNRVVYIGYLPI

SEQ ID NO: 122558 - protein, 55 aa, Glycine max
  Coding DNA Sequence Number=SeqID_5780
MQELVELFTHNDYQDRQIHSTVALTPPSRRAVVVPTTAATAEQELVLGIRNNGDG

SEQ ID NO: 122559 - protein, 316 aa, Glycine max
  Coding DNA Sequence Number=SeqID_5781
MDETKILLELKSVSSLCVHSFINLLCEETISFLSVFSSDPLFHCIVAFCTLVFLYLPHLFLKIILSPVPILTAILLLSILRLGAIQRLQHERRENHVKHEEQPIVYEENKGSKYKGEKQSPCTIEPDETKSVEQVHQWVHSETEVISDMGFESSSRFVEWNVKAPLEVIYEEYGEGEEAGDDANENVGIMRYPSLSRFYPESDSDSESESEFPAIGDWDSPEDLEFRWGEEEEEDDGDDDDEEEEDREGLIEIALDGCKRKRNLEFNFDEENLIEIDISPSRYRELSGDDEVFSGIRGICSSELRMKLFQHETPPP

SEQ ID NO: 122560 - protein, 148 aa, Glycine max
  Coding DNA Sequence Number=SeqID_5782
  Gene Ontology: Mol. function=oxidoreductase activity; Cellular component=mitochondrion; Biological process=electron transport
  Homolog annotation: Hit_ID=Q2HTY1; Match level="QueryCoverage=79%, HitCoverage=20%, E-value=2e-39, Identity=70%"; Hit description=FAD -dependent pyridine nucleotide-disulphide oxidoreductase; Calcium- binding EF-hand
MWSFTFFERVSRAFRDHGSNFKLVLLCTTVSGGGVLAYGEAVAASEAAATTTEKKKVVVLGTGWAGTSFLRNLDNPKYEVHVVSPRNYFAFTPLLPSVTCGTVEARSIVEPVRNIFRKVISQQNTHLAPVSYFCIMRLRATIIVLYLA

SEQ ID NO: 122561 - protein, 43 aa, Glycine max
  Coding DNA Sequence Number=SeqID_5783
MVMRGTMKKLAFCIGWSMLLENIDGVETLEAVATGNYFERWLS

SEQ ID NO: 122562 - protein, 382 aa, Glycine max
  Coding DNA Sequence Number=SeqID_5784
  Gene Ontology: Mol. function=oxidoreductase activity; Cellular component=integral to membrane; Biological process=electron transport
  Homolog annotation: Hit_ID=Q2HTY1; Match level="QueryCoverage=50%, HitCoverage=35%, E-value=3e-95, Identity=84%"; Hit description=FAD -dependent pyridine nucleotide-disulphide oxidoreductase; Calcium- binding EF-hand
  Pfam annotation: Domain name=LRR_1; Domain location=122-144; Score =10.1; E_value=3.6; Accession=PF00560.23; Description=Leucine Rich Repeat
  Pfam annotation: Domain name=LRR_1; Domain location=146-168; Score =17.7; E_value=0.042; Accession=PF00560.23; Description=Leucine Rich Repeat
  Pfam annotation: Domain name=LRR_1; Domain location=49-70; Score=1.2; E_value=1.7e+02; Accession=PF00560.23; Description=Leucine Rich Repeat
  Pfam annotation: Domain name=LRR_1; Domain location=72-94; Score =12.0; E_value=1.6; Accession=PF00560.23; Description=Leucine Rich Repeat
  Pfam annotation: Domain name=efhand; Domain location=225-253; Score =32.8; E_value=1.2e-06; Accession=PF00036.22; Description=EF hand
  Pfam module annotation: Pfam domain module=LRR_1::LRR_1::LRR_1::LRR _1::efhand; Domain location=122-144::146-168::49-70::72-94::225-253
HVEAREGAKADIVGVDWEQLLRLEGREVQRQPHHHNQHRFAITRRNASSGSELTLQNNALSGALPSLANLSMLESVFLSSNNFTSAPDGCFQGLTSLQTLSMTDRINLAPWTIPVELNDNNNLVKLELGNANLIGTLPDVFDKFVSLQELRLSYNNLTGGLPKSFARSAIQDMWLNNQNGFGFSGTIETNRRAIATDEWLRVEATNNVYALGDCATINQRKVMEDIAAIFKKADKDNSGTLTVKEFQEVLADICERYPQVELYLKSQQMHNIADLLKGSKEDVEKESIELNIEELKTILSKVDSQMKFLPATAQVASQQGTYLAKCFNRMEECEKNPEGPIRYKHLGQFAPLGGEQTAAQLPGDWVSIGHSSQWLWYSVYAR

SEQ ID NO: 122563 - protein, 566 aa, Glycine max
  Coding DNA Sequence Number=SeqID_5785
  Gene Ontology: Mol. function=binding
  Homolog annotation: Hit_ID=Q1S8C2; Match level="QueryCoverage=99%, HitCoverage=100%, E-value=0.0, Identity=76%"; Hit description =Armadillo
  Pfam annotation: Domain name=Arm; Domain location=177-218; Score =10.8; E_value=0.55; Accession=PF00514.13; Description=Armadillobeta -catenin-like repeat
  Pfam annotation: Domain name=Arm; Domain location=219-259; Score =16.8; E_value=0.076; Accession=PF00514.13; Description=Armadillobeta- catenin-like repeat
  Pfam annotation: Domain name=Arm; Domain location=260-301; Score =10.6; E_value=0.59; Accession=PF00514.13; Description=Armadillobeta -catenin-like repeat
  Pfam annotation: Domain name=Arm; Domain location=302-342; Score =11.9; E_value=0.4; Accession=PF00514.13; Description=Armadillobeta -catenin-like repeat
  Pfam annotation: Domain name=Arm; Domain location=344-387; Score =16.6; E_value=0.087; Accession=PF00514.13; Description=Armadillobeta- catenin-like repeat
  Pfam annotation: Domain name=Arm; Domain location=431-471; Score =21.4; E_value=0.0033; Accession=PF00514.13; Description =Armadillobeta-catenin-like repeat
  Pfam module annotation: Pfam domain module=Arm::Arm::Arm::Arm::Arm::Ar m; Domain location=177-218::219-259::260-301::302-342::344-387::431 -471
MSDEEAFAEASGLRRAVELIFSVLSLSYPIRVFSGKWQLIRAKLEELHAGLIAAEKCDSGESPSLSRLAAAVVATATECHDLCRRCVVFSYSGKLLLQSDLDVAFAKLDAHAKKLNEIYKTGILTNGFALVVSKPSLAASKEDMRFYVRDLTTRMKVGDLGMKRQALKNLLEVVVEDEKYVKVIVDVGDVVHLLVGFLGSNEVEIQEESAKVVSVVAGFDSYKGVLIGAGVIAPLVKVLDCGSVLGKVAAARCLVKLTENSDNAWCVSAHGGVSVLLKICGGDCGGDLVGPACGVLRNLVGVEEIKRFMVDEGAAVTFIRLVRSKEESIQVNSIAFIVSIASGDEVVRQMVIKEGAIHALLRVLDPKWSYSCKTREVAMRAIEDLCFCSPSSVGVLMSYGFVDQLIYYVRNGEVSIQELALKVAFRLCGTSEEAKKAMGDARFMPEFVKFLNAKSFEVREMAAEALSGMVMVPRNRKRFVQDDHNIALILQLLDPEEGNSGNKKFLISILMSLTNCTSGRKKIVSSGYAKNIEKLADAEVSSDAKRLVKKLSTNRFRSMLSGIWRS

SEQ ID NO: 122564 - protein, 118 aa, Glycine max
  Coding DNA Sequence Number=SeqID_5786
MEKKKKKGEEESLTLAIFPAVASQLSHRPPWHRPPLPSSIFPLSQSHTKAEVGKSSSRRDGAHALFSRCDAAVVASIDIGGSLKNRIFDYIGAWVVVNMSIDHHVVDDSIDLFGIHRQ

SEQ ID NO: 122565 - protein, 188 aa, Glycine max
  Coding DNA Sequence Number=SeqID_5787
  Gene Ontology: Mol. function=protein serine/threonine kinase activity; Cellular component=membrane; Biological process=protein amino acid phosphorylation
  Homolog annotation: Hit_ID=Q9LYI8; Match level="QueryCoverage=52%, HitCoverage=11%, E-value=1e-48, Identity=87%"; Hit description=MAP3K delta-1 protein kinase
  Pfam annotation: Domain name=Pkinase; Domain location=1-146; Score= -77.6; E_value=0.00062; Accession=PF00069.15; Description=Protein kinase domain
  Pfam annotation: Domain name=Pkinase_Tyr; Domain location=9-155; Score=-101.6; E_value=3.1e-06; Accession=PF07714.7; Description =Protein tyrosine kinase
  Pfam module annotation: Pfam domain module=Pkinase::Pkinase_Tyr; Domain location=1-146::9-155
MGHTQDRSRMAKMKKVTREKGGSSKNENVKMNVWLHNRVCDFGLSRMKHHTYLSSKSCAGTPEWMAPEVLRNEPANEKCDVYSFGVILWELTTTRIPWQGLNPMQVVGAVGFQNKRLEIPEDVNPVVAQIIRDCWQTNHVPSLYDIRIWTEIHILGKRPFSDTHSMSENLRADCHCCNYRSFAIFLPF

SEQ ID NO: 122566 - protein, 226 aa, Glycine max
  Coding DNA Sequence Number=SeqID_5788
  Gene Ontology: Mol. function=protein serine/threonine kinase activity; Cellular component=intracellular; Biological process =protein amino acid phosphorylation
  Homolog annotation: Hit_ID=Q9LYI8; Match level="QueryCoverage=71%, HitCoverage=18%, E-value=2e-76, Identity=82%"; Hit description=MAP3K delta-1 protein kinase
  Pfam annotation: Domain name=Pkinase; Domain location=32-223; Score =14.0; E_value=2.1e-09; Accession=PF00069.15; Description=Protein kinase domain
  Pfam annotation: Domain name=Pkinase_Tyr; Domain location=32-226; Score=8.0; E_value=5.9e-13; Accession=PF07714.7; Description=Protein tyrosine kinase
  Pfam module annotation: Pfam domain module=Pkinase::Pkinase_Tyr; Domain location=32-223::32-226
MGVNGDCYDGRNKEVNPVLGESSEWEIQWEDLDIGERIGIGSYGEVYRADCNGTEVAVKKFLDQDFSGDALAQFKSEVEIMLRLRHPNVVLFMGAITRSPHFSILTEFLPRGSLYRLLHRPNLRLDEKKRLRMALDVAKGMNYLHTSHPPIVHRDLKSPNLLVDRHWAVKVFGPRGKELLWWNGSSQDKVRNKRECLKALHGTNNDENWARYQNARNEARSTVSET

SEQ ID NO: 122567 - protein, 66 aa, Glycine max
  Coding DNA Sequence Number=SeqID_5789
LNAKNSQEKAADSIQKLVAEKGREGLKAFSASQAVADEARAMESADQVLSKEMATLKKLYEDLIMT

SEQ ID NO: 122568 - protein, 63 aa, Glycine max
  Coding DNA Sequence Number=SeqID_5790
MAAQVATPMIERELIAMIVDMLPVSYYEKMVVYMPSSFADLVFAGERIEVGLRRGKFDCLALT

SEQ ID NO: 122569 - protein, 221 aa, Glycine max
  Coding DNA Sequence Number=SeqID_5791
MQIKHYDILTELFATDRAKGNVAKTAKERRKQWEKENIDLNNYFEDTEMYVPNVGMFDENQFSPPNFEDASPQNGQTNPSGLNTSRGTKRKRNVVELVEDQYERMNESIMTIAEALKEGNSVSKELHQVAERQVEVAERQVAVIEKQVEIAEKQVTVIQQTRPRHYSESDVWDLLEELRVTDPFRMKVYNHLCDNEHKKRKLFGVPPHMRGEALIQMMTDA

SEQ ID NO: 122570 - protein, 153 aa, Glycine max
  Coding DNA Sequence Number=SeqID_5792
  Gene Ontology: Mol. function=nucleic acid binding; Cellular component= endoplasmic reticulum membrane; Biological process=DNA integration
MCPYEHALYIKAQNNDFLIVCLYVDDLIFKGSNPSMFNEFKKEMMKEFKMTNIGLMSYYLNIELMQEDKDIFIIQESYAKEVIKKFKMDDSNPVNIPMECEIKLSKHEEGERVDPTLFKSIVGSLRYLTCTRPDTIYDVGVVSGYMDNPTTLV

SEQ ID NO: 122571 - protein, 220 aa, Glycine max
  Coding DNA Sequence Number=SeqID_5793
  Gene Ontology: Mol. function=transcription factor activity; Cellular component=nucleus; Biological process=regulation of transcription, DNA-dependent
  Homolog annotation: Hit_ID=Q8LDC8; Match level="QueryCoverage=87%, HitCoverage=90%, E-value=6e-26, Identity=40%"; Hit description =Ethylene-responsive transcription factor 1B
  Pfam annotation: Domain name=AP2; Domain location=78-143; Score =145.3; E_value=1.6e-40; Accession=PF00847.10; Description=AP2 domain
MTSPLFQSPCYWDMLQEHDPYSSEVLFDSMSSTNAVLDPIHDSLSFDMVDFSTAPTTEGNHNDEAKQLVVKSEGQNKQRSYIGVRKRPWGKFAAEIRDTTRNGTRVWLGTFDTAEAAALAYDQAAFSMRGQSAVLNFPVKRVKESLQEIQYSCFFNGSSSPALALKERHCIQRKLSSKGKKCKGKETSESVVVLEDLGVDYLEQLLSLSDQSESPSYFNY

SEQ ID NO: 122572 - protein, 95 aa, Glycine max
  Coding DNA Sequence Number=SeqID_5794
MACEIFVLKNLLDIVKGIQLVLMISAQIIKDGRSFYDPKLLRATRGSPEKERIRNDHAETETISRPPSTTGGKQHHLSSVAGIGGQHGSNSSRRN

SEQ ID NO: 122573 - protein, 121 aa, Glycine max
  Coding DNA Sequence Number=SeqID_5795
MVVSHRGFDQPSFDLGIDDDDDKEVDDVVVVEKSQENNNDEPAYNYNHVVYQDSQGYDSENLSLEDLFDNDGLTQDSCFEVSSKENREFMANRTKPLNEVENEAFGESQNEEAMKSRVNEI

SEQ ID NO: 122574 - protein, 142 aa, Glycine max
  Coding DNA Sequence Number=SeqID_5796
  Gene Ontology: Cellular component=exocyst; Biological process =exocytosis
  Homolog annotation: Hit_ID=Q1SHQ5; Match level="QueryCoverage=81%, HitCoverage=19%, E-value=3e-30, Identity=53%"; Hit description=Exo70 exocyst complex subunit
FRNSNLGFILGEDWLTKHELKVKEYVSKYEHVGWNKVFLSLPETPTAEQARAILECFDVAFHDACKAQFSWVVPDPKLREEIKASIASKFVPSHRELFEKYQVGSETVFGLTPDDLEHSLSDILSGSVSSSHSPSPPHRFKR

SEQ ID NO: 122575 - protein, 300 aa, Glycine max
  Coding DNA Sequence Number=SeqID_5797
  Gene Ontology: Mol. function=RNA binding
  Homolog annotation: Hit_ID=Q1RY97; Match level="QueryCoverage=47%, HitCoverage=67%, E-value=1e-39, Identity=47%"; Hit description =Transposase
MASNNYQFDLNEIPYIEGVNEIQYQNEELDEERQATVPLVVRSLVDDTLVLDLNTDGNRHYPVFYLNLDYLQLDANDDLNIEDTDSILNEEEYTDYVLDAGDDTDFVFNAGNVNVSHKDTTVRKKKFLSNEQRWAIYTTLLEKNVNRKLKRTTTNEVATLFSVSLRTIQRIWKRAKDTPHDHTSLPDEPKFIDMYNIVYIDEKWFYMSKNTEKYYLFSVEEDPLRQCQSSHYIGKVMFLVAMGRPKFDNEGNEIFSGKVGVWPFVTREPALRISVNREAGTLVMKPITSVNRDINRKWLI

SEQ ID NO: 122576 - protein, 292 aa, Glycine max
  Coding DNA Sequence Number=SeqID_5798
  Gene Ontology: Mol. function=transmembrane receptor activity; Cellular component=exocyst; Biological process=exocytosis
  Homolog annotation: Hit_ID=Q1S1D5; Match level="QueryCoverage=89%, HitCoverage=43%, E-value=2e-90, Identity=64%"; Hit description=Exo70 exocyst complex subunit
  Pfam annotation: Domain name=Exo70; Domain location=24-292; Score= -194.8; E_value=0.00086; Accession=PF03081.6; Description=Exo70 exocyst complex subunit
  Subcellular localization annotation: CTP_CleavageSite=20; ConfidenceScore=5.14e-01
MPKMGLKNLFFFKTSPSPPSSSPTRTFSDSLMDENIETARAIISKWELISPSDQAAPLFSNTRQEAKQYLNAVMSLQSTMQHLVALDSSSDTLIQAHFLMQLAMKRLQTEFYRILTQNRDNLDPESVASTDHRSSSVSDDGTDFSDDEFRFAGDSVSTVAMADLKAIAECMVSAGYSKECVKIYILMRKSMVDEALYHFGVERLTFSQIQKMDWEVLESKIKSWLNAVRFVVRTLFHGEKTLCDYVFGSPERKIAESCFAAVCREGAESLFAFPEKVAKCKKTPEKMFRTLD

SEQ ID NO: 122577 - protein, 271 aa, Glycine max
  Coding DNA Sequence Number=SeqID_5799
  Gene Ontology: Mol. function=RNA-directed DNA polymerase activity; Cellular component=intracellular; Biological process=RNA-dependent DNA replication
MPIENLEHFQIEKEPHQCIKIGKEMGDEVQKEITQALFDNADLFEWSASDMSGIDPDFIFHKLAIFPKDKPIAQRKRKLRDERRKTIEVETEKLLVVKFIREVDHKTWLTNVIVVKKATKKCRMLLHFLDAYFVYNQIKMYLPDQENTTFITEAANCCYKVMPFSPKNAGATYQRLMDKVFKEKIDINVEVYVDDMVVKSATPDQHAKDLVKIFTELRKHNMRLNPKKYTLGSTKKVGLSIQIPTQDGREVQAFLQVVEEVLRPVYLERGV

SEQ ID NO: 122578 - protein, 117 aa, Glycine max
  Coding DNA Sequence Number=SeqID_5800
MDTRACILEEAFNTKILALPRPLGSHNQANHSKQCRYHQNYCHYTKECIVLKNKIKELIQKGCLNDFVSGNNYNRERYRAKGNGGCRDGYRGGYAGNRFNYQQHPTGEGKQQQKETP

SEQ ID NO: 122579 - protein, 69 aa, Glycine max
  Coding DNA Sequence Number=SeqID_5801
MELLVFGLKFEPRGAIKAQFLADFMARLPPKPSCNSEGEWWMLYVDGACNPKGNGAEITLKGPEDISLE

SEQ ID NO: 122580 - protein, 40 aa, Glycine max
  Coding DNA Sequence Number=SeqID_5802
MRHKKSQGNEGVVLCVSLRSHSINVPQTETLFLEEEGSSA

SEQ ID NO: 122581 - protein, 129 aa, Glycine max
  Coding DNA Sequence Number=SeqID_5803
  Gene Ontology: Cellular component=exocyst; Biological process =exocytosis
  Homolog annotation: Hit_ID=Q1SHQ5; Match level="QueryCoverage=98%, HitCoverage=28%, E-value=5e-36, Identity=52%"; Hit description=Exo70 exocyst complex subunit
IAVGTLFHGERTLCNYVFGSPERKTAEKMFRTLDLYEAISENRQQIESIFSSESTSSIRSQVLASQTRLGEAVRTMLNNFESAIQKGSSKIPVPGGEIHPLTSYVTNYIAFLADWPQNLLPESYYRSPD

SEQ ID NO: 122582 - protein, 185 aa, Glycine max
  Coding DNA Sequence Number=SeqID_5804
  Gene Ontology: Mol. function=metal ion binding; Biological process =metal ion transport
  Homolog annotation: Hit_ID=Q94CS5; Match level="QueryCoverage=37%, HitCoverage=34%, E-value=1e-20, Identity=68%"; Hit description=Heavy- metal-associated domain-containing protein-like
  Pfam annotation: Domain name=HMA; Domain location=109-168; Score =39.5; E_value=1.2e-08; Accession=PF00403.16; Description=Heavy-metal- associated domain
  Subcellular localization annotation: CTP_CleavageSite=28; ConfidenceScore=5.73e-01
MKGMNLFCSSISSTAVTSSTTDHHSTVRRSTKRHAGIPRKSQLRVPCSSRLLPINPKPQNGDVRRTGSIQVNNLYDSSSTRYLLGDWVSESDKIPSNSHKTTLQNQVVVLRVSLHCKACARKVTKHISKMEGVTSFSIDMEAKKVTIIGHVTPLGVLASVSKVKNAQLWPSSTSSLPSLSSSMPM

SEQ ID NO: 122583 - protein, 94 aa, Glycine max
  Coding DNA Sequence Number=SeqID_5805
MAKFDPEIVLEFYANAWPTEEGVRDMRSWVRGQWIPFDADAIGQLLGYPLVLEEGQECEYGQRRNRSDGFDEEAIAQLLYMDDVAPQQHPAQRS

SEQ ID NO: 122584 - protein, 100 aa, Glycine max
  Coding DNA Sequence Number=SeqID_5806
  Gene Ontology: Mol. function=RNA-directed DNA polymerase activity; Cellular component=chromatin; Biological process=RNA-dependent DNA replication
MNVVFKWTDVHEKAFNLLKDKLTNAPFLCLPNFDEAFEIECDAPGVGIWVVLIQDSKPVAYFSNESNSRMNPFEEGGNNGGETSLSNDPLQGIRGPMTRS

SEQ ID NO: 122585 - protein, 49 aa, Glycine max
  Coding DNA Sequence Number=SeqID_5807
MASTRLDISFSHVFREANKVDDASGSVKEALQLQEDFYDSVGLSFFRGV

SEQ ID NO: 122586 - protein, 163 aa, Glycine max
  Coding DNA Sequence Number=SeqID_5808
  Pfam annotation: Domain name=zf-GRF; Domain location=46-91; Score =58.9; E_value=1.7e-14; Accession=PF06839.3; Description=GRF zinc finger
  Subcellular localization annotation: CTP_CleavageSite=49; ConfidenceScore=5.59e-01
MAPAKGGVLWHGRSRGRGSHGCSSSIILWSTMFANSSTRGNATSNRLCYCRRRATIRTTRTTRNNGRLFYACPLPQQDADRCNFFSWVDEDIDVGATEIGRIEPIPDFCLRLRLEILQREVRMLTYCVVVGFVVVVTFNVSYHTFTNGLRRLLMTGANVANEM

SEQ ID NO: 122587 - protein, 78 aa, Glycine max
  Coding DNA Sequence Number=SeqID_5809
MGSEIYPEDHENPRAFFSSFSPILLDSSIQYPWGGVHKIRVTSNVALKYTCLPSMLALPHEHGRSTLSRRVPKLTGYL

SEQ ID NO: 122588 - protein, 180 aa, Glycine max
  Coding DNA Sequence Number=SeqID_5810
  Homolog annotation: Hit_ID=Q8TGM5; Match level="QueryCoverage=22%, HitCoverage=61%, E-value=7e-08, Identity=70%"; Hit description =Uncharacterized protein ART3
SGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 122589 - protein, 73 aa, Glycine max
  Coding DNA Sequence Number=SeqID_5811
MTAGDPPQQKTSQGNEKKKEDDNITQGDPPQEERSLRIEIEEELKNITEGDPPKQKRSQGNEKKTEDDNITQG

SEQ ID NO: 122590 - protein, 273 aa, Glycine max
  Coding DNA Sequence Number=SeqID_5812
MVLKEELAACSRSKRSLDQHLEATEQSMLAIIGQYKEELNQSLTHEQKLVEDFADFAQAYAEKEARGRVIDVLHQEATMWMDRFALTLNGSQDLPRLLAKAKAITEGVQEQMKADLSALKDQMASITEAMLKLQKTIEDNATAPASNTAREAEPVLQPAINLGRDRNMTGFNRRYSPQAYPYGLLPDFTPRTAPDDWSQAPTIEGQLPPHVDYPLQEDDEGDAHLGPLLPLKEPAPHELPQPNIVCHVPSPSAPVKELVPFAKDKGKFDLLEE

SEQ ID NO: 122591 - protein, 272 aa, Glycine max
  Coding DNA Sequence Number=SeqID_5813
MAFSNGMINLLSSHLFSRASGYPAIIFGLFSDVTKGWHQSQKGDSVSGLYNITGGTATAIGSILMLEGGLAIAGPTFFIPFAGWAAVGIVLIGATLIIAGLYLYSKAHERLHSPIELWASRCIFGTRENDGEIRPGLNLDFQNKLPRFASLIEEVESWHAETYAPIAISLEQSAQLGLGALTTKLSTNSHWPTPDWATIIHGQVSIEVPTIEFTILLPDFMIGQSEWSGTLRIEDTDGNARKSQKCKTINKLSPQPLPGYFPQIPRRLFHSE

SEQ ID NO: 122592 - protein, 113 aa, Glycine max
  Coding DNA Sequence Number=SeqID_5814
  Gene Ontology: Mol. function=oxygen transporter activity; Biological process=oxygen transport
  Homolog annotation: Hit_ID=Q2K5U9; Match level="QueryCoverage=98%, HitCoverage=39%, E-value=1e-34, Identity=65%"; Hit description =Hypothetical conserved protein
MTKLGASRDRIAASLGPSISQDNYEVGPEYVARFTDIEPAYADYFSRAEKEGHALFDLKQFTIDRLTKAGVKAENLGLCTYPDEERFYSYRRTTHRAEPDYGRQISAIAILED

SEQ ID NO: 122593 - protein, 78 aa, Glycine max
  Coding DNA Sequence Number=SeqID_5815
MRKFFHEHSMEDTSSAVEITTAEEVLLRAFHGRTFFRRCNFNCGRSVFRGMLAEEPSFVHSCGRTSSVSFHGRTFFRS

SEQ ID NO: 122594 - protein, 211 aa, Glycine max
  Coding DNA Sequence Number=SeqID_5816
MMFLVLQNLELLQDSLEKPYKYATSLVPRVKLYLIKDEKLEKTRWGQIVVYVRPERVIRQFGYIPTVPPPSVSDSLTDDDIDDQWLHFSDHLVGAGEICVVLGQVAPDYMDWFFRISHPFVTPTEETAEPRHHPLPHVEEFVKPPIPEVSVASDLPTHSVVDCQGCAAIAEELERVINLKMVTEGTDLYDIMARCLRIARGDAADKSLRPR

SEQ ID NO: 122595 - protein, 167 aa, Glycine max
  Coding DNA Sequence Number=SeqID_5817
TRGRRFFRRKEILIAEEPSSAETGGRTFIRALPWKKLLPRMAAEEPSSARRKCNVLDTRGRSFFRGFPQKNLLPRVSKMFHFLLVEDGSSSESRGRTFFRCHPRKNHLPPDLPQHIHTRGRSEPSMEEGSKLQSADNGRRARREEEELEAGSGERKKLLVVEEDFER

SEQ ID NO: 122596 - protein, 60 aa, Glycine max
  Coding DNA Sequence Number=SeqID_5818
MESDAVWITEEEDDIFYEDNVQVKQPLGERGSLTDPTLDTFDIDSLVLNDNVDDHFSTEE

SEQ ID NO: 122597 - protein, 274 aa, Glycine max
  Coding DNA Sequence Number=SeqID_5819
  Gene Ontology: Mol. function=protein serine/threonine kinase activity; Biological process=protein amino acid phosphorylation
  Homolog annotation: Hit_ID=Q7XIB4; Match level="QueryCoverage=96%, HitCoverage=38%, E-value=1e-28, Identity=34%"; Hit description =Putative cyclin-dependent kinase CDC2C
MDLKLKKCSEPTRKKISGRVRGTATRKPSRKPLGFNKLAPAEGLASQTQTSQKVNGRSFHILEEEKIKIGDKAQKSSSGKPEDAFHMKNASQGDIPLSGPLQVSTSSGFAWAKSRKDDTSFRSHCRTISRGHIFNALEPSTLNTRNNLDTTNQENKEFCGRYPNSRGHDLLEISKLSMQNQWSKFDRPDSFDASDEYHSQELSTALYHREDSVSKRSNLTFQDQGEKVEFSGPLLSQMHTVDELLERHERHIRRTVRRSWFQRGIKAYQAHGYL

SEQ ID NO: 122598 - protein, 337 aa, Glycine max
  Coding DNA Sequence Number=SeqID_5820
  Gene Ontology: Mol. function=protein serine/threonine kinase activity; Cellular component=nucleus; Biological process=protein amino acid phosphorylation
  Homolog annotation: Hit_ID=Q7XIB4; Match level="QueryCoverage=91%, HitCoverage=47%, E-value=1e-125, Identity=68%"; Hit description =Putative cyclin-dependent kinase CDC2C
  Pfam annotation: Domain name=Pkinase; Domain location=104-332; Score =233.4; E_value=4.8e-67; Accession=PF00069.15; Description=Protein kinase domain
  Pfam annotation: Domain name=Pkinase_Tyr; Domain location=104-336; Score=38.7; E_value=7.6e-15; Accession=PF07714.7; Description =Protein tyrosine kinase
  Pfam module annotation: Pfam domain module=Pkinase::Pkinase_Tyr; Domain location=104-332::104-336
MGCVSSKQAVSVTPAIDHYGAFRSNAGGPCEPEKKRTESGGGPSQSEVGESGRTSSNCESLSFRLGNLQKYVQGEHVAAGWPAWLSAVAGEAIQGWVPLRADAFEKLEKIGQGTYSSVFRARELETRKIVALKKVRFDNFEPESVRFMAREILILRRLDHPNIIKLEGLITSRLSCSIYLVFEYMEHDITGLLSSPDIKFTEPQIKCYMKQLLAGLEHCHLRGVMHRDIKGSNLLVNNEGVLKVADFGLANYVNSGHRQPLTSRVVTLWYRPPELLLGSTDYDPSVDLWSVGCVFAELLVGKPILQGRTEKYDNASTLKEATDMKMLAMGWIFEFLC

SEQ ID NO: 122599 - protein, 57 aa, Glycine max
  Coding DNA Sequence Number=SeqID_5821
MPHGLFPYENHALMPLRHFTEHLVGARFGTNSKRTGTMWRKTESKNAKSRDPRGANS

SEQ ID NO: 122600 - protein, 125 aa, Glycine max
  Coding DNA Sequence Number=SeqID_5822
  Subcellular localization annotation: CTP_CleavageSite=58; ConfidenceScore=5.15e-01
LPSLVTDAWGVNTFPVCKYNSSNKCWWRLRAYSLLGTRTHESRVALPSKEGTSTWVVVTENKRGYISCGSVLVEGTSTRFFKENKGGYIPYGSLLVKEFTRLKRNLKDRRSLGNWMKARVAVEPV

SEQ ID NO: 122601 - protein, 180 aa, Glycine max
  Coding DNA Sequence Number=SeqID_5823
  Homolog annotation: Hit_ID=Q6CQE5; Match level="QueryCoverage=17%, HitCoverage=28%, E-value=3e-07, Identity=83%"; Hit description =Protein TAR1
  Subcellular localization annotation: CTP_CleavageSite=55; ConfidenceScore=5.18e-01
MADFAVIKWWMSHARDQSRASRSVLDPSTTLCVHARSQRDLRVRAPSCPDPVAPRGAVGESGCLGMQPQSGGKFRPRLNTGERPIANNGWGPAMCPGRMWNGESRSADRLGTLTDAELRWVAQARAVDMLVETSSSRFVGWAARALGRASAPCALLGGRPGGLPISGPVFENTGTKESGQ

SEQ ID NO: 122602 - protein, 111 aa, Glycine max
  Coding DNA Sequence Number=SeqID_5824
MFSEMLYKKSKISPAMVLLWMKEIASSLTSNIVQIKGPDPSLRISKARNKGRAKGMLSCQRNVCKESNKGRSETMAVTRNAPKLVQRQWQSQGKQRRPFKENNKAYQGRRR

SEQ ID NO: 122603 - protein, 74 aa, Glycine max
  Coding DNA Sequence Number=SeqID_5825
MTLPRTSHLVVHDTLDPWEPGNRMENKAWMVTLSKISHTHPLASELHRHTVGTKLIVANMRQNRCRGVVGPTSV

SEQ ID NO: 122604 - protein, 78 aa, Glycine max
  Coding DNA Sequence Number=SeqID_5826
MVLRDIMFLHIVDGIRNQLIHVYTYLCHDGTDKLTLRQGEIGVVVLALLRDQGGGQGIDKGKLLVPHPGAQVSVKHYG

SEQ ID NO: 122605 - protein, 178 aa, Glycine max
  Coding DNA Sequence Number=SeqID_5827
  Gene Ontology: Mol. function=transcription factor activity; Cellular component=nucleus; Biological process=regulation of transcription
  Homolog annotation: Hit_ID=Q1SA40; Match level="QueryCoverage=84%, HitCoverage=73%, E-value=4e-75, Identity=92%"; Hit description =TAFII55 protein conserved region
  Pfam annotation: Domain name=TAFII55_N; Domain location=1-146; Score =211.2; E_value=2.4e-60; Accession=PF04658.4; Description=TAFII55 protein conserved region
MEEQFILRVPPNVAERIERLLNENNASSSEDKSLDLSFREDGRSGTFMIGNEQFPASLLDLPCVVESYKTYDDNSLIKTADIGQMIMVRESGDAAPDVIEYRHGLTPPMRDARKRRFRREPDLNPELVSRVEKDLLKIMAGGTADNLDILTSLFVSNSNLAKFSILKHKFDSTLNCSL

SEQ ID NO: 122606 - protein, 94 aa, Glycine max
  Coding DNA Sequence Number=SeqID_5828
MTSELTSDFPPRIPASLHQSDFAPYVSRSYNAQWNALELSHDKHMSCWCCILWEMEGWCLVLGVHRVDFVADLGVAFMDDWAFLAVRVVGNEKD

SEQ ID NO: 122607 - protein, 100 aa, Glycine max
  Coding DNA Sequence Number=SeqID_5829
MAFGDHPGHHLHFEDENVFSHCMPSKATMTIICILKMIMSSIIACLQSDCMLSKGDNDLHLHFEDDNVFSHCMPSKATMTIICISNMTMSSVIACLQRWQ

SEQ ID NO: 122608 - protein, 339 aa, Glycine max
  Coding DNA Sequence Number=SeqID_5830
  Gene Ontology: Mol. function=protein binding; Cellular component =cyanelle; Biological process=carbohydrate metabolic process
  Homolog annotation: Hit_ID=Q1XUX0; Match level="QueryCoverage=99%, HitCoverage=70%, E-value=1e-177, Identity=88%"; Hit description=FeS assembly protein SufB
  Pfam annotation: Domain name=UPF0051; Domain location=71-310; Score =473.8; E_value=2.1e-139; Accession=PF01458.8; Description =Uncharacterized protein family (UPF0051)
ETLAEKGIIFCSISEAIKNHPDLVKKYLGKVVPRGDNFYSALNSAVFSDGSFCYIPKGVRCPMELSTYFRINQAGTGQFERTLVIADEGSYVSYLEGCTAPSRDENQLHAAVVELIAMDNAEIKYSTVQNWYPGNEEGKGGVFNFVTKRGLCEKNAKISWTQVETGSAVTWKYPSCILKGDGSIGEFYSIAVTNNHQYADTGTKMIHIGKNTKSTIISKGISAGKSQNSYRGQVKVMPSAKGARNFSQCDSLLMGNECGAHTFPYIEIKDPTAQLEHEATTSKIGEDQIFYCNQRGIDTERAIALIVNGFSKEVLNKLPMEFAIEAQKLLEISLEGSVG

SEQ ID NO: 122609 - protein, 81 aa, Glycine max
  Coding DNA Sequence Number=SeqID_5831
LGRIDGDPALRGTRIRATWEYVSSVEETLRTSGGVLLPKTKLDQSRSNPVRFGIWPMVIDYQGLENEIRKLGGLLVIDYQA

SEQ ID NO: 122610 - protein, 212 aa, Glycine max
  Coding DNA Sequence Number=SeqID_5832
  Pfam annotation: Domain name=Transposase_23; Domain location=115-185; Score=-1.8; E_value=0.0018; Accession=PF03017.5; Description =TNP1ENSPM transposase
MTFEAPKEIADRIDVLTATIGRPEHPGRVRVAGVGVTIKQYFGSPSRTSRSSSDISLEDLQQLTQQIRDQLEESITEKMQSQGLALPPEPEIGPLGPRVSTKESCVALSGNDSGTSDSEKCGLYIEENLSRLVALGRLYEGSTTVHNIPLLHGQVKVCVEEVKDAEALVPVSTDDVTLLENMLSTSVFQPMLKVPTLIVLSLTSVFQKPMLT

SEQ ID NO: 122611 - protein, 93 aa, Glycine max
  Coding DNA Sequence Number=SeqID_5833
MERSVIDAASGGALGDLTPTEARNLIEKMASNSQQFTARNDAIVLRGVHEMATDSSSSTENKKLEGKFDALVNLVTQLALNQKSVGSSGLRII

SEQ ID NO: 122612 - protein, 154 aa, Glycine max
  Coding DNA Sequence Number=SeqID_5834
  Gene Ontology: Mol. function=shikimate 5-dehydrogenase activity; Cellular component=cytoplasm; Biological process=aromatic amino acid family biosynthetic process, shikimate pathway
  Homolog annotation: Hit_ID=Q8PC67; Match level="QueryCoverage=100%, HitCoverage=35%, E-value=3e-65, Identity=81%"; Hit description =Glutamyl-tRNA reductase
  Pfam annotation: Domain name=GlutR_N; Domain location=6-149; Score =276.2; E_value=6.3e-80; Accession=PF05201.5; Description=Glutamyl -tRNAGlu reductase, N-terminal domain
MTLWVLGLNHQTAPVELRERAAFAGEALPRALGSLRDTPQIAEAVLLSTCNRTELYAVADSAQALDQWLHTQAGDLQGYLYQHADAEAVRHLFRVATGLDSMVLGEPQILGQVKEAWSTARDHGLLGQRLDRLFQQTFSVAKRARTDTQVGANP

SEQ ID NO: 122613 - protein, 330 aa, Glycine max
  Coding DNA Sequence Number=SeqID_5835
  Gene Ontology: Mol. function=binding; Cellular component=membrane
  Homolog annotation: Hit_ID=Q3R535; Match level="QueryCoverage=87%, HitCoverage=49%, E-value=1e-81, Identity=54%"; Hit description=TPR repeat
  Pfam annotation: Domain name=TPR_2; Domain location=107-140; Score =0.4; E_value=29; Accession=PF07719.7; Description=Tetratricopeptide repeat
  Pfam annotation: Domain name=TPR_2; Domain location=176-209; Score =11.1; E_value=1.7; Accession=PF07719.7; Description=Tetratricopeptide repeat
  Pfam annotation: Domain name=TPR_2; Domain location=39-72; Score=7.1; E_value=5; Accession=PF07719.7; Description=Tetratricopeptide repeat
  Pfam annotation: Domain name=TPR_4; Domain location=107-132; Score =3.1; E_value=16; Accession=PF07721.5; Description=Tetratricopeptide repeat
  Pfam annotation: Domain name=TPR_4; Domain location=210-235; Score =11.3; E_value=1.7; Accession=PF07721.5; Description=Tetratricopeptide repeat
  Pfam annotation: Domain name=TPR_4; Domain location=244-269; Score =0.2; E_value=36; Accession=PF07721.5; Description=Tetratricopeptide repeat
  Pfam annotation: Domain name=TPR_4; Domain location=40-64; Score=4.5; E_value=11; Accession=PF07721.5; Description=Tetratricopeptide repeat
  Pfam module annotation: Pfam domain module=TPR_2::TPR_2::TPR_2::TPR _4::TPR_4::TPR_4::TPR_4; Domain location=107-140::176-209::39-72::107- 132::210-235::244-269::40-64
MPALIRIPSVLLLSLACSQALAAVPAKAPVRAPATEELALEPVMAGEFALQAGKLAEAARWYLQAAQQTDGDAGLAERATRISMLANDDASAAKGLALWQQRAPRSLTMRSAAGALAMRQGDVKAARTELQGLLADSDERGWKFALAALIGGGRDPAVPAQVLGELVDANAIPPKIEAWQEFGRLALRMDKPELARRMIDEVVKRFPEEPRVALLRASQLQQAGETGKALSLLHDVEPKTRQDPELRNAVAIAYDSLGQPSAAERVLAFGPQDVQTWGMRASLLAKQGDKAALSNLYNELSRQAAKPDPAQRLLLGKIAEYLKRYPEAVQ

SEQ ID NO: 122614 - protein, 816 aa, Glycine max
  Coding DNA Sequence Number=SeqID_5836
  Homolog annotation: Hit_ID=Q9PA76; Match level="QueryCoverage=31%, HitCoverage=81%, E-value=2e-96, Identity=70%"; Hit description =Ribose-phosphate pyrophosphokinase
  Pfam annotation: Domain name=GHMP_kinases_C; Domain location=406-476; Score=27.0; E_value=6.6e-05; Accession=PF08544.3; Description=GHMP kinases C terminal
  Pfam annotation: Domain name=GHMP_kinases_N; Domain location=299-357; Score=59.7; E_value=9.5e-15; Accession=PF00288.16; Description=GHMP kinases N terminal domain
  Pfam annotation: Domain name=LolB; Domain location=55-189; Score =68.8; E_value=1.8e-17; Accession=PF03550.5; Description=Outer membrane lipoprotein LolB
  Pfam annotation: Domain name=Pribosyltran; Domain location=698-815; Score=97.0; E_value=5.7e-26; Accession=PF00156.17; Description =Phosphoribosyl transferase domain
  Pfam module annotation: Pfam domain module=GHMP_kinases_C::GHMP _kinases_N::LolB::Pribosyltran; Domain location=406-476::299-357::55 -189::698-815
  Subcellular localization annotation: CTP_CleavageSite=39; ConfidenceScore=5.23e-01
MSVSLIRPMLLVAVTLAVTACTSVGTQKTAPPAVVETVSAEAARAEAARVAALQAQSDWAFQGRVAVSKGKDGGSGRIDWKQEGRRYVVELSAPVTRQSWKLTGDTHSEAGRLEGLAGGPRDGEDAQQLLLEATGWDIPVNQLPQWIRGLVAGDAAGPEKVERDGAVPGLVPGRGRASGAATPDRGQQWRRQGAPAGGSVGAGRPMSAGCDDAGWSWWPAPAKLNLFLHITGRRADGYHELQTVFRLLDWGDRIGLRLREDGQVRREGEGLAGVAEADDLAVRAARILKDAANIAQGADIIVEKRVSAGGGFGGGSSDAATVLVVLNRLWRAGLDEDALAALGLRLGADVPVFVRGRNAWAEGVGERLQPIVLEPAWYVVVEPGVHVPTPALFADPDLTRDSPVAKIEDFASGTLVGNAFEPVLRRREPAVEAAFAALSDIGTARLTGSGSGCFVEFASQSAAEQGRSKLPKELRARVAAGVARASPRGPRHQVLILAFVGSNPTAPANSGCVRAFQRIARAGRGNNRGVVSSKGPSGSLPTPDPRHSSPPETIMMQESPNLLVFSGNANKRLAQNICKELGVRPGKALVSHFSDGEVQVEIEENVRKQDVFVIQPTCAPSAENLMELLVLIDALKRASVASVTAVVPYFGYSRQDRRMRSSRVPITAKLAAKMFSTAGADRVLTVDLHADQIQGFFDIPVDNVYASPLLLADIWRAYGTENLIVVSPDVGGVVRARAVAKRLDDADLAIIDKRRPRANVSTVMNIIGDVEGKTCVMVDDIVDTAGTLCAAAAALKARGALKVAAYCTHAVLSGPA

SEQ ID NO: 122615 - protein, 92 aa, Glycine max
  Coding DNA Sequence Number=SeqID_5837
  Gene Ontology: Mol. function=RNA-directed DNA polymerase activity; Biological process=RNA-dependent DNA replication
MSWFLLYKIFPLRKKLAANLCNVLLSLLEASCGYFLSSMYRLILKYQGLAFFSSSIKQQCASLPQHLNSMFIKSLCGLSWNMDVSVARASTI

SEQ ID NO: 122616 - protein, 235 aa, Glycine max
  Coding DNA Sequence Number=SeqID_5838
  Gene Ontology: Mol. function=receptor activity; Cellular component =outer membrane-bounded periplasmic space; Biological process=amino acid transport
  Homolog annotation: Hit_ID=Q2KUS2; Match level="QueryCoverage=88%, HitCoverage=54%, E-value=4e-84, Identity=78%"; Hit description=ABC transporter substrate-binding protein precursor
MASGLAPNQLEHLARDAGVGAAVLFDGDDLDALGLGGLLHHVQPAVAVGVGKADEAQRLDLGLGHGVGQRAGHQGVVLRGLEDPATLVVHGLDDFGAGGHADHRHLGFGGHVHHGQRARGDRRADQHVDLVVGGQLARVLDGLRRVGGVVQDDPFDLLAGHFLGQQRNRIALGDAERRGGTGAGHRDAHLDLGAGQQRQGQGNGGGGRGQAEVLAHVLSPVVALLCPGRGGSEPS

SEQ ID NO: 122617 - protein, 445 aa, Glycine max
  Coding DNA Sequence Number=SeqID_5839
  Homolog annotation: Hit_ID=Q7VTH4; Match level="QueryCoverage=43%, HitCoverage=99%, E-value=1e-44, Identity=52%"; Hit description =Putative cobalt transport protein
  Subcellular localization annotation: CTP_CleavageSite=13; ConfidenceScore=5.30e-01
MASSPPTTRRPPRCAGTGTAARDRAPIYSRRLAAAPAARRPEAAGVGRGRRRIVPAARSRHPCGSLRARRLAAVVRWRHASRRLAPGARPGLGAAGRRRLHGLVPGLARGVGGTLADRRDGRAGAGGDAVDPQFRPDRRVRAGVDAVAAHRPAGRGQGVAGAGAGPALRARDLAQFPRDPRSPGGARTGRQSGGADRAAGGAHAEAGAGSGRGHRRAQPKGHCHEIQQHCAGGAVRRADRGAEPDSADPAAGHTGADHAADAGRHAGRRHAGAGPRRAGLPVVPGAGGHRPAGAAGRARGAGRVLRADGWFPGGTGGRRFRHRLAGAAPGGAGGGVRRPTGRLRHRLRGRRHRGGLCLRRAVAGHGHQDGAGQGGDGGGGVRARRPDQGRAGGVGGDAGRAGLADAWPVGATQRSWPQGIPQLTPVWLSSTSSPLTNAFAETWFP

SEQ ID NO: 122618 - protein, 41 aa, Glycine max
  Coding DNA Sequence Number=SeqID_5840
MGVNNKAEKRTSTKSLKTSTQKYRGACFSKRGFGLSAIKTC

SEQ ID NO: 122619 - protein, 81 aa, Glycine max
  Coding DNA Sequence Number=SeqID_5841
MRMTKIVTAMVVVVMLVTMAMKVWWRCCGGGDGGGIGGGGDNDSDSGSVVVAVITTLTIVVVVVEAKNAIVKCGKCVLFQN

SEQ ID NO: 122620 - protein, 50 aa, Glycine max
  Coding DNA Sequence Number=SeqID_5842
MVLVEVWRVLIEVGNLVMVVGLLFEVERVWLRFFDIANVMDQKRVKNSLI

SEQ ID NO: 122621 - protein, 266 aa, Glycine max
  Coding DNA Sequence Number=SeqID_5843
  Gene Ontology: Mol. function=receptor activity; Biological process =protein amino acid phosphorylation
  Homolog annotation: Hit_ID=Q84KS6; Match level="QueryCoverage=79%, HitCoverage=67%, E-value=9e-27, Identity=36%"; Hit description =Membrane located receptor-like protein
MWRQSALLVFVLLLVQQICATSEQEHACPPSSCGKITHITYPFRLTGDPKGCGDKWYELACENNVTVLYLYSGKYHVQAINYNNFTIRVVDPGVQQPYCSSIPRYFLSQSNFSAIDEGDPYLAFQNRDYSWEYVFQHIVFLNCRHAVIDNEKYVETDPCIKWHSKGYIYAIAGDLIAKDFEVGCEVKLVAPTSLWGLDTYTQMHRALIYGFELSWMNLACEDYCGNPSCTFNSSSQMLECSSLRVCRNFVVGWQYLTQCGKGCKNY

SEQ ID NO: 122622 - protein, 297 aa, Glycine max
  Coding DNA Sequence Number=SeqID_5844
  Gene Ontology: Mol. function=protein kinase activity; Cellular component=cell surface; Biological process=protein amino acid phosphorylation
  Homolog annotation: Hit_ID=Q1S8T2; Match level="QueryCoverage=85%, HitCoverage=45%, E-value=3e-80, Identity=55%"; Hit description =Protein kinase
  Pfam annotation: Domain name=Pkinase; Domain location=3-240; Score =95.8; E_value=1.3e-25; Accession=PF00069.15; Description=Protein kinase domain
  Pfam annotation: Domain name=Pkinase_Tyr; Domain location=5-240; Score=26.7; E_value=4.1e-14; Accession=PF07714.7; Description =Protein tyrosine kinase
  Pfam module annotation: Pfam domain module=Pkinase::Pkinase_Tyr; Domain location=3-240::5-240
MARGFKEKLGGGGYGFVFKGKLRSGPSVAIKMLHKAKGSKRALVYEFMPNGSLDKFIFPKDGNIHLTYDEIYNIAIGVARGIAYLHHGCEMKILHFDIKPHNILLDETFTPKVSDFGLAKLYPIDNSIVTRTEARGTIGYMAPELFYGNIGGISHKADVYSFGMLLIDMTNKRKNPNPHADDHSSQLYFPTWIYNQLEKETDIEMEGVTEEEKKMIIVSLWCIQLKPSDRPSMNKVVEMLEGDIESLEIPPKPSLYPHDTMENDQSIYSSQTMSTDFISSSSYSKEIVTNPLVEDVI

SEQ ID NO: 122623 - protein, 70 aa, Glycine max
  Coding DNA Sequence Number=SeqID_5845
MVNMHQNTIEEQGYLYFMLNDNSYASSAPETSAEEVLWDGLWNIDHVHGNFSVASAASKVDLYNLVAPFC

SEQ ID NO: 122624 - protein, 78 aa, Glycine max
  Coding DNA Sequence Number=SeqID_5846
MAKPNSNPNHSNGDMNYSRPYTTHVTFCLLYHRQVRRAHKDALRGHRFQDLNLGHYMSKSSIISLIQVFVFDITYGDG

SEQ ID NO: 122625 - protein, 197 aa, Glycine max
  Coding DNA Sequence Number=SeqID_5847
MEITTIQRNNYSSIHVEHFFNIQELKKTGLKLNETLLFCGVRQFFNEPPTIYPELIRTFWRHAKFINKKTIASMVLGVKADVCMRAVPTRKAESRSMTLKSLEHSTKTMLTRMKRLAKAIIDEDLGSNNFGISRKIQKIMVEQHQQKKTRKLSQRDEEEEELLANEHRTKRRHKSTTPASARPPIVTSIPHRLKDLT

SEQ ID NO: 122626 - protein, 127 aa, Glycine max
  Coding DNA Sequence Number=SeqID_5848
MKVEEEAFCTPGQNETKNKIQGYQRETNKNIHIFLNEHQGMKGMAFEKQHFIQHACSELQNKERETRLKRAIKGINSRTHQQESSQGYCASNQWGKTHQMIIMMDGSNSHKGKIITFKLSFQNYHDM

SEQ ID NO: 122627 - protein, 126 aa, Glycine max
  Coding DNA Sequence Number=SeqID_5849
MWMDSQKASTSGYDGSDNVVHCDVIKVLRPIRKYHFDGTYVCFTKDVDNYSFVQHLLKLPTIQYKATYNLKKIVQAEASAKAMDDTIMRGVIIDLTNIGVMDKTGEASSTTMANEVEPYIQDLASK

SEQ ID NO: 122628 - protein, 98 aa, Glycine max
  Coding DNA Sequence Number=SeqID_5850
MSLKIKRLKNIIVSLKMTVVVEFEKVVVLSKPRVVDDTEVGELSCNGILHREAKLLILLELTFDKELHLHGLDNHILDFITSDIGGLCIVQRSGARAG

SEQ ID NO: 122629 - protein, 44 aa, Glycine max
  Coding DNA Sequence Number=SeqID_5851
MNDLIVRVVYQQNALAGVGASIDGSLGAAFLNLSICRGDRGGGN

SEQ ID NO: 122630 - protein, 67 aa, Glycine max
  Coding DNA Sequence Number=SeqID_5852
MNNNRIRIGLTLYDPSFDEHASGHHHSDIACSKRKKLLERLKRWVDAGSEKPRVRHSISKGVEEHCT

SEQ ID NO: 122631 - protein, 224 aa, Glycine max
  Coding DNA Sequence Number=SeqID_5853
MAKFDPDVVLEFYANAWPKEEGVRDMRSWVRGQWIPFDADALSQFLGDPLVLEEGQECEYTTSCPAIITPDLPLPKCQLVYAILTRMSVHVAQLIADAIYLFADKSNKALGFPALITGLCQSFRVPVTPSKATDAPPPPHQADPAGSFGMERYLQHLVRQQAANHRGQVQTHECLYQLSLSLQSQGFAPFPCPTLDQFRAEVAWPGDWPEDQTEEASAEAPGDP

SEQ ID NO: 122632 - protein, 82 aa, Glycine max
  Coding DNA Sequence Number=SeqID_5854
MTKEIGSMGEKFRGRHSTASSQEREEILGFRKMRRSKKHKRDTSAACLASDSHRTHMRVRLRCDAVSVVSAVTGHGWTKGHM

SEQ ID NO: 122633 - protein, 76 aa, Glycine max
  Coding DNA Sequence Number=SeqID_5855
MVPFIAPVWGFEGTYWVRTSNMPPGSLKGTYWVRTSNLPLGSLEVHSRCPSWPQCRALRYPSLFHNLVARKNERSG

SEQ ID NO: 122634 - protein, 313 aa, Glycine max
  Coding DNA Sequence Number=SeqID_5856
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=6e-42, Identity=32%"; Hit description= UPI00006A17C9 related cluster
GLHILTFRGLHALTFGGLHVFTLRGLHTLAFRGLHALTFRGLLALTFRGLHVLAFRGLHALSFRGLHVLAFRELHALTFKGLHILTFRGLHILTFRGLHILTFRGLHVLTFRGLHVVTFRGMHVLAFRGLDVLTSPSEGCTPSPSEGLHALTFRGLHVLAIRGLHALTFRGLDLLTFRGLNFLAFRGLHTLSFRGLHVLAFRGLHALTFRGVHILAFRGVHALTFRGLQVLAFRGLHVLAFRGIYILIFRGLQVLVFRGLHALAFRGLHVLTFRGLHLLAFTGLHIFTFGGLHTLAIRGLHVLTFRGLHDLTL

SEQ ID NO: 122635 - protein, 172 aa, Glycine max
  Coding DNA Sequence Number=SeqID_5857
  Gene Ontology: Mol. function=pantothenate kinase activity; Biological process=coenzyme A biosynthetic process
  Homolog annotation: Hit_ID=Q8L5Y9; Match level="QueryCoverage=53%, HitCoverage=10%, E-value=2e-38, Identity=82%"; Hit description =Pantothenate kinase 2
MELDSMDEETTLLTLIEGVLAANIFDWGSRACVDLYHKGTIIEIYRMSHNKMQRPWRVNDFDAFKQRMLGIGDKKPPPHRRALLFVDNAGKKLIYVGAYDSNDVVGHAFNGGRCRCNDIPDLKSVCFNVVADVNNVFEGKASTTAMKSSKSQESRPSKMVFRDRRRLVGGLQ

SEQ ID NO: 122636 - protein, 157 aa, Glycine max
  Coding DNA Sequence Number=SeqID_5858
  Gene Ontology: Mol. function=transporter activity; Cellular component= periplasmic space; Biological process=transport
  Homolog annotation: Hit_ID=Q6D3E3; Match level="QueryCoverage=75%, HitCoverage=22%, E-value=6e-57, Identity=80%"; Hit description =Periplasmic dipeptide transport protein
MIQADWAKVGIKANIVSYEWGEYLKRVKGGEHQAALMGWTTATGDPDNFFGPLYSCTSANGGSNSSKWCYAPFEKIITEARAEQNHDKRVALYREAQQMMHDQMPAVMIAHSTIFEPLQRTLAQLIDIDRAHHQTLLLGLFRQGKTAANGHRQRRAQ

SEQ ID NO: 122637 - protein, 57 aa, Glycine max
  Coding DNA Sequence Number=SeqID_5859
  Gene Ontology: Mol. function=transcription factor activity; Biological process=regulation of transcription, DNA-dependent
  Homolog annotation: Hit_ID=Q397K1; Match level="QueryCoverage=93%, HitCoverage=19%, E-value=9e-09, Identity=51%"; Hit description =Transcriptional regulator, LysR family
SLPASDRRYARLAAVAVRPGGAAADGAQSALRHHGFGDQRGDSGIWRDGGGYYAGGE

SEQ ID NO: 122638 - protein, 371 aa, Glycine max
  Coding DNA Sequence Number=SeqID_5860
  Gene Ontology: Mol. function=signal transducer activity; Cellular component=membrane; Biological process=signal transduction
  Homolog annotation: Hit_ID=UPI00005F7B3B; Match level="QueryCoverage =87%, HitCoverage=59%, E-value=2e-93, Identity=59%"; Hit description =COG0840: Methyl-accepting chemotaxis protein
  Pfam annotation: Domain name=HAMP; Domain location=6-75; Score=32.7; E_value=1.3e-06; Accession=PF00672.15; Description=HAMP domain
  Pfam annotation: Domain name=MCPsignal; Domain location=106-328; Score=357.4; E_value=2.3e-104; Accession=PF00015.11; Description =Methyl-accepting chemotaxis protein (MCP) signaling domain
  Pfam module annotation: Pfam domain module=HAMP::MCPsignal; Domain location=6-75::106-328
MTKVIIVSAVVFGLLILLFTDRYLVTMLVKPLDRIRNHFTVIAQGDLSQPVEEFGRNCVGKLVPLLRAMQDSLREAVSAIRSGTENIYRGAAEISAGNNDLSSRTEEQAAALEQTAASMEQLTATVKFNADNARQASALAETATGTAQQGGRLVGEVVTTMQGISGSSKKIAEITSVINGIAFQTNILALNAAVEAARAGEQGRGFAVVASEVRNLAQRSAGAAKEIATLIEDSVSRVEKGSELVSSAGSTMDDILKSVQDVNEIMKHIAAASEEQSKGISQVGTAVTEMDSVTQQNASLVEQVSAAASALERQTEELQASVAKFRLSDSAPRAQAVASAAAPATALRRPVLSAAAGAQGKPASSVEWVSF

SEQ ID NO: 122639 - protein, 98 aa, Glycine max
  Coding DNA Sequence Number=SeqID_5861
  Gene Ontology: Mol. function=transferase activity; Cellular component= mitochondrion; Biological process=DNA integration
  Homolog annotation: Hit_ID=Q1SPQ1; Match level="QueryCoverage=68%, HitCoverage=13%, E-value=1e-15, Identity=51%"; Hit description =Polynucleotidyl transferase, Ribonuclease H fold
MADKVPAMGTTVLSVFGSHISCVDSLHMKQRIFPHLYGYPANKNSWLVEPMFSRHPHGHLWVYNGIPVTECARMDFDQGNPQCFVRAGCSLRIDPAEP

SEQ ID NO: 122640 - protein, 148 aa, Glycine max
  Coding DNA Sequence Number=SeqID_5862
MWRKAHHAICDIFELRKGACGILILLGREPGLQSMEETCPGRELAVAGHPLVPGQGTAIHNHRTWGHQALHGEAKKKGKVREHGEKRLGKSQGIWMWIRICILVWTGPNRKGIFLVIADKIKGYSLDIQLSNIQLSRYQPQASTGTNG

SEQ ID NO: 122641 - protein, 322 aa, Glycine max
  Coding DNA Sequence Number=SeqID_5863
  Gene Ontology: Mol. function=chromatin binding; Cellular component =chromatin; Biological process=chromatin assembly or disassembly
  Homolog annotation: Hit_ID=Q1SAV4; Match level="QueryCoverage=90%, HitCoverage=80%, E-value=3e-83, Identity=50%"; Hit description =Integrase, catalytic region
  Pfam annotation: Domain name=Chromo; Domain location=243-297; Score =36.6; E_value=8.4e-08; Accession=PF00385.14; Description='chromo' (CHRromatin Organisation MOdifier
  Pfam annotation: Domain name=rve; Domain location=1-117; Score=2.8; E_ value=0.0035; Accession=PF00665.16; Description=Integrase core domain
  Pfam module annotation: Pfam domain module=Chromo::rve; Domain location=243-297::1-117
MLPTHHTAYTVAVLFMDLVGKLHSMPRSLVSDCDPLFLSKFWQELFHLSGTKLRLSSAYHPQSDGQTEVLNRVIEQYLRAFVHKKPSSWGKLLGWVEWSYNTSWNSSSGLTLYEITFGKKPFNFPQYLTGDSNIDVVDVMLTDREAVFTEIKKKLEKAQNRMKYFADKKRREAQFKVGDMVLVKLRPHRQTSVSAYKLLLPEEARIHPVFHCSLLKPYYSTESDTSSHSTTLPVLSKDDHLLIQPLAILNTRQNKDSEQEVLVQWQGLSSDDTTWEKWDQLQAEYHLEDKVLSEAARNDSNTGARPRRKSRAPTYLKDFTSR

SEQ ID NO: 122642 - protein, 385 aa, Glycine max
  Coding DNA Sequence Number=SeqID_5864
  Gene Ontology: Mol. function=pyruvate kinase activity; Cellular component=chloroplast; Biological process=glycolysis
  Homolog annotation: Hit_ID=Q43117; Match level="QueryCoverage=73%, HitCoverage=48%, E-value=1e-140, Identity=89%"; Hit description =Pyruvate kinase isozyme A, chloroplast precursor
  Pfam annotation: Domain name=HpcH_HpaI; Domain location=83-237; Score= -88.5; E_value=0.074; Accession=PF03328.5; Description=HpcHHpaI aldolase family
  Pfam annotation: Domain name=PK; Domain location=3-278; Score=22.7; E_ value=3.4e-18; Accession=PF00224.11; Description=Pyruvate kinase, barrel domain
  Pfam annotation: Domain name=PK_C; Domain location=295-385; Score= -0.9; E_value=1.3e-05; Accession=PF02887.6; Description=Pyruvate kinase, alphabeta domain
  Pfam module annotation: Pfam domain module=HpcH_HpaI::PK::PK_C; Domain location=83-237::3-278::295-385
MATSVGRIVVKLDDGLDVREEASSGPGTVVLDSMMKKWKSIERLKFLKIIKSIWVWLIKVEEYFAATGTLEAERLPRAVKTLRSCAFNWWLRWKLCNPQATLFEFDWLDIDFGISEGVDFIAISFVKSAEVITHLKSYIAARSRDSDISVIAKIESIDSLKNIEEIILAADGAMVARGDLGAQIPLEQVPSAQQRIVEICRQLNKPVIVASQLLESMIEYPTPTRAEVADVSEAVRQRADALMLSGESAMGQYPEKALTVLRSVSLRIEKWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKS

SEQ ID NO: 122643 - protein, 101 aa, Glycine max
  Coding DNA Sequence Number=SeqID_5865
LNRAYPDSFSHCLQHALVPCTAATPIGDLLPNLQEDFRYKESPCPWIPWAMNNHISEPDTTLNPKPYGSNTNCYAIEGDKHWGDLHQWVMSNHISEPNITP

SEQ ID NO: 122644 - protein, 63 aa, Glycine max
  Coding DNA Sequence Number=SeqID_5866
MGEMGRRGVVRLGIRMQETQLAQDSILGSRAYRLNSLVFDENIWEEELEQLEKTEKASTTCKV

SEQ ID NO: 122645 - protein, 82 aa, Glycine max
  Coding DNA Sequence Number=SeqID_5867
MAFFLSYLDYKAQNAQVSNALGNGNFTHTPDIFSKIATLQTKFREDPAVNKGWAAFLPRQLHVASLRSFIKRLPQEASSWLL

SEQ ID NO: 122646 - protein, 502 aa, Glycine max
  Coding DNA Sequence Number=SeqID_5868
  Gene Ontology: Mol. function=protein binding; Cellular component =nucleolus; Biological process=multicellular organismal development
  Homolog annotation: Hit_ID=Q6L3T5; Match level="QueryCoverage=88%, HitCoverage=68%, E-value=2e-47, Identity=29%"; Hit description =Putative Sas10/Utp3 family protein, identical
  Pfam annotation: Domain name=Sas10_Utp3; Domain location=80-474; Score=-65.3; E_value=3.4e-06; Accession=PF04000.5; Description =Sas10Utp3 family
MGKKRGTNYQKKDTKSSKSKTSSRHATYSSDDMDDEIDAFHKQRDIVPLDINDDAEESEDEELPIFDVQDVDEDEDEDEDDEDDDDDDGDDDVAKMIRQRKYLRAKFGGGDDEMHDVDDEEDEEDYKLTLGGKKFSHGAENRNFEIQSSDDEAPKEEEELALQIQREKAKSLTMEDYDLVDISEDKDNEKLTLKDVSDKGNEAIKSLDRDIIFTVDELNALSKEEQMNALYRSAPELVDWLSELNEVHRQLECEINPFLSKVVPLVVFLFSLIHGHANHVKKGEIVMKGEVRYFELKQLIFLSYCQAITFFLLLKSEGQPVHDHPIIARLEEIKKLLDQIKQLDTKLPFELEDILKENNGLETVLNSDIENAPTTNDSIVKNQEQPLVSAKSTEETVVPNKQVEIQELESSKDGVQKTRKVKPQKDHIGAQSLEMLKVRASLEEKLKNKGLYSSIAPKPSNALKRLRPVNGYSFTLLSFTLLVSSMLELISHLQISQPARNI

SEQ ID NO: 122647 - protein, 307 aa, Glycine max
  Coding DNA Sequence Number=SeqID_5869
  Homolog annotation: Hit_ID=Q10PN9; Match level="QueryCoverage=22%, HitCoverage=16%, E-value=1e-12, Identity=57%"; Hit description=5'-3' exonuclease, N-terminal resolvase-like domain containing protein, expressed
  Pfam annotation: Domain name=5_3_exonuc_N; Domain location=171-281; Score=-42.5; E_value=1.9e-05; Accession=PF02739.7; Description=5'-3' exonuclease, N-terminal resolvase-like domain
MVTACANLGGARCVRESGWCWVAAHVEEICESGSNGGSGDGLGRRRERGRGAKKGTRFRHRNSTRFVSLPFLSRSLFFHAVTCFNVYAVTVTAIATNLTQMACCYKYHNLFLHSHFLLRKLPFPSHVYATSFSRNLRTPWLLRSSRAPLSKGYCSATSESPGAVPATPPTAAATLVPGAGIGTARAMQLGSAVNAERVTNSDPLNGRVMIIDGQNFRHNLYPAYKSNRPPTPDTIVQGLQYFKASIKAMSIKIIEASVEADDVIGTLALRSVDAGYKPNLYSVPNAIAPITGNVPPSLVLGVRVEIP

SEQ ID NO: 122648 - protein, 441 aa, Glycine max
  Coding DNA Sequence Number=SeqID_5870
  Gene Ontology: Mol. function=translation initiation factor activity; Cellular component=cytosol; Biological process=regulation of translation
  Homolog annotation: Hit_ID=Q6K8R0; Match level="QueryCoverage=91%, HitCoverage=91%, E-value=1e-116, Identity=49%"; Hit description =Putative eukaryotic translation initiation factor 2A
  Pfam annotation: Domain name=eIF2A; Domain location=187-337; Score =205.5; E_value=1.3e-58; Accession=PF08662.1; Description=Eukaryotic translation initiation fact
MASNSHSPSLEILGPEDFSLWTGPPFANDQPSVKLEKVNCINAKFSDDGSNLMVTKSNSLISVYDCSTAKEIRVFEVPNVVAAALSPKGTYLQTFQKPSGPQEKNVTLWSIETGAAVYQQSQKNMTKANWPAIQFSSDEATGVAAAELSSLPGSHVAAFVPESKGIPASVQIFACGNASQSQPVARRSFFRCSTTQLKWNHGSTGLLVVVQSDVDKTNQSYYGESKLCYLTTDGMHEGLVPLLMPAKATLFDKKCNPLLELGTGPYNTIRWNPKGKYKKQLGATKAEWSVTSEWSPDGCYFMTATTAPRLQVDNGIKIFHYNGSLYFKKMFDKLYQADWKPESPSKFGDIAELIKSLNLVQLEDKKPSGPPKSTQTSTKASSTNPPTQKPAAYRPPHAKNASAIQAEFFVMESMFFLMHSKLLFDYCTRAPENLRLQVLLY

SEQ ID NO: 122649 - protein, 244 aa, Glycine max
  Coding DNA Sequence Number=SeqID_5871
  Gene Ontology: Mol. function=zinc ion binding
  Homolog annotation: Hit_ID=Q5JLV4; Match level="QueryCoverage=73%, HitCoverage=81%, E-value=2e-23, Identity=38%"; Hit description =Putative PIT1
MVNDFIVCIDRIIASTTCFGSVNEKHCDGVDPVIIPVSDNGGKVCSSSSSSSSSNKDDDVVVVVECRICQEEDQAQAMEAPCSCNGTLKEEEEGWEFSEVFVIPCGYWSGVVVLSFDFKLAYELVCSLFLGMQFAHRKQEWGHNADLRVALASAEQQLLQTEYEDYAMSQTSSIAFLRSVTLIMLMILLVREALMVTKNSVTGQDASIIFNFEVSLLQFAGVLLPCFAMARSWYAIQNRRRRQG

SEQ ID NO: 122650 - protein, 122 aa, Glycine max
  Coding DNA Sequence Number=SeqID_5872
  Gene Ontology: Mol. function=zinc ion binding
  Homolog annotation: Hit_ID=Q2R2F0; Match level="QueryCoverage=95%, HitCoverage=36%, E-value=6e-21, Identity=38%"; Hit description=AT hook motif family protein, expressed
MSLVLINYAERPLRESASKEKDEVDIVIPEGTNPEVYTEEQDKLLGDCESTWELYVDGYDEDGNRIYDPIKGEACHQCRYGENVVEVHHNTKWTCLLVGIFATTVLAAGEKVGCLLAKYTVG

SEQ ID NO: 122651 - protein, 214 aa, Glycine max
  Coding DNA Sequence Number=SeqID_5873
  Homolog annotation: Hit_ID=Q1SRN1; Match level="QueryCoverage=55%, HitCoverage=8%, E-value=9e-10, Identity=31%"; Hit description =Integrase, catalytic region
MAVEVAATRGGCGGGHGYGDGRGGHGGQFSNIQCQICHKYGHEASYRYYRHDDNYVPTRPMNCPNQNQYSNSNQNPNQQCNRPHPLKDQIKLLLFCLVKSQVSKEVLLQVLVRADGLNQFLNLLQSSRLPLKSHITVNTNSSDVSEPVFRASSNSVLNSVKGINDASVVNTVSSGSTSFATWHSRLGHPSVDTMKLVFKLCNLPIINKTGSDFC

SEQ ID NO: 122652 - protein, 516 aa, Glycine max
  Coding DNA Sequence Number=SeqID_5874
  Gene Ontology: Mol. function=phosphoinositide binding; Biological process=intracellular signaling cascade
  Homolog annotation: Hit_ID=Q2RAA5; Match level="QueryCoverage=47%, HitCoverage=21%, E-value=1e-53, Identity=49%"; Hit description=Phox domain-containing protein, putative, expressed
  Pfam annotation: Domain name=PX; Domain location=215-322; Score=42.6; E_value=1.3e-09; Accession=PF00787.14; Description=PX domain
MGSDQSTNVASHHHGHSVASEGGHNNLTASNKHPSLNQGTGMILAKTSDQGGTLLQDSILHQDSSQVRPADWARMLEVVNQRRTEILMPENLENMWTKGRNYKRKENKIIKTGSQDLPAKSPSTDSSLPHRKLAQETSASKCGKYEVAEGKSSLPPLPVMGSAPLQNVGDAKSLESSKNPDKELSIVGDLASDGYKSPLKRSSSASSLGILSNKEDSIISEFFNPEFERHSEGFRGKSSSDMIVRKEGPLVPKLRNFERLHRHLKDIPNYTLHLPPKRIFSSSTDDAFVHQRCIQLDKYLQDLLSIANVAEQHEVWDFFSVSSKNYSFGKSPSVMKTLAVNVDDAMDDIVRQFKGVSDGLRRKVVGSSSLINEGSATSNTTWNLSWNADEIDKSIPRQSTAESVFSSDNEEGEKNNFDRDNIDRAVAQDSGLHSDNALISKGNSSRINNCDEESSNLEFDRKHDMVVEARVGNDIPATNFILVHGNLEDPVGVPPEVIVLGTKMLARILPTWSSWE

SEQ ID NO: 122653 - protein, 271 aa, Glycine max
  Coding DNA Sequence Number=SeqID_5875
  Gene Ontology: Mol. function=phosphoinositide binding; Biological process=intracellular signaling cascade
  Homolog annotation: Hit_ID=Q2RAA5; Match level="QueryCoverage=97%, HitCoverage=28%, E-value=6e-77, Identity=51%"; Hit description=Phox domain-containing protein, putative, expressed
  Pfam annotation: Domain name=PXA; Domain location=102-259; Score= -25.4; E_value=0.0063; Accession=PF02194.6; Description=PXA domain
MESVNDLIQEAKLRTLWWALCIFVVSYFLTHTSKSMWMNVPMSILFVVGLRILFNRVEFRWKVPQPRLQTYLSHLEKKQLSLNDPRLTSLPPPAKWKRKIDSPAVEAAMSDFIDKILKDFVVDLWYSEITPDKEFPEQIRAIIMDVLAEISGRVKEINLVDLLTRDLVDLIGVHIELFRRNQATIGVDVMKTLSSEERDDRLKFHLLNSKELHPALISPESSSAANECCFSYSTKTTRSSVSCDSFYISGIINLLGNATYYEFGKPWGLLS

SEQ ID NO: 122654 - protein, 737 aa, Glycine max
  Coding DNA Sequence Number=SeqID_5876
  Gene Ontology: Mol. function=binding; Cellular component=nucleus; Biological process=metabolic process
  Homolog annotation: Hit_ID=Q5ZDP1; Match level="QueryCoverage=81%, HitCoverage=84%, E-value=8e-77, Identity=27%"; Hit description =Pentatricopeptide (PPR) repeat-containing protein-like
  Pfam annotation: Domain name=PPR; Domain location=125-159; Score =32.2; E_value=1.9e-06; Accession=PF01535.11; Description=PPR repeat
  Pfam annotation: Domain name=PPR; Domain location=160-194; Score =10.6; E_value=0.42; Accession=PF01535.11; Description=PPR repeat
  Pfam annotation: Domain name=PPR; Domain location=226-260; Score =30.3; E_value=6.8e-06; Accession=PF01535.11; Description=PPR repeat
  Pfam annotation: Domain name=PPR; Domain location=392-426; Score =25.8; E_value=0.00015; Accession=PF01535.11; Description=PPR repeat
  Pfam annotation: Domain name=PPR; Domain location=455-489; Score =33.8; E_value=6e-07; Accession=PF01535.11; Description=PPR repeat
  Pfam annotation: Domain name=PPR; Domain location=556-590; Score =39.0; E_value=1.6e-08; Accession=PF01535.11; Description=PPR repeat
  Pfam module annotation: Pfam domain module=PPR::PPR::PPR::PPR::PPR::PP R; Domain location=125-159::160-194::226-260::392-426::455-489::556 -590
MGIRQMAKDYNFPQWLRGMRALGRGNEKRNGTEFIMETLAPGIPCFVFHFCTMSLFLRLCFVGTWKRNRWKRNERFRLFTTHLQTTEPHVGNVISTNISIAQRFKMGKLEEARHLFDQMPNRTVSSWNTMISGYSLLGRYPEALTLVSFMHRSCVALNEVSFSAVLSACARSGSFLLGKQVHSLLLKSGYERFGLVGSALLYFCVHCCGIREAEVVFEELRDGNQVLWSLMLAGYVKQDMMDDAMDMFEKMPVRDVVAWTTLISGYAKREDGCERALDLFGCMRRSSEVLPNEFTLDCVVRVCARLGVLRAGKVVHGLCIKGGLDFDNSIGGAVTEFYCGCEAIDDAKRVYESMGGQASLNVANSLIGGLVSKGRIEEAELVFYELRETNPVSYNLMIKGYAMSGQFEKSKRLFEKMSPENLTSLNTMISVYSKNGELDEAVKLFDKTKGERNYVSWNSMMSGYIINGKYKEALNLYVAMRRLSVDYSRSTFSVLFRACSCLCSFRQGQLLHAHLIKTPFQVNVYVGTALVDFYSKCGHLAEAQRSFISIFSPNVAAWTALINGYAYHGLGSEAILLFRSMLHQGIVPNAATFVGVLSACNHAGLVCEGHLKEAEEFIIKMPIEADGIIWGALLNASWFWKDMEVGERAAEKLFSLDPNPIFAFVVLSNMYAILGRWGQKTKLRKRLQSLELRKDPGNLGSNDTASDRELTTDGLGGIVSKPKCSTKKPQGWDDYIH

SEQ ID NO: 122655 - protein, 195 aa, Glycine max
  Coding DNA Sequence Number=SeqID_5877
  Gene Ontology: Mol. function=nucleic acid binding; Biological process= DNA integration
MINNLKRTYWLITWRRMSLRCEKLKANIVTNVSKWVVKMMNVMLISSFAPSNLWGEAVLITYFLQNRIPYKKTGKTPYELWKEHNVFPLKSRQPTGTDSDSFRIKPEQSLENHNEFMAEDLRRSKRQRKETSFGDDFYIYHVEDDPLSFTKAISSSGALSWEQAIKIEIDFTKKNNTWTLVDLPQGVRLVTPCFS

SEQ ID NO: 122656 - protein, 235 aa, Glycine max
  Coding DNA Sequence Number=SeqID_5878
  Gene Ontology: Mol. function=nucleic acid binding; Cellular component= nucleus; Biological process=DNA integration
MYIEIGVTKPIRCKWIFKKYNPNGFIDKYKARLVAKGFTQKQNVDYFDSFVPMTRISSIQVLIALASKHKLVVHQMDVKTDFLNDDQEEIYMTQPKGCVILGQENKVCKLLKPLYGLKQARKQWHDKFNRALLDDVLRTKAFLSSKFDMKDRGEASVILGVRIIRKGDSIKLSQGHYVEKFLKRFGYHDLNPMRQNPLVVMCSHLAVVQLYGDQQTIHNCKINNGIRVCSFGVSW

SEQ ID NO: 122657 - protein, 59 aa, Glycine max
  Coding DNA Sequence Number=SeqID_5879
MVFFILNSLSVNLAKAELSISAILSQLLESSLSQPKFRFSSQVHQGLLLHYNIIDNSTL

SEQ ID NO: 122658 - protein, 107 aa, Glycine max
  Coding DNA Sequence Number=SeqID_5880
MNSYLTEFKSLANHIIDLLHTFLLSCFISGSWHLDGRRAYVTIATTSRDPNIDVQPTMPLSVTVGDGNEFSCSSVCKNVPVVIQSQIFHVDLFAMSIVGANLIFGVE

SEQ ID NO: 122659 - protein, 161 aa, Glycine max
  Coding DNA Sequence Number=SeqID_5881
MSSGIACFQKVTMSSYTFRRRQCLLLKKLQCLLSLCFIGYDALSFYAFKENEMKKKKKKNFSVFMLSRVLLLGLPLVAGWMGFATFQKEMCKIFKRGAKWSFWGHFLAPGPIRKLKGEVTSSPGRASYFRIKSSARLGELSSSQMPHFAINRRGGLKEKGP

SEQ ID NO: 122660 - protein, 126 aa, Glycine max
  Coding DNA Sequence Number=SeqID_5882
  Gene Ontology: Mol. function=oxidoreductase activity
  Homolog annotation: Hit_ID=Q9LJ65; Match level="QueryCoverage=99%, HitCoverage=35%, E-value=3e-27, Identity=46%"; Hit description =Oxidase-like protein
MGEVDPAFIQYLQHRPKFSTIQPEDIPVIDISPITNHTASDPCSIGGLVKEIRNASKEWGFFQLSNHAVPLTLRQNIEKASRLFFTQNLEEKRKVSKDENNTTGYHDREHPKNIRDWKEVFDFLAK

SEQ ID NO: 122661 - protein, 99 aa, Glycine max
  Coding DNA Sequence Number=SeqID_5883
  Gene Ontology: Mol. function=oxidoreductase activity
  Homolog annotation: Hit_ID=Q9LJ65; Match level="QueryCoverage=98%, HitCoverage=42%, E-value=1e-20, Identity=41%"; Hit description =Oxidase-like protein
MEKLCFKLLELIALSLGVEAKRFEELFIKDQTSSILLNCYPPCPYPHLAHGVWSNDAYESVEHRVVVNSEKERFSIPFFYLSHETEVKPLEKLINEQNP

SEQ ID NO: 122662 - protein, 48 aa, Glycine max
  Coding DNA Sequence Number=SeqID_5884
MGHATLPPLSCYSCLNMCPPNAPWNASMTYEHGLGQREGFKMSARMQF

SEQ ID NO: 122663 - protein, 136 aa, Glycine max
  Coding DNA Sequence Number=SeqID_5885
  Subcellular localization annotation: CTP_CleavageSite=61; ConfidenceScore=5.65e-01
MDTSKPYTGAMRGTMHKPQVKLGADKKFSPNRFPATSTYRLQRAARPRLQRTTCPRLQRTACSRLQRATHPLEGCMSSPSESCTPSPSEDYTSSPSEDYMSSPSEDCSSSPSENCTSLPSHVSQRTLRGRARARLT

SEQ ID NO: 122664 - protein, 35 aa, Glycine max
  Coding DNA Sequence Number=SeqID_5886
MEKCKEASTPMATSTYLDLDKKLLSPCNALDAGVR

SEQ ID NO: 122665 - protein, 35 aa, Glycine max
  Coding DNA Sequence Number=SeqID_5887
MTNAKIEPGTAVYKKNRSLWEKGINKQNIEASFLV

SEQ ID NO: 122666 - protein, 284 aa, Glycine max
  Coding DNA Sequence Number=SeqID_5888
  Gene Ontology: Mol. function=methyltransferase activity; Cellular component=chloroplast; Biological process=metabolic process
  Homolog annotation: Hit_ID=Q2XV86; Match level="QueryCoverage=83%, HitCoverage=77%, E-value=2e-95, Identity=66%"; Hit description =MPBQ/MSBQ methyltransferase 2
  Pfam annotation: Domain name=Methyltransf_11; Domain location=89-187; Score=55.5; E_value=1.7e-13; Accession=PF08241.2; Description =Methyltransferase domain
  Pfam annotation: Domain name=Methyltransf_12; Domain location=89-185; Score=25.6; E_value=0.00018; Accession=PF08242.2; Description =Methyltransferase domain
  Pfam annotation: Domain name=Ubie_methyltran; Domain location=43-224; Score=-144.7; E_value=0.051; Accession=PF01209.9; Description =ubiECOQ5 methyltransferase family
  Pfam module annotation: Pfam domain module=Methyltransf _11::Methyltransf_12::Ubie_methyltran; Domain location=89-187::89 -185::43-224
MAYLMLSGAESTKLISGSGIAPSGFGSVGLNFHKSPASQPGFNKEAFWFYKFLATTVYDHVINPWHWTEDMRDNALEHADVYDRKVRMVDVEGGAAFTTLGIVKHVDAKNVTILDQSPHHLAKTKQKEPLKECKIIEGDAENLPFPTDYADHIFLLEGSMCIEYWPDPQRGIKEAYRVLKIRGKACIIGPADFRNIKLKRIGPKWYRGVTRHGLNMGCSVTGIKPLSGDSPLKLGPKTEDVKKPVIPLLLLSRFILGTIAATYYVLVSVYMWIKDKIIPKGIPI

SEQ ID NO: 122667 - protein, 300 aa, Glycine max
  Coding DNA Sequence Number=SeqID_5889
  Gene Ontology: Mol. function=phosphotransferase activity, alcohol group as acceptor; Cellular component=cytoplasm; Biological process =carbohydrate phosphorylation
  Homolog annotation: Hit_ID=UPI000068AB8C; Match level="QueryCoverage =38%, HitCoverage=53%, E-value=3e-50, Identity=83%"; Hit description =transaldolase
  Pfam annotation: Domain name=GHMP_kinases_N; Domain location=229-297; Score=83.1; E_value=8.6e-22; Accession=PF00288.16; Description=GHMP kinases N terminal domain
  Pfam annotation: Domain name=Transaldolase; Domain location=1-142; Score=-1.6; E_value=7.5e-09; Accession=PF00923.9; Description =Transaldolase
  Pfam module annotation: Pfam domain module=GHMP_kinases _N::Transaldolase; Domain location=229-297::1-142
MVKEGEELAALHPRIVVKVPMTQDGIKAIRYFSEKGIKTNCTLVFSSGQALLAAKAGATYVSPFLGRLDDVSTDGLHLISEIREIYDNYAFQTQILAASVRHSMHIINCAKIGADVEQLINPTIQKFRTEFKAEPEHIFLSPGRINIIGEHVDYSDGFVLPAAIDKYICFAVRKLPQSNFCTIIAKDLGEEYTFDVTIEVKPVPQMWMNYILGVFSQLQKSENQFCGMEIVFSSTIPMGSGLSSSAALECGFAYILNELFDLHLTKKEIAVIGQKSEHTFAGVQCGIMDQFASVFGKENK

SEQ ID NO: 122668 - protein, 89 aa, Glycine max
  Coding DNA Sequence Number=SeqID_5890
MEYGEVCRVCVLINIQFPHTTHPKTTLAGCFACTRRLTQTLIKLVLGKKQTHPMSQMTVSTRLRNENEKKHAYIRVVCVVPKKNGMYNV

SEQ ID NO: 122669 - protein, 471 aa, Glycine max
  Coding DNA Sequence Number=SeqID_5891
  Gene Ontology: Mol. function=receptor activity; Cellular component =mitochondrion
  Homolog annotation: Hit_ID=Q10AB4; Match level="QueryCoverage=95%, HitCoverage=96%, E-value=2e-88, Identity=42%"; Hit description =Expressed protein
  Pfam annotation: Domain name=DUF668; Domain location=308-395; Score =173.3; E_value=6.1e-49; Accession=PF05003.3; Description=Protein of unknown function (DUF668)
MALETLLVKVKTAISNSIDSVPPKLLKKKPSFKAKQNVGVLAFEIGGVMSKLLHLWHSLSDATIVRVQNDALNLEGVRKIISNDESFLLGLACAEFAESLRVAANSVTRLSARCEDPALRSFHWAFLEFADSGRDPNMWALSGPKDTDSKLKKMERYVTLTATLYREMEELTVLENSFRKALNHADGNSKDQQKLYELQQKIFWQKQEVKDLKERSLWSRSFDSVVVLLVRFSFTVLARIKVVFGIGRHIPCLSCTLSASATVYPSDQNPNGFVYESLEEEEDLKLEEEEANGFFAANSKLLRPPESTLGASGLALHYANLIIVMEKMIKSPHLVGVDARDDLYGMLPRSIRWGLRGRLRGVGFCASDPVLAGEWRDALGRILGWLSPLAHNMIKWQSERSFEQHNLVPKTNVLLLQTLFFANKDKTEAAITELLVGLNYIWRFEREMTAKALFECANSNGLLLKLNKPSQ

SEQ ID NO: 122670 - protein, 66 aa, Glycine max
  Coding DNA Sequence Number=SeqID_5892
MSLHVLYLYVFSGYPPGIPRLLYLSLQSFKEVNVGAGSSRATFWGRDKVKAAENQSRYLGTDANGG

SEQ ID NO: 122671 - protein, 186 aa, Glycine max
  Coding DNA Sequence Number=SeqID_5893
MCVQITLGCLRMLPDSSKVKAAELCVQITIGYVCLPPDLWMLCLYGQPLGMSACHLTHGSGSSDVVFVWTTDGYVRLPPDPWMTTLASACQSNLGSLNDEITIGCLHMPSDSWVTIAKGGVVDKSGAFALTYPQFVMRNSNLRSSCEMGWKFSSLFKVYGGLRSWLKRLAERPDMMYVRVLVWPVV

SEQ ID NO: 122672 - protein, 138 aa, Glycine max
  Coding DNA Sequence Number=SeqID_5894
RPRLQFPPAKVSAGLCHHDIGIVPTRHPVDPKKSNKVLGFPALITGLCQFYGVPVATSKVIRPSINRAFIEKYSAPRRAQGEVPQQLRDGQQQATDAPPPPLGSTSAHLQRLECCPRPMADRQATKSKAKCSKSTLNV

SEQ ID NO: 122673 - protein, 606 aa, Glycine max
  Coding DNA Sequence Number=SeqID_5895
  Gene Ontology: Mol. function=carboxypeptidase activity; Cellular component=proton-transporting two-sector ATPase complex; Biological process=ATP synthesis coupled proton transport
  Homolog annotation: Hit_ID=Q9FHM0; Match level="QueryCoverage=66%, HitCoverage=76%, E-value=1e-167, Identity=69%"; Hit description =Arabidopsis thaliana genomic DNA, chromosome 5, TAC clone:K17N15
  Pfam annotation: Domain name=DUF231; Domain location=416-596; Score =248.6; E_value=1.3e-71; Accession=PF03005.6; Description=Arabidopsis proteins of unknown function
MAWTTLKGSPRMSSHPRPLSWIVIMVGALAFFLIYASWVLVSSPIGATVQGYFYSVGSSEKLDLPVSSVNEASINDGHSNTSLDLVDKNPSSEDLQSSTISTEVPSDSKTEQTDTTLNSQVDLSDSTSVNLTMTKEVNNNATDVANSSLPTQENSQVDLNSKTTTSLVGINSSNETDNIRMEEPTSVASINPSSAVSTAPNETSISSGDSTSTAVPASVEKPNNTPSAGCDLYRGNWIHDPLGPLYTNNSCPVLTQMQNCQGNGRPDKDYENWRWKPFQCDLPRFDPKKFLELMRGKTLAFIGDSVARNQMESMLCQELSSCGLGAAAATAPCHVHDQMVETPKNRGNRNMQRYYFRSTSVMIVRIWSSWLVKLTSEPFDYAPGGVDKLHLDAPDEKLMEHIPNFDVVVLSSGHWFAKQSVYILNNEIVGGQLWWPDKSRKMKIDSVKAYGISVETFLTAIATIPNYKGLTIVRSYSPDHYEGGAWNTGGSCTGKAKPLAPGELVENVHTNIMHEQQVTGFNRAVERATNGSKLRLMDITEAFQYRHDGHPGPYRSPDPNKITKRGPDGRPPPQDCLHWCMPGPVDTWNELVFEIIRREYEGGSAS

SEQ ID NO: 122674 - protein, 116 aa, Glycine max
  Coding DNA Sequence Number=SeqID_5896
MVNDIFTLSRYKENMVQPKPSVGLKGKPHQHALTHHAFLYFNKQRLGPPRPKSCFGIYPNSRKLSASKNGKNTIEAFHRALGGCTFGYQQQGNGGNVACPIISEHNIGLRPSPTTP

SEQ ID NO: 122675 - protein, 470 aa, Glycine max
  Coding DNA Sequence Number=SeqID_5897
  Gene Ontology: Mol. function=nucleotide binding; Cellular component =phragmoplast; Biological process=translation
  Homolog annotation: Hit_ID=Q6L4A9; Match level="QueryCoverage=98%, HitCoverage=59%, E-value=3e-95, Identity=45%"; Hit description =Putative microtubule-associated protein, identical
  Pfam annotation: Domain name=MAP65_ASE1; Domain location=2-399; Score= -152.5; E_value=0.00042; Accession=PF03999.3; Description=Microtubule associated protein (MAP65ASE1 family)
MQFEAEVARLEALKSSKMKELVLKKRTELEEICRKTHLIPEIDNAVESAVDAIESGSFLLSSKSIAIISYANLKVCLFLFDAGSVDPACILEQIELQISQVKEEAFGRKEILEKVEKWLAACDEESWLEEYNRDDNRYNAGRGAHLTLKRAEKARALVNKIPAMVDGLTSKTIAWEKEKGIEFTYDGIRLLSMLEEYNILRQGKEQERRRQRDLKKLQGQMIAEQEALYGSKPSPSKPQSVKKGPRMSTGGAASRRVSLGGAMLQTPKPDSKATHSRATRKIDKAHQIEHLNYLDDGIAGLSAGGSQSHITAARRGLDIAGVPVKKHSFGAGTQIIESPLLRQPFSPISSNSVSSKSNVANATDEQNKQSEKLQRTLSLNNVPFTTPSKTATTVVDEENRTPKAIPIPVPATPSTVSVPMNMAMTPVPSSIFKNISLNSTTPTSVPHGNDMVQEAEYSFEEKRLSYYMLA

SEQ ID NO: 122676 - protein, 164 aa, Glycine max
  Coding DNA Sequence Number=SeqID_5898
  Homolog annotation: Hit_ID=Q8L9A9; Match level="QueryCoverage=37%, HitCoverage=21%, E-value=3e-27, Identity=82%"; Hit description =Probable xyloglucan endotransglucosylase/hydrolase protein 8 precursor
  Pfam annotation: Domain name=Glyco_hydro_16; Domain location=38-164; Score=-32.3; E_value=3.9e-05; Accession=PF00722.11; Description =Glycosyl hydrolases family 16
MERVSEFPHKKDTAVKFSSAWWLCNMMMKKHPTGKFSLLHGFATSPVRKYPDIDSYSCTSAKRRSNDTSRRFRRVQAKHKAMNNINDYAESLFQLCSENGAGPERDELDFEFLGNKTGEPYLIQTNVYKNGTGGRKMRHMLWFDPTEDYHTYSIHEGRIRMISC

SEQ ID NO: 122677 - protein, 332 aa, Glycine max
  Coding DNA Sequence Number=SeqID_5899
  Gene Ontology: Mol. function=nucleic acid binding; Cellular component= membrane; Biological process=DNA integration
  Homolog annotation: Hit_ID=Q1RSG2; Match level="QueryCoverage=96%, HitCoverage=31%, E-value=3e-58, Identity=33%"; Hit description =Integrase, catalytic region; Zinc finger, CCHC-type
MKEELIMINKNGTWELTPKDKHVIGVKVVYRTKLYPDGHEDNVYRLRKALYPRAWYNRIDSHFLQNDFRRSQNESTLYVKECDFGKQIIVSLYVDDLLVTGLGMMKYFLGMEVDQLDDGIFLSQRKYVVDLLKKFKLESCNPVTTPLAVNEKLSKNDGDAKVDCRQKSAEIFERHGWLILAFGTTKEMSTTGFVFSLGNGVFTWNSKKQGVVAQSSAKAEYIAATTVSNQAIWIRKVLTDLNHVQEESIVVWYDNKLTIVIAKIPIQHGRTKHINAKFHAVRDAEKNGDVQLMHCSSEEQITDILTKALPCAKFNVLRSKLGMFKKSFKEEC

SEQ ID NO: 122678 - protein, 71 aa, Glycine max
  Coding DNA Sequence Number=SeqID_5900
MSLPSAVHVFSIIKCEASGDWEARYSVVFQIGSFAKRKKKEEVEMRVVIAKRAGRTKSVSYLCFTLISDKR

SEQ ID NO: 122679 - protein, 58 aa, Glycine max
  Coding DNA Sequence Number=SeqID_5901
MEHLRQILCPKSFILMKLSGQTPLQWNKGDPLSKWTRDIAKEKLESNSSMMPRRNCKR

SEQ ID NO: 122680 - protein, 104 aa, Glycine max
  Coding DNA Sequence Number=SeqID_5902
MSKILIMGAIFVNMGIFVVQVELLNSNHCAIRKVSQHFGKKMGKKLNPWAHMGPVDDLGEKQLAHLGEQVASGVSHQLAWATWAASSSPYFAINRHEGLKEKGP

SEQ ID NO: 122681 - protein, 117 aa, Glycine max
  Coding DNA Sequence Number=SeqID_5903
  Gene Ontology: Mol. function=single-stranded DNA binding; Cellular component=nucleus; Biological process=protein modification process
  Homolog annotation: Hit_ID=Q9STA6; Match level="QueryCoverage=75%, HitCoverage=19%, E-value=3e-28, Identity=74%"; Hit description=RAD23 protein
  Pfam annotation: Domain name=ubiquitin; Domain location=6-91; Score =65.5; E_value=1.7e-16; Accession=PF00240.13; Description=Ubiquitin family
MKVFVKTLKGTHFEIEVNPSDTVRVQDQLRLSGCMLSEVKKNIETVQGADVYPAAQQMLIHQGKVLKDGTTLEENKVAENSFIVIMLSKLSGALNLTWLSIVAVQQIDGVSDCLCKL

SEQ ID NO: 122682 - protein, 54 aa, Glycine max
  Coding DNA Sequence Number=SeqID_5904
AVAAVAAAIAAERHPSATDMCVAARFRVTAGAAAIVAEHGGAVFRAATSKHWWL

SEQ ID NO: 122683 - protein, 150 aa, Glycine max
  Coding DNA Sequence Number=SeqID_5905
MLDSVIEYITQAASSYAFIFCFCNLIIVIILVDLKPKLSFDQESEQIRLSMPTNTGIEGAISKSLVNKNTFSPQAREVSQHAKEEVVVDKVGSEGNDNCDCNSEEDDDELKRRVEEFIERVNEGWKAEHLSTSSLLWVFGKYPTQAGGLE

SEQ ID NO: 122684 - protein, 141 aa, Glycine max
  Coding DNA Sequence Number=SeqID_5906
MSPSPTKVTASPPTPFTKYIALRNGAPVGIAEDMMLRPDFDVEYFDGDIYAIWVLSLLDLCDAVHCLDGAGHAFHRRHSCREVTAEPVGEDKGGRHREVVVPKTAPAVRDLGAKGEFTGNFVPISFLCSRSAASLKDLKHV

SEQ ID NO: 122685 - protein, 645 aa, Glycine max
  Coding DNA Sequence Number=SeqID_5907
  Gene Ontology: Mol. function=protein binding; Cellular component =integral to membrane; Biological process=defense response to fungus
  Homolog annotation: Hit_ID=Q949G8; Match level="QueryCoverage=97%, HitCoverage=87%, E-value=1e-137, Identity=32%"; Hit description =HcrVf2 protein
  Pfam annotation: Domain name=LRRNT_2; Domain location=19-59; Score =49.3; E_value=1.3e-11; Accession=PF08263.3; Description=Leucine rich repeat N-terminal domain
  Pfam annotation: Domain name=LRR_1; Domain location=109-134; Score =10.8; E_value=2.7; Accession=PF00560.23; Description=Leucine Rich Repeat
  Pfam annotation: Domain name=LRR_1; Domain location=136-158; Score =17.4; E_value=0.051; Accession=PF00560.23; Description=Leucine Rich Repeat
  Pfam annotation: Domain name=LRR_1; Domain location=187-208; Score =12.8; E_value=1.1; Accession=PF00560.23; Description=Leucine Rich Repeat
  Pfam annotation: Domain name=LRR_1; Domain location=213-235; Score =6.9; E_value=14; Accession=PF00560.23; Description=Leucine Rich Repeat
  Pfam annotation: Domain name=LRR_1; Domain location=237-262; Score =5.8; E_value=23; Accession=PF00560.23; Description=Leucine Rich Repeat
  Pfam annotation: Domain name=LRR_1; Domain location=264-286; Score =14.8; E_value=0.32; Accession=PF00560.23; Description=Leucine Rich Repeat
  Pfam annotation: Domain name=LRR_1; Domain location=288-310; Score =8.1; E_value=8.7; Accession=PF00560.23; Description=Leucine Rich Repeat
  Pfam annotation: Domain name=LRR_1; Domain location=312-334; Score =13.5; E_value=0.79; Accession=PF00560.23; Description=Leucine Rich Repeat
  Pfam annotation: Domain name=LRR_1; Domain location=336-358; Score =16.5; E_value=0.098; Accession=PF00560.23; Description=Leucine Rich Repeat
  Pfam annotation: Domain name=LRR_1; Domain location=365-387; Score =7.8; E_value=9.8; Accession=PF00560.23; Description=Leucine Rich Repeat
  Pfam annotation: Domain name=LRR_1; Domain location=389-412; Score =11.0; E_value=2.5; Accession=PF00560.23; Description=Leucine Rich Repeat
  Pfam annotation: Domain name=LRR_1; Domain location=414-437; Score =7.8; E_value=10; Accession=PF00560.23; Description=Leucine Rich Repeat
  Pfam annotation: Domain name=LRR_1; Domain location=462-484; Score =5.8; E_value=24; Accession=PF00560.23; Description=Leucine Rich Repeat
  Pfam annotation: Domain name=LRR_1; Domain location=487-509; Score =5.4; E_value=27; Accession=PF00560.23; Description=Leucine Rich Repeat
  Pfam annotation: Domain name=LRR_1; Domain location=511-530; Score =5.3; E_value=29; Accession=PF00560.23; Description=Leucine Rich Repeat
  Pfam annotation: Domain name=LRR_1; Domain location=532-554; Score =2.9; E_value=82; Accession=PF00560.23; Description=Leucine Rich Repeat
  Pfam annotation: Domain name=LRR_1; Domain location=560-579; Score =11.6; E_value=1.9; Accession=PF00560.23; Description=Leucine Rich Repeat
  Pfam annotation: Domain name=LRR_1; Domain location=584-606; Score =8.1; E_value=8.6; Accession=PF00560.23; Description=Leucine Rich Repeat
  Pfam annotation: Domain name=LRR_1; Domain location=608-630; Score =10.5; E_value=3.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1; Domain location=19 -59::109-134::...
  Pfam module annotation: Domain location=136-158::187-208::213 -235::237-262::264-286::288-310::312-334::336-358::365-387::389 -412::414-437::462-484::487-509::511-530::532-554::560-579::584 -606::608-630
MENLEIDLMVLPCRESVCIPSERETLLKFKNNLIDPSNRLWSWNHNHTNCCHWYGVLCHNVTSHLLQLHLNTSPSTAFYRYYDGYFDREAYRGFQFGGEISPCLADLKHLNYLDLSGNRFLGEGMSIPSFLGTMTSLTHLDLSGNGFMGKIPSQIGNLSNLVYLDLASYYLNSLIAENVEWVSSMWKLEYLDLSNANLSKAFHWLHTLQSLPSLTHLYLSYCTLPHYNEPSLLNFSSLQTLDLSRTRYSPAISFVPKWIFKLKKLVSLQLQGNEIQGPIPGGIRNLSLLQNIDLSFNSFSSSIPNCLYGLHRLKFLNLVHNNLHGTISDALGNLTSLVELVLSYNQLEGTIPTFLGNLRNSREIDLTYLDLSMNKFSGNPFESLGSLSKLSSLFINDNNFQGVVNEDDLANLTSLRAFDASGNNFTLKVGPNWLPNFHLSYLDVTSWHIGPNFPSWIQSQNKLRYVGLSNTGILDSIPTWFWEAQSQVLYLNLSHNHIHGELVTTIKNPISIQTVDLSTNHLCGKLPHLSNDVYELDLSTNSFSESMQDFLCNNQDKPMQLEFLNLASNNLSGEIPDCWINWPFLVEVNLQSNHFVGNFPPSMGSLAELQSLEIRNNLLSGIFPTSLKKTSQLISLDLGENNLQD

SEQ ID NO: 122686 - protein, 295 aa, Glycine max
  Coding DNA Sequence Number=SeqID_5908
  Gene Ontology: Mol. function=single-stranded DNA binding; Cellular component=nucleus; Biological process=protein modification process
  Homolog annotation: Hit_ID=Q9STA6; Match level="QueryCoverage=71%, HitCoverage=55%, E-value=3e-81, Identity=75%"; Hit description=RAD23 protein
  Pfam annotation: Domain name=UBA; Domain location=72-114; Score=43.0; E_value=1e-09; Accession=PF00627.21; Description=UBATS-N domain
  Pfam annotation: Domain name=XPC-binding; Domain location=179-237; Score=109.9; E_value=7.3e-30; Accession=PF09280.1; Description=XPC -binding domain
  Pfam module annotation: Pfam domain module=UBA::XPC-binding; Domain location=72-114::179-237
  Subcellular localization annotation: CTP_CleavageSite=41; ConfidenceScore=5.77e-01
MCQIMQASATPTSTSVSAAPQAPASTGATPTPVTAPAAPASAAAPAPISSGSAVPESDIYGQAASNLVAGSNLEGTIQQILDMGGGSWDRDTVVRALRAAYNNPERAVEYLYSGIPEQAEAPPVTREPASAQPANPPAAAPQAAQPASVPSSGPNANPLDLFPQGLPNVGSGAAGAGSLDFLRNSQQFQALRAMVQANPQILQPMLQELGKQNPHLMRLIQEHQVDFLRLINEPVEGGEGNILGQLASAMPQAVTVTPEERQAIERVLMNELMFGNIYLVILMQCCLSSVNENHF

SEQ ID NO: 122687 - protein, 91 aa, Glycine max
  Coding DNA Sequence Number=SeqID_5909
MDKEINGADGVNKFQSGEEEEDKEQCSPVSVLDPPFDDDDDDHEGDGFDWDCSYANHFMLLRCFVLMPPIFGGFHWKIAIAHHPTCISHSM

SEQ ID NO: 122688 - protein, 984 aa, Glycine max
  Coding DNA Sequence Number=SeqID_5910
  Gene Ontology: Mol. function=protein binding; Cellular component =integral to membrane; Biological process=defense response to fungus
  Homolog annotation: Hit_ID=Q949G8; Match level="QueryCoverage=97%, HitCoverage=93%, E-value=0.0, Identity=43%"; Hit description=HcrVf2 protein
  Pfam annotation: Domain name=LRRNT_2; Domain location=1-38; Score =37.5; E_value=4.7e-08; Accession=PF08263.3; Description=Leucine rich repeat N-terminal domain
  Pfam annotation: Domain name=LRR_1; Domain location=108-130; Score =14.9; E_value=0.29; Accession=PF00560.23; Description=Leucine Rich Repeat
  Pfam annotation: Domain name=LRR_1; Domain location=155-180; Score =11.6; E_value=1.9; Accession=PF00560.23; Description=Leucine Rich Repeat
  Pfam annotation: Domain name=LRR_1; Domain location=182-204; Score =14.3; E_value=0.44; Accession=PF00560.23; Description=Leucine Rich Repeat
  Pfam annotation: Domain name=LRR_1; Domain location=234-255; Score =11.9; E_value=1.7; Accession=PF00560.23; Description=Leucine Rich Repeat
  Pfam annotation: Domain name=LRR_1; Domain location=260-282; Score =3.6; E_value=61; Accession=PF00560.23; Description=Leucine Rich Repeat
  Pfam annotation: Domain name=LRR_1; Domain location=284-309; Score =2.6; E_value=93; Accession=PF00560.23; Description=Leucine Rich Repeat
  Pfam annotation: Domain name=LRR_1; Domain location=311-333; Score =12.7; E_value=1.2; Accession=PF00560.23; Description=Leucine Rich Repeat
  Pfam annotation: Domain name=LRR_1; Domain location=335-357; Score =9.8; E_value=4.2; Accession=PF00560.23; Description=Leucine Rich Repeat
  Pfam annotation: Domain name=LRR_1; Domain location=359-381; Score =11.8; E_value=1.8; Accession=PF00560.23; Description=Leucine Rich Repeat
  Pfam annotation: Domain name=LRR_1; Domain location=383-405; Score =19.0; E_value=0.018; Accession=PF00560.23; Description=Leucine Rich Repeat
  Pfam annotation: Domain name=LRR_1; Domain location=412-434; Score =9.5; E_value=4.7; Accession=PF00560.23; Description=Leucine Rich Repeat
  Pfam annotation: Domain name=LRR_1; Domain location=436-459; Score =11.5; E_value=2; Accession=PF00560.23; Description=Leucine Rich Repeat
  Pfam annotation: Domain name=LRR_1; Domain location=461-484; Score =7.3; E_value=12; Accession=PF00560.23; Description=Leucine Rich Repeat
  Pfam annotation: Domain name=LRR_1; Domain location=509-531; Score =5.5; E_value=27; Accession=PF00560.23; Description=Leucine Rich Repeat
  Pfam annotation: Domain name=LRR_1; Domain location=534-556; Score =6.7; E_value=16; Accession=PF00560.23; Description=Leucine Rich Repeat
  Pfam annotation: Domain name=LRR_1; Domain location=558-583; Score =4.6; E_value=40; Accession=PF00560.23; Description=Leucine Rich Repeat
  Pfam annotation: Domain name=LRR_1; Domain location=607-626; Score =11.6; E_value=1.9; Accession=PF00560.23; Description=Leucine Rich Repeat
  Pfam annotation: Domain name=LRR_1; Domain location=631-653; Score =8.1; E_value=8.6; Accession=PF00560.23; Description=Leucine Rich Repeat
  Pfam annotation: Domain name=LRR_1; Domain location=655-677; Score =8.9; E_value=6.3; Accession=PF00560.23; Description=Leucine Rich Repeat
  Pfam annotation: Domain name=LRR_1; Domain location=679-702; Score =11.5; E_value=2; Accession=PF00560.23; Description=Leucine Rich Repeat
  Pfam annotation: Domain name=LRR_1; Domain location=704-726; Score =11.2; E_value=2.2; Accession=PF00560.23; Description=Leucine Rich Repeat
  Pfam annotation: Domain name=LRR_1; Domain location=728-750; Score =16.1; E_value=0.13; Accession=PF00560.23; Description=Leucine Rich Repeat
  Pfam annotation: Domain name=LRR_1; Domain location=800-822; Score =7.9; E_value=9.6; Accession=PF00560.23; Description=Leucine Rich Repeat
  Pfam annotation: Domain name=LRR_1; Domain location=81-106; Score =6.4; E_value=18; Accession=PF00560.23; Description=Leucine Rich Repeat
  Pfam annotation: Domain name=LRR_1; Domain location=824-846; Score =15.1; E_value=0.25; Accession=PF00560.23; Description=Leucine Rich Repeat
  Pfam annotation: Domain name=LRR_1; Domain location=848-870; Score =16.0; E_value=0.14; Accession=PF00560.23; Description=Leucine Rich Repeat
  Pfam annotation: Domain name=LRR_1; Domain location=872-893; Score =6.8; E_value=15; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1; Domain location=1-38::108-130::155-180::182-204::234-255::260 -282::284-309::311-333::335-357::359-381::383-405::412-434::436 -459::461-484::509-531::534-556:...
  Pfam module annotation: Domain location=:558-583::607-626::631 -653::655-677::679-702::704-726::728-750::800-822::81-106::824 -846::848-870::872-893
ERETLLKFKNNLIDPSNRLWSWNHNNTNCCHWYGVLCHNLTSHLLQLHLNSSDSIFNDDWEAYRRWSFGGEISPCLADLKHLNYLDLSANEYLGEGMSIPSFLGTMTSLTHLNLSHTGFMGKIPPQIGNLSNLVYLDLRAVADGAVPSQIGNLSKLQYLDLSGNYFLGEGMAIPSFLGTMTSLTHLDLSYTGFYGKIPPQIGNLSNLLYLGLGGHSSLEPLFVENVEWVSSMWKLEYLDLSYANLSKAFHWLHTLQSLPSLTHLYFSECTLPHYNEPSLLNFSSLQSLILYNTSYSPAISFVPKWIFKLKKLVSLQLVRNGIQGPIPGGIRNLTLLQNLDLSENSFSSSIPDCLYGLHRLKFLNLMDNNLHGTISDALGNLTSLVELDLSYNQLEGTIPTFLGNLRNSREIDLTFLDLSINKFSGNPFESLGSLSKLSVLHINYNNFQGVVNEDDLANLTSLKAFDASGNNFTLKVGPNWLPNFQLFFLDVTSWHIGPNFPSWIQSQNKLQYVGLSNTGILDSIPTWFWEAHSQVSYLNLSHNHIHGELVTTIKNPISIQTVDLSTNHLCGKLPYLSSDVYGLDLSTNSFSESMQDFLCNNQDKPMQLEFLNLASNNLSGEIPDCWINWPFLVEVNLQSNHFVGNFPPSMGSLAELQSLEIRNNWLSGIFPTSLKKTGQLISLDLGENNLSGCIPTWVGEKLSNMKILRLRSNSFSGHIPNEICQMSRLQVLDLAKNNLSGNIPSCFRNLSAMTLVNRSTYPQIYSYAPNNTEHSSVSGIVSVLLWLKGRGDEYGNILGLVTSIDLSSNKLLGEIPREITDLNGLNFLNLSHNQLIGPIPEGIGNMGSLQTIDFSRNQISGEIPPTISKLSFLSMLDVSYNHLKGKIPTGTQLQTFDASSFIGNNLCGPPLPINCSSNGKTHSYEGSHGHGVNWFFVSATIGFVVGLWIVIAPLLIFVTRGCIQDLTLQAGKAKNFDEISIDNQ

SEQ ID NO: 122689 - protein, 175 aa, Glycine max
  Coding DNA Sequence Number=SeqID_5911
  Homolog annotation: Hit_ID=Q2HRE1; Match level="QueryCoverage=79%, HitCoverage=52%, E-value=6e-14, Identity=49%"; Hit description =Lipopolysaccharide-modifying protein
  Pfam annotation: Domain name=DUF821; Domain location=3-169; Score= -190.1; E_value=2.5e-09; Accession=PF05686.3; Description=Arabidopsis thaliana protein of unknown function (DUF821)
MAYFVGRVERRHYGDTMAEQRALCLLERIGFENHKRGSTNQTCQVNALIDIRCTLKVLFGQSVKNTFCHVTLPLYVYDYMFHLLNSYAKLFRYKPSISANATELCVESMVCGAEGSVKKFMMESLVKVPANTDPCTMPAPFDPPTLYATLERKESSIQQVESWEKSYWDNQTITS

SEQ ID NO: 122690 - protein, 134 aa, Glycine max
  Coding DNA Sequence Number=SeqID_5912
  Gene Ontology: Mol. function=kinase activity
  Homolog annotation: Hit_ID=Q69T90; Match level="QueryCoverage=66%, HitCoverage=27%, E-value=9e-12, Identity=38%"; Hit description =Pantothenate kinase-like
MGFYYFNREGDTSIPDATTKAEEFAQSIASFADTFPAKRFARIIEDFKKDPARQGVPLDVLDVENANAISLFENVVRLNDAIVDEGKRLENLVRGVFARTYLILVLHMLVDFLFQRRKKKVQRGGGKYPERERG

SEQ ID NO: 122691 - protein, 501 aa, Glycine max
  Coding DNA Sequence Number=SeqID_5913
  Gene Ontology: Mol. function=DNA binding; Cellular component =chromatin; Biological process=DNA integration
  Homolog annotation: Hit_ID=Q1S9T4; Match level="QueryCoverage=99%, HitCoverage=37%, E-value=0.0, Identity=84%"; Hit description =Integrase, catalytic region
MAMKDEYDALIENKTWDLVPRPSNANVIRSLWIFRHKKKSDGSFERYKARLVGNGANQQTGVDCGDTFSPVVKPATIRTVLSVALSKSWCLHQLDVKNAFLHGNLHETVYMHQPPGFRNSQFPDHVCLLKKSLYGLKQAPRAWYQRFTDYVATIGFSHSISDHSLFIYHHGNNIAYILLYVDDIILAASSDTLRESIMAQLSSEFSMKDLGPLSYFLGISVTRHPEGLFLSQKKYAEEIIERAGMSSCKPSSTPVDTKAKLSGSSGNPYHDPTEYRSLAGALQYLTFTRPDISYAVQQVCLFMHDPKTQHMSALKRIIRYINGTIDFGLHLYPSSIDKLISYTDADWAGCPDTRRSTSGYCVYLGDNLISWSAKRQHTLSRSSAEAEYRGVANVVSESCWLRNLLLELCCPVTKATLVYCDNISAVYLSDNPVQHQRTKHIEMDIHFVREKVACGQVRVLHIPSRFQIADIFTKGLPLQLFDDFRDSLNIRSPPVSTTGVY

SEQ ID NO: 122692 - protein, 106 aa, Glycine max
  Coding DNA Sequence Number=SeqID_5914
  Gene Ontology: Mol. function=transcription factor activity; Cellular component=nucleus; Biological process=regulation of transcription, DNA-dependent
  Homolog annotation: Hit_ID=Q9FH94; Match level="QueryCoverage=100%, HitCoverage=54%, E-value=3e-33, Identity=71%"; Hit description=TINY -like protein
  Pfam annotation: Domain name=AP2; Domain location=21-85; Score=136.2; E_value=8.8e-38; Accession=PF00847.10; Description=AP2 domain
MEGEGGSATRKRGKDGETETTTRYKGIRMRKWGKWVAEIREPNKRSRIWLGSYSTPVAAARAYDTAVFYLRGPSARLNFPELLAAEGPAASDAVMSAASIRKKATE

SEQ ID NO: 122693 - protein, 93 aa, Glycine max
  Coding DNA Sequence Number=SeqID_5915
MGFVGRGDMEVEVDVWRLKSLRGGGVGSDVGDGDDMIVGNDGFGGDVMGGADAVVGEGWSTILMVRGWSTIGIGWKEGCVVIQKIIANRCRDI

SEQ ID NO: 122694 - protein, 66 aa, Glycine max
  Coding DNA Sequence Number=SeqID_5916
MIAKKSRGKLKQGRSVGKEKQRESKEACRHKVVHNRAQRRWIMSAKESNSDCLPTQRLGLVLESRM

SEQ ID NO: 122695 - protein, 722 aa, Glycine max
  Coding DNA Sequence Number=SeqID_5917
  Homolog annotation: Hit_ID=Q1RVB7; Match level="QueryCoverage=96%, HitCoverage=96%, E-value=0.0, Identity=54%"; Hit description=Zinc finger, BED-type predicted
MASTVASAMASTSAAEPDPDAAARKRYEGLLTVRTRAIKGKGAWYWAHLEPMLLNNAVKLKCSLCDSLFSASNPSRTASEHLKRGACPNFNHSSLPSPSPISTVLSHSHSNNGRKRTSTSTSNSPNQDHSVQHLVLSGGKDDLCALAVFEDSVKKLKSPRNLSHVAPPELTKDQVNSAVELLADWFYESCGSVPLSALEHPKFQSFLTQLGLPVTLLRREIYGSRLDDRFGLAKAESETRMRDAMFFQVGCDGWKGEDGVVKFIVNLPNGTSVFNKVVFGGGGGVVSSKYAEEILWELVSGVCGSDVQRCVGVVADRFKGKALRNLEVQNHWMVNVACQVQGFMGLIKDFSIGLPLFSVVTENCLKVANFINTESQVRSSFLRYRMQELECAGLVRVPSPKCHVLKDFAASVFPMLEDILSCAAVIQMVVLEDTFKVACMEDPLAREVAGIVQSEGFWNELEAVYSLVKLIRGVVQDIGAERPLIGRCLPLWEEVRTKVVKEWCVKYSVAEAPVVEILEKRFRKNYHPAWSAAFILDPLYLVKDASGKYLPPFNCLTREQEKDVDKLLTRLASREEAHVVLMELMKWRSEGLDPLYAQAVQMKQRDPVTGKMKVANPLSSRLVWETCLSEFKSLGKLAVRLIFLHGTSSGFKSNCSFIRKISANKHSRVSLERALKVVYIAAHAKLERRDFSNEEEKEAELLAREGSDDGMLAEVFADAPLL

SEQ ID NO: 122696 - protein, 61 aa, Glycine max
  Coding DNA Sequence Number=SeqID_5918
MARTCSPLKVKACSPLKVRTCSPRKIDCPFESGDNSCNLILSFANLSGNSLIVYVLFDLVT

SEQ ID NO: 122697 - protein, 137 aa, Glycine max
  Coding DNA Sequence Number=SeqID_5919
MSGVERKCNAQSVKFRNIPEAKRGDDCIIHKQSGPLGPSRMFKQKAVPSGGSNPACLGELAATTSLFSPINRGRRAEQIRSTLLVSENHLKLVRKIVSVKKIQAEALPRRFRGRFREGFPPFFIVLRSFFVVLRSST

SEQ ID NO: 122698 - protein, 141 aa, Glycine max
  Coding DNA Sequence Number=SeqID_5920
MPRTHDAILYYNGKWNMPPQNKFVGCAFTGKNPKKFQIPSTCTIDELKNLIKQVAPKGIPPLGIHESQMVRRLFFRQPARFEYSDTLIKYEINELRTNEELLKVLVQSNYWKKYEPIEILAVFTKYVVKIEDEVTGTSLNN

SEQ ID NO: 122699 - protein, 912 aa, Glycine max
  Coding DNA Sequence Number=SeqID_5921
  Gene Ontology: Mol. function=protein binding; Cellular component =integral to membrane; Biological process=defense response to fungus
  Homolog annotation: Hit_ID=Q1SWI7; Match level="QueryCoverage=98%, HitCoverage=99%, E-value=0.0, Identity=37%"; Hit description=Leucine- rich repeat
  Pfam annotation: Domain name=LRR_1; Domain location=12-34; Score =14.7; E_value=0.33; Accession=PF00560.23; Description=Leucine Rich Repeat
  Pfam annotation: Domain name=LRR_1; Domain location=148-170; Score =10.2; E_value=3.5; Accession=PF00560.23; Description=Leucine Rich Repeat
  Pfam annotation: Domain name=LRR_1; Domain location=172-194; Score =16.6; E_value=0.09; Accession=PF00560.23; Description=Leucine Rich Repeat
  Pfam annotation: Domain name=LRR_1; Domain location=196-218; Score =12.8; E_value=1.2; Accession=PF00560.23; Description=Leucine Rich Repeat
  Pfam annotation: Domain name=LRR_1; Domain location=220-242; Score =23.1; E_value=0.00099; Accession=PF00560.23; Description=Leucine Rich Repeat
  Pfam annotation: Domain name=LRR_1; Domain location=244-266; Score =15.7; E_value=0.17; Accession=PF00560.23; Description=Leucine Rich Repeat
  Pfam annotation: Domain name=LRR_1; Domain location=268-290; Score =14.7; E_value=0.34; Accession=PF00560.23; Description=Leucine Rich Repeat
  Pfam annotation: Domain name=LRR_1; Domain location=321-343; Score =1.6; E_value=1.4e+02; Accession=PF00560.23; Description=Leucine Rich Repeat
  Pfam annotation: Domain name=LRR_1; Domain location=345-367; Score =12.3; E_value=1.4; Accession=PF00560.23; Description=Leucine Rich Repeat
  Pfam annotation: Domain name=LRR_1; Domain location=369-391; Score =11.6; E_value=1.9; Accession=PF00560.23; Description=Leucine Rich Repeat
  Pfam annotation: Domain name=LRR_1; Domain location=393-416; Score =8.1; E_value=8.7; Accession=PF00560.23; Description=Leucine Rich Repeat
  Pfam annotation: Domain name=LRR_1; Domain location=418-440; Score =0.7; E_value=2.1e+02; Accession=PF00560.23; Description=Leucine Rich Repeat
  Pfam annotation: Domain name=LRR_1; Domain location=466-489; Score =7.5; E_value=11; Accession=PF00560.23; Description=Leucine Rich Repeat
  Pfam annotation: Domain name=LRR_1; Domain location=491-524; Score =5.2; E_value=30; Accession=PF00560.23; Description=Leucine Rich Repeat
  Pfam annotation: Domain name=LRR_1; Domain location=536-557; Score =4.3; E_value=45; Accession=PF00560.23; Description=Leucine Rich Repeat
  Pfam annotation: Domain name=LRR_1; Domain location=564-585; Score =12.2; E_value=1.5; Accession=PF00560.23; Description=Leucine Rich Repeat
  Pfam annotation: Domain name=LRR_1; Domain location=588-610; Score =7.0; E_value=14; Accession=PF00560.23; Description=Leucine Rich Repeat
  Pfam annotation: Domain name=LRR_1; Domain location=61-82; Score =11.0; E_value=2.5; Accession=PF00560.23; Description=Leucine Rich Repeat
  Pfam annotation: Domain name=LRR_1; Domain location=612-634; Score =10.5; E_value=3.1; Accession=PF00560.23; Description=Leucine Rich Repeat
  Pfam annotation: Domain name=LRR_1; Domain location=636-659; Score =13.2; E_value=0.93; Accession=PF00560.23; Description=Leucine Rich Repeat
  Pfam annotation: Domain name=LRR_1; Domain location=661-683; Score =11.1; E_value=2.3; Accession=PF00560.23; Description=Leucine Rich Repeat
  Pfam annotation: Domain name=LRR_1; Domain location=685-707; Score =13.7; E_value=0.68; Accession=PF00560.23; Description=Leucine Rich Repeat
  Pfam annotation: Domain name=LRR_1; Domain location=727-749; Score =8.7; E_value=6.6; Accession=PF00560.23; Description=Leucine Rich Repeat
  Pfam annotation: Domain name=LRR_1; Domain location=751-773; Score =13.7; E_value=0.68; Accession=PF00560.23; Description=Leucine Rich Repeat
  Pfam annotation: Domain name=LRR_1; Domain location=775-797; Score =17.0; E_value=0.068; Accession=PF00560.23; Description=Leucine Rich Repeat
  Pfam annotation: Domain name=LRR_1; Domain location=799-820; Score =4.7; E_value=38; Accession=PF00560.23; Description=Leucine Rich Repeat
  Pfam annotation: Domain name=LRR_1; Domain location=87-115; Score =8.5; E_value=7.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::LRR_1; Domain location=12-34::148-170::172-194::196-218::220-242::244-266::268 -290::321-343::345-367::369-391::393-416::418-440::466-489::491 -524::536-557::564-585::...
  Pfam module annotation: Domain location=588-610::61-82::612-634::636 -659::661-683::685-707::727-749::751-773::775-797::799-820::87-115
MAIPSFLGTMTSLTHLNLSHTGFYGKIPPQIGNLSNLVYLDLGGYSDLFAENVEWVSSMWKLEYLHLSNANLSKAFHWLHTLQSLPSLTHLYLSGCTLPHYNEPSLLNFSSLQTLHLSLTRYSPAISFVPKGNEIQGPIPVGIRNLTLLQNLDLSQNSFSSSIPDCLYGLHRLKYLDLRGNNLHGTISDALGNLTSLVELHLLYNQLEGTIPTSLGNLTSLVELDLSNNQLEGTIPPSLGNLTSLVRLDLSYSQLEGNIPTSLGNLTSLVELDLSYSQLEGNIPTSLGNVCNLRVIGLSYLKLNQQVNELLEILAPCISHGLTRLAVQSSQLSGNLTDHIGAFKNIVLLDFSNNSIGGALPRSFGKLSSLRYLNLSINKFSGNPFESLGSLSKLSSLYIDGNLFHGLVKEDDLANLTSLTEFGASGNNFTLKVGPNWRPNFRLSYLDVTSWQLSPNFPSWIQSQNKLEYVGLSNTGIFDSIPTQMWETLPQVLYLNLSHNHIHGESGTTLKNPISIPVIDLSSNHLCGKLPYLSSDVSQLDLSSNSISESMNDFLCNDQDEPMQLQFLNLASNNLSGEIPDCWMNWTFLVNVNLQSNHFVGNLPQSMGSLAELQSLQIRNNTLSGIFPTSLKKNNQLISLDLRENNLSGSIPTWVGEKLLNVKILLLRSNSFTGHIPNEICQMSLLQVLDLAQNNLSGNIPSCFSNLSAMTLKNQRRGDEYRNILGLVTSIDLSSNNLLGEIPRKITNLNGLNFLNLSHNQLIGHIPQGIGSMGSLQSIDFSRNQLSGEIPPTISNLSFLSMLDVAYNHLKGKIPTGTQLQTFDASSFIGNNLCGPPLPINCSSNGKTHSYEGSDGHGVNWFFVSATIGFIVGFWIVIAPLLICRSWRYAYFHFLDHVWFKLQSFYSCSISV

SEQ ID NO: 122700 - protein, 258 aa, Glycine max
  Coding DNA Sequence Number=SeqID_5922
  Homolog annotation: Hit_ID=Q9SWB3; Match level="QueryCoverage=96%, HitCoverage=56%, E-value=8e-89, Identity=71%"; Hit description=Seed maturation protein PM39
MTPPKQLKQSIKKRTQAMKTVNNLISNLSQKHCHFEASPTTPQEKRTDHAAAPTEYGKSVAQSLTEKLAPVSGKVAGVGSGVKSKVSGTQTSSVGVEQDKGVSVKDYLVDKLRPGDEDRALSEVISETLHKKELPPVEVTEEGVRKVVSDAVHKREDDPERRMEHQRILGKVTESEEVKGRLGGESVVTEKKYQEMYVNSPGKGVVDKLKGMVGTWFTNPAENQSSQDSSMNYEAGRAEVEQVNQGAAGERRQQESYN

SEQ ID NO: 122701 - protein, 186 aa, Glycine max
  Coding DNA Sequence Number=SeqID_5923
  Gene Ontology: Mol. function=protein binding; Cellular component =integral to membrane; Biological process=defense response to fungus
  Homolog annotation: Hit_ID=Q1SWI6; Match level="QueryCoverage=78%, HitCoverage=64%, E-value=5e-37, Identity=54%"; Hit description =Leucine-rich repeat, plant specific
  Pfam annotation: Domain name=LRRNT_2; Domain location=27-67; Score =53.1; E_value=9e-13; Accession=PF08263.3; Description=Leucine rich repeat N-terminal domain
  Pfam annotation: Domain name=LRR_1; Domain location=121-146; Score =9.6; E_value=4.6; Accession=PF00560.23; Description=Leucine Rich Repeat
  Pfam annotation: Domain name=LRR_1; Domain location=148-170; Score =14.3; E_value=0.45; Accession=PF00560.23; Description=Leucine Rich Repeat
  Pfam module annotation: Pfam domain module=LRRNT_2::LRR_1::LRR_1; Domain location=27-67::121-146::148-170
MNSSSIYILVFVQLWLFSLPCRESVCIPSERETLLKFKNNLNDPSNRLWSWNPNNTNCCHWYGVLCHNLTSHLLQLHLNTSPSAFYHDYYDDGFYRRFDEEAYRRWSFGGEISPCLADLKHLNYLDLSGNYLLGAGMSIPSFLGTMTSLTHLDLSDSGFYGKIPPQIGNLSNLVYLDLSLDVANGT

SEQ ID NO: 122702 - protein, 244 aa, Glycine max
  Coding DNA Sequence Number=SeqID_5924
  Gene Ontology: Mol. function=protein binding; Cellular component =integral to membrane; Biological process=protein amino acid phosphorylation
  Homolog annotation: Hit_ID=Q1SWI6; Match level="QueryCoverage=89%, HitCoverage=88%, E-value=3e-41, Identity=48%"; Hit description =Leucine-rich repeat, plant specific
  Pfam annotation: Domain name=LRRNT_2; Domain location=3-43; Score =53.1; E_value=9e-13; Accession=PF08263.3; Description=Leucine rich repeat N-terminal domain
  Pfam annotation: Domain name=LRR_1; Domain location=124-146; Score =14.3; E_value=0.45; Accession=PF00560.23; Description=Leucine Rich Repeat
  Pfam annotation: Domain name=LRR_1; Domain location=172-197; Score =11.9; E_value=1.7; Accession=PF00560.23; Description=Leucine Rich Repeat
  Pfam annotation: Domain name=LRR_1; Domain location=199-221; Score =14.7; E_value=0.33; Accession=PF00560.23; Description=Leucine Rich Repeat
  Pfam annotation: Domain name=LRR_1; Domain location=97-122; Score =9.6; E_value=4.6; Accession=PF00560.23; Description=Leucine Rich Repeat
  Pfam module annotation: Pfam domain module=LRRNT_2::LRR_1::LRR_1::LRR_ 1::LRR_1; Domain location=3-43::124-146::172-197::199-221::97-122
VCIPSERETLLKFKNNLNDPSNRLWSWNPNNTNCCHWYGVLCHNLTSHLLQLHLNTSPSAFYHDYYDDGFYRRFDEEAYRRWSFGGEISPCLADLKHLNYLDLSGNYLLGAGMSIPSFLGTMTSLTHLDLSDSGFYGKIPPQIGNLSNLVYLDLSLDVANGTVPSQIGNLSKLRYLDLSYNYLLGEGMAIPSFLGTMTSLTHLNLSHTGFYGKIPPQIGNLSNLVYLDLGGYSDLFAENVEWVS

SEQ ID NO: 122703 - protein, 1020 aa, Glycine max
  Coding DNA Sequence Number=SeqID_5925
  Gene Ontology: Mol. function=protein binding; Cellular component =integral to membrane; Biological process=protein amino acid phosphorylation
  Homolog annotation: Hit_ID=Q9ZTJ6; Match level="QueryCoverage=91%, HitCoverage=87%, E-value=1e-107, Identity=32%"; Hit description=Hcr2- 5D
  Pfam annotation: Domain name=LRRNT_2; Domain location=22-62; Score =52.4; E_value=1.6e-12; Accession=PF08263.3; Description=Leucine rich repeat N-terminal domain
  Pfam annotation: Domain name=LRR_1; Domain location=116-141; Score =6.8; E_value=15; Accession=PF00560.23; Description=Leucine Rich Repeat
  Pfam annotation: Domain name=LRR_1; Domain location=143-165; Score =15.6; E_value=0.18; Accession=PF00560.23; Description=Leucine Rich Repeat
  Pfam annotation: Domain name=LRR_1; Domain location=167-189; Score =1.1; E_value=1.8e+02; Accession=PF00560.23; Description=Leucine Rich Repeat
  Pfam annotation: Domain name=LRR_1; Domain location=191-214; Score =12.9; E_value=1.1; Accession=PF00560.23; Description=Leucine Rich Repeat
  Pfam annotation: Domain name=LRR_1; Domain location=216-238; Score =12.8; E_value=1.1; Accession=PF00560.23; Description=Leucine Rich Repeat
  Pfam annotation: Domain name=LRR_1; Domain location=267-288; Score =11.7; E_value=1.8; Accession=PF00560.23; Description=Leucine Rich Repeat
  Pfam annotation: Domain name=LRR_1; Domain location=293-315; Score =5.8; E_value=23; Accession=PF00560.23; Description=Leucine Rich Repeat
  Pfam annotation: Domain name=LRR_1; Domain location=317-338; Score =7.2; E_value=13; Accession=PF00560.23; Description=Leucine Rich Repeat
  Pfam annotation: Domain name=LRR_1; Domain location=344-366; Score =14.7; E_value=0.33; Accession=PF00560.23; Description=Leucine Rich Repeat
  Pfam annotation: Domain name=LRR_1; Domain location=368-390; Score =5.9; E_value=22; Accession=PF00560.23; Description=Leucine Rich Repeat
  Pfam annotation: Domain name=LRR_1; Domain location=392-414; Score =15.0; E_value=0.27; Accession=PF00560.23; Description=Leucine Rich Repeat
  Pfam annotation: Domain name=LRR_1; Domain location=416-438; Score =20.8; E_value=0.005; Accession=PF00560.23; Description=Leucine Rich Repeat
  Pfam annotation: Domain name=LRR_1; Domain location=440-462; Score =19.8; E_value=0.0099; Accession=PF00560.23; Description=Leucine Rich Repeat
  Pfam annotation: Domain name=LRR_1; Domain location=464-486; Score =20.8; E_value=0.005; Accession=PF00560.23; Description=Leucine Rich Repeat
  Pfam annotation: Domain name=LRR_1; Domain location=488-510; Score =19.3; E_value=0.014; Accession=PF00560.23; Description=Leucine Rich Repeat
  Pfam annotation: Domain name=LRR_1; Domain location=512-534; Score =17.1; E_value=0.062; Accession=PF00560.23; Description=Leucine Rich Repeat
  Pfam annotation: Domain name=LRR_1; Domain location=536-558; Score =19.1; E_value=0.016; Accession=PF00560.23; Description=Leucine Rich Repeat
  Pfam annotation: Domain name=LRR_1; Domain location=589-611; Score =0.5; E_value=2.3e+02; Accession=PF00560.23; Description=Leucine Rich Repeat
  Pfam annotation: Domain name=LRR_1; Domain location=613-635; Score =4.0; E_value=51; Accession=PF00560.23; Description=Leucine Rich Repeat
  Pfam annotation: Domain name=LRR_1; Domain location=637-659; Score =11.6; E_value=1.9; Accession=PF00560.23; Description=Leucine Rich Repeat
  Pfam annotation: Domain name=LRR_1; Domain location=661-684; Score =7.7; E_value=10; Accession=PF00560.23; Description=Leucine Rich Repeat
  Pfam annotation: Domain name=LRR_1; Domain location=686-709; Score =3.4; E_value=65; Accession=PF00560.23; Description=Leucine Rich Repeat
  Pfam annotation: Domain name=LRR_1; Domain location=734-757; Score =6.4; E_value=18; Accession=PF00560.23; Description=Leucine Rich Repeat
  Pfam annotation: Domain name=LRR_1; Domain location=764-785; Score =12.0; E_value=1.6; Accession=PF00560.23; Description=Leucine Rich Repeat
  Pfam annotation: Domain name=LRR_1; Domain location=789-811; Score =2.5; E_value=96; Accession=PF00560.23; Description=Leucine Rich Repeat
  Pfam annotation: Domain name=LRR_1; Domain location=813-836; Score =13.0; E_value=1.1; Accession=PF00560.23; Description=Leucine Rich Repeat
  Pfam annotation: Domain name=LRR_1; Domain location=838-860; Score =9.7; E_value=4.4; Accession=PF00560.23; Description=Leucine Rich Repeat
  Pfam annotation: Domain name=LRR_1; Domain location=862-884; Score =12.1; E_value=1.6; Accession=PF00560.23; Description=Leucine Rich Repeat
  Pfam annotation: Domain name=LRR_1; Domain location=932-954; Score =7.9; E_value=9.6; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1; Domain location=22-62::116-141::143-165::167-189::191 -214::216-238::267-288::293-315::317-338::344-366::368-390::392 -414::416-438::440-462::...
  Pfam module annotation: Domain location=464-486::488-510::512 -534::536-558::589-611::613-635::637-659::661-684::686-709::734 -757::764-785::789-811::813-836::838-860::862-884::932-954
MDLMEWLWFMLKKLPCRESVCIPSERETLMKFKNNLNDPSNRLWSWNPNNTNCCHWYGVLCHNLTSHLLQLHLHTSDSAFYHDAYHYRFYHRFDEEAYRRWSFGGEISPCLADLKHLNYLDLSANYFLGEGMSIPSFLGTMTSLTHLNLSYTGFNGKIPPQIGNLSNLVYLDLSYDVANGTVPSQIGNLSELRYLDLSYNYFEGMAIPSFLCVMTSLTHLDLSYTAFMGKIPSQIGNLSNLVYLGLGSYDFEPLLAENVEWVSSMWKLEYLYLSNANLSKAFHWLHTLQSLPSLTHLYLSECTLPHYNEPSLLNFSSLQTLDLSGTSYSPAISFFPKWIFKLKKLVSLQLGGNDIQGSIPGGIRNLTLLQNLDLSVNSIASSIPDCLYGLHRLKFLDLEGNNLHGTISDALGNLTSLVELDLSYNQLEGTIPTSLGNLTSLVELDLSYNQLEGIIPTSLGNLTSLVELDLSYNQLEGTIPTSLGNLTSLVELDLSANQLEGTIPNSLGNLTSLVKLQLSRNQLEGTIPTSLGNLTSLVRLDLSYNQLEGTIPTSLANLCLLMEIDFSYLKLNQQVNELLEILAPCISHGLTALAVQSSRLSGNLTDHIGAFKNIDTLLFSNDSIGGALPRSFGKLSSLTYLDLSINKFSGNPFESLRSLSKMSSLQIDGNNFQGVVKEDDLANLTSLMEFHASGNNFTLKVGPKWLPNFQLSYLDVTSWQLGPNFPSWIQSQNQLQHFGLSNTGILDSIPTWFWEALSQDEPMQLKFLNLASNNLSGEIPDCWMNWTFLADSLQIRNNTLSGIFPTSLKKNKKLISLDLGENNLSGSIPTWVGEKLLNVKILRLRSNSFAGLIPNEICQMSLLQVLDVAQNNLSGNIPSCFSNLSAMTLKNQSTDPRIYSQAQYNMSSMYSIVSVLLWLKGRGDEYRNILGLVTSIDLSSNKLLGEIPREITDLNGLNFLNQVCFFPNCANARRQMGEIKSSGMVAPGPVHSLQFTSISPQPFDAMELSDEPAVAPFPQY

SEQ ID NO: 122704 - protein, 1126 aa, Glycine max
  Coding DNA Sequence Number=SeqID_5926
  Gene Ontology: Mol. function=protein binding; Cellular component =integral to membrane; Biological process=defense response to fungus
  Homolog annotation: Hit_ID=Q949G8; Match level="QueryCoverage=86%, HitCoverage=94%, E-value=0.0, Identity=42%"; Hit description=HcrVf2 protein
  Pfam annotation: Domain name=LRRNT_2; Domain location=26-66; Score =47.4; E_value=4.9e-11; Accession=PF08263.3; Description=Leucine rich repeat N-terminal domain
  Pfam annotation: Domain name=LRR_1; Domain location=1008-1030; Score =1.6; E_value=1.5e+02; Accession=PF00560.23; Description=Leucine Rich Repeat
  Pfam annotation: Domain name=LRR_1; Domain location=115-140; Score =8.4; E_value=7.8; Accession=PF00560.23; Description=Leucine Rich Repeat
  Pfam annotation: Domain name=LRR_1; Domain location=142-164; Score =11.2; E_value=2.3; Accession=PF00560.23; Description=Leucine Rich Repeat
  Pfam annotation: Domain name=LRR_1; Domain location=193-214; Score =10.0; E_value=3.8; Accession=PF00560.23; Description=Leucine Rich Repeat
  Pfam annotation: Domain name=LRR_1; Domain location=219-241; Score =8.7; E_value=6.6; Accession=PF00560.23; Description=Leucine Rich Repeat
  Pfam annotation: Domain name=LRR_1; Domain location=243-268; Score =7.0; E_value=14; Accession=PF00560.23; Description=Leucine Rich Repeat
  Pfam annotation: Domain name=LRR_1; Domain location=270-292; Score =13.2; E_value=0.97; Accession=PF00560.23; Description=Leucine Rich Repeat
  Pfam annotation: Domain name=LRR_1; Domain location=294-316; Score =11.7; E_value=1.8; Accession=PF00560.23; Description=Leucine Rich Repeat
  Pfam annotation: Domain name=LRR_1; Domain location=318-340; Score =14.3; E_value=0.44; Accession=PF00560.23; Description=Leucine Rich Repeat
  Pfam annotation: Domain name=LRR_1; Domain location=342-364; Score =20.9; E_value=0.0047; Accession=PF00560.23; Description=Leucine Rich Repeat
  Pfam annotation: Domain name=LRR_1; Domain location=395-417; Score =1.8; E_value=1.3e+02; Accession=PF00560.23; Description=Leucine Rich Repeat
  Pfam annotation: Domain name=LRR_1; Domain location=419-441; Score =10.0; E_value=3.9; Accession=PF00560.23; Description=Leucine Rich Repeat
  Pfam annotation: Domain name=LRR_1; Domain location=443-465; Score =12.1; E_value=1.5; Accession=PF00560.23; Description=Leucine Rich Repeat
  Pfam annotation: Domain name=LRR_1; Domain location=467-490; Score =7.9; E_value=9.7; Accession=PF00560.23; Description=Leucine Rich Repeat
  Pfam annotation: Domain name=LRR_1; Domain location=492-515; Score =5.5; E_value=26; Accession=PF00560.23; Description=Leucine Rich Repeat
  Pfam annotation: Domain name=LRR_1; Domain location=540-563; Score =10.1; E_value=3.7; Accession=PF00560.23; Description=Leucine Rich Repeat
  Pfam annotation: Domain name=LRR_1; Domain location=565-598; Score =5.2; E_value=30; Accession=PF00560.23; Description=Leucine Rich Repeat
  Pfam annotation: Domain name=LRR_1; Domain location=610-631; Score =4.3; E_value=45; Accession=PF00560.23; Description=Leucine Rich Repeat
  Pfam annotation: Domain name=LRR_1; Domain location=638-659; Score =12.2; E_value=1.5; Accession=PF00560.23; Description=Leucine Rich Repeat
  Pfam annotation: Domain name=LRR_1; Domain location=662-684; Score =7.0; E_value=14; Accession=PF00560.23; Description=Leucine Rich Repeat
  Pfam annotation: Domain name=LRR_1; Domain location=686-708; Score =10.5; E_value=3.1; Accession=PF00560.23; Description=Leucine Rich Repeat
  Pfam annotation: Domain name=LRR_1; Domain location=710-733; Score =11.5; E_value=2; Accession=PF00560.23; Description=Leucine Rich Repeat
  Pfam annotation: Domain name=LRR_1; Domain location=735-757; Score =9.5; E_value=4.7; Accession=PF00560.23; Description=Leucine Rich Repeat
  Pfam annotation: Domain name=LRR_1; Domain location=759-781; Score =16.3; E_value=0.11; Accession=PF00560.23; Description=Leucine Rich Repeat
  Pfam annotation: Domain name=LRR_1; Domain location=832-854; Score =8.1; E_value=8.7; Accession=PF00560.23; Description=Leucine Rich Repeat
  Pfam annotation: Domain name=LRR_1; Domain location=856-878; Score =15.0; E_value=0.28; Accession=PF00560.23; Description=Leucine Rich Repeat
  Pfam annotation: Domain name=LRR_1; Domain location=880-902; Score =16.0; E_value=0.14; Accession=PF00560.23; Description=Leucine Rich Repeat
  Pfam annotation: Domain name=LRR_1; Domain location=904-925; Score =6.8; E_value=15; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1; Domain location=26-66::1008-1030::115-140::142-164::193-214::219 -241::243-268::270-292::294-316::318-340::342-364::395-417::419 -441::443-465::...
  Pfam module annotation: Domain location=467-490::492-515::540 -563::565-598::610-631::638-659::662-684::686-708::710-733::735 -757::759-781::832-854::856-878::880-902::904-925
MNSSIYILVFVQLWLFSLPCRESVCIPSERETLLKIKNNLIDPSNRLWSWNHNHTNCCHWYGVLCHNVTSHVLQLHLNTTFSAAFYDGYYHFDEEAYEKSQFGGEISPCLADLKHLNHLNLSGNYFLGAGMSIPSFLGTMTSLTHLDLSLTGFMGKIPSQIGNLSNLVYLDLGGYSVEPMLAENVEWVSSMWKLEYLHLSYANLSKAFHWLHTLQSLPSLTHLDLSGCTLPHYNEPSLLNFSSLQTLHLSFTSFSPAISFVPKWIFKLKKLVSLQLWGNEIQGPIPGGIRNLTLLQNLDLSGNSFSSSIPDCLYGLHRLKFLNLRDNHLHGTISDALGNLTSLVELDLSGNQLEGNIPTSLGNLCNLRDIDFSNLKLNQQVNELLEILAPCISHGLTRLAVQSSRLSGHLTDHIGAFKNIDTLLFSNNSIGGALPRSFGKLSSLRYLDLSTNKFSGNPFESLGSLCKLSSLYIGGNLFQTVVKEDDLANLTSLMEIHASGNNFTLKVGPNWLPNFQLFHLDVRSWQLGPSFPSWIKSQNKLEYLDMSNAGIIDSIPTQMWEALPQVLYLNLSHNHIHGESGTTLKNPISIPVIDLSSNHLCGKLPYLSSDVSQLDLSSNSISESMNDFLCNDQDEPMQLQFLNLASNNLSGEIPDCWMNWTFLVNVNLQSNHFVGNLPQSMGSLAELQSLQIRNNTLSGIFPTSLKKNNQLISLDLGENNLSGCIPTWVGEKLLKVKILRLRSNSFAGHIPNEICQMSHLQVLDLAENNLSGNIPSCFCNLSAMTLKNQSTDPSIYSEAQYVGSSYSSIYSMVSVLLWLKGRGDEYRNILGLVTSIDLSSNKLLGEIPRKITNLNGLNFLNLSHNQLIGHIPQGIGNMGSLQSIDFSRNQLSGEIPPTISKLSFLSMLDVSYNHLKGKIPTGTQLQTFDASSFIGNNLCGLPLPINCSSNGKTHSYEGSHGHGVNWFFVSATIGFVVGFWIVIAPLLICRSWSNLHRTIYDVWGNLTSLVELDLSINQSEATIRTSWGNLSNLGTWGRLISYISNSTNRLGGESVVTEKKYQEMYVNSPGKGVVDKLKGMVGTWFTNPAENQSSQDLSMNYEAGRAEVEQVNQGAAGERRLQESSN

SEQ ID NO: 122705 - protein, 92 aa, Glycine max
  Coding DNA Sequence Number=SeqID_5927
MKELTHLGEPVTLGVIISSPGRAAISPSAHFPINRHAREAEERFQGSEVEGIERREKEEEERRGNEAEALSNDDCDQSLHRSLFGVLCAIID

SEQ ID NO: 122706 - protein, 50 aa, Glycine max
  Coding DNA Sequence Number=SeqID_5928
MVNMSRAMKMGSLPAARARSIRSSLTGPIWPTAIKQKQCRIRKQQHCNNL

SEQ ID NO: 122707 - protein, 1115 aa, Glycine max
  Coding DNA Sequence Number=SeqID_5929
  Gene Ontology: Mol. function=protein binding; Cellular component =integral to membrane; Biological process=defense response to fungus
  Homolog annotation: Hit_ID=Q949G9; Match level="QueryCoverage=95%, HitCoverage=94%, E-value=0.0, Identity=39%"; Hit description=HcrVf1 protein
  Pfam annotation: Domain name=LRRNT_2; Domain location=26-66; Score =51.1; E_value=3.8e-12; Accession=PF08263.3; Description=Leucine rich repeat N-terminal domain
  Pfam annotation: Domain name=LRR_1; Domain location=108-133; Score =9.5; E_value=4.8; Accession=PF00560.23; Description=Leucine Rich Repeat
  Pfam annotation: Domain name=LRR_1; Domain location=135-157; Score =11.2; E_value=2.3; Accession=PF00560.23; Description=Leucine Rich Repeat
  Pfam annotation: Domain name=LRR_1; Domain location=186-207; Score =9.2; E_value=5.4; Accession=PF00560.23; Description=Leucine Rich Repeat
  Pfam annotation: Domain name=LRR_1; Domain location=212-234; Score =8.2; E_value=8.4; Accession=PF00560.23; Description=Leucine Rich Repeat
  Pfam annotation: Domain name=LRR_1; Domain location=236-261; Score =3.4; E_value=65; Accession=PF00560.23; Description=Leucine Rich Repeat
  Pfam annotation: Domain name=LRR_1; Domain location=263-285; Score =12.6; E_value=1.3; Accession=PF00560.23; Description=Leucine Rich Repeat
  Pfam annotation: Domain name=LRR_1; Domain location=287-309; Score =1.3; E_value=1.6e+02; Accession=PF00560.23; Description=Leucine Rich Repeat
  Pfam annotation: Domain name=LRR_1; Domain location=311-333; Score =10.6; E_value=3; Accession=PF00560.23; Description=Leucine Rich Repeat
  Pfam annotation: Domain name=LRR_1; Domain location=335-357; Score =19.4; E_value=0.013; Accession=PF00560.23; Description=Leucine Rich Repeat
  Pfam annotation: Domain name=LRR_1; Domain location=359-381; Score =17.1; E_value=0.064; Accession=PF00560.23; Description=Leucine Rich Repeat
  Pfam annotation: Domain name=LRR_1; Domain location=383-405; Score =20.9; E_value=0.0047; Accession=PF00560.23; Description=Leucine Rich Repeat
  Pfam annotation: Domain name=LRR_1; Domain location=407-429; Score =20.9; E_value=0.0047; Accession=PF00560.23; Description=Leucine Rich Repeat
  Pfam annotation: Domain name=LRR_1; Domain location=431-453; Score =17.6; E_value=0.045; Accession=PF00560.23; Description=Leucine Rich Repeat
  Pfam annotation: Domain name=LRR_1; Domain location=455-477; Score =2.2; E_value=1.1e+02; Accession=PF00560.23; Description=Leucine Rich Repeat
  Pfam annotation: Domain name=LRR_1; Domain location=484-506; Score =1.3; E_value=1.7e+02; Accession=PF00560.23; Description=Leucine Rich Repeat
  Pfam annotation: Domain name=LRR_1; Domain location=508-530; Score =13.8; E_value=0.64; Accession=PF00560.23; Description=Leucine Rich Repeat
  Pfam annotation: Domain name=LRR_1; Domain location=532-554; Score =12.3; E_value=1.4; Accession=PF00560.23; Description=Leucine Rich Repeat
  Pfam annotation: Domain name=LRR_1; Domain location=556-579; Score =7.1; E_value=13; Accession=PF00560.23; Description=Leucine Rich Repeat
  Pfam annotation: Domain name=LRR_1; Domain location=581-604; Score =4.9; E_value=34; Accession=PF00560.23; Description=Leucine Rich Repeat
  Pfam annotation: Domain name=LRR_1; Domain location=629-652; Score =5.4; E_value=28; Accession=PF00560.23; Description=Leucine Rich Repeat
  Pfam annotation: Domain name=LRR_1; Domain location=654-676; Score =6.8; E_value=15; Accession=PF00560.23; Description=Leucine Rich Repeat
  Pfam annotation: Domain name=LRR_1; Domain location=678-697; Score =0.7; E_value=2.1e+02; Accession=PF00560.23; Description=Leucine Rich Repeat
  Pfam annotation: Domain name=LRR_1; Domain location=699-720; Score =4.0; E_value=51; Accession=PF00560.23; Description=Leucine Rich Repeat
  Pfam annotation: Domain name=LRR_1; Domain location=727-746; Score =11.6; E_value=1.9; Accession=PF00560.23; Description=Leucine Rich Repeat
  Pfam annotation: Domain name=LRR_1; Domain location=751-773; Score =7.5; E_value=11; Accession=PF00560.23; Description=Leucine Rich Repeat
  Pfam annotation: Domain name=LRR_1; Domain location=775-797; Score =10.0; E_value=3.9; Accession=PF00560.23; Description=Leucine Rich Repeat
  Pfam annotation: Domain name=LRR_1; Domain location=799-822; Score =12.2; E_value=1.5; Accession=PF00560.23; Description=Leucine Rich Repeat
  Pfam annotation: Domain name=LRR_1; Domain location=824-846; Score =10.8; E_value=2.7; Accession=PF00560.23; Description=Leucine Rich Repeat
  Pfam annotation: Domain name=LRR_1; Domain location=848-870; Score =16.9; E_value=0.075; Accession=PF00560.23; Description=Leucine Rich Repeat
  Pfam annotation: Domain name=LRR_1; Domain location=920-942; Score =7.2; E_value=13; Accession=PF00560.23; Description=Leucine Rich Repeat
  Pfam annotation: Domain name=LRR_1; Domain location=944-966; Score =14.3; E_value=0.44; Accession=PF00560.23; Description=Leucine Rich Repeat
  Pfam annotation: Domain name=LRR_1; Domain location=968-990; Score =16.6; E_value=0.091; Accession=PF00560.23; Description=Leucine Rich Repeat
  Pfam annotation: Domain name=LRR_1; Domain location=992-1013; Score =8.6; E_value=7.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1::LRR_1; Domain location=26-66::108 -133::135-157::186-207::212-234::236-261::263-285::287-309::311 -333::335-357::359-381::...
  Pfam module annotation: Domain location=383-405::407-429::431 -453::455-477::484-506::508-530::532-554::556-579::581-604::629 -652::654-676::678-697::699-720::727-746::751-773::775-797::799 -822::824-846::848-870::920-942::...
  Pfam module annotation: Domain location=944-966::968-990::992-1013
MNSSIYILVFVQLWLLSLPCRESVCIPSERETLLKFKNNLNDPSNRLWSWNHNHTNCCHWYGVLCHNVTSHLLQLHLNSSPSAFDDWGAYRRFQFRGEISPCLADLKHLNYLDLSGNYFLGKGMSIPSFLGTMTSLTYLDLSLTGFMGKIPSQIGNLSNLVYLDLGSYLSEPLFAENVEWLSSMWKLEYLYLTNANLSKAFHWLYTLQSLPSLTHLYLSDCKLPHYNEPSLLNFSSLQTLHLSFTSYSPAISFVPKWIFKLKKLVSLKLWGNKFQGRIPGGIRNLTLLQNLYWSGNSFSSSIPDCLYGLHRLKFLNLRANYLHGTISDALGNLTSLVKLDLSYNQLEGNIPTSLGNLTSLVELDLSYSQLEGNIPTSLGNLTSLVELDLSGNQLEGNIPTSLGNLTSLVELDLSGNQLEGNIPTSLGNLTSLVELDLSYSQLEGTIPTSLGNLCNLRVIDLSYLKLNQQVNELLEILAPCISHELTNLAVQSSRLSGNLTDHVGAFKNIERLDFSNNLIGGALPKSFGKLSSLRYLDLSINKFSGNPFESLGSLSKLSSLHIDGNLFHRVVKEDDLANLTSLTEFGASGNNFTLKVGPNWIPNFQLTYLEVTSWPLGPSFPLWIQSQNKLEYVGLSNTGIFDSISTQMWEALSQVLYLNLSRNHIHGEIGTTLKNPISIPTIDLSSNHLCGKLPYLSSNVLQLDLSSNSFSESMNDFLCNDQDEPMQLEFLNLASNNLSGEIPDCWMDWTSLVDVNLQSNHFVGNLPQSMGSLAELQSLQIHNNTLSGIFPTSLKKNNQLISLDLGANNLSGTIPTWVGENLLNLKILRLRSNRFASHIPSEICQMSHLQVLDLAENNLSGNIPSCFSNLSAMALKNQSTDPRIYSQAQYGRRYSSTQSIVSVLLWLKGRRDEYRNILGLVTSIDLSSNKLLGEIPREITYLNGLNFLNLSHNQFIGHIPQGIGNMRSLQSIDFSRNQLSGEIPPTIANLSFLSMLDLSYNHLKGKIPTGTQLQTFNASSFIGNNLCGPPLPVNCSSNGKTHSYEGSDGHGVNWFFVSMTIGFIVGFWIVIAPLLICRSWRYGGCRTCALSSISPQPFDDVDLSDEPAVAPFPQY

SEQ ID NO: 122708 - protein, 952 aa, Glycine max
  Coding DNA Sequence Number=SeqID_5930
  Gene Ontology: Mol. function=protein binding; Cellular component =integral to membrane; Biological process=defense response to fungus
  Homolog annotation: Hit_ID=Q949G8; Match level="QueryCoverage=96%, HitCoverage=94%, E-value=0.0, Identity=42%"; Hit description=HcrVf2 protein
  Pfam annotation: Domain name=LRRNT_2; Domain location=26-66; Score =48.0; E_value=3.2e-11; Accession=PF08263.3; Description=Leucine rich repeat N-terminal domain
  Pfam annotation: Domain name=LRR_1; Domain location=114-139; Score =8.4; E_value=7.8; Accession=PF00560.23; Description=Leucine Rich Repeat
  Pfam annotation: Domain name=LRR_1; Domain location=141-163; Score =11.6; E_value=2; Accession=PF00560.23; Description=Leucine Rich Repeat
  Pfam annotation: Domain name=LRR_1; Domain location=192-213; Score =10.8; E_value=2.8; Accession=PF00560.23; Description=Leucine Rich Repeat
  Pfam annotation: Domain name=LRR_1; Domain location=218-240; Score =7.2; E_value=13; Accession=PF00560.23; Description=Leucine Rich Repeat
  Pfam annotation: Domain name=LRR_1; Domain location=242-267; Score =3.4; E_value=65; Accession=PF00560.23; Description=Leucine Rich Repeat
  Pfam annotation: Domain name=LRR_1; Domain location=269-291; Score =11.6; E_value=1.9; Accession=PF00560.23; Description=Leucine Rich Repeat
  Pfam annotation: Domain name=LRR_1; Domain location=293-315; Score =11.7; E_value=1.8; Accession=PF00560.23; Description=Leucine Rich Repeat
  Pfam annotation: Domain name=LRR_1; Domain location=317-339; Score =9.0; E_value=5.9; Accession=PF00560.23; Description=Leucine Rich Repeat
  Pfam annotation: Domain name=LRR_1; Domain location=341-363; Score =20.8; E_value=0.005; Accession=PF00560.23; Description=Leucine Rich Repeat
  Pfam annotation: Domain name=LRR_1; Domain location=365-387; Score =12.6; E_value=1.3; Accession=PF00560.23; Description=Leucine Rich Repeat
  Pfam annotation: Domain name=LRR_1; Domain location=394-416; Score =8.9; E_value=6.1; Accession=PF00560.23; Description=Leucine Rich Repeat
  Pfam annotation: Domain name=LRR_1; Domain location=418-441; Score =10.7; E_value=2.9; Accession=PF00560.23; Description=Leucine Rich Repeat
  Pfam annotation: Domain name=LRR_1; Domain location=443-466; Score =2.5; E_value=96; Accession=PF00560.23; Description=Leucine Rich Repeat
  Pfam annotation: Domain name=LRR_1; Domain location=491-513; Score =5.2; E_value=31; Accession=PF00560.23; Description=Leucine Rich Repeat
  Pfam annotation: Domain name=LRR_1; Domain location=516-538; Score =5.4; E_value=27; Accession=PF00560.23; Description=Leucine Rich Repeat
  Pfam annotation: Domain name=LRR_1; Domain location=540-561; Score =5.1; E_value=32; Accession=PF00560.23; Description=Leucine Rich Repeat
  Pfam annotation: Domain name=LRR_1; Domain location=589-608; Score =11.6; E_value=1.9; Accession=PF00560.23; Description=Leucine Rich Repeat
  Pfam annotation: Domain name=LRR_1; Domain location=613-635; Score =8.1; E_value=8.6; Accession=PF00560.23; Description=Leucine Rich Repeat
  Pfam annotation: Domain name=LRR_1; Domain location=637-659; Score =10.5; E_value=3.1; Accession=PF00560.23; Description=Leucine Rich Repeat
  Pfam annotation: Domain name=LRR_1; Domain location=661-684; Score =11.5; E_value=2; Accession=PF00560.23; Description=Leucine Rich Repeat
  Pfam annotation: Domain name=LRR_1; Domain location=686-708; Score =11.2; E_value=2.2; Accession=PF00560.23; Description=Leucine Rich Repeat
  Pfam annotation: Domain name=LRR_1; Domain location=710-732; Score =12.3; E_value=1.4; Accession=PF00560.23; Description=Leucine Rich Repeat
  Pfam annotation: Domain name=LRR_1; Domain location=782-804; Score =7.9; E_value=9.6; Accession=PF00560.23; Description=Leucine Rich Repeat
  Pfam annotation: Domain name=LRR_1; Domain location=806-828; Score =15.1; E_value=0.25; Accession=PF00560.23; Description=Leucine Rich Repeat
  Pfam annotation: Domain name=LRR_1; Domain location=830-852; Score =17.0; E_value=0.068; Accession=PF00560.23; Description=Leucine Rich Repeat
  Pfam annotation: Domain name=LRR_1; Domain location=854-875; Score =6.8; E_value=15; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1; Domain location=26-66::114-139::141-163::192-213::218-240::242-267::269 -291::293-315::317-339::341-363::365-387::394-416::418-441::443 -466::491-513::516-538::...
  Pfam module annotation: Domain location=540-561::589-608::613 -635::637-659::661-684::686-708::710-732::782-804::806-828::830 -852::854-875
MNSSIYILVFVQLWLFSLPCRESVCIPSERETLLKFKNNLNDSSNRLWSWNHNHTNCCHWYGVLCHNVTSHLLQLHLNTSPSAFYDGNFHFDWEAYQRWSFGGEISPCLADLKHLNHLNLSGNYFLGAGMSIPSFLGTMTSLTHLDLSLTGFYGKIPPQIGNLSNLVYLDLGNYFSEPLFAENVEWVSSMWKLEYLYLSYANLSKAFHWLHTLQSLPSLTHLSLSGCTLPHYNEPSLLNFSSLQTLHLSFTSYSPAISFVPKWIFKLKKLVSLQLWSNKFQGSIPCGIRNLTLLQNLDLSGNSFSSSIPDCLYGLHRLKSLEIHSSNLHGTISDALGNLTSLVELDLSYNQLEGTIPTSLGNLTSLVALYLKYNQLEGTIPTFLGNLRNSREIDLTILNLSINKFSGNPFESLGSLSKLSSLWIDGNNFQGVVKEDDLANLTSLTDFGASGNNFTLKVGPNWIPNFQLTYLEVTSWQLGPSFPLWIQSQNQLQYVGLSNTGILDSIPTWFWEAHSQVLYLNLSHNHIHGELVTTIKNPISIQTVDLSTNHLCGKLPYLSNDVYDLDLSTNSFSESMQDFLCNNQDKPMQLEFLNLASNNLSGEIPDCWINWPFLVEVNLQSNHFVGNFPPSMGSLAELQSLEIRNNLLSGIFPTSLKKTSQLISLDLGENNLSGCIPTWVGEKLSNMKILRLRSNSFSGHIPNEICQMSLLQVLDLAKNSLSGNIPSCFRNLSAMTLVNRSTYPLIYSQAPNDTRYFSVSGIVSVLLWLKGRGDEYGNILGLVTSIDLSSNKLLGEIPREITDLNGLNFLNLSHNQLIGPIPEGIGNMGSLQTIDFSRNQISGEIPPTISNLSFLSMLDVSYNHLKGKIPTGTQLQTFDASSFIGNNLCGPPLPINCSSNGKTHSYEGSHGHGVNWFFVSATIGFVVGLWIVIAPLLICRSWRHAYFHFLDH

SEQ ID NO: 122709 - protein, 241 aa, Glycine max
  Coding DNA Sequence Number=SeqID_5931
  Homolog annotation: Hit_ID=Q9SWB3; Match level="QueryCoverage=95%, HitCoverage=48%, E-value=2e-77, Identity=69%"; Hit description=Seed maturation protein PM39
MWDRISSLYKQEKRTDHAAAPTEYGKSVAQSLTEKLAPVSGKVAGAGSGVKSKVSGTQTSSMGVEQDKGVSVKDYLVDKLRPGDEDRALSEVISETLHKKELPPVEVTEEGVRKVVSDAVHKREDDPERRMEHQRILGKVTESEEVKRRLGGESVVTEKKNQEMYVNSPGKGVVDKLKGVVGTWFTNPAENQSSQAKCHINFEFVFAWVEDSSMNYEAGRAEVEQVNQGAAGERRLQESSN

SEQ ID NO: 122710 - protein, 125 aa, Glycine max
  Coding DNA Sequence Number=SeqID_5932
  Gene Ontology: Mol. function=magnesium ion binding; Cellular component=membrane; Biological process=photosynthesis, light harvesting
  Homolog annotation: Hit_ID=Q00321; Match level="QueryCoverage=67%, HitCoverage=29%, E-value=4e-44, Identity=95%"; Hit description=Type I (26 kD) CP29 polypeptide
  Pfam annotation: Domain name=Chloroa_b-bind; Domain location=16-120; Score=48.8; E_value=1.9e-11; Accession=PF00504.12; Description =Chlorophyll A-B binding protein
PDRRIFLPEGLLDRSEIPEYLTGEVPGDYGYDPFGLSKKPEDFAKYQAFELIHARWAMLGAAGFIIPEAFNKYGANCGPEAVWFKPARSTSVISCKTGALFSHEQNNSNLLEFMPWTNTILLTSD

SEQ ID NO: 122711 - protein, 38 aa, Glycine max
  Coding DNA Sequence Number=SeqID_5933
MCNPMQQCDWIYPHTWKMMELTCAAPGRLISYLMDLLV

SEQ ID NO: 122712 - protein, 210 aa, Glycine max
  Coding DNA Sequence Number=SeqID_5934
  Gene Ontology: Mol. function=nucleoside-triphosphatase activity; Cellular component=intracellular; Biological process=protein transport
  Homolog annotation: Hit_ID=Q1T499; Match level="QueryCoverage=91%, HitCoverage=34%, E-value=8e-69, Identity=64%"; Hit description=ClpX, ATPase regulatory subunit
MSVTFNDQLITYSPSAIDTKNILFICGGAFINLEKTISERRQDSSIGFGAPVRSNMRAGGITNAAVTSSLLESVLIEPKNALAKQYKKLFNTNNVKLHFTEKAHRLIAKKAMAKKTGARGLRALLESILTEAMYEIPDVKAGDELIDAVVVDEESVGSVNAPGCGGKILCGDGALELYLAKIEGSVVNGDVAEPDLQEGESEISSRAVSM

SEQ ID NO: 122713 - protein, 521 aa, Glycine max
  Coding DNA Sequence Number=SeqID_5935
  Gene Ontology: Mol. function=reticuline oxidase activity; Cellular component=membrane; Biological process=electron transport
  Homolog annotation: Hit_ID=Q84PV5; Match level="QueryCoverage=96%, HitCoverage=89%, E-value=1e-143, Identity=51%"; Hit description =Putative berberine bridge enzyme
  Pfam annotation: Domain name=BBE; Domain location=444-507; Score =96.2; E_value=9.8e-26; Accession=PF08031.2; Description=Berberine and berberine like
  Pfam annotation: Domain name=FAD_binding_4; Domain location=51-192; Score=121.8; E_value=1.9e-33; Accession=PF01565.13; Description=FAD binding domain
  Pfam module annotation: Pfam domain module=BBE::FAD_binding_4; Domain location=444-507::51-192
DLASCLDNHDIKNFTTLPYKEHDHSSAYNYYKILNFSIQNLRFAEPVIPKPIAIVLPESLEQLQKSVACCREGFMEIRVRCGGHSYEGTSYVADDGTPFVIIDMMNLNHVWVDMETETAWVEGGATLGETYYAISQASNEHGFSGGSCPTVGVGGHIGGGGFGILSRKYGLAADNVVDALLVNADGKLFDRETMGEDVFWAIRGGGGGLWGIIYAWKIKVLKLPQVVTSFTVSRTGTKRHVANLVHKWQNVAPNLEDDFYLSCFVGAGLPQAKTKGLSTTFNGFYLGPRAGAISILDHAFPELGIVEEECIEMSWIQSTVFFSGLSDGASVSDLNNRYLQEKQYFKAKSDYVKKHVPLVGIETALDILEKEPKGYVILDPYGGKMHNISSESIAFPHRRGNLFTIQYLIYWKEADNDKNSDYVDWIRGFYAAMTPFVSWGPRAAYVNYMDFDLGVMERISNGANMKDVVEHARVWGEKYFLSNYDRLVRAKTLIDPNNVFTNDQGIPPISLTISDVKPQSK

SEQ ID NO: 122714 - protein, 85 aa, Glycine max
  Coding DNA Sequence Number=SeqID_5936
MKKNVFSSLSALFLYVFHEANAWLASGCGAHALLFPPISVLDMLSVRRDNVLAERAGCALSVLISDLSSSEVLHPLSELTASLSG

SEQ ID NO: 122715 - protein, 111 aa, Glycine max
  Coding DNA Sequence Number=SeqID_5937
  Homolog annotation: Hit_ID=Q1SKD7; Match level="QueryCoverage=90%, HitCoverage=25%, E-value=6e-08, Identity=33%"; Hit description =Ankyrin
MAPKNLLSKRARKEATEEGSSAAPQEDMEFDGHRFRSEEHQCYFEAIKSWSFLKERQVQLRKGAYAEFQEEIARRQWTQLAGPMAKYDPEIVMEFYANAWPTEEGVRDKRS

SEQ ID NO: 122716 - protein, 99 aa, Glycine max
  Coding DNA Sequence Number=SeqID_5938
MALHVLTSFHNSNFTTTHAKVIEAFHRTVGGRMFKHEMKENAKNESESAQWRLGAAAKGDPRSEIAPSSLAPLSRLARVNGFGLGANVALSLARDGRLA

SEQ ID NO: 122717 - protein, 97 aa, Glycine max
  Coding DNA Sequence Number=SeqID_5939
MAFIILRFMHSFHKLEIHAKVITQYPTPVQLVDPEQWADQASMLVQMVVDHQELELEMTKEWALEGWARSPLAQAPGLRRPHPLPKEKAGLLARPPN

SEQ ID NO: 122718 - protein, 80 aa, Glycine max
  Coding DNA Sequence Number=SeqID_5940
AANHRLHVQTHDCLYQLSLSLQSQGFTSFPCPTLDQFRAEVAWPGDWPEAPTEAPDEADEAREDEEMTDFLDFLGGSRAT

SEQ ID NO: 122719 - protein, 238 aa, Glycine max
  Coding DNA Sequence Number=SeqID_5941
GVPIAEIKWAARRAALSARPRAKRPAPHFHFFFYALTLPALLLSASSYLHRSLGKRPTGTLPASHLRLPGTGTKDNIQLRNILPERNVELRLGMFDEFLQELRRRRWDQVLTHLPEKRIDVALVKEFYSNLYDPEDHSPRFCRVRGQVVRFDADTINDFLDTPVIFEDGEEYTAYTRYLSTHPDPDTIAATLCTPGGRFVLNADGLPWKLLRKDMTTLAQTWSVLSYYDLAPTSHTSD

SEQ ID NO: 122720 - protein, 175 aa, Glycine max
  Coding DNA Sequence Number=SeqID_5942
GGGGGGGDVNDDIVVVVVIVVAIGDDNVGNGDISGGNDDRGCISGGCHNVDGDGGGSDSVVVVVATLVVVVVVVMVTMTIAVAMVVVGSNANDDGNFNGDDGDNDDNGGDDIDGGGGGRRSNVNDDGHDNDNGVNYDDDNHGGGDSSVGDGDDESGIDSGGDDSDDGGGSSSDNK

SEQ ID NO: 122721 - protein, 86 aa, Glycine max
  Coding DNA Sequence Number=SeqID_5943
MSRNFMDCLMMGVKFLEAVKQRLHAIKKWSPNEIRAINSWGSRLDGGGCMNDNQFMRLRIRFDGGGCTNSARQSIRGAPDSMVEDA

SEQ ID NO: 122722 - protein, 220 aa, Glycine max
  Coding DNA Sequence Number=SeqID_5944
MGEVEEVQEQIKIDMEAMKEQMATIMEAMMSMKKIMEVNAAAIATTSTIAEVDLTSPSGLNQMNHPTSDMVCLGGKELEDPGGPHLVRKNKHAFLPYGLPPNYTPPNMAYNPNENVNNSTPILIENQQPQSDHAHVSRPMGETHEMPHHNLADFESRLGYAAKGQTVGDILLQNTLEGPQYHPQPHLLHSTAGKNPHAMAEMGKLDHLEKSDVPLFPPIS

SEQ ID NO: 122723 - protein, 126 aa, Glycine max
  Coding DNA Sequence Number=SeqID_5945
MSNRASSEKYRTKRTLYMEQLEKLTRALSLQTSNTRQQFEETKNLQQTLLVEQHQLKLQIAAFEKDKIAKEESSNLFYFSDEIRKNIAEVNRLRELQINQLQANQHAMPNSDGGSNAIDAQLDLNL

SEQ ID NO: 122724 - protein, 135 aa, Glycine max
  Coding DNA Sequence Number=SeqID_5946
MPCLTKELRNMGEAAKKICLASLKNQSCHVGEGSFSSPSTDAKGRNNPELDLTLGISTTHSAQTSDNHNHTSDQVEKNLIKGSPTTPGAGVNFNINQVYERQLSIPGLELKLATEKEDIKKLNRYILKLFSLKHV

SEQ ID NO: 122725 - protein, 426 aa, Glycine max
  Coding DNA Sequence Number=SeqID_5947
SDRTRFNSYDEDLLTLVERVDKAFLEQLSVSLDARAILSLPLENDPFAALNSIMGDFAWRPHVKLVGPTGRTMPLSATALATGEKGQPIGERDDAAVPSGHKKSKAPISLRVLRRVVGLMTSASCLLIEQEVPPAPPAIEAHATVETVNPVIPAFSPRPIADVVQEVAPTTTEVIVPTTQVGSAIHCRDSFIKCQMQVTLPGCFSKGIWLFLRRMDCSTKRLCKRGHLWRWRLPSGGLLLGFFGEWSALRWPMPLFPLLRLWSLRLFGEWSTLMWPMLHSPSKVGGALAKLLHTRLDGDDLFRHCKDLQAKKMELDGKVESMAAEKDRPVKRIVELEARLKELKSRLWSSMRKAVRQVSFFAKDLDLGLFDPFKDVNEGVLLDEEEEAVDERKQDLDVAVGSWWSCKKWNDAESSQQKYSLDGYKD

SEQ ID NO: 122726 - protein, 53 aa, Glycine max
  Coding DNA Sequence Number=SeqID_5948
MAHGGHRWSWVVEKKISLSEVVLLKGSLILALSMTICAERNSPCAKRNNSRSA

SEQ ID NO: 122727 - protein, 227 aa, Glycine max
  Coding DNA Sequence Number=SeqID_5949
MGQLQRQAFCKAYGKIWDLARVEVSTESIASLAQYYDHPLRCFTFGDFQLSLIVEEFEEILGCPLGGRKPYLFSGFYPSLARISKKSPNLGAGIRPPKASRKWGGRNTEKIFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEKSRFYLHAKDVQMFP

SEQ ID NO: 122728 - protein, 103 aa, Glycine max
  Coding DNA Sequence Number=SeqID_5950
MTLPFAVAPNRLCPAEKNSARADDHKVSPPITRLAVPGLQKVQNDHNLSLRANGLACLWLTKSCADDHNLSPRAIRLDRLWMAKRCADDHNLSAHVIGLAASG

SEQ ID NO: 122729 - protein, 68 aa, Glycine max
  Coding DNA Sequence Number=SeqID_5951
  Subcellular localization annotation: CTP_CleavageSite=45; ConfidenceScore=5.13e-01
MLTTSKDWKVVSNDSSVASTYGIEVGQLTKMSSSPDTITKCPPSSGSTGVPKDSCMGRLFVQGGRSLP

SEQ ID NO: 122730 - protein, 78 aa, Glycine max
  Coding DNA Sequence Number=SeqID_5952
  Homolog annotation: Hit_ID=Q69XE4; Match level="QueryCoverage=37%, HitCoverage=17%, E-value=6e-10, Identity=90%"; Hit description =Putative 2-on-2 hemoglobin
  Pfam annotation: Domain name=Bac_globin; Domain location=4-71; Score=- 17.6; E_value=0.02; Accession=PF01152.11; Description=Bacterial-like globin
MKLILMIFSNLLSEGHPALIVRHRPFPVTHQAAERWLHHMQHALDSTTDIDDDSKTKMMTFSGLFSTPRSHFTENGCS

SEQ ID NO: 122731 - protein, 63 aa, Glycine max
  Coding DNA Sequence Number=SeqID_5953
DVFMRKLFISLSSPELNCIDPSLSHFESYGKEEVDENLATPKQVRGSRLQAVVPNRSGTLIDE

SEQ ID NO: 122732 - protein, 82 aa, Glycine max
  Coding DNA Sequence Number=SeqID_5954
MGVQKVEGGGAVMKKGGAESRRKGGAIMRKRGAESKVEGGEESRSGGVKRKARRLVALRPSPALGATLHAVAGTHLAPRVGA

SEQ ID NO: 122733 - protein, 131 aa, Glycine max
  Coding DNA Sequence Number=SeqID_5955
STLEDPTSPLSSLVIDYTPLVIDYQKPSWLPDLVFKPGNRLHPVELACLGTSQVLTDRLCPGWVGIGQAWFWAIAPHLTSPRSPDPHDISPGTTLWWRSGDGAQQVFHIQKARINPPSPVAHLQLSSRTPT

SEQ ID NO: 122734 - protein, 67 aa, Glycine max
  Coding DNA Sequence Number=SeqID_5956
MEKRARKGSQRRRKRERVNGEEGSASEIGRVKYNLKLEQQNETLQWLEAHAAHLNKNMGMVYEFKPT

SEQ ID NO: 122735 - protein, 202 aa, Glycine max
  Coding DNA Sequence Number=SeqID_5957
  Gene Ontology: Mol. function=protein binding; Cellular component =integral to membrane; Biological process=protein amino acid phosphorylation
  Homolog annotation: Hit_ID=Q9LJW7; Match level="QueryCoverage=99%, HitCoverage=71%, E-value=4e-30, Identity=38%"; Hit description =Disease resistance protein-like
  Pfam annotation: Domain name=LRR_1; Domain location=123-144; Score =2.4; E_value=1e+02; Accession=PF00560.23; Description=Leucine Rich Repeat
  Pfam annotation: Domain name=LRR_1; Domain location=146-169; Score =13.2; E_value=0.92; Accession=PF00560.23; Description=Leucine Rich Repeat
  Pfam annotation: Domain name=LRR_1; Domain location=171-193; Score =11.4; E_value=2.1; Accession=PF00560.23; Description=Leucine Rich Repeat
  Pfam annotation: Domain name=LRR_1; Domain location=3-25; Score=11.9; E_value=1.7; Accession=PF00560.23; Description=Leucine Rich Repeat
  Pfam annotation: Domain name=LRR_1; Domain location=72-97; Score =11.4; E_value=2.1; Accession=PF00560.23; Description=Leucine Rich Repeat
  Pfam annotation: Domain name=LRR_1; Domain location=99-121; Score =13.1; E_value=0.99; Accession=PF00560.23; Description=Leucine Rich Repeat
  Pfam module annotation: Pfam domain module=LRR_1::LRR_1::LRR_1::LRR _1::LRR_1::LRR_1; Domain location=123-144::146-169::171-193::3-25::72- 97::99-121
MTSLTHLDLSLTGLMGKIPSQIGNLSNLVYLDLGGYSTDLKPPLFAENLVYLDLSSEVANGTVPSQIGNLSKLRYLDLSFNRFLGEGMAIPSFLGTMTSLTHLDLSFTGFRGKIPPQIGNLSNLVYLDLRYVANGTVPSQIGNLSKLRYLDLSYNDFEGMAIPSFLCAMTSLTHLDLSLTEFYGKIPPQIGNLSNLVYLDLG

SEQ ID NO: 122736 - protein, 97 aa, Glycine max
  Coding DNA Sequence Number=SeqID_5958
  Homolog annotation: Hit_ID=Q8H3G8; Match level="QueryCoverage=47%, HitCoverage=5%, E-value=8e-11, Identity=68%"; Hit description=Myosin heavy chain-like protein
MSFISAQSAEVTSHTTDLGRDGLLEEDENGAEQRIEYVRKSICNSCECWENAENEGTSLKKQVQAPTLKNSTLEDRVTHLDNALKECVRQLRQTRCL

SEQ ID NO: 122737 - protein, 155 aa, Glycine max
  Coding DNA Sequence Number=SeqID_5959
PGPPPDIRGRPIVRAHPEREAITHLLCIPGQDFTRAAAKRRVWIMRTNMTTFTWIWMTLLFSNILHNDHNANLPLQMYRDRAHKTPSGPEEVQQGPGVSSSGYGPLLVLQGARIAPIRHPVGPKKSNRALGFLALVTGLCSPTGCPFPPARSRHH

SEQ ID NO: 122738 - protein, 89 aa, Glycine max
  Coding DNA Sequence Number=SeqID_5960
MECPKTTLFDRTYHQCLINVFKVPLAIDSRSFDDNKDDDKKLKSQDHFMITKIMTLKNEFKIESRTLQRSRGNLISRIKNQYSRFKIQE

SEQ ID NO: 122739 - protein, 56 aa, Glycine max
  Coding DNA Sequence Number=SeqID_5961
  Subcellular localization annotation: CTP_CleavageSite=15; ConfidenceScore=5.24e-01
MTFTLPSLLPAQWIMASPLASPPLPPPSPSPPPPPPPFDTSASPPTMKRTCKASRL

SEQ ID NO: 122740 - protein, 61 aa, Glycine max
  Coding DNA Sequence Number=SeqID_5962
MENNGGLWWLKVAKRRAHSKHLLYDPNGQTVDKCLVKLQTKFREDPTVNEVWEAFLPRQLM

SEQ ID NO: 122741 - protein, 144 aa, Glycine max
  Coding DNA Sequence Number=SeqID_5963
  Gene Ontology: Mol. function=DNA binding; Biological process =transposition, DNA-mediated
  Homolog annotation: Hit_ID=Q898Q4; Match level="QueryCoverage=95%, HitCoverage=43%, E-value=2e-09, Identity=31%"; Hit description =Transposase
MRDIDIQASFNSTKRKVVFEVQDESFENDIDRETEEFERMKVERHRLGKRKWNRSFEVALSASETNEITADFVNFHDMVTMNTTRVRERKKFVFFGERKFKITLAIFAKEDLVFELIMTVFDEVRRATMRAFELDINHIGIPPY

SEQ ID NO: 122742 - protein, 43 aa, Glycine max
  Coding DNA Sequence Number=SeqID_5964
GSYLAHELKIYAKVDVNPRAFFCISGRVFLESPSHGSSDGSPP

SEQ ID NO: 122743 - protein, 98 aa, Glycine max
  Coding DNA Sequence Number=SeqID_5965
ALKTLNSTLIGKSEQPTPHWVEVKSHVQTGGYNCDYYVMHWMSNIVCGNLTNEWMKDNHVETNGAFQGKAKLLFAHAGDKWDVEFYAKVNDDVYVNIG

SEQ ID NO: 122744 - protein, 256 aa, Glycine max
  Coding DNA Sequence Number=SeqID_5966
  Gene Ontology: Mol. function=protein serine/threonine kinase activity; Biological process=protein amino acid phosphorylation
  Homolog annotation: Hit_ID=Q1SDE2; Match level="QueryCoverage=77%, HitCoverage=32%, E-value=2e-56, Identity=54%"; Hit description =Protein kinase; Curculin-like (Mannose-binding) lectin
MAQDEKKDMQNMKIVNRKKERVHQREQLTTDTITSPDNESVKCECIPSYIPLDNQDVSKECHPPTTIIYCVEKNFKLESVMDDCNIVAITYNASTFTCAKKRLSLLNARNSSSSKGQKPLLKVPNNEYGTSNKATKKNNFNVKNFFKVMIAVTDTLACFFGALVVDYHPFTQRLARRKQYLNASAIGINFREFTFQELHEAKDGFIRILGKGSSGKVYQGTLTINDTEIGIAGERPQWGQRIEMAIEVTRGLLLLA

SEQ ID NO: 122745 - protein, 82 aa, Glycine max
  Coding DNA Sequence Number=SeqID_5967
  Gene Ontology: Mol. function=RNA-directed DNA polymerase activity; Cellular component=chromatin; Biological process=RNA-dependent DNA replication
MALIPTLEASVSTTKEMSQWGRYRSITFNESSIKTRQAYKSSQGPGGTRCGPLLNGFHLGWNGLNTILGDQVPQIFHLSLSE

SEQ ID NO: 122746 - protein, 117 aa, Glycine max
  Coding DNA Sequence Number=SeqID_5968
DMDLPASRDKRRDQHIAAVGTTNNNMLSNRKTLDVGSLLSSKSETQHGHRFTSIPYVPMDPGIGPLFNSPPNSLKIVPSGVAYCRNLPFGGRKNRKGVCGLRTLSVKGSGVVFAHGE

SEQ ID NO: 122747 - protein, 125 aa, Glycine max
  Coding DNA Sequence Number=SeqID_5969
  Subcellular localization annotation: CTP_CleavageSite=54; ConfidenceScore=5.37e-01
MDLSFLQSPHAQSFLRSSKAQYQMINNTMGEGNTSTRDMSTINNTMGEGSTSTRDMSTDKINVDLNEYPIEDISLENGYSGTVSEHFDHDIVANDVLEVEEIETYERENIVSSSQNIEIYEFAEE

SEQ ID NO: 122748 - protein, 257 aa, Glycine max
  Coding DNA Sequence Number=SeqID_5970
  Gene Ontology: Mol. function=molybdate-transporting ATPase activity; Cellular component=outer membrane-bounded periplasmic space; Biological process=molybdate ion transport
  Homolog annotation: Hit_ID=Q8D002; Match level="QueryCoverage=96%, HitCoverage=95%, E-value=1e-93, Identity=67%"; Hit description =Molybdate-binding periplasmic protein of molybdate ABC transporter
  Pfam annotation: Domain name=SBP_bac_1; Domain location=10-246; Score= 43.3; E_value=8.4e-10; Accession=PF01547.15; Description=Bacterial extracellular solute-binding protein
  Subcellular localization annotation: CTP_CleavageSite=57; ConfidenceScore=5.13e-01
MQNTLYHWAAAAVVTVSLSGQALAAEKITVFAAASLTNAMQQIATQYQQKSGVEVVSSFASSSTLARQIEQGAPADLFISADQQWMDDAVAKNSVIGSTRYTLLGNDLVLVAAKSANAQPVTINAQTPWQNLLKGERLAVGDPDHVPAGIYAKEALQKLGAWDTLSSQLAPANNVRAALALVERRETPYGIVYDSDAVASDKVQVVGRFPEASHKPVEYPMAVVSDHQNAAVQAFYDYLQGPDAAAVFKQYGFTPKR

SEQ ID NO: 122749 - protein, 178 aa, Glycine max
  Coding DNA Sequence Number=SeqID_5971
  Homolog annotation: Hit_ID=Q84VH5; Match level="QueryCoverage=76%, HitCoverage=24%, E-value=3e-54, Identity=70%"; Hit description =Envelope-like protein
KLSVKYAILHRIGAANWVPTNHTSTVATESFAVKLPIAFPTVLCGIMLSQHPNILNNIDSVMKRESPLSLHYKLFEGTHVPDIVSTSGKAAASGAVSKDALIAELKDTCKVLEATIKASTEKKMELELLIKRLSESGIDDEEAAEEEGEAAEEEEEAAEEEEDAAEETESDDDSEATP

SEQ ID NO: 122750 - protein, 385 aa, Glycine max
  Coding DNA Sequence Number=SeqID_5972
  Gene Ontology: Mol. function=phosphotransferase activity, phosphate group as acceptor; Cellular component=cytosol; Biological process =nucleobase, nucleoside, nucleotide and nucleic acid metabolic process
  Homolog annotation: Hit_ID=P69441; Match level="QueryCoverage=54%, HitCoverage=97%, E-value=1e-109, Identity=94%"; Hit description =Adenylate kinase
  Pfam annotation: Domain name=ADK; Domain location=5-187; Score=347.1; E_value=3e-101; Accession=PF00406.12; Description=Adenylate kinase
  Pfam annotation: Domain name=ADK_lid; Domain location=123-158; Score =82.9; E_value=9.7e-22; Accession=PF05191.4; Description=Adenylate kinase, active site lid
  Pfam annotation: Domain name=Ferrochelatase; Domain location=206-385; Score=-41.2; E_value=1.7e-09; Accession=PF00762.10; Description =Ferrochelatase
  Pfam module annotation: Pfam domain module=ADK::ADK_lid::Ferrochelatas e; Domain location=5-187::123-158::206-385
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAASGRVYHIKFNPPKVEGKDDVTGEELTTRKDDQEETVRKRLVEYHQMTAPLIGYYTKEAQAGNTKYAKVDGTKAVADAKTGILLANLGTPEAPTSDATAVVAAAAWRDSADSFSARRQTLSVRLDGGGLAADGLQPSSGKSAGRPPAGYARRARHELRKTGVDHIVVLALYPQYSCSTVAAVWDELARILATRRRIPGVTFIRDYADNDLYIRALANSARASFEKHGEPDLLLLSYHGIPQRFANEGDDYPQRCRDTT

SEQ ID NO: 122751 - protein, 96 aa, Glycine max
  Coding DNA Sequence Number=SeqID_5973
MHSIGVRNPLEQPPLPIYRKKEVVLAAQLAQALPFLLRLREFYESITEAPEDIFQQNGGGGCRPARPGELGFFLLKQPSFQNILEGARFENCYLHP

SEQ ID NO: 122752 - protein, 406 aa, Glycine max
  Coding DNA Sequence Number=SeqID_5974
  Gene Ontology: Mol. function=RNA-directed DNA polymerase activity; Cellular component=chromatin; Biological process=chromatin assembly or disassembly
  Subcellular localization annotation: CTP_CleavageSite=22; ConfidenceScore=5.44e-01
MHEAATMHGSVTKSWTKQSKPEASSKPPLLPTPPKTISKTQDTLKTKQQASKTLTPAYMSDRKAKVLCYFCDESFTPKPGLSHKTLKLHVMEVDELQVGAEKEVLLENSMGSSSTDPQIFVHALTGIANFHTMHVTGYYQKKPLHVLIDSGRCCDLVLGVEWLVSLGDIVWDFNKLQMEFFVKGRRHVLRGASTGLKTVKKKQLGKVMSTGVHLSILQEPSGLPPSRPGHDHQIPLVPATGIIQNNSSPFASPIVLVGKKDGSWRLCVDYRDLNKHTIKNKFPIPLVDDLLDELAGSRIFSKIDLRSGYNQVGMDPDDVYKTAFMTHVGHFEYLVMPFGLTSALITFQGLMNSVFKEFLLVFFDDILGGVPIPGPIWNILEGGYFGWMLPSSPGRAGRQPAPSFLL

SEQ ID NO: 122753 - protein, 84 aa, Glycine max
  Coding DNA Sequence Number=SeqID_5975
MHEPQAKLGADQKFSPGHQVSAGSIDPWHHSMTCTYQSMTIHCHPSMGHTIDLKALCFLAVQNNRRFSTERKGKTLGSIFQLIA

SEQ ID NO: 122754 - protein, 78 aa, Glycine max
  Coding DNA Sequence Number=SeqID_5976
MEREMVTMVLNTLLVFYYEKMVGYMPSSFADLVFAGERIEVGLRRGKFDYPALMNRKPRENGENKKEGGTHVVISVPT

SEQ ID NO: 122755 - protein, 186 aa, Glycine max
  Coding DNA Sequence Number=SeqID_5977
MEPPRKNIPTIKNVGDATQIFPEDLFISGKWVNFQSLKEEGFDVKGLFDKDEVNIQGDVDGTTIVVSGCAMDGLTMIKDWEKEITHVLFNIVMPRVGSRDYVSDTDCFCMYKIMVGEKMNLLEIIFFYWMQAFKEKFSPKVKKNYIPQAMLFIQILRLVGMDVFSLEPSSGITQLKVATFVKMGIT

SEQ ID NO: 122756 - protein, 622 aa, Glycine max
  Coding DNA Sequence Number=SeqID_5978
  Homolog annotation: Hit_ID=Q10Q83; Match level="QueryCoverage=32%, HitCoverage=45%, E-value=2e-41, Identity=44%"; Hit description =Expressed protein
  Pfam annotation: Domain name=DUF566; Domain location=233-596; Score =373.1; E_value=4.3e-109; Accession=PF04484.3; Description=Family of unknown function (DUF566)
  Subcellular localization annotation: CTP_CleavageSite=23; ConfidenceScore=5.17e-01
MDVCESGKNKAPETPRVRPPSVLAEKNAVTITTTRRSRTREISSRYKSPTPPASPSAPPRRCPSPNLTRTTPASSSSSSSHLFPKRSLSTERKRPSTPPSPTPQRPSTPVSVDGKLLSRRRLPDGLWPSTMRSLSVSFQSDTISIPVSKKEKPVVSASDRSLRPASNVAHKQPEIPTIRKPTLERKRSPLKGKNASDQSENSKPVDSSLSSRLIDQHRWPSRIGGKVSSNVLNRSVDCADIRTSNTSVSGTGVSSSLRRFSLSISDESSKPLQRASSDAVRLLSLVGSGRIGSEVKSVDDCLPPELRPHKSVTAKPTDKAGLAFAGVRSQSLSAPGSRLPSPSRTSVLSSSSSRGVSPSRLRPSTPPSRGVSPSRIRPTNSSIQSNNSISVLRFIADFKKGKKGAANIEDAHKLRLLHNRYLQWRFANARAEAVLYIQNAIVEKTLYNVWITTLSLWESVIRKRINLQQLKLELKLNSVFNDQITFLDDWAVLERDHIDAVSGAVEDLEASTLRLPVTGGAMADIEHLKVAICQAVDVMQAMGSAICSLLSQVEGMNYLISEVAVIAVQEKTMLDECEVLLASVAAMQEKCLGILETLNRNLIGRRILYGGENFVFLLDTNV

SEQ ID NO: 122757 - protein, 96 aa, Glycine max
  Coding DNA Sequence Number=SeqID_5979
MGERNSQKLPRRAAFNIRRWLSFNCTIKLQRKEGFPWKSGILDKREELRKVGVAGGNVLGEMGKDMQSLTILPKSKEENRSPEVEGGEEELPVAGE

SEQ ID NO: 122758 - protein, 164 aa, Glycine max
  Coding DNA Sequence Number=SeqID_5980
  Gene Ontology: Mol. function=DNA binding; Cellular component=nucleus; Biological process=regulation of transcription, DNA-dependent
  Homolog annotation: Hit_ID=Q70RD0; Match level="QueryCoverage=89%, HitCoverage=57%, E-value=2e-52, Identity=63%"; Hit description=MYB10 protein
  Pfam annotation: Domain name=Myb_DNA-binding; Domain location=62-107; Score=48.1; E_value=3e-11; Accession=PF00249.21; Description=Myb-like DNA-binding domain
  Pfam annotation: Domain name=Myb_DNA-binding; Domain location=9-56; Score=47.3; E_value=5e-11; Accession=PF00249.21; Description=Myb -like DNA-binding domain
  Pfam module annotation: Pfam domain module=Myb_DNA-binding::Myb_DNA -binding; Domain location=62-107::9-56
MEGSSGVRKGAWSQFEDDLLRDCVNLHGEGKWHLVPQRAGLNRCRKSCRLRWLNYLKPNIKRGDFNEDEVDLMIRLHKLLGNRWSLIAGRLPGRTSNDVKNYWNAYMRRKVHSHNKDNKIKKQETKSTVKPHEVIKPIPRVLTKTSPWLQRKFINSPKVGVSEE

SEQ ID NO: 122759 - protein, 766 aa, Glycine max
  Coding DNA Sequence Number=SeqID_5981
  Gene Ontology: Mol. function=receptor activity; Cellular component =integral to membrane; Biological process=red or far red light signaling pathway
  Homolog annotation: Hit_ID=Q2HT55; Match level="QueryCoverage=99%, HitCoverage=98%, E-value=0.0, Identity=75%"; Hit description=SPX, N -terminal; EXS, C-terminal
  Pfam annotation: Domain name=EXS; Domain location=570-739; Score =230.1; E_value=5e-66; Accession=PF03124.5; Description=EXS family
  Pfam annotation: Domain name=SPX; Domain location=1-314; Score=113.6; E_value=5.6e-31; Accession=PF03105.10; Description=SPX domain
  Pfam module annotation: Pfam domain module=EXS::SPX; Domain location =570-739::1-314
MVPEWEEAYMDYNSLKATLKNMSKFRELNESAPMASTPKGSLKRRLTLYRAFSGLTDRQRGSPRKGEDEVILVRAEEGEGSEGLYQTMFLKPSEEGAEQDLVFFKKLDHEFNKVNSFYKKMVNGMVEEAEELSKQMNALIALRIKVDNVGFRNLGSNGISTSFSMNHDINDAKTGLSRVHMDVIHEVEMSNGTHLENGSGNYEEQTTSKTSVGAFRPASLETLDHVKINMTTPETPLSTIKGLLSSSKSDQSFSKKELRKAEEQISIALKEFYNKLRLLKSYSFLNLLAFSKIMKKYDKVSSRNASKDYLKMVDSSYVGSSDEVNRLMERVEHAFIKHFANGNHRKGMNTLRPTAKKERHRITFLLGLFTGCSIALIVALIILIHARNILYSEGRTRYMDNIFPLYSLFGYIVLHMIIYSANIYLWRRYKINFPFIFGFKEGTELGYREVFLLSSGLAVLSLAAVLSNLDMEMDQRTKSFSALTELVPLCLVIVLLLITFCPFNIIYKSSRFFLIQCAFHCVCAPLYKVNFPENFLADQLTSQVQAFRSLEFYVCYYFWGNFKTRSNNCLKSDVYKAFYLIVAIIPFWIRCLQCFRRLLEERNTMHGLNGLKYISTVVALVLRTTNEFQRGMVWKILAATSSGIATIVNTYWDIVIDWGLLRRNSRNPWLREKLSVPNKNVYFVAMVLNVILRLAWMQSVLGIRETPILHRTALTALVTCLEILRRGIWNFFRLENEHLNNVGNYRAFKSVPLPFNYEDEEENTVI

SEQ ID NO: 122760 - protein, 140 aa, Glycine max
  Coding DNA Sequence Number=SeqID_5982
  Gene Ontology: Mol. function=transferase activity; Cellular component= integral to membrane; Biological process=transport
  Homolog annotation: Hit_ID=Q2HVW5; Match level="QueryCoverage=80%, HitCoverage=12%, E-value=5e-21, Identity=56%"; Hit description =Nucleoporin interacting component; Protein prenyltransferase
MAMVSAVQEAQKDNLKSFNDYMMKVLEDISFLGEVNLLCNPYLLFLLKFLIAANSNVGTLSGQLAFVSSTSQVSSGMPSMEIVPLTGRPIVEKKASIYAEAALGVGVGNLQRIRAFLRLTQWINKGGMVPEEIAAAASEE

SEQ ID NO: 122761 - protein, 131 aa, Glycine max
  Coding DNA Sequence Number=SeqID_5983
  Gene Ontology: Mol. function=DNA binding; Cellular component=nucleus; Biological process=regulation of transcription
  Homolog annotation: Hit_ID=Q1HAY1; Match level="QueryCoverage=90%, HitCoverage=51%, E-value=1e-40, Identity=62%"; Hit description=R2R3 -MYB transcriptional regulator
  Pfam annotation: Domain name=Myb_DNA-binding; Domain location=62-100; Score=12.4; E_value=0.29; Accession=PF00249.21; Description=Myb-like DNA-binding domain
  Pfam annotation: Domain name=Myb_DNA-binding; Domain location=9-56; Score=33.1; E_value=9.7e-07; Accession=PF00249.21; Description=Myb -like DNA-binding domain
  Pfam module annotation: Pfam domain module=Myb_DNA-binding::Myb_DNA -binding; Domain location=62-100::9-56
MEGPSGVRKGAWTKCEDDLLRACVQLYGEGKWHLVPQRAGLNRCRKSRRLRWLNYLKPNIKRGDLSEDEVDMMIRMHKLLGNRLPRRTSNDVKNYWNTYMRRKVYSHKKDNNVEKQAEAKSNSETSRSDKA

SEQ ID NO: 122762 - protein, 69 aa, Glycine max
  Coding DNA Sequence Number=SeqID_5984
  Subcellular localization annotation: CTP_CleavageSite=35; ConfidenceScore=5.58e-01
MSPPPLEPHNHSQTHLKLSGRLRLQAPVFAGGFVCASTLSATMDRSMRISGFRLSACFSRSADGLMRCS

SEQ ID NO: 122763 - protein, 84 aa, Glycine max
  Coding DNA Sequence Number=SeqID_5985
TSPWLQGKFFNSSKVGASGEGATSISGSGNWWETLLDDKEDNEGNINNTCFFGGVESLTFGMRSLIQLLVTFLLKVKIGVDIKF

SEQ ID NO: 122764 - protein, 751 aa, Glycine max
  Coding DNA Sequence Number=SeqID_5986
  Gene Ontology: Mol. function=RNA-directed DNA polymerase activity; Cellular component=chromatin; Biological process=chromatin assembly or disassembly
  Pfam annotation: Domain name=Chromo; Domain location=620-670; Score =29.0; E_value=1.6e-05; Accession=PF00385.14; Description='chromo' (CHRromatin Organisation MOdifier
  Pfam annotation: Domain name=rve; Domain location=317-472; Score =100.7; E_value=4.3e-27; Accession=PF00665.16; Description=Integrase core domain
  Pfam annotation: Domain name=zf-H2C2; Domain location=258-299; Score =8.4; E_value=0.028; Accession=PF09337.1; Description=His(2)-Cys(2) zinc finger
  Pfam module annotation: Pfam domain module=Chromo::rve::zf-H2C2; Domain location=620-670::317-472::258-299
MARATLSSGLTFIKGYAVLASPLTKLLSQGQFQWSPEATEAFQKLKDAITRAPVLALPDFKVPFVVETDASNTGMGTVLSQGGHPIAFFSKQFCPRMASASTYIRELAAITATVKKWRQYLLGHRFTILTDHRSLRELMSQAIQTPEQHRYLVRLLGFDYTIQYRSGQTNTVADALSRVNEDNQASLYMLTMPRLVFIEDLRKELARTPAFKELYEQIQANPTKYPDHSVTSGLILHKGRIWLPSTSSFIKLLLEEFHQTPVGGHMGVQKTLQHLQENFKWDSMRTDVHNFIANCITCQQTKYDNRKPGGLLCPIPIPALPWEDLSMDFIVGLPAYKGNTCILVIVDRFSKWLHLGMLPPHHTAYTVALLFMEIARKLHGMPRSIISDRDPLFVSKFWKELFTMSGTRLRLSSAHPQTDGQTKVANQIIKQYLRAYVHQKPATWGHYLMWAEWSYNTSCHSTTWMTPFEITYGRKPPSFPQYITGTSRIDVVDELLTQREEVFASLRKKLSKAQERMKETTDKGCRDQEFNVGDWVLVKLRPHRQTSVAGAPYLKLAKRYYGPFRILDRLGKVAYKLQLPDHSKIHPVFHVSLLKAYIAAADANRSAELPPEDVNNKPIVKPLTIIASKVVPSETGPRRMVLVQWVGLPPEDASWEDWSEFQTLHDLKDKVWFEGQGSDTQQTQGVPLAEQGEDNNGGVSLARPKRRIAPPSYLEDYVHVWKVMGKREKSVALKLWFRTKVVRLTHEDEMP

SEQ ID NO: 122765 - protein, 363 aa, Glycine max
  Coding DNA Sequence Number=SeqID_5987
  Gene Ontology: Mol. function=DNA binding; Cellular component=nucleus; Biological process=regulation of transcription, DNA-dependent
  Homolog annotation: Hit_ID=Q1SLD2; Match level="QueryCoverage=99%, HitCoverage=91%, E-value=7e-96, Identity=56%"; Hit description =Homeodomain-related
  Pfam annotation: Domain name=Myb_DNA-binding; Domain location=14-61; Score=53.5; E_value=7.2e-13; Accession=PF00249.21; Description=Myb -like DNA-binding domain
  Pfam annotation: Domain name=Myb_DNA-binding; Domain location=67-112; Score=46.0; E_value=1.3e-10; Accession=PF00249.21; Description=Myb -like DNA-binding domain
  Pfam module annotation: Pfam domain module=Myb_DNA-binding::Myb_DNA -binding; Domain location=14-61::67-112
MGRSPCCDKVGLKKGPWTPEEDQKLLAYIEEHGHGSWRALPAKAGLQRCGKSCRLRWTNYLRPDIKRGKFSMQEEQTIIQLHALLGNRWSAIATHLPKRTDNEIKNYWNTHLKKRLDKMGIDPVTHKPKNDALVSTEGPSKSAANLSHMAQWESARLEAEARLVRESKLRSSSHSSSSLHHTLIGTSAVSSSSSSAPMIPPSSLSLDHAWNNGSSISTTVNATRVSDLESPTSTLSENNAPPINITSVIEFVGSSERGTVKEEGEQEWNKLGYHESFTHLGEYKDGKENSMPFTSSLHELTMTMATTWGSSTSGAHAHAHAHVAEEGCFTNLLLNANSGARSLSPQDGGESNNCHDNARNSGS

SEQ ID NO: 122766 - protein, 181 aa, Glycine max
  Coding DNA Sequence Number=SeqID_5988
  Homolog annotation: Hit_ID=Q1SPB9; Match level="QueryCoverage=96%, HitCoverage=31%, E-value=7e-17, Identity=32%"; Hit description =Transposase
MEAIFKRFEDVDICGKVTLKSKIWELAYPDLTSMCVPLEKVKTKGGQRKHMTKQQRSMKRDLSYFEYMDALHLVHNSSSALKRSASSSKQSQSKRNMLMLNLFHPCMQDFIKNIIDVKDDGNCGYHVIAALLGLGEDSWSLVHNHLLKELEQWYDDYIVLFGGVDRYEHFKRSLLANGLSM

SEQ ID NO: 122767 - protein, 518 aa, Glycine max
  Coding DNA Sequence Number=SeqID_5989
  Gene Ontology: Mol. function=transferase activity; Cellular component= nucleus; Biological process=mRNA editing
  Homolog annotation: Hit_ID=Q1SLC5; Match level="QueryCoverage=99%, HitCoverage=99%, E-value=0.0, Identity=73%"; Hit description =Tetratricopeptide-like helical
  Pfam annotation: Domain name=PPR; Domain location=174-208; Score =31.9; E_value=2.3e-06; Accession=PF01535.11; Description=PPR repeat
  Pfam annotation: Domain name=PPR; Domain location=236-270; Score =38.8; E_value=1.8e-08; Accession=PF01535.11; Description=PPR repeat
  Pfam annotation: Domain name=PPR; Domain location=271-304; Score=4.7; E_value=2.1; Accession=PF01535.11; Description=PPR repeat
  Pfam annotation: Domain name=PPR; Domain location=338-372; Score =41.2; E_value=3.5e-09; Accession=PF01535.11; Description=PPR repeat
  Pfam annotation: Domain name=PPR; Domain location=373-406; Score=9.9; E_value=0.51; Accession=PF01535.11; Description=PPR repeat
  Pfam annotation: Domain name=PPR; Domain location=409-443; Score=2.9; E_value=3.3; Accession=PF01535.11; Description=PPR repeat
  Pfam annotation: Domain name=PPR; Domain location=475-509; Score=9.5; E_value=0.56; Accession=PF01535.11; Description=PPR repeat
  Pfam annotation: Domain name=PPR; Domain location=73-107; Score=24.4; E_value=0.00041; Accession=PF01535.11; Description=PPR repeat
  Pfam module annotation: Pfam domain module=PPR::PPR::PPR::PPR::PPR::PP R::PPR::PPR; Domain location=174-208::236-270::271-304::338-372::373 -406::409-443::475-509::73-107
  Subcellular localization annotation: CTP_CleavageSite=43; ConfidenceScore=5.16e-01
MIRKRRGRSTITNVGTLKQIHALMIVNGLTSNVGFLRKLVLTTAMSMVGPNATSAVIRYALQMFAQIPQPDTFMWNTYIRGSSQSHDPVHAVALYAQMDQRSVKPDNFTFPFVLKACTKLFWVNTGSAVHGRVLRLGFGSNVVVRNTLLVFHAKCGDLKVATDIFDDSDKGDVVAWSALIAGYAQRGDLSVARKLFDEMPKRDLVSWNVMITVYTKHGEMESARRLFDEAPMKDIVSWNALIGGYVLRNLNREALELFDEMCGVGECPDEVTMLSLLSACADLGDLESGEKVHAKIIEMNKGKLSTLLGNALVDMYAKCGNIGKAVRVFWLIRDKDVVSWNSVISGLAFHGHAEESLGLFREMKMTKVCPDEVTFVGVLAACSHAGNVDEGNRYFHLMKNKYKIEPTIRHCGCVVDMLGRAGLLKEAFNFIASMKIEPNAIVWRSLLGACKVHGDVELAKRANEQLLRMRGDQSGDYVLLSNVYASQGEWDGAENVRKLMDDNGVTKNRGSSFVEAFS

SEQ ID NO: 122768 - protein, 145 aa, Glycine max
  Coding DNA Sequence Number=SeqID_5990
  Gene Ontology: Mol. function=RNA-directed DNA polymerase activity; Biological process=RNA-dependent DNA replication
  Homolog annotation: Hit_ID=Q1SLC2; Match level="QueryCoverage=34%, HitCoverage=28%, E-value=2e-13, Identity=72%"; Hit description=RNA -binding region RNP-1
MKRIGKGVTYEFDKSLVAIGADIALGVDDLTEGSAELSELLLGAFPGEVAKVQDLGRVLMNKRCGMRQGSFFVQKNKTQECITMKNILTTYEKALGQAINLQKSKLVFSRNVSQQLHEDILEIMNVNVGLGFGKYMRLSTSMGKS

SEQ ID NO: 122769 - protein, 359 aa, Glycine max
  Coding DNA Sequence Number=SeqID_5991
  Gene Ontology: Mol. function=nucleic acid binding; Cellular component= mitochondrial outer membrane translocase complex; Biological process =protein import into mitochondrial outer membrane
  Homolog annotation: Hit_ID=Q1S2B6; Match level="QueryCoverage=74%, HitCoverage=55%, E-value=1e-110, Identity=66%"; Hit description=RNA -binding region RNP-1
MVRGKTVYIQYSNRHEIVNNKSPGDIPGNVLLVTIEGVEAGDVSIDVIHLVFSAFGFVHKIATFEKTAGFQALIQFTDAETASSARDALDGRSIPRQTAVGPDGKRKEPDSNVLLASIENMQYAVTVDVLHTVFSAFGTVQKIAIFEKNGQTQALIQYPDIITASAAREALEGHCIYDGGYCKLHLSYSRHTDLNVKAFSDKSRDYTVPDPSLLAAQGPATAWQNPQAAPMYPGSAPAYHTQVPGGQVPAWDPNLQAVRPSYVSAPGTFHVQSGAAPPMPAYAPAAAMPAASSPHAQSSPMAHNANPMGIAQPRVPPNANLQSSGASLSAPGSSPLMQTSQAAQGLVQPNARPGGASPP

SEQ ID NO: 122770 - protein, 683 aa, Glycine max
  Coding DNA Sequence Number=SeqID_5992
  Gene Ontology: Mol. function=nucleic acid binding; Cellular component= chromatin; Biological process=DNA integration
  Homolog annotation: Hit_ID=Q1RWN2; Match level="QueryCoverage=89%, HitCoverage=72%, E-value=5e-75, Identity=47%"; Hit description =Peptidase S8 and S53, subtilisin, kexin, sedolisin; Integrase, catalytic region; Zinc finger, CCHC-type
  Pfam annotation: Domain name=rve; Domain location=182-334; Score =21.0; E_value=0.0001; Accession=PF00665.16; Description=Integrase core domain
  Pfam annotation: Domain name=zf-CCHC; Domain location=86-103; Score =23.0; E_value=0.00016; Accession=PF00098.13; Description=Zinc knuckle
  Pfam module annotation: Pfam domain module=RVT_2::rve::zf-CCHC; Domain location=391-602::182-334::86-103
MTPKFDYVMCSIEESKDTDTLTIDELQSSLLVHELRMTSHVEEVQALQIAHTDQHAEQGRGRGGFGQCRRGRGRGHGRQGLDKSTIECFTCHQLGHFNRECSNQRKKANYVENDEDTLLMACTDITKANEEVKLGNNSSTAVIGKGNVRLNMNGNTYTVTRVFFVPELRNNILSIEQLQEKGLAFCFNMESAKCFILKTIWTFKFSGFKYALPAPYGIWFANNESANKTVQGLHGREEITSFIPKEEYLEGYTDFTNFCCDNGIYRQLTTAYTPQQNGIAERNNITIMNMVQSMLSEKKMPKTFWAEAATWSVHILNWCPTLAYEETILCDLDWGDKDVEPVVEENIEEHEYETGEGLSEGSTEANLAMSASESDPTHFDVAVQIAKWRKAMDEEMEAINKNGTWKLMELPDGAQKIGVKLVVKGYAQEYKVDYTKVFAPIARMETIRLVVALAAQKGWTIYQLDVKSTFLHGELEETVYVDQPCGYVQKGDEHEVYKLKKALYGLKQAPRAWYNRIEAYFFKGGFEKCDYEHSLFVKREKEDIILIVSLYVDDLIFTGNDELMFAKFKSSMKHEFDMTDLEMLQRFGMDKSNSVQTPIVPGVKLTKDDTGAKDSRWYCEGQRLKVVAQVRGENKWLPVFEEGLLLRSIGNAYSHYQYGKIQQFIYCKEYKHEASNGHNGMRN

SEQ ID NO: 122771 - protein, 96 aa, Glycine max
  Coding DNA Sequence Number=SeqID_5993
MESNIPILSKKRLNWLDNRGMRMSQIYSFGDQIKGTKIELFHFQAAWFSHPEYQNVVASAWEKPNPNILIKLHHVKEDSLLFNSEIFGELKEFIRN

SEQ ID NO: 122772 - protein, 76 aa, Glycine max
  Coding DNA Sequence Number=SeqID_5994
  Homolog annotation: Hit_ID=Q337I5; Match level="QueryCoverage=74%, HitCoverage=11%, E-value=2e-07, Identity=47%"; Hit description =Expressed protein
MENKTSESANPGNLLVETDLIMSEIQNPIHMEFGRNLRGKNGLICESVLMELKEFVSMCGGPNEKLRADRLINCLR

SEQ ID NO: 122773 - protein, 173 aa, Glycine max
  Coding DNA Sequence Number=SeqID_5995
  Gene Ontology: Mol. function=calcium ion binding
  Homolog annotation: Hit_ID=Q1SLN2; Match level="QueryCoverage=97%, HitCoverage=99%, E-value=1e-35, Identity=44%"; Hit description =Calcium-binding EF-hand
  Pfam annotation: Domain name=efhand; Domain location=105-133; Score =34.8; E_value=2.9e-07; Accession=PF00036.22; Description=EF hand
  Pfam annotation: Domain name=efhand; Domain location=143-171; Score =30.7; E_value=5.2e-06; Accession=PF00036.22; Description=EF hand
  Pfam module annotation: Pfam domain module=efhand::efhand; Domain location=105-133::143-171
MVILREIGYLISDGKASQNDGNSTSPLFGLVRAEEQVSKPGEFSHQENESKGSIDSENYLERDEVKMVMAKLGFFCSSESEELQEKYGSKELSELFEEQEPSLEEVKQAFDVFDENKDGFIDAEELQRVLCILGLKEAAKLENCHKMIRIFDTNQDGRIDFIEFVKIMENRFR

SEQ ID NO: 122774 - protein, 94 aa, Glycine max
  Coding DNA Sequence Number=SeqID_5996
MGVEEKSPKFQESWDLRSNPFQGGGNDAILPRKEGEVKFDEEDPRPTSSNGAYIRNVQGEWNVDNMTMYLSATIIDAIRGIIPSSGSQSNDEPA

SEQ ID NO: 122775 - protein, 448 aa, Glycine max
  Coding DNA Sequence Number=SeqID_5997
  Gene Ontology: Mol. function=zinc ion binding; Cellular component =nucleus; Biological process=regulation of transcription
  Homolog annotation: Hit_ID=Q1SM76; Match level="QueryCoverage=98%, HitCoverage=88%, E-value=1e-159, Identity=64%"; Hit description=Zinc finger, Dof-type
  Pfam annotation: Domain name=MFMR; Domain location=228-372; Score= -66.3; E_value=0.021; Accession=PF07777.2; Description=G-box binding protein MFMR
  Pfam annotation: Domain name=zf-Dof; Domain location=83-145; Score =143.3; E_value=6.7e-40; Accession=PF02701.6; Description=Dof domain, zinc finger
  Pfam module annotation: Pfam domain module=MFMR::zf-Dof; Domain location=228-372::83-145
MWEDALLEEDTNDTLGEKPTDDKKEDGAPTQSSEEVTNLDTASGSCEESVALSTEREATTLKTTKTEEEQSETSNSQDKNLKKPDKILPCPRCNSMDTKFCYYNNYNVNQPRHFCKNCQRYWTAGGTMRNVPVGAGRRKNKSSASHYRQITVSEAALQNPRTDLPNGAYHPSLKCNGTVLTFGTDTPLCESMASVLNLADKTMPNYTRNGFHKPEELRIPVPHASGEKGDDQSNKSSVTSTTSVEGAITNGPKEQVVQNCQSFPPQVPYFPGTPWPIPWNPVQWSSPVPPPAFCPPGFTMPFYPATAYWGCAVPGTWNIPWLVQPSSPNGATPNSGPNSPTLGKHSREDSTFKSNESGGEDGHSKENNKEKSLWVPKTLRIDDSEAAKSSIWATLGIKNDKADSVPGGTLFKAFPSKHDDKNHSMQASPVLQANPAALSRSLNFHETS

SEQ ID NO: 122776 - protein, 200 aa, Glycine max
  Coding DNA Sequence Number=SeqID_5998
  Gene Ontology: Mol. function=structural constituent of ribosome; Cellular component=intracellular; Biological process=translation
  Homolog annotation: Hit_ID=Q5N757; Match level="QueryCoverage=45%, HitCoverage=38%, E-value=1e-09, Identity=40%"; Hit description =Pentatricopeptide (PPR) repeat-containing protein-like
  Subcellular localization annotation: CTP_CleavageSite=56; ConfidenceScore=5.31e-01
MAYFHSSISLCNSSVDQYMANSLDFEPKSRHRKTPNSLQSPPCRRSRSAVVDVVIFAAVIAAFGFLLFPYAQILASESVKFGILIVNLVKEEVSFTPWIYMFIGVSVTFAALTTWVLVACTIRKCGNPNCKGLRKAATFDIQLETEDCVKNSPSLTKDGWRFRDRRRIERPRSRIQKRRNKKSYRKERILDTECSLKLVE

SEQ ID NO: 122777 - protein, 65 aa, Glycine max
  Coding DNA Sequence Number=SeqID_5999
MSEVKDPAIKLFGKTIPVPEIPRGSAGAPASSSGDVVDDSVDASSTNSSRESHTKRDALGKDVDK

SEQ ID NO: 122778 - protein, 311 aa, Glycine max
  Coding DNA Sequence Number=SeqID_6000
  Gene Ontology: Mol. function=transferase activity, transferring glycosyl groups; Cellular component=chloroplast; Biological process =glucan biosynthetic process
  Homolog annotation: Hit_ID=Q75T79; Match level="QueryCoverage=59%, HitCoverage=28%, E-value=9e-87, Identity=77%"; Hit description =Starch synthase II precursor
  Pfam annotation: Domain name=Glyco_transf_5; Domain location=82-253; Score=99.9; E_value=7.7e-27; Accession=PF08323.2; Description=Starch synthase catalytic domain
MWDWSSKSQQEPVMIADNHEEDDERLSDPTPDEPESSKRPRRNPQLPARLQDCVMFNDNNPSDEEIINFALFAGYGPITFEEALSYKNWRKAMDDEIHAIGELNVKLPQNEDKRTKTKESSYRDGNVPWHVPCGGVCYGDGNLAFIENDWHTALLPVYLKAYYRDQGLMQYARSVLVIHNIAHQGRGPVDDFFFVDLPEHHKDLFKFHIGGDHFNIFAAGLKTADRVVTVSHGYAWELKTSEGGWGLHGIINENDWKLGHYGYTNYSLETLSSGKAKCKAALQKELGLPIHEDVPVIGFVGGWINRKELIS

SEQ ID NO: 122779 - protein, 314 aa, Glycine max
  Coding DNA Sequence Number=SeqID_6001
  Homolog annotation: Hit_ID=Q9MBG8; Match level="QueryCoverage=77%, HitCoverage=77%, E-value=4e-42, Identity=43%"; Hit description =Arabidopsis thaliana genomic DNA, chromosome 3, TAC clone:K5K13
  Pfam annotation: Domain name=DUF298; Domain location=97-194; Score =32.9; E_value=3.7e-07; Accession=PF03556.6; Description=Domain of unknown function (DUF298)
MDASGIDIFEIYRRYCDIKSGHAYIGGEEGYRQDSDLQKAKVSREALTQLSKLVESRVTTGYVGIADSGKTTILNPKPLRTKQTCQLAEYNGNLLGIGWACQKSARTRSRRGLLESVGKAVSRAVNAWKLVLAGRFSLLHPWCDFVEKNQRYNIFEDTWQQVLAFSGFTHDSLDAYDPEGAWPVLIDDFVEHVHRMLGSYYDNSNLHCNCDDPESQSWVFDDPLPADYGFHTGLTIFSGLKRKLPDDSSKSDDMDSNDMIFSNCKRSRAHDAEDLEDNPPGNTAYDWVCRTTQLVPMCSLVGREGLPFDEAPLL

SEQ ID NO: 122780 - protein, 628 aa, Glycine max
  Coding DNA Sequence Number=SeqID_6002
  Gene Ontology: Mol. function=binding; Cellular component =intracellular; Biological process=metabolic process
  Homolog annotation: Hit_ID=Q9FK33; Match level="QueryCoverage=95%, HitCoverage=91%, E-value=0.0, Identity=50%"; Hit description =Selenium-binding protein-like
  Pfam annotation: Domain name=PPR; Domain location=105-139; Score=3.9; E_value=2.6; Accession=PF01535.11; Description=PPR repeat
  Pfam annotation: Domain name=PPR; Domain location=185-219; Score =33.1; E_value=9.8e-07; Accession=PF01535.11; Description=PPR repeat
  Pfam annotation: Domain name=PPR; Domain location=329-363; Score =48.6; E_value=2.1e-11; Accession=PF01535.11; Description=PPR repeat
  Pfam annotation: Domain name=PPR; Domain location=435-469; Score =10.5; E_value=0.43; Accession=PF01535.11; Description=PPR repeat
  Pfam annotation: Domain name=PPR; Domain location=70-104; Score=25.9; E_value=0.00015; Accession=PF01535.11; Description=PPR repeat
  Pfam module annotation: Pfam domain module=PPR::PPR::PPR::PPR::PPR; Domain location=105-139::185-219::329-363::435-469::70-104
MEQRLKPKPKKVEYSERQVAVLDDTQIRQTSSSGLCIQIEKLVVCNRYREAMKLFEILELEHDGFDVGGSTYDALVSACVGLRSIRGVKRVFNYMISSGFEPDLYLMNRVLFMHVKCGLMLDARKLFDEMPDLVQVGRQIHSCALKRGVGDDTFVSCALIDMYSKCGSIEDAHCVSDQMSEKTTVGWNSIIASYALHGYSEEALSLYYEMRDSGAAIDHFTISIVIRICARLASLEYAKQAHAALVSHGYGQCSSLCEGMGEGCCTQPYPCICKEAVSGFKPMTNKSPRHNFTAAPGLALKHFNNIINKWGRMEDARHVFNWVRCKNVISWSALIAGYGNHGQGEEAVEMFEQMLQEGMIPNHVTFLAVLSACSYSGLSERGLLDEAYEPIRSAPFKPTTNMSAALLTACRMHYNLELGKVAAENLYGMEPEKLCNYIVLLNLYNSSGKLKEAAGVLQTLKRKGLRMLPACTWIEVKKQPHAFLCGDKSHSQRKEIYEKVDNLMVEISRHGYVEENETLLPDVDEEEQRILKYHSEKLDIAFGLINTPHWTPLQITQGHRVCGDCHSAIKLIAMVTRREIVVRDASKFHHFRNGSCSCSDYWCDKVSFKLQSFILSSLLLTHLSLTFD

SEQ ID NO: 122781 - protein, 586 aa, Glycine max
  Coding DNA Sequence Number=SeqID_6003
  Gene Ontology: Mol. function=transporter activity; Cellular component= membrane; Biological process=oligopeptide transport
  Homolog annotation: Hit_ID=Q2HUR9; Match level="QueryCoverage=99%, HitCoverage=99%, E-value=0.0, Identity=79%"; Hit description=TGF -beta receptor, type I/II extracellular region; Major facilitator superfamily MFS_1
  Pfam annotation: Domain name=MFS_1; Domain location=39-520; Score =22.1; E_value=3.1e-05; Accession=PF07690.6; Description=Major Facilitator Superfamily
  Pfam annotation: Domain name=PTR2; Domain location=101-504; Score =321.2; E_value=1.9e-93; Accession=PF00854.12; Description=POT family
  Pfam module annotation: Pfam domain module=MFS_1::PTR2; Domain location=39-520::101-504
MEEKVNKEHQVCTSDGAIDSQGHPAVREKTGDWVAAILILVNQGLATLAFFGIGVNLVLFLTRVMGQDNAEAANSVSKWTGTVYLFSLLGAFLSDSYWGRYMTCAIFQVIFVIGLVSLSLSSYIFLLKPSGCGNKELPCGSHSSYQTILFYVSIYLIALGNGGYQPNIATFGADQFDEGDTREQHSKIVFFSYFYLALNIGSLFSNTILNYFEDDGLWTLGFWASAGSAALALVLFLCGTRRYRYFKPNGNPLPRFCQVFVAATRKWKVKVLQDDKLYEVDEFSTDEGRKMLHTEGFRFLDKAAFITSKNFKQMEESKCSPWYLSTVTQVEEVKCILRLLPIWLCTILYSVVFAQMASLFVEQGDAMDTRISSFHIPPASMSTFDILSVAIVIFIYRRVLDPLVARTMKSKGLTELQRMGIGLVLAIMAMVSAGLVEHFRLKNAIEDCNECKGSSSLSIFWQVPQYVFVGASEVFMYVGQLEFFNAQTPDGLKSFGSALCMTSISLGNYVSSLLVAIVMKISATDEMPGWIPGNLNKGHLDMFYFLLAALTAADLVIYVLMARWYKYVKFQGNNENDTNKEDPEVV

SEQ ID NO: 122782 - protein, 116 aa, Glycine max
  Coding DNA Sequence Number=SeqID_6004
  Gene Ontology: Mol. function=nutrient reservoir activity
  Homolog annotation: Hit_ID=Q8LA49; Match level="QueryCoverage=59%, HitCoverage=19%, E-value=2e-15, Identity=50%"; Hit description =Globulin-like protein
MELDLTPKTAEALFEGDGGGYYTWSSSQVPLLAKNNVGAGRLVLQPRGFALPHYADSSKIGYVIQGPLTSCGSCKLRCLFLCSLWSNSITLGGVRLDHRATGGCCSRDWWSIRLLL

SEQ ID NO: 122783 - protein, 155 aa, Glycine max
  Coding DNA Sequence Number=SeqID_6005
  Homolog annotation: Hit_ID=Q42155; Match level="QueryCoverage=26%, HitCoverage=40%, E-value=1e-12, Identity=76%"; Hit description=NADH dehoydrogenase
MEAWIITYICPIKQLIKWKLLVKKQNGQKVNTSKFSLEILKNVKTTIIRKGNGLPQVHDSHFLHDELVLALFVGVALILALPREVELGLPAPVERDAQVGTLRMKHTTLGSLHSTPRIEAEAACEGREVKVVVSVKTKGRKMKASPWEAESGRCH

SEQ ID NO: 122784 - protein, 217 aa, Glycine max
  Coding DNA Sequence Number=SeqID_6006
  Homolog annotation: Hit_ID=Q2R9P0; Match level="QueryCoverage=58%, HitCoverage=8%, E-value=3e-24, Identity=48%"; Hit description =Armadillo/beta-catenin-like repeat family protein, expressed
MEAPCCSFHDSYKMDMFFKHAVRRNCGGSYFNCLMHYPLFDIVAVKLPLDLEFRSLFCAAQFKASIYLLLSNWAKTGLQHISTCKYIGGTSKSCNLEAYSKPSCWTLDFSSGIPIPNNSAAGHRTVISPSCAGTFLARYYNKQTMIKALEKISTNWTKAVTDAGVPVVVLVKLLHSTLSIALNASRVHDRSGASSAEQMMEAVVGPFKISSLRRRIW

SEQ ID NO: 122785 - protein, 134 aa, Glycine max
  Coding DNA Sequence Number=SeqID_6007
  Subcellular localization annotation: CTP_CleavageSite=51; ConfidenceScore=5.62e-01
MKRTQQSPPFRLLAFLLFLLPPRVSSFWLPFPFVFKAFVVSLLRFRRQEIEATERSSSGSVSGKTSSDSVSGRRNIYSCMVIMVRTRGLGRALARVIGRGRPDEHDAIDVPRRHRPTASARRQQVHIAVDEDVS

SEQ ID NO: 122786 - protein, 185 aa, Glycine max
  Coding DNA Sequence Number=SeqID_6008
MDLKVKALTSMNSNDKKKANLFAAKKERIILPTYNDDLGGNKYHISEFLSQPSGIAAVLNTKAFQSFQSLDANTYRCELPKLQFLNFEAAPLLDLRVTSTDEDCLVEMLSCKFEGSEVVKEQNNHFSAFMRNHMTWGGAGAESFLEVDVNLNLTLEIYTQPFTMMPTSAVEGPGNMLCTPHGQVL

SEQ ID NO: 122787 - protein, 588 aa, Glycine max
  Coding DNA Sequence Number=SeqID_6009
  Gene Ontology: Mol. function=transporter activity; Cellular component= membrane; Biological process=oligopeptide transport
  Homolog annotation: Hit_ID=Q2HUR9; Match level="QueryCoverage=96%, HitCoverage=97%, E-value=0.0, Identity=71%"; Hit description=TGF -beta receptor, type I/II extracellular region; Major facilitator superfamily MFS_1
  Pfam annotation: Domain name=MFS_1; Domain location=41-521; Score =25.0; E_value=2.3e-05; Accession=PF07690.6; Description=Major Facilitator Superfamily
  Pfam annotation: Domain name=PTR2; Domain location=103-505; Score =321.7; E_value=1.3e-93; Accession=PF00854.12; Description=POT family
  Pfam module annotation: Pfam domain module=MFS_1::PTR2; Domain location=41-521::103-505
DKIKGKVNRDNEVCTSDGAIDSHGHPAVLKRTGTWTTGILILVNQGLATLAFFGVGVNLVLFLTRVMGQDNAEAANNVSKWTGTVYLFSLLGAFLSDSYWGRYMTCAIFQVIFVIGLVSLSLSSHISLLKPSGCGDKELQCGSHSSSQTALFYLSIYLVALGNGGYQPNIATFGSDQFDEGDPKERLSKVAFFSYFYLALNLGSLFSNTILDYFEDKGQWTLGFWASAGSAAIALILFLCGTRRYRYFKPVGNPLPRVGQVFVAAGKKWKVKVLSEENLYEDEESSPSGRRKMLHTEGFRFLDKAAFITSKDLEQLEENKRNPWCLSTVTQVEEVKCILRLLPIWLCTIMYSVVFAQMASLFVVQGDAMATGISSFKIPPASMSSFDILGVAFFIFIYRHALDPFVAKVMKSKLTELQRMGIGLVLAIMAMVSAGLVEKFRLKYAIKDCNQCDGSSSLSIFWQVPQYVLTGASEVFMYVPQLEFFNAQTPDGLKSFGSALCMTSISLGNYVSSLLVAIVMKISTKGDIPGWIPGNLNLGHLDRFYFLLAALTTADLVVYVALAKWYKSIQFEENAEEDIKKENHEVMV

SEQ ID NO: 122788 - protein, 115 aa, Glycine max
  Coding DNA Sequence Number=SeqID_6010
MDKTSNAWIKWNNSHKKTDNAIRRRKRKPPKNKCKAQDNICLTSKEESKVVDEVLLGIFLMLSTSDHEVLGRSIMTKCRSMAWSAYVSRFRGSFSQLSCPFHCVTTSMSPTQTNL

SEQ ID NO: 122789 - protein, 399 aa, Glycine max
  Coding DNA Sequence Number=SeqID_6011
  Gene Ontology: Mol. function=metal ion binding; Cellular component =intracellular; Biological process=protein kinase C activation
  Homolog annotation: Hit_ID=Q6ES36; Match level="QueryCoverage=99%, HitCoverage=78%, E-value=1e-108, Identity=51%"; Hit description =Pentatricopeptide (PPR) repeat-containing protein-like
  Pfam annotation: Domain name=PPR; Domain location=112-146; Score=6.3; E_value=1.3; Accession=PF01535.11; Description=PPR repeat
  Pfam annotation: Domain name=PPR; Domain location=178-212; Score =18.7; E_value=0.021; Accession=PF01535.11; Description=PPR repeat
  Pfam annotation: Domain name=PPR; Domain location=218-252; Score =12.9; E_value=0.22; Accession=PF01535.11; Description=PPR repeat
  Pfam annotation: Domain name=PPR; Domain location=254-287; Score =13.3; E_value=0.2; Accession=PF01535.11; Description=PPR repeat
  Pfam annotation: Domain name=PPR; Domain location=77-111; Score=25.9; E_value=0.00014; Accession=PF01535.11; Description=PPR repeat
  Pfam module annotation: Pfam domain module=PPR::PPR::PPR::PPR::PPR; Domain location=112-146::178-212::218-252::254-287::77-111
MRERGAMPNKLTFPFLLKSCAVASALFEGKQVHADAVKCGLDSDVYVGNNLINFYGCCKKIVDARKVFGEMPERTVVSWNSVMTACVESLWLGDGIGYFFRMWGCGFEPDETSMVLLLSACAELGYLSLGRWVHSQLVLRGMVLSVQLGTALVDMYGKSGALGYARDVFERMENRNVWTWSAMILGLAQHGFGEEALELFAIMNNNNNDNRDIRPNYVTYLGVLCACSHAGMVDEGYQYFHDMECVHGIKPLMTHYGAMVDVLGRAGRLEEAYEFIQSMPIEPDPVVWRTLLSACTVHDVHDHTGIGERVSKKLLLKEPRRGGNLVIVANMYAEVGMWEEAANVRRVMRDGGMKKVAGESCVDLGGSMHRFFAGYDPCPDLVPVYHLLDGLNLHLKMVN

SEQ ID NO: 122790 - protein, 185 aa, Glycine max
  Coding DNA Sequence Number=SeqID_6012
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=97%, HitCoverage=65%, E-value=4e-86, Identity=72%"; Hit description =Photosystem II D2 protein (Photosystem Q(A) protein)
  Pfam annotation: Domain name=Photo_RC; Domain location=1-169; Score =100.4; E_value=5.2e-27; Accession=PF00124.9; Description =Photosynthetic reaction centre protei
GLWTFVALHGAFALIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDVTGLWMSALGVVGLALNLRAYDFVSQEIRAAEDPEFETFYTKNILLNEGIRAWMAAQDQPHETLYSLR

SEQ ID NO: 122791 - protein, 105 aa, Glycine max
  Coding DNA Sequence Number=SeqID_6013
MLRRPQTRRHLIRLAQLDHLIQSSIYGIWFASRRPTTRRILQSQGFTSFSCPTPDQFRVEVAWPGDWPEAQAGGAPAEAPDEADEAREDEEITDLLDFLGGGGAT

SEQ ID NO: 122792 - protein, 134 aa, Glycine max
  Coding DNA Sequence Number=SeqID_6014
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=57%, HitCoverage=4%, E-value=3e-17, Identity=50%"; Hit description=Chromo
MTSAEMQLRRERGLCFTCDDKFSPSHRCPNKQYFVPQWEEEDEPALQPDPPDEVLVGNGNALTAEGLILDLEVKIQGHTLKLPVYLLQVSGADLVLGAAWLATIRPHLSDYSTLTLKFYLGNQFITLHGERPSL

SEQ ID NO: 122793 - protein, 63 aa, Glycine max
  Coding DNA Sequence Number=SeqID_6015
MFYTENSKKATPLDNDPLIQMFEKFHFTIMPLNVPYSIPVVENQENSGIDRLWSEEEGLHYPF

SEQ ID NO: 122794 - protein, 557 aa, Glycine max
  Coding DNA Sequence Number=SeqID_6016
  Gene Ontology: Mol. function=nucleic acid binding; Cellular component= intracellular; Biological process=regulation of transcription
  Homolog annotation: Hit_ID=O22091; Match level="QueryCoverage=99%, HitCoverage=100%, E-value=4e-74, Identity=36%"; Hit description=ZPT4- 4
  Pfam annotation: Domain name=zf-C2H2; Domain location=364-386; Score =14.3; E_value=0.29; Accession=PF00096.16; Description=Zinc finger, C2H2 type
  Pfam annotation: Domain name=zf-C2H2; Domain location=463-485; Score =17.1; E_value=0.063; Accession=PF00096.16; Description=Zinc finger, C2H2 type
  Pfam annotation: Domain name=zf-C2H2; Domain location=9-31; Score =11.6; E_value=0.58; Accession=PF00096.16; Description=Zinc finger, C2H2 type
  Pfam annotation: Domain name=zf-C2H2; Domain location=97-119; Score =10.6; E_value=0.75; Accession=PF00096.16; Description=Zinc finger, C2H2 type
  Pfam module annotation: Pfam domain module=zf-C2H2::zf-C2H2::zf -C2H2::zf-C2H2; Domain location=364-386::463-485::9-31::97-119
MEEDQEVKHMCKFCSKSFPCGRSLGGHMRSHVTANVSTEAEKLSSFNNNGGGGDSDQGGTNNGGGYGLRENPKKTWRFNDSSEDNNNNNTTLLVLDKLCKECGKGFHSWKALFGHMKCHSEKLSQNNNSSSSLLLEDQDSWNDNNTNASQSQKMTVLMDDSHSENEATAPNRRRRSKRRRTRYMAPSTSSVSLVSEAHEQEQEEVAMSLMMLSRDVSPWCGLNSVNSMQFESPSLVPTNLDSKAEGKRVVISNGSEKKVTKPRDVKWEFCNLDVSNLNSKGKMSSELLGTQSPGSEFGVNKTMVSNSAFEDNETDDNHNSNNKCTSIKANFMDSELKSSSLKSWVNNKPSEDEFSKSSNKRGKFECTTCKKIFHSYQALGGHRASHKRIKGCFASRNESSENSTELEAELSPDHTTENKLLKNEYVEEHEMVTTVTTTTTTTAITDFDNEINTVRDSKKGKVHECSICLKIFPSGQALGGHKRSHHLAGGSESARNFQSQTIVLQEAAPEIRDFFDLNLPASTEEEGTGHRHAEHYKPWWVVGGNHKQEALVGLISN

SEQ ID NO: 122795 - protein, 100 aa, Glycine max
  Coding DNA Sequence Number=SeqID_6017
MGKCVTPLKEWSSIPKNVHVTQGITLEALHRDKHQEIKLKQTQQIKDVVYRYLLTIGQGLLRFELFVTYVDVDTPILIPQQNYQSYRPTYFETSQQPIYK

SEQ ID NO: 122796 - protein, 37 aa, Glycine max
  Coding DNA Sequence Number=SeqID_6018
MDCAKKLDYLSMKKGEGSANAKALKATKAQARKMNEE

SEQ ID NO: 122797 - protein, 121 aa, Glycine max
  Coding DNA Sequence Number=SeqID_6019
MEGGIGPILDLTPKEEKRIEGLKSEERKVPLATLSFQGYALYWWTSIAIERRICGDPPVEYCNDLKSILRKRHIPSYYEIELMDKLQRLRKGSISVKEYRQQMELLFLRARLREEGKNKHS

SEQ ID NO: 122798 - protein, 135 aa, Glycine max
  Coding DNA Sequence Number=SeqID_6020
  Homolog annotation: Hit_ID=Q8H3G8; Match level="QueryCoverage=83%, HitCoverage=12%, E-value=7e-12, Identity=39%"; Hit description =Myosin heavy chain-like protein
MMFLHIKWHQALNESPIGHNQSPKVTSEVVAIAEDINDMSFISAQSAEVTSHTTDLGRDGLLEEDENGAEQRIEYVRKSICNSCECWENAENEGTSLKKQVQAPTLKNSTLEDRVTHLDNALKECVRQLRQTRCL

SEQ ID NO: 122799 - protein, 63 aa, Glycine max
  Coding DNA Sequence Number=SeqID_6021
MGLTVEYGGVLNAEVGLQQTAAVTNPSDDDGVEETTVTDLRGEGERGFCFVSETELVRGGRAF

SEQ ID NO: 122800 - protein, 707 aa, Glycine max
  Coding DNA Sequence Number=SeqID_6022
  Gene Ontology: Mol. function=zinc ion binding
  Homolog annotation: Hit_ID=Q8LJG8; Match level="QueryCoverage=95%, HitCoverage=96%, E-value=0.0, Identity=49%"; Hit description =Putative male sterility 1 protein
  Pfam annotation: Domain name=PHD; Domain location=624-672; Score =38.6; E_value=2.1e-08; Accession=PF00628.19; Description=PHD-finger
MVVSGGKGLKRAAKKRVTADFYDFLTFPTPSLAEAENFAGGPFRSNVRAFLTKHALLPPPSALFPHLLTWQIVFRVGELTEGPDAPVVCLDVVEEDVARSRSVYCDQCRVFGWSGHPVCGKRYHFIIKADGSSIGGYHKPCMCCGDILHLSESKCKSCNHVTTTDDVEDWVYHQLENTTHLLHGVVHTNGYGHLLRVNGREGGSRFLSGIHIMDFWDRLCKTLGVRKVSVMDVSKKYGIEYRLLHAIMKGHPWYGDWGYKFGSGSYCLTHESYKSAVESLSNLPLSTFSQGKMPDSRVQDMIKYYQSLSEHELVNIRDLFCFIMGLIGDAHKTASNVDETTCKKRRFNASGLSISWDKSDIERVEQAMIRVLRAVSESKWVSWRALRGAASKLGSPELLDYCLGELGGKMVYGGMVVNSRCNPQTGVYEFRVEAATGACYGILANNNSSGSKYPSEENLLQCLRYLYDSLLHPQMMVNYEAGTRTLVMSSAQKLFDCKQFVKDYNPEMLPLSDSQMFRLSCHVELVDEFEDSEAITPPELIVLPLNATVAELKNQAANAFQDVYLMFRRFQVDELHGYSGVDDSTLVKLLLGSRDVVCVRGRCIGKNGLSKFRMERGLERWTVDCSCGAKDDDGERMLACDICGVWRHTRCSDIHDTDPVPARFVCQKCQHSESKLKSSGHCKDETVTNVSGSSCFRNGLPVPSDVI

SEQ ID NO: 122801 - protein, 625 aa, Glycine max
  Coding DNA Sequence Number=SeqID_6023
  Gene Ontology: Mol. function=nucleic acid binding
  Homolog annotation: Hit_ID=Q01AC6; Match level="QueryCoverage=25%, HitCoverage=53%, E-value=1e-19, Identity=37%"; Hit description=[S] KOG4843 Uncharacterized conserved protein
  Pfam annotation: Domain name=Rxt3; Domain location=483-564; Score =81.7; E_value=2.3e-21; Accession=PF08642.1; Description=Histone deacetylation protein Rxt3
MLVMHLLYMLVIIVVAFGAPKRSHEESVHSSSKHPNEDLGTYSKLVSSSVSNEYHMPHDITQDSRVAKVPRTEFHDADRRSPLNPVYRMSSPLNDSRTDHPIGPENRIESRDSKDNRDLRFENRDTKTEKKELHGEARRDPPSAKSEKDVRVEGRGDDNKDVRHDRDSHNDPKGDTKTEKDGYNVVSSHLNWKDSKEYHRGKRYSDSPGGNWDTWHMSRGNTQGSVEVGKESSAAGERDHVEAHEAVCENKVDPKGDDRSKEKDRKRKDVKHREWGDREKERSDRRNSPQVTNSTGDCKESAKEDRDVERLEREKKDLPKEKENLTERERDQMKRESWNGMEKEVSNNEKESVDASDKLTEQEIVLPEQKKQKEVDSWKNVDREARERRKERDADLEGDRSDKRTKGLDKESNDGCADVEGVMEKEREEHESSQSEMEKNGESSNNGPTLEIRIPSEHVTATNRQDALRHQYPYSANYLVPLDLFKSSASSIVPPVRGGQLWGTDVYTYDSDLVAVLMHTGYCRPTASPPHAAIQELRATVRVLPPQDCYISTLRNNIRSRAWGAAIGCSYRVERCCIVKKGGDTIDLEPCLTHTSTIEPTLAPVTVERTMTTRAAASAYFIYVG

SEQ ID NO: 122802 - protein, 282 aa, Glycine max
  Coding DNA Sequence Number=SeqID_6024
  Gene Ontology: Cellular component=nucleus
  Homolog annotation: Hit_ID=Q8L4K4; Match level="QueryCoverage=87%, HitCoverage=65%, E-value=8e-19, Identity=41%"; Hit description=SET domain-containing protein-like
  Subcellular localization annotation: CTP_CleavageSite=27; ConfidenceScore=5.25e-01
MVATCNSKTLSTPNLSFPPHMASRRLRAFKRWMKSKGFEWSDALEFVDTPEEGVAEACLTTKTSGAREIIEEAGLDGHLGLAFAIMYERSLGGDSPFAGYLQLLPFQECVPIVWTLDEVNELLCGAEDVHFTAMSSNDESDTDVDGCNNDEGIVEEEALAQNSSIDMTALNNGNCNVSDLDSSSLSESDTSMLEMIMTKDVSSGSEVFNTYGILGNAALLHRYGFTEQDNSYDIVNIDMELAILYVAAKTLTILRSHLMENHRLNSSVCYTSCYYQIMPTIS

SEQ ID NO: 122803 - protein, 45 aa, Glycine max
  Coding DNA Sequence Number=SeqID_6025
MEDDLILVAELAGELWDAGVKAEFFLNKSTLSMQTNQGSLGWYLL

SEQ ID NO: 122804 - protein, 551 aa, Glycine max
  Coding DNA Sequence Number=SeqID_6026
  Gene Ontology: Mol. function=RNA-directed DNA polymerase activity; Cellular component=chromatin; Biological process=chromatin assembly or disassembly
  Subcellular localization annotation: CTP_CleavageSite=65; ConfidenceScore=5.49e-01
LLQEEKVLDSRRSFRDKPTPIPPSTTFSSPLPSSATSFSPLLPTPSKPLPSLPTKRLSLEELTLRCEGGLCFNYDEKFYHDHKCAFKAFLLIADDDEAFQEDNPVMEPLPDPPDTHELLQALINLHTLSGHLAPETLRLLGHIAAQQVVILVDGGSTHNFIQEHLVHQLGRSPCTTTPLKVMVDNGHQLDCHLLHEAIPLHVQNVTFTVDLHVLPLCGANLVETLILLFIPLPHHSVDELIRPSTNSFPSLILLVRKHDDSWTFCVDYRALNAITIKDCSSILTIDELLDELGGATWFSKLDLLQGYHQLLMHEDDVCKTAIRTHHDHYEFKVGYLGHMVSTQGVEPIPTKTDASGLGMGIVLSQRGHSIPFPSKPSTPKLLCASTYVHKLFAITTMAILNEPKAYPHYVIAQDLILKGGCIWLPQGSSFTSTLLMEYHSSPIGGHMRHTKYKTIKVVGLLCPLSVPFQPWEDLSLDFIVDLLPFHYLGGRRPFFERNPSGHATHPPYITHRRRPIHGYCWEDSRDALDYHPRILHGKTGTSLNPHITLRT

SEQ ID NO: 122805 - protein, 70 aa, Glycine max
  Coding DNA Sequence Number=SeqID_6027
MTFEKTMLRVITLNFFFKTVHCSRGLHFAFERVTRGADEKEEKRKEERERRDRDRERSRNRRRIKGMEEA

SEQ ID NO: 122806 - protein, 156 aa, Glycine max
  Coding DNA Sequence Number=SeqID_6028
MEVKDKVELVPYRNLDVLVQLYIRVEQQLKRKATSKSYGSHSYPKKDKGQGILGAATSKKKDDKGKNRKGKEEQSLMVKEQCKETISASSPCKGTLVSTAIPLKLEVIPQVKELLHKGLVHKSLNPCALWYDECVERCNPLMYNHPCIQHLHDSHT

SEQ ID NO: 122807 - protein, 316 aa, Glycine max
  Coding DNA Sequence Number=SeqID_6029
MRAPTILRSLPMRQLQPRAPAAVAPLPEKTLFDRELTAELDTLRSQGELGLAQLLDAAITTQKVASDSLANVCYKDYADRGAVDKYLEDNVEMLDECNYFMDKIDHINKYVDSLRVVVHLVDKGGSAKPITRALELLESCQGMEKRCKAMEKHRGCCLKKMLRQKLCHETELSEVMCGSMAMALLCCRFLELGLSFDPKHGLPLMKFSQPMSSSWLRLFQELINQAEKKRVQRRKSWSSLLMQTVAAARELKEQMKSKREKEMKYAVERLKICCRELGHGVEIVEERVKILYKSLIDVRMILLGILSQPTTVFRSD

SEQ ID NO: 122808 - protein, 105 aa, Glycine max
  Coding DNA Sequence Number=SeqID_6030
  Gene Ontology: Mol. function=translation initiation factor activity; Cellular component=nucleus; Biological process=mature ribosome assembly
  Homolog annotation: Hit_ID=Q8GVF5; Match level="QueryCoverage=74%, HitCoverage=32%, E-value=9e-30, Identity=88%"; Hit description =Putative eukaryotic translation initiation factor 6
MRVKGVFCRIDFSLRIIVKLESSQNLPMPIVCLLLEVPKNFYSGFEAELADVIPVVKTSIGGTRIVGRLCVGNKNGLLLPHTTTDQGDSYYSAVYFYSQYCLMLC

SEQ ID NO: 122809 - protein, 101 aa, Glycine max
  Coding DNA Sequence Number=SeqID_6031
MELSSSYDIVLTYGIDLSDMAVAEELQHLRNSLPDCRGRKLEKTLFLRDQRSGGWLRKGKLYGDKSKRAGSLKMTLDQVRALFLGYGSNHMIVLGGTHPNK

SEQ ID NO: 122810 - protein, 99 aa, Glycine max
  Coding DNA Sequence Number=SeqID_6032
  Subcellular localization annotation: CTP_CleavageSite=76; ConfidenceScore=5.17e-01
MGTQRSACTIVLVMAAALGRVSEWVTVFAWVSVLTFRFLGKEMNSMSKMILVFSCVGGSRRGRVALSGGSEWWLVVALSGGSRPMVVVRGGGEWRLSGG

SEQ ID NO: 122811 - protein, 330 aa, Glycine max
  Coding DNA Sequence Number=SeqID_6033
  Gene Ontology: Mol. function=RNA-directed DNA polymerase activity; Cellular component=chromatin; Biological process=chromatin assembly or disassembly
  Pfam annotation: Domain name=rve; Domain location=161-270; Score =15.8; E_value=0.00028; Accession=PF00665.16; Description=Integrase core domain
MEFEFSIEYKQGKENVATDALSRLKDIECKALTAQTIQPNVLDRIQSSRVSDASLATIIPALKENSSSHKHYTWLNDQLRRKGKLVVGKDLQLRQELLHWFHNSTPGGHSGKIATCKRIQVVLYWKGLTLDVKQFMQQCATYQQCKYDHSAYLGLLQPLHVPDHVWQHISMDFIEGIPLSNSKQAIFVVVDRLSKVAHFIPLSHPYTASTVAQTFMDHVFKLHGFPSSITSDRDSIFLNKFWQELMAFQEWWYNTTFHSAIQTTPYEVVYGQPPPIHLPYLPGESKAYRQVSIAARANEKLAPKYFGPYPMISRIGVVAYELKLPDHAKI

SEQ ID NO: 122812 - protein, 121 aa, Glycine max
  Coding DNA Sequence Number=SeqID_6034
  Subcellular localization annotation: CTP_CleavageSite=25; ConfidenceScore=5.02e-01
MFGRQGLGCANRFSQLSLPLGAAVRAVGVSMSHNQAEERRRDRIIVLRCRSPPRPLTFRMLPSDKPNHEEASANRIGAGLLSWHCGIGPLDDPVGNMLFSVRIIVEILLLLAFSRTYKRNE

SEQ ID NO: 122813 - protein, 538 aa, Glycine max
  Coding DNA Sequence Number=SeqID_6035
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=327-524::4-106
MDERLAAKDKEDVSSSWLSRIEFPRFNGDNVKEWLYQCETYFLMDETPPEVKTKFGNACDDPMAELMNLRQKGTISEYHEQFDAIMTRLDLPADYSLSCFLGGLKTEVQMMVRMFQPQSVMKAYNLAKLYESTAMQGTAVTLPSKNKYAVPIKSLLGPKPPAVTEPKSMKTKPRLTKNLSPAFMSERRAKGLCYFCDKPFSVEHGLTHKKLEIHTSWRTMHVTGRYNKKPLHILIDSGSTHNFLDVHVVARIGCKIEDLKPLVVTVADGTKGKRHVLRGSNQSSCKSVKSPTLNKIVNNSVHLSMIQVGMEDVFVTPTQLPLSRGEHDHRIPLLQSAKPVNKKPYRYAKQQKDIIDKIIHEMLDSGIIQTSNNPYASPVVLGLEQETIKDRFPIPLVEDLMDELHGSTIFSKIDLRAGCHQVKMHTTDIYKTTFRTHNGHFEYLVMPFGLTNAPPTFQNLMNTIFQEFLRKFVLVFFYDILIYSQSLDEHLQHLHKVEYLGHVISVEGVSIDPAKIVAVQNWPMPATLKQLRGFWGLA

SEQ ID NO: 122814 - protein, 135 aa, Glycine max
  Coding DNA Sequence Number=SeqID_6036
  Gene Ontology: Mol. function=translation initiation factor activity; Cellular component=nucleus; Biological process=mature ribosome assembly
  Homolog annotation: Hit_ID=Q9M060; Match level="QueryCoverage=89%, HitCoverage=49%, E-value=2e-58, Identity=90%"; Hit description =Eukaryotic translation initiation factor 6 (EIF-6)-like protein
  Pfam annotation: Domain name=eIF-6; Domain location=2-94; Score=17.4; E_value=6.3e-08; Accession=PF01912.9; Description=eIF-6 family
MDKFSLRSLLSCVETEEMIADVLGVEVFRQTVAGNILVGSYCVFSNRGGLVHPHTSIEDLDELSTLLQVPLVAGTVNRGSEVIAAGMTVNDWTAFCGSDTTATELSVIESVFKLREAQPSAIVDEMRKSLIDTYV

SEQ ID NO: 122815 - protein, 126 aa, Glycine max
  Coding DNA Sequence Number=SeqID_6037
MDLCAKDRITGHGEETAMDVDEAMNRETSEVKFMGLGATVDLEEPNSDTKGKIQGSTSSGTHSHPGKIREKGGIAASLDKMTNSFDRMIEKMDGKVDDEDTQEVLLDIALIPDRNRDNNGLKMLNG

SEQ ID NO: 122816 - protein, 127 aa, Glycine max
  Coding DNA Sequence Number=SeqID_6038
MENGHDGKLTEKFSGLNINQHGQQHEHDQSNLSSNNNDNLYQVMKAVEAAEATIKQQVLNCGSGHGCWMWFVGIFDTTGNCRQLWSMQPHLWLCCGCRHPKSYDPKRQRCGPQKPLHCSRNHAQTVF

SEQ ID NO: 122817 - protein, 387 aa, Glycine max
  Coding DNA Sequence Number=SeqID_6039
  Homolog annotation: Hit_ID=Q10E61; Match level="QueryCoverage=33%, HitCoverage=27%, E-value=2e-24, Identity=45%"; Hit description =Expressed protein
MPILDPLWGDLHSHAPGPHSLGCEGFCLNIYRKNFFSLRLNGVWLGTTARPYPDSKLKESQYQLTPWRSDTNHANVATQSQPHSIGAPLATSNKNGLELVPQHMYSQVKPQVSVDAQAGTDWGLLGRNQNGLSGGVATSVDTDDLGRFSPLASRNSSAHDASTHLVVTQGDTRPAHYGDEVTNKQVTFRVPVSNNEVDDPDGDGTHSMRETSANWSSGNPPYTTTVDDPSSSYSPYLPAVLEEPSSSFSEAADEDPLPAIEGLQISGEAFPGRELKAGGYSINGTTSWAKQPIYLVNADDVGTLLAIEVQPLDNRKRKGEPVKVFANDNKKIACDPEMQNHIEKAFNSGHASYRVSLSTGYLDIWEPATLTIKREGYSIKCSGPNGL

SEQ ID NO: 122818 - protein, 165 aa, Glycine max
  Coding DNA Sequence Number=SeqID_6040
  Homolog annotation: Hit_ID=Q9FLU4; Match level="QueryCoverage=86%, HitCoverage=60%, E-value=8e-15, Identity=30%"; Hit description =Arabidopsis thaliana genomic DNA, chromosome 5, TAC clone:K18P6
  Pfam annotation: Domain name=DUF599; Domain location=1-155; Score =137.7; E_value=3.1e-38; Accession=PF04654.3; Description=Protein of unknown function, DUF599
MGSTLMATTSILLSAGLAAVISSTYSVKKPLNDAIYGAHSEFMVALKYVTLLTIFLFSFFCHTLSIRFFNQVSILICTPQDVMSSSIVVTPQYLTELLEKGTILSTVGNRLFYSALPLLLWIFGPVLVFLSSVAMLPILYNLDFVCGNNNGKGKIVKNDKGEDYV

SEQ ID NO: 122819 - protein, 116 aa, Glycine max
  Coding DNA Sequence Number=SeqID_6041
MANRMENFGIRMSCTEALSQKSPTPAKRAHLSLSARPPQDCTEKELSLKRKPSYRALNEILRVCEVSRGGGGIPTTCSYLSSSLFIVVKETSLLWRAKSSVGSSYGVLDVNIFISI

SEQ ID NO: 122820 - protein, 162 aa, Glycine max
  Coding DNA Sequence Number=SeqID_6042
MEAMKDQMTTMMEAMMSMRKVREVNMAAVAATSAATEVDPTHPAGLNQSKHSFPPYGLPPNYTPPNAIHASDENVDNSTPIPIKSQQPQSGHAQFKVPNFDKYKGTTCPKNHLKMYCRKMRAYASECRMLTYSHIYSIMQWLAGIQGGESLVNSDVVKQYYA

SEQ ID NO: 122821 - protein, 656 aa, Glycine max
  Coding DNA Sequence Number=SeqID_6043
  Gene Ontology: Mol. function=nucleotide binding; Cellular component =nucleolus; Biological process=regulation of transcription, DNA -dependent
  Homolog annotation: Hit_ID=Q1S808; Match level="QueryCoverage=99%, HitCoverage=100%, E-value=0.0, Identity=58%"; Hit description=Plus-3
  Pfam annotation: Domain name=Plus-3; Domain location=272-381; Score =160.1; E_value=5.9e-45; Accession=PF03126.8; Description=Plus-3 domain
MADLENLLLEAAGRTGTAGRNRHSLPPSRRRHDGAYSDGGSDSRDDDSDDELNYASRKPSGSQVPLKKRLDPTERDDDLGSQEEADDDGRSDHDGDSSDESNIGDDLYKDEDDRRKLSEMTELQREMILSDRATKKDDKNLLGKIASKREKGKAAAPRKQSPPMSSSRMRASARSADRSAKNDALNELRAKRLKQQDPEAHRRLREASRNAGPRHFSPPKRKTFTSTSLSSSSHSESESRSHSDDEGSTGDGGIADSDDDRALAGSEGPSFQDIKEITIRRSKLAKWFMEPFFEELIVGCFVRVGIGRSKTGPIYRLCMVKNVDASEPDRQYKLENKTTYKYLNVVWGNESSAARWQMAMVSDSAPMEEEFKQWVKEVDCSGGRMPSKQDVLEKKQAIQKAITFVYSAATVKQMLQEKKSASTRPLNVAAEKDRLRRELEIAQSKHDEAEVERIKTRLQELEASRQAKQKDAKALKLAEMNRKNRFENFKNASELKPVNIGLKAGEAGYDPFSRRWTRSRNYYAAKPGEKAAAGNNIVNGNVAGAGSNATGAPVTAEAGMVATAAALEAAAGAGKLVDTSAPVDQGTESNMLHNFELPISLALLQKYGGAPGAQAGFMARKQRIESTVGFRVSENDGRRHALTLTVSDYKRRRGLL

SEQ ID NO: 122822 - protein, 56 aa, Glycine max
  Coding DNA Sequence Number=SeqID_6044
MTCGREYARVWKVYYSRLAKNADSLSGLCTLGWRFLDADSKPPGVELWAVLDVPVH

SEQ ID NO: 122823 - protein, 230 aa, Glycine max
  Coding DNA Sequence Number=SeqID_6045
MLLFNAAGVELTKKVLIREVFMLENQIPFHVLEQISGEKIIQSESKVLPNHTVHWLDLMYHLIVPRSQPQPQPQPEPEPQAPDPGVEEFFLTYFGFGQWEILALPLLPAQPQPRLESEYDPIFCRWEYCLPLEDSRVNNPLVRSLTQTVANLMEITERRQTSTDSNEGAPRDEKLPSAKQLRNAGIFFKPAERGISSIDFDDKNCVFTCLVSDLMSTQKSSSETSLHTRR

SEQ ID NO: 122824 - protein, 407 aa, Glycine max
  Coding DNA Sequence Number=SeqID_6046
  Pfam annotation: Domain name=DUF247; Domain location=13-339; Score= -145.4; E_value=0.0012; Accession=PF03140.6; Description=Plant protein of unknown function
MPVVIEIKEGEPEECGRACVCRVPKSLCSAKPEAFTPQFVGLGPYHSFDDKLTMTLELKLAAAKRVFKHAFEIPISKSIYEHLYHADAFQKPESSYALAQDGLFLLALLHWSADAEPQQHYSFLTGRQGLPLVNSFGLELTIDAVISDVYMLENQIPTPVLHQVNQASFCKGKSESDEIQPQEDLGAKMQSLCEKHCPLVHLQQLSKKPQEYDHLLDLMYHFIVPDEKPKIDSGNSQLTISQSNQDTHCLNLIHSPLRMKKKVTTAEETHAVPDAIPCAWDSFPHIPALFMRALRSIYDLLKYVSRLIQPTVDSLYGSLSTRQSQNQLLKSVTLLVGGVKRASEEILRDKNLDKDVRSVATIPSVTELHKAGIGFQPAKLGGISGIEYDEGTCMFSLPSIKLNVNSE

SEQ ID NO: 122825 - protein, 123 aa, Glycine max
  Coding DNA Sequence Number=SeqID_6047
MWQAFLLKQIPCHIKVGTIEKHYKSQQEQAINSEDIGEGMEIINGIDIKWKKDHVVGEEVFEDPFGCSQLVLLCHDETKMEVMVWTEAHKLRDESFFLLQLNDLGTLQMQTAWESSVEFQTKR

SEQ ID NO: 122826 - protein, 336 aa, Glycine max
  Coding DNA Sequence Number=SeqID_6048
  Gene Ontology: Mol. function=zinc ion binding; Biological process =regulation of transcription
  Homolog annotation: Hit_ID=Q0GLC6; Match level="QueryCoverage=85%, HitCoverage=96%, E-value=3e-53, Identity=45%"; Hit description=Dof25
  Pfam annotation: Domain name=zf-Dof; Domain location=46-108; Score =124.1; E_value=3.8e-34; Accession=PF02701.6; Description=Dof domain, zinc finger
MGLSSKQVSSSGLDWKQTLLEAQNLELPKPNLMRKQQQQQQQQTQPNSESLKCPRCDSTNTKFCYYNNYNKSQPRHFCRACKRHWTKGGTLRNVPVGGGRKNKRVRKSITTPITTSSTTTSITTTTSTCTATVTTSIGNNNNNMDAMLGCNSHMTIQTPLADDHKNMSSSLYQALIRPPPLLLQQQNLMNNTRDLEGKDFGIGIGNGNNGIFPSLTLPFPIHHQSQSLLFPFSTSSSSFDTNPCSVVSTSLRSSNVYNYGEDQFKAIEEPTINSTITTTTIVPSTNNTHHPWEIAAATSGVGLGTSSNSNYWNWEDFDSLVSTDLKDPWDGSDIKP

SEQ ID NO: 122827 - protein, 90 aa, Glycine max
  Coding DNA Sequence Number=SeqID_6049
MTVVPPLRLHYQPTPPIACRWCVGGLIGDGGLGCGWLVVGGGLVGTLDVGSGPGALVGGGAGGGAGALVLVLVQGWHPRFWDRKDKGDGH

SEQ ID NO: 122828 - protein, 58 aa, Glycine max
  Coding DNA Sequence Number=SeqID_6050
MHIINNPDQQPGYPTSVMVPRMLLMMGMAKWISLAEMLGAQRRGCGHYMDVKGEDDGG

SEQ ID NO: 122829 - protein, 203 aa, Glycine max
  Coding DNA Sequence Number=SeqID_6051
  Gene Ontology: Mol. function=carrier activity; Cellular component =integral to membrane; Biological process=protein insertion into membrane
  Homolog annotation: Hit_ID=Q42191; Match level="QueryCoverage=94%, HitCoverage=39%, E-value=1e-41, Identity=49%"; Hit description=Inner membrane protein OXA1, mitochondrial precursor
MAEKVPSFKHGGASWFIDLSTPDALYVFPVLTALSFLITVECNMQEGMEGNPVAGTMKNVSRGLAVLTVPFTMGFPKAIFCYWVTSNLFSLVYGLVSQAECVELFGRFSQGCHKYVLKVPGVKKTLGIPEIPVAPPTTTSATQSPFSIFPALKQATSATRNGSSSIPDEASKHSNKKISSASVISQRLRSLEKQVKGRKKNKK

SEQ ID NO: 122830 - protein, 43 aa, Glycine max
  Coding DNA Sequence Number=SeqID_6052
MDGRTGIIAQWDVYFHCNVKFGGRCSRILMMLECAGDVLHNQH

SEQ ID NO: 122831 - protein, 157 aa, Glycine max
  Coding DNA Sequence Number=SeqID_6053
  Gene Ontology: Mol. function=nucleic acid binding; Biological process= transport
  Homolog annotation: Hit_ID=Q8H6Q8; Match level="QueryCoverage=85%, HitCoverage=4%, E-value=5e-27, Identity=43%"; Hit description=CTV.20
CVQEAIKPLIDIGIDAAVLMCLRDIRHNKFEDSLIGTVETSLGHGPVYFNCYPNKIVSLMDRNILDSLFLNIHFHGLDMKEGSIPAALIYRIQYKVMNTCASRFLLKPQRGETTLFIIDMTKANVSLPRTIKWDEVTLPENGSWTRPCRQFPDPLQP

SEQ ID NO: 122832 - protein, 36 aa, Glycine max
  Coding DNA Sequence Number=SeqID_6054
  Homolog annotation: Hit_ID=UPI0000196E3D; Match level="QueryCoverage =97%, HitCoverage=5%, E-value=2e-08, Identity=66%"; Hit description =alpha-galactosidase/ hydrolase, hydrolyzing O-glycosyl compounds
MAKDVNRLVNMYRVTRDDWDLWEDVKAYFDVTRDYS

SEQ ID NO: 122833 - protein, 128 aa, Glycine max
  Coding DNA Sequence Number=SeqID_6055
MMRSGTRHSSPMSAKGAPHSVWLGYATKCLPLSGISGVWLEVSQSKVSGYLMCLPHGLSDMCVPRLRLLALRGYGSGVVDVLLGHMHNTGWCLVGRQAIRWERMLALDLHKMGADRTSQCFPSLTYHI

SEQ ID NO: 122834 - protein, 114 aa, Glycine max
  Coding DNA Sequence Number=SeqID_6056
MESNEAIAAAASMAIEADLILPTAAHHPVPNIVGRGRSTPGHVSNPHLGCNQGSYPYGLPPNYTPPAMHEDVGHITPLIRYITLEASRIHTWKDLITAFLRQYQYNSDMAPDRT

SEQ ID NO: 122835 - protein, 154 aa, Glycine max
  Coding DNA Sequence Number=SeqID_6057
  Gene Ontology: Mol. function=ribonuclease H activity; Cellular component=mitochondrion; Biological process=DNA integration
  Homolog annotation: Hit_ID=Q1SAS4; Match level="QueryCoverage=99%, HitCoverage=6%, E-value=2e-61, Identity=72%"; Hit description=RNase H, putative
MFVSYKDWHEMLPFALHGYWTSLRTSTGATPFSLVYGMEVVLPFEVEIPSLRILAESGLEEVEWAQTHFDQLNLIEGKRLAAMSHGQLYESRVKNAFDKRVHPSKFSKGDLVLKKVSQAQKDHRGKWAPNYEGPYVVKKAFSGGVLLLMNMDDE

SEQ ID NO: 122836 - protein, 290 aa, Glycine max
  Coding DNA Sequence Number=SeqID_6058
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-34, Identity=30%"; Hit description= UPI00006A17C9 related cluster
MDIFTFRGLHALTFRGLHVLAFRGLHVLTIKGQHVLVIRGLHALVLRELHAHAFKGIHFLTFRGLHVLAFRGLHALPSRGGLHVLPCRGLHVLPCRGLHILDFRGLHVLAFRGMDVLTLRGLHALTFRRLYVLPFRGLHALAFRGLHALISRGLHVLTFRGLHALNFRGLHVLAIRGLHALTIRGLHVLDIRGLHVLAFRGLHNLAFRGLQVLTFRGLHRTTRPRHQRIGRPDLKRATRPHIKRTGRPNLLRATRPHLQRTIRPPFQRATSPHLQRATRPRHQRAACPHH

SEQ ID NO: 122837 - protein, 106 aa, Glycine max
  Coding DNA Sequence Number=SeqID_6059
MVIDYQRLPSTPSSLFKPGNRLHPLELACLGTSQVLTDRLCPGWVGIGQAWFWAIAPHLTSPRSLDPRDISPGTTLWSTNKSRKFHPSTLPHLKLVGLWGTHHMWY

SEQ ID NO: 122838 - protein, 94 aa, Glycine max
  Coding DNA Sequence Number=SeqID_6060
  Homolog annotation: Hit_ID=Q9FIZ2; Match level="QueryCoverage=76%, HitCoverage=67%, E-value=1e-19, Identity=57%"; Hit description =Arabidopsis thaliana genomic DNA, chromosome 5, TAC clone:K23L20
  Pfam annotation: Domain name=Mit_rib_S27; Domain location=12-82; Score=56.7; E_value=7.9e-14; Accession=PF08293.2; Description =Mitochondrial ribosomal subunit S27
MMTRVSLKNVLSAVINQGAAEARAWIFGHQLNPAGNKTPHKILRMKLFGEKVAQWYPHDIKKDDPLVMARQEQEYCSFLFTSLFARYLFVFMPL

SEQ ID NO: 122839 - protein, 77 aa, Glycine max
  Coding DNA Sequence Number=SeqID_6061
MYKNKTTLISGRRRSVHDVIVRKEWERASLKRMHLFNKCPSFYLLEYVWFPVTQANMQEVIGLVPCNRSAIGMLAIR

SEQ ID NO: 122840 - protein, 118 aa, Glycine max
  Coding DNA Sequence Number=SeqID_6062
  Homolog annotation: Hit_ID=Q2HV31; Match level="QueryCoverage=45%, HitCoverage=9%, E-value=1e-16, Identity=81%"; Hit description =Prefoldin
MAQVQPINKRRNEVDRKVEANLKAIEEIKAATDIALRNEEMADSAKVAVEGELRLVEEQCNPPLRGWIKGNSGGATKGYLSPMASGGIFRDIWGKALGSLCFNIGIEIALISRSYFGH

SEQ ID NO: 122841 - protein, 95 aa, Glycine max
  Coding DNA Sequence Number=SeqID_6063
MKERPLSDAKRNRREAHDSDLVGCPLCGKLEWLKNLSISEEMLRRFNSSMGVCHLVGNSFVAQADHQGGGELRCTTGWPQQILHGFLSEVSSGHA

SEQ ID NO: 122842 - protein, 51 aa, Glycine max
  Coding DNA Sequence Number=SeqID_6064
MEVGEWVTMTVWKMATCSKMRPRMGSLAAMGGGGQGLDLSKPNFKTKSHTF

SEQ ID NO: 122843 - protein, 158 aa, Glycine max
  Coding DNA Sequence Number=SeqID_6065
MVRLRGDFDLVIIGVIGGSGIFIRVWRIFTSDFVVIIETSGAHHHLDLLLAFLFIDLLIDLILFLGHTGSIGENPIELAETRDQGRKSQCSIGLLWIHWVSWRSDTCKLINGIRDKLGHMNTDLGQDSVDQLAFWQREIRIMIAGKDVAEEKRHPDSC

SEQ ID NO: 122844 - protein, 371 aa, Glycine max
  Coding DNA Sequence Number=SeqID_6066
MTKHRVLKEHNKTFLNWFKDKIFGNDSASETLRKLANGPKRNVRTCQVYNINKYLFYTKSQDDKNTMKNSGVSLKAESRYFATVNDNNPYMAFMPYFRVIEEIWELNYWVDVNVGMRIDDFRFTLVDLKKLAYQNEPFIMAEQTKQVFYVQDPCDERQMVTPSSSTPLESTPSLSTSKRTRKATRLKSLSAKPVGVERLLFHMDHTTKKSNEGKENNDDKVYEKYKFSKEKWNQFCQSCRDSSWEDFREEKSAQGNFVAHGRQDDPETDASNRHGLYVDDNPPRLVSHGRVYEWLTTVHHVPLGNDLVKDKHVPKGPMKPVDRLEPDNDPIYQMTLMIPQRFLKPMHMNKLSLGLANASMYLCMDSLSHSP

SEQ ID NO: 122845 - protein, 176 aa, Glycine max
  Coding DNA Sequence Number=SeqID_6067
RGTLGATFTPKPLPIANLELVCFLLHVGTDLSASSLLLLAFHQNPTWLVRLSATMLLLVSPLNKAKCSCYAKPLAKRDLCAKPECHFGEADLSTPCSAKLKSSSVSKIAMSNFIRCAKRELDALSAQKERLLLHLPKLDMTDLGSPLKKLGREELMRRHWDEELTDFVEGNIVVAI

SEQ ID NO: 122846 - protein, 114 aa, Glycine max
  Coding DNA Sequence Number=SeqID_6068
MGGVYHPQPQSLHFALERLPPAIVEREKFDHIEERLRAIEGGRDYAFTDMAELCLVPDVVIPSKFKVSDFNKYKGTTFPKNHLKMYYKKMGACAKVEKLLMHFFQESLIGEAVT

SEQ ID NO: 122847 - protein, 262 aa, Glycine max
  Coding DNA Sequence Number=SeqID_6069
  Homolog annotation: Hit_ID=Q5CEG7; Match level="QueryCoverage=39%, HitCoverage=99%, E-value=7e-43, Identity=82%"; Hit description =Senescence-associated protein
EGRIKATRAESQWIVAARPLCHLQYPVAYLSRLQRILPAARWELRFKASRRANPPHEVIIQRTVASRHWLFNQARGPIVRINGSSRTRLNYYCDTVIRRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLD

SEQ ID NO: 122848 - protein, 247 aa, Glycine max
  Coding DNA Sequence Number=SeqID_6070
  Gene Ontology: Mol. function=thiamin-phosphate diphosphorylase activity; Biological process=thiamin biosynthetic process
  Homolog annotation: Hit_ID=UPI00005F72DF; Match level="QueryCoverage =99%, HitCoverage=69%, E-value=1e-108, Identity=75%"; Hit description= COG3520: Uncharacterized protein conserved in bacteria
  Subcellular localization annotation: CTP_CleavageSite=46; ConfidenceScore=5.21e-01
RALQARSVSAAAPHRRPGRPALPTGARAAAAPRDAASGPGAVAVVRALHAGAGGAARQQPAARRLDLQLRSVRPQRAAAAAPDRIRARTGVPPPGHHPAGVHQPVPSPADAAVLPRLGRRAADGVAGSPGQPALRRIPVEPDRHRPAGAAGTRQHQRPRQTFYGRSSDSPQPRSGRPEQDFAAVFQGAGAHRRKRAALAAGGTARASSPQGWARRAAARRVGLSRHRGARYSAQIPHRAGADAAARL

SEQ ID NO: 122849 - protein, 493 aa, Glycine max
  Coding DNA Sequence Number=SeqID_6071
  Pfam annotation: Domain name=Transposase_23; Domain location=345-414; Score=8.9; E_value=0.00012; Accession=PF03017.5; Description =TNP1ENSPM transposase
MKRTRKVTRLRSLATKQHGARRLVVNVDLNTGKADGPHKKKLRTYLEIVVRDKVDVTYETWKEVPAAQKDLIWEDIHRNLKSLKLLIIGQRRKFFRLSMRAEQDDVDDIACEKYDISKDKWAQFCETRRDPSWEDVRKKEQAIQKQNIVPPPHALSRGGYEYLEQKLMAEKTKKKLEEAARSGSNDGVIDPPSPIKCHVKWKMARMKKIGQMTSEITKEITEKIDVLTAAIRRPEHPSRVRATGASVTIKKYFGSVPRTSCSSSSLHPEDLQQLTQQIRDQLEESITENVTRQLMASFSQMQSQFQSHMQSQGLALPPEPEVGPSGPRVSTKESCVDPSGNDLETGDSDKCGLYIKANLPRLVALGRLYEGSTVHNIPLLPGQVKVGVEEVKDEQAPVPIPTNEVTLMGQALNTFLAWPTRLVKALSEWVNWDATVFGVFNPDFPLYIKHKDLFEIAHGGQCLNISIIQLWILDLTETSMRAGNSDVYGFLEP

SEQ ID NO: 122850 - protein, 102 aa, Glycine max
  Coding DNA Sequence Number=SeqID_6072
MVNAVSRTFPLDLMMKSMHFEVKNRLSFELQKVVVGLSAIPPLSAALTCLAQRRIWQSISIKAAREISALSAAGYTPLETWHKILGGTGAQHSTMPILGKEP

SEQ ID NO: 122851 - protein, 35 aa, Glycine max
  Coding DNA Sequence Number=SeqID_6073
  Homolog annotation: Hit_ID=Q9SXZ7; Match level="QueryCoverage=88%, HitCoverage=6%, E-value=2e-07, Identity=83%"; Hit description=NADPH oxidoreductase homolog
MLSCYYTSAGGVVMFSRALRLYKREGIRVNVLCPE

SEQ ID NO: 122852 - protein, 86 aa, Glycine max
  Coding DNA Sequence Number=SeqID_6074
  Subcellular localization annotation: CTP_CleavageSite=57; ConfidenceScore=5.30e-01
MIHWLRSDGGIGFTFATALVAAIVTASASIIFFMLIMASIIVVICSFMASMSAFICSCTSSTSPITLALARVRNGFMIPTWLAHGT

SEQ ID NO: 122853 - protein, 122 aa, Glycine max
  Coding DNA Sequence Number=SeqID_6075
  Gene Ontology: Mol. function=chitin binding; Cellular component =extracellular region; Biological process=chitin metabolic process
  Homolog annotation: Hit_ID=UPI0000612705; Match level="QueryCoverage =70%, HitCoverage=42%, E-value=4e-07, Identity=26%"; Hit description =UPI0000612705 related cluster
MYLQRTTRPRLERVIGLHVLSSRGLHVLAFIGQHVLAIRGLHVLTFRGLHALTFRGLHVLTFRGPHVLTFRGIHTLIFRGLYILPLRGVHVLAFGGLHIYTLRDFKVEGYASSLSEGSTSTP

SEQ ID NO: 122854 - protein, 47 aa, Glycine max
  Coding DNA Sequence Number=SeqID_6076
MQADICTESLPMQPTSARKVYRSRFEKEVSPDDADPTFPNRHHPNII

SEQ ID NO: 122855 - protein, 206 aa, Glycine max
  Coding DNA Sequence Number=SeqID_6077
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=9e-22, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLFHKGGPLGTSTFSFRGQRVLTFRGLHVLAIRGLQVLAIRGLHAFRGLHVLTFRGLHVLAFRELHVLTFRGLHTLTFRGLHVLTVGGLHALTFSGLHALAFRGLRVLAFRGLHVLAFRGLHILTFRGLHTLIFRGLYVLPLRGLHVLAFGGLHALTIRGLHVPLFRGLHALAFRGRHVRAFGGLRTPSPLEGYASLLSEGSTSTP

SEQ ID NO: 122856 - protein, 88 aa, Glycine max
  Coding DNA Sequence Number=SeqID_6078
MASTNFLFPEGNSMITAIIESKNLSTMSLATLFEKLQEHEMELQRLNQNEESDKRKRGIALKVSSSIQEGSDNEDLDDEEDNSQEIKD

SEQ ID NO: 122857 - protein, 100 aa, Glycine max
  Coding DNA Sequence Number=SeqID_6079
MVPRMSSGPPPLDDKGEKMRDQMVPRMSSGPPPLDDKGEKVWDQMIPRMSSGSPPLHDKRRRMTIICLYVPSDTTVSEWQKGERNDHNLSHHVIGPAASG

SEQ ID NO: 122858 - protein, 464 aa, Glycine max
  Coding DNA Sequence Number=SeqID_6080
  Gene Ontology: Mol. function=protein serine/threonine kinase activity; Cellular component=membrane; Biological process=protein amino acid phosphorylation
  Homolog annotation: Hit_ID=Q70I29; Match level="QueryCoverage=95%, HitCoverage=61%, E-value=1e-134, Identity=48%"; Hit description=S -receptor kinase-like protein 2
  Pfam annotation: Domain name=PAN_1; Domain location=61-143; Score =3.6; E_value=0.069; Accession=PF00024.16; Description=PAN domain
  Pfam annotation: Domain name=PAN_2; Domain location=61-129; Score =125.1; E_value=2e-34; Accession=PF08276.2; Description=PAN-like domain
  Pfam annotation: Domain name=PAN_3; Domain location=69-143; Score =0.8; E_value=0.033; Accession=PF08277.2; Description=PAN-like domain
  Pfam annotation: Domain name=Pkinase; Domain location=179-376; Score =55.6; E_value=1.6e-13; Accession=PF00069.15; Description=Protein kinase domain
  Pfam annotation: Domain name=Pkinase_Tyr; Domain location=179-400; Score=12.0; E_value=3.3e-13; Accession=PF07714.7; Description =Protein tyrosine kinase
  Pfam module annotation: Pfam domain module=PAN_1::PAN_2::PAN _3::Pkinase::Pkinase_Tyr; Domain location=61-143::61-129::69-143::179- 376::179-400
MHRSYPKEFCDNYGLCGAYGNCIINQAQGCQCLKGFSPKSPQAWASSDWSQGCVRNKPLSCNGEHKDGFVKFEGLKVPDTTQTWLDKTIGLEECRVKCLNNCSCMAYSNSDIRGAGSGCVMWYGDLIDIRQFETGGQGLHIRMSASESEIGGTMLDKSEKDIDLPTFDFSFISNATNDFSQSEKLGQGGFGSVYKGILPDGQEIAVKRLSKTSGQDSTRHTLLGWTKRFEIIGGIARGLLYLHQDSRLKIIHRDLKTSNVLLDSNMNPKISDFGMARTFGLDQDEANTNRVMGTYGYMPPEYVVHGSFSVKSDVFSFGVIVLEIISGKKNRAFYDPHHHLNLLGHAWRLWIEKRPTELMDDLVDNSACPSEIIRYIHIGLLCVQQRPEDRPNMSSVTLFLNGEKLLPEPNQPGFYTGKAHPTKPNSSSRNIDVYSFNEMSNSLLEPRFKHACCVDVSNADSKTD

SEQ ID NO: 122859 - protein, 134 aa, Glycine max
  Coding DNA Sequence Number=SeqID_6081
  Gene Ontology: Mol. function=transferase activity
  Homolog annotation: Hit_ID=Q1RWV8; Match level="QueryCoverage=85%, HitCoverage=17%, E-value=1e-21, Identity=44%"; Hit description=IMP dehydrogenase/GMP reductase
  Pfam annotation: Domain name=Ank; Domain location=50-84; Score=15.9; E_value=0.14; Accession=PF00023.20; Description=Ankyrin repeat
  Pfam annotation: Domain name=Ank; Domain location=85-118; Score=14.8; E_value=0.22; Accession=PF00023.20; Description=Ankyrin repeat
  Pfam module annotation: Pfam domain module=Ank::Ank; Domain location =50-84::85-118
MGDTEDDRVSEDMENTSKRLFKLCMKGEWGKVVETYSKDKKVHTAKITRTGDTALHIAVIDGQYDVVRQLVRLIPEEALRIQNERKNTALHLAASMGSVGMCECIASSEPSLLNMRNLDGETPLFLAALHGRKH

SEQ ID NO: 122860 - protein, 393 aa, Glycine max
  Coding DNA Sequence Number=SeqID_6082
  Gene Ontology: Mol. function=oxidoreductase activity; Cellular component=membrane; Biological process=metabolic process
  Homolog annotation: Hit_ID=Q6D0N1; Match level="QueryCoverage=52%, HitCoverage=90%, E-value=1e-68, Identity=61%"; Hit description =Probable short-chain dehydrogenase
  Pfam annotation: Domain name=Epimerase; Domain location=46-257; Score= -31.5; E_value=0.00041; Accession=PF01370.11; Description=NAD dependent epimerasedehydratase family
  Pfam annotation: Domain name=KR; Domain location=48-208; Score=-79.3; E_value=0.0093; Accession=PF08659.1; Description=KR domain
  Pfam annotation: Domain name=adh_short; Domain location=48-191; Score= 13.2; E_value=7.4e-07; Accession=PF00106.15; Description=short chain dehydrogenase
  Pfam module annotation: Pfam domain module=Epimerase::KR::adh_short; Domain location=46-257::48-208::48-191
RNLDEGDGYCMTNNSQQKLNREFSYPSIKQSADGALHIAYTYFRQAINSGIGAAIADELLTQGWQVTGFSRTPVEKDHPAFTSVSVDLFDAGQLKRALAGLAKVDALVHAAGMMLAAPLGELEEEQGARLWYLHVQVAQIMANTLLPQMGHGDRILLLGSRTSRGAANRSQYVSTKAAMVGMARSWAAELAPQGITVNVIAPGATATPMLLQPDRASSPPKLPPIGRYIHPEEVAALAGFVLSPAAAAITGQELRASPIVKNRMGEADYVSSAKTPGLSCYAFFGFTKMRSAAEKRAMNHDVLQEINAEPLFPVQSDQHIVFGVDGKFKAHALITILSIMKHAGDRIAPRRDAASSAGPAVCHAAGHRTFYPCDLLSLSGTADFAAGGKTALS

SEQ ID NO: 122861 - protein, 83 aa, Glycine max
  Coding DNA Sequence Number=SeqID_6083
MPPMAACTSLTILRAKPRWCSMSAAVRGSIKIARRKGRIAWCGLRWINRARFNRGARDRAADNPYLATGYVIHYATPFTSSTR

SEQ ID NO: 122862 - protein, 91 aa, Glycine max
  Coding DNA Sequence Number=SeqID_6084
MVDDIFTPSRYKEIIMVQPKPSAGLKGKPHQHALTFMPSCIQKSKAWVPRPKSCFGTYPNFCKLSTHPKMAITHAQTQSISNIHKLMRKHH

SEQ ID NO: 122863 - protein, 32 aa, Glycine max
  Coding DNA Sequence Number=SeqID_6085
MACEGRYLMGRFWCYYSHKYDYARLPVEPTTK

SEQ ID NO: 122864 - protein, 76 aa, Glycine max
  Coding DNA Sequence Number=SeqID_6086
MKSGDMRGYRMVIRTFRQPGANEPIDAQRLTSSSAPFVILTHEVRDNESGGRRRYVMVIRTFHQSRRMSLTVSGRC

SEQ ID NO: 122865 - protein, 254 aa, Glycine max
  Coding DNA Sequence Number=SeqID_6087
MAHMKKNGQMTSEAAKEIVDKSPHREALSPMNIRMYWQLPFVDQRPMGGDTETGDSNKCDLYVNDTPPRLVALGRVYEGSTTVHNVPLGNDQVMDKHVVEGLTKPIDMLDPDIDPLYLMTLTILQLFLKPLQVPWDASVFEVYNDNFPFYIKHEDLSEIAHDVLQCRAHWQIVVILPKDNVVIWFCSLHNMFDNYLKEIINCALKGFNDSQGSKSKATATWIVVKQKGSIECGYYMMHWMSTIVLGGFKDNWEM

SEQ ID NO: 122866 - protein, 73 aa, Glycine max
  Coding DNA Sequence Number=SeqID_6088
  Homolog annotation: Hit_ID=Q8H534; Match level="QueryCoverage=61%, HitCoverage=36%, E-value=2e-08, Identity=46%"; Hit description =Putative adenine phosphoribosyl transferase
ARAEEIKRLLVLVEEESIRAETESEVSCEVISQKYALEYGTACLELHVGSVQPERVGAEVVECACVIGVPDVK

SEQ ID NO: 122867 - protein, 316 aa, Glycine max
  Coding DNA Sequence Number=SeqID_6089
  Gene Ontology: Mol. function=structural molecule activity; Cellular component=intermediate filament
  Homolog annotation: Hit_ID=Q95YM2; Match level="QueryCoverage=92%, HitCoverage=6%, E-value=2e-15, Identity=27%"; Hit description=I -connectin
  Pfam annotation: Domain name=NUMOD3; Domain location=151-164; Score =7.0; E_value=14; Accession=PF07460.2; Description=NUMOD3 motif
  Pfam annotation: Domain name=NUMOD3; Domain location=206-219; Score =6.2; E_value=19; Accession=PF07460.2; Description=NUMOD3 motif
  Pfam annotation: Domain name=NUMOD3; Domain location=260-273; Score =6.2; E_value=19; Accession=PF07460.2; Description=NUMOD3 motif
  Pfam annotation: Domain name=NUMOD3; Domain location=96-109; Score =4.7; E_value=35; Accession=PF07460.2; Description=NUMOD3 motif
  Pfam module annotation: Pfam domain module=NUMOD3::NUMOD3::NUMOD3::NUM OD3; Domain location=151-164::206-219::260-273::96-109
MKDGELIQSELPPATQYQLPNVKDSNNKPVMAIPFKTKDFNEEVTSKDIKSLMEQANYTNKYLQVLGETIKTKVVPKQKSTEEVSPSIPIEKPSFKPFKVSDKAKRKIRELRKTKSLVEGVGETIKTKVVPKQKSVEEASPSIPIEKPLFKPFKVSEKAKQKIRDLRKTKSLVEGVGETIKTKVVPKQKSVEEASPSIAIEKPLFKPFKVSEKAKRKIRDLRKTKSLVEGVETIKTKVVSKQKSVEEASPSIPIEKPLFKPFKVSEKAKRKIRDLRKTKSLVEGVGDNHSELLNKIGSLLKVIPETPQTSENTSKM

SEQ ID NO: 122868 - protein, 126 aa, Glycine max
  Coding DNA Sequence Number=SeqID_6090
  Gene Ontology: Mol. function=DNA binding; Biological process=DNA integration
  Homolog annotation: Hit_ID=Q1S3H4; Match level="QueryCoverage=92%, HitCoverage=24%, E-value=5e-31, Identity=47%"; Hit description =Integrase, catalytic region
MSPYRVVFGKACHLPVEIEHKVYWAVKTCNFSMDQAGEERKLQLSELDEIRLEAYENAKFYKEKTKKFHDSMIIKKDFTVGQKMLFYNSRLGLMSVEIKSESTDKSFKVNGHHLKPFLSNPSLVDA

SEQ ID NO: 122869 - protein, 100 aa, Glycine max
  Coding DNA Sequence Number=SeqID_6091
MTGSEKLLPDMKMRGERGEAHGCVFQTKEETYPFRANEARLTSASSKGGKCAESPPTFICGKRRKNRRKLVMKNIPDSGVVFMFEEGISTSHVCPKGQQP

SEQ ID NO: 122870 - protein, 130 aa, Glycine max
  Coding DNA Sequence Number=SeqID_6092
SLQLVAPPGSIPSVKQFLERVAWPGAQPSLYREDEGPTAQVPQHVEDASSEATIPEPYMVEEEADPPTPVVDLSSPQHAVDPSTSILNIPEDPTTPVLTLNTSPSATPVLHLTDEEGGQTQDTQDQSHEF

SEQ ID NO: 122871 - protein, 128 aa, Glycine max
  Coding DNA Sequence Number=SeqID_6093
MQRRSTVGDLIPIDLEINATCRRHNSERIKKFLQDLEAAATPEEEPRSSKASSSFPVAGHCHIEPVEDPIMAEEPRRVTLEDYSSSIVPQFFTSIAQCHTLISSGDYYLMTCNLWLATLRYLASFVAQ

SEQ ID NO: 122872 - protein, 248 aa, Glycine max
  Coding DNA Sequence Number=SeqID_6094
  Gene Ontology: Mol. function=protein binding; Biological process =apoptosis
  Homolog annotation: Hit_ID=Q1S0J6; Match level="QueryCoverage=99%, HitCoverage=77%, E-value=3e-68, Identity=55%"; Hit description =Ubiquitin; Apoptosis regulator Bcl-2 protein, BAG
  Pfam annotation: Domain name=BAG; Domain location=67-145; Score=38.8; E_value=1.8e-08; Accession=PF02179.6; Description=BAG domain
MLSGPTGLHHEDQKLFYKDKERDSKAFLDMVGVKDKSKIVLVEDPISQEKRLLERRKNAKMEKAAKSISAISLEVDRLAGRVSAFESIISKGGRVVETDLLNLIELLMNQLLKLDGIVADGDVKLQRKMQVKRIQKYVETLDVLKVKNSMSSSNGDHATVQLQQKHSNGQQQKHSNGHHRSALAPIQEQQQEQEQPPRNSTSGVVVTTNWELFDSVPPLIPVPSTSPSPHPSETNKSGPPKFNWEFFN

SEQ ID NO: 122873 - protein, 112 aa, Glycine max
  Coding DNA Sequence Number=SeqID_6095
  Gene Ontology: Mol. function=DNA binding; Biological process=DNA integration
  Homolog annotation: Hit_ID=Q1RSZ9; Match level="QueryCoverage=92%, HitCoverage=15%, E-value=1e-08, Identity=62%"; Hit description =Polynucleotidyl transferase, Ribonuclease H fold
MSHSNSIFHTALVVSNIKNHVSIILEMENVQYMTWAELFKPRFQYKEPYLHHSSNGECLSKSCLVIQLVSGLTSAYRGVGMLIQQSDHQPSFYQARLMLILEEAGSAMVATS

SEQ ID NO: 122874 - protein, 71 aa, Glycine max
  Coding DNA Sequence Number=SeqID_6096
MRVHVARIGGVTKIRKDKQTTSFSTYCHCSNSKDVSSIYDPPTVLARARFVAREKVLRGCVPGWCAKCKFQ

SEQ ID NO: 122875 - protein, 206 aa, Glycine max
  Coding DNA Sequence Number=SeqID_6097
MEGFYDDANSYGGKKVWVFWPIIRHPFKQHLVLKVTNKDRFPISEHIFNSCNLEVPDKYCGKLGGFLPKTGKPTIKSNERSFHGWKGTKSGHNRLAGTDSNKKDPCWFFLCELEQSACGIFIMGKGKAHLQGLKETGPRGDLVVAHRPLIPHEGQPIHVKRGYRQVFQVRRCVILEKLGDLEDPPHKIGTIKLWHLQLHTMRHRGL

SEQ ID NO: 122876 - protein, 81 aa, Glycine max
  Coding DNA Sequence Number=SeqID_6098
MVGGKEEKETSRQSNLNFFMNGAFNFDEGSCSNSQVLPAKASYWSLARVLSLLAKGPSTEENIDKTTRTLNQAQEELELLA

SEQ ID NO: 122877 - protein, 113 aa, Glycine max
  Coding DNA Sequence Number=SeqID_6099
MTPEPKAATKDVKIDLFEDDDDFDEFEINEDNCDSRLNNSTHGYPDLEIFENLSRFLFFFKEGHHIVQACCQRLIKELIKENDKIGENYVGPCGLNKLKRDRLKMQKKQQQSI

SEQ ID NO: 122878 - protein, 48 aa, Glycine max
  Coding DNA Sequence Number=SeqID_6100
MAVRWCWWSRSGNGLMMLGEVVHGGGSIDDPNLRQRCTYVVGAWVTHK

SEQ ID NO: 122879 - protein, 176 aa, Glycine max
  Coding DNA Sequence Number=SeqID_6101
  Gene Ontology: Mol. function=RNA-directed DNA polymerase activity; Cellular component=chromatin; Biological process=chromatin assembly or disassembly
MVGNGQQLECNCLYEVITIGIQSTKFTVDLYVLPISGANVVLGGDNIYFHIMVLSDDYQLNISKDLPPAIQALLTKFCVDYHALNALTGRDRFPIPTIDELGGAQCFSKLDLLQGYHQIRMHSKDIPKTAFRTHHGHYEFRVEYIGHLVSHKGVKPVASKVEAIHQWPVPQSTKAL

SEQ ID NO: 122880 - protein, 56 aa, Glycine max
  Coding DNA Sequence Number=SeqID_6102
MSFGQTFCIIKLPASPTGHFEFSDLAPKLHGFSQFDLEEGTHLASMRTSNDFHLAH

SEQ ID NO: 122881 - protein, 226 aa, Glycine max
  Coding DNA Sequence Number=SeqID_6103
  Gene Ontology: Mol. function=RNA-directed DNA polymerase activity; Cellular component=chromatin; Biological process=chromatin assembly or disassembly
MELVGKIHGIPRSLVSDRDPLFVSKFWQELFRLSGMQLRMSLAYHPQSDGQTKVLNRVIQQYLCAFVHYRPRAWGKLLLGVERSHNTSWNARTGSTPYEITFGRKPFNFLEYILGSSNLDVVEDMLTDREETFQAIRKKLMKAQATMKHLADAERREGSPELIESVQLPKHFIHDQPIISPLAILAYRKSSLSTWEVLVQWQGCLQTRPYGRIGINYARTINLRTR

SEQ ID NO: 122882 - protein, 88 aa, Glycine max
  Coding DNA Sequence Number=SeqID_6104
MKKICSNLQGKDNAPPPPPQWIEAKSHVQQGAYECGYYVMHWMWYIVSGGLKNELHNYFSDGTSLDTDTMTTLRKKWAAYFLEVGKWM

SEQ ID NO: 122883 - protein, 143 aa, Glycine max
  Coding DNA Sequence Number=SeqID_6105
  Homolog annotation: Hit_ID=Q2SAC6; Match level="QueryCoverage=48%, HitCoverage=11%, E-value=5e-13, Identity=48%"; Hit description =Predicted ATPase
  Pfam annotation: Domain name=DUF1446; Domain location=1-143; Score= -114.1; E_value=6.5e-06; Accession=PF07287.2; Description=Protein of unknown function (DUF1446)
MDPLGAQQKVLEIANSLVLNVSVAVAHEVSVTNIVGSGFSPAKSYIMEGGISTYLGAAPIVRCLEKYQPNVIITSRIAYATLFLAPMVYELGWNWDELEHLAQGSLAGHLLECGCQLTGGISCIQHVPSTHETFSQLTIMLEM

SEQ ID NO: 122884 - protein, 242 aa, Glycine max
  Coding DNA Sequence Number=SeqID_6106
  Gene Ontology: Mol. function=protein binding; Cellular component =outer membrane-bounded periplasmic space; Biological process=cell wall organization and biogenesis
  Homolog annotation: Hit_ID=UPI00005F9B58; Match level="QueryCoverage =85%, HitCoverage=89%, E-value=1e-26, Identity=33%"; Hit description =COG3121: P pilus assembly protein, chaperone PapD
  Pfam annotation: Domain name=Pili_assembly_C; Domain location=151 -239; Score=33.6; E_value=6.8e-07; Accession=PF02753.7; Description =Gram-negative pili assembly chaperone
  Pfam annotation: Domain name=Pili_assembly_N; Domain location=19-147; Score=74.2; E_value=4.1e-19; Accession=PF00345.11; Description=Gram -negative pili assembly chaperone
  Pfam module annotation: Pfam domain module=Pili_assembly_C::Pili _assembly_N; Domain location=151-239::19-147
MVHLFSVVFMFISLGVHATVVPLQDRVLFSSTDSDRRLLIVNNDGQAPVLLQSWIDDGATGDMNKEKNYPFVVIPAVTRMAPGKVLNLKILPTEKISELPTDRESVFWINLYEIPGVKQTKQSHHINKIEVGLNSQLKIIYRPFKEAMNINTTGESIGLRLTDGGRILEITNPTPYYITPVSVKVNSPGAGQPVTLGMDRLIAPFSHKRFKLSEAVNSKKTPVEYTIVDDVGKNARFMKVLN

SEQ ID NO: 122885 - protein, 71 aa, Glycine max
  Coding DNA Sequence Number=SeqID_6107
MKEVRQVKRVPRYPHVPATMTFRKLLDFRESNGSRGVKIWTRVIKTTLPLIVGPEGDNHFLNTRPLATRFA

SEQ ID NO: 122886 - protein, 68 aa, Glycine max
  Coding DNA Sequence Number=SeqID_6108
MALCISTDCKYMDAKCGDSYTPPARHPAPACAARQTRRAAGDAALCEACRRAGDPTLPERPLYLILKA

SEQ ID NO: 122887 - protein, 131 aa, Glycine max
  Coding DNA Sequence Number=SeqID_6109
  Gene Ontology: Mol. function=isomerase activity; Biological process =aromatic compound metabolic process
  Homolog annotation: Hit_ID=Q12G69; Match level="QueryCoverage=95%, HitCoverage=100%, E-value=7e-54, Identity=83%"; Hit description=4 -oxalocrotonate tautomerase
  Pfam annotation: Domain name=Tautomerase; Domain location=7-66; Score= 34.3; E_value=4.3e-07; Accession=PF01361.11; Description=Tautomerase enzyme
  Pfam annotation: Domain name=Tautomerase; Domain location=73-130; Score=28.4; E_value=2.5e-05; Accession=PF01361.11; Description =Tautomerase enzyme
  Pfam module annotation: Pfam domain module=Tautomerase::Tautomerase; Domain location=7-66::73-130
MEESTMPLAHISLRTGKTEAYRQAIFDGVYRAMRETFDVPEDDQFMFLTEHEAANFRYGATYLDVARSDDLVFIQITANNTRGVEQKKALFQRIAALLGDNPGIRSEDVFVSLVEVVKENWSLGRGLAQYA

SEQ ID NO: 122888 - protein, 77 aa, Glycine max
  Coding DNA Sequence Number=SeqID_6110
MPGEKDSVGDSLDITLVALFQKQTRYPSGISLTPQCNPLHEPTRWDGSEADIFHQLKVFQIVLRSRFAKVQFDEIGI

SEQ ID NO: 122889 - protein, 58 aa, Glycine max
  Coding DNA Sequence Number=SeqID_6111
  Homolog annotation: Hit_ID=UPI00005F864F; Match level="QueryCoverage =96%, HitCoverage=15%, E-value=2e-13, Identity=66%"; Hit description =COG3239: Fatty acid desaturase
MMMWLVHLLLLAGLFYWLSLHGFSPLWLVLAVSYPALMLTKVRSFYEHRADEAPLARS

SEQ ID NO: 122890 - protein, 129 aa, Glycine max
  Coding DNA Sequence Number=SeqID_6112
  Gene Ontology: Mol. function=oxidoreductase activity; Cellular component=membrane; Biological process=lipid metabolic process
  Homolog annotation: Hit_ID=UPI00005FA6AA; Match level="QueryCoverage =88%, HitCoverage=36%, E-value=3e-35, Identity=53%"; Hit description =COG3239: Fatty acid desaturase
MDNALLPGFEPCPVRRRQIIGFRIIMRIGQGVVAVMRQVRIPVETIRIPHRQRQRAKQLIKARQARRMAMDQLMLQRQIPGGEQDQQQRGEGQAQRLPVQHAGEPAAINEPAACQLMHHFALLRTEVGG

SEQ ID NO: 122891 - protein, 367 aa, Glycine max
  Coding DNA Sequence Number=SeqID_6113
  Gene Ontology: Mol. function=RNA-directed DNA polymerase activity; Cellular component=extracellular region; Biological process=RNA -dependent DNA replication
MILKKLNDRVDWSFLRKTLCEFGFPTKIVDLIMNCTTEEDFLYPFFSSRHDHRQGDPMSLYLFLFCMEKQGLLIQDKVKLVQDVLRGFFLAYGLKRTHHPSKYLGFPLITSKTKKAYFAFLLDRVNSRIIGWKSKLLNCAGRVTLANSVLPAIPFYMMQNLWIPQGICDTIDSRIRCFIWGGNHNHWVDWGTISKSRQHGGLSVHKCKQVLMQDLNKLWVKILNEKYVHNSNVCNLNVSKGCSYSWSSIMKGLSTLRSGFYIQIRDGSSSLWFKPWLYGDTLYSGVEDIHERDLHLRVCDVYFDGELHLDVLTTSILGHIWDKLLVLFLDYTMPDTITWSHSSSGEYDTKSAYVWLNHEPAGHFNST

SEQ ID NO: 122892 - protein, 121 aa, Glycine max
  Coding DNA Sequence Number=SeqID_6114
  Gene Ontology: Mol. function=sugar porter activity; Cellular component=integral to membrane; Biological process=carbohydrate transport
  Homolog annotation: Hit_ID=Q93YP9; Match level="QueryCoverage=96%, HitCoverage=27%, E-value=1e-33, Identity=57%"; Hit description=Sugar transporter ERD6-like 4
MPLGEDYEDARNLRKPFVINNNNNVGYSGNLFVVLCVLIVALGPIQFGFTCGYSSPTQADMIRDLNLSISRFSLFGSLSNVGAMVGATVSGQLAEYFGRKGSLIVAAIPNIFGWLAISIAK

SEQ ID NO: 122893 - protein, 60 aa, Glycine max
  Coding DNA Sequence Number=SeqID_6115
  Gene Ontology: Mol. function=transporter activity; Cellular component= integral to membrane; Biological process=transport
  Homolog annotation: Hit_ID=Q93YP9; Match level="QueryCoverage=78%, HitCoverage=9%, E-value=2e-16, Identity=87%"; Hit description=Sugar transporter ERD6-like 4
MFYVHLMQVPVYIAEVSPRTMRGSLGSVNQLSVTIGIMLAYLLGLFVNWRILAMLGEILT

SEQ ID NO: 122894 - protein, 132 aa, Glycine max
  Coding DNA Sequence Number=SeqID_6116
  Gene Ontology: Mol. function=sugar porter activity; Cellular component=integral to membrane; Biological process=carbohydrate transport
  Homolog annotation: Hit_ID=Q93YP9; Match level="QueryCoverage=94%, HitCoverage=25%, E-value=9e-29, Identity=57%"; Hit description=Sugar transporter ERD6-like 4
  Subcellular localization annotation: CTP_CleavageSite=86; ConfidenceScore=5.22e-01
MGSTRNPGIGLLVLQQLSGINGVFFYSSKIFASAGISSSDAATFGLGAMQVAITGIATSLLDRSGRRMLLILSSSIMTLSLLLVAAAFYLEGVVTDDSNVHEVLAMLSVMGLCGFGHWIFSRRWTNTLDHNV

SEQ ID NO: 122895 - protein, 130 aa, Glycine max
  Coding DNA Sequence Number=SeqID_6117
DGDVDLNVSPQALDKLLGYELAFKIKVQPKFRNFVVLKCSTDTSLINVVIDMLADAETSSKINIPAFDSNHSTQHESQFVSVTADHDPLLKLPLTPTKRQAFQDCDDEAGSSQISPAQLSSNKLKKHGAI

SEQ ID NO: 122896 - protein, 93 aa, Glycine max
  Coding DNA Sequence Number=SeqID_6118
MEESNRENNKDHISQSRGSALDGEEHIGEWRNPIGKITKITFPSQEGPLLTVKNTLENGGSNRENNKDHISQSRGSALDGEEHIGEWRIQSGK

SEQ ID NO: 122897 - protein, 105 aa, Glycine max
  Coding DNA Sequence Number=SeqID_6119
  Gene Ontology: Mol. function=DNA binding; Cellular component=nucleus; Biological process=regulation of transcription
  Homolog annotation: Hit_ID=Q1SXU6; Match level="QueryCoverage=66%, HitCoverage=14%, E-value=4e-24, Identity=78%"; Hit description =SWIRM; Lambda integrase-like, N-terminal; Homeodomain-related
MAAFLSALAGLEVAQAAAQAALTTLSEMLVSRLTVLEKEELDVEKAISEIIEVQMKNIQDKLVHFEDLDLLMEKEGQQMEQMKNMFFLDQLTLLFHKSSAPKTGE

SEQ ID NO: 122898 - protein, 656 aa, Glycine max
  Coding DNA Sequence Number=SeqID_6120
  Gene Ontology: Mol. function=ribonucleoside-diphosphate reductase activity; Cellular component=ribonucleoside-diphosphate reductase complex; Biological process=DNA replication
  Homolog annotation: Hit_ID=Q8GZU8; Match level="QueryCoverage=99%, HitCoverage=80%, E-value=0.0, Identity=95%"; Hit description =Ribonucleotide reductase large subunit B
  Pfam annotation: Domain name=ATP-cone; Domain location=1-98; Score =69.0; E_value=1.6e-17; Accession=PF03477.6; Description=ATP cone domain
  Pfam annotation: Domain name=Ribonuc_red_lgC; Domain location=222 -656; Score=737.3; E_value=9.8e-219; Accession=PF02867.5; Description= Ribonucleotide reductase, barrel doma
  Pfam annotation: Domain name=Ribonuc_red_lgN; Domain location=148 -220; Score=131.8; E_value=1.9e-36; Accession=PF00317.11; Description= Ribonucleotide reductase, all-alpha d
  Pfam module annotation: Pfam domain module=ATP-cone::Ribonuc_red _lgC::Ribonuc_red_lgN; Domain location=1-98::222-656::148-220
MYVVKRNGRQETVHFDKITARLKKLSYGLSSDHCDAVLVAQKVCAGVYKGVTTSQLDELAAETAAAMTANHPDYACVSFLNFLLAARIAVSNLHKNTKKSFSETIKIMYYHFNERSGLKAPLIADDVYEIIMKNAARLDSEIIYDRDFDYDYFGFKTLERSYLLKVQGQVLERPQHMLMRVAVGIHKDDIDSAVKTYHMMSQRWFTHASPTLFNAGTPRPQLSSCFLVCMKDDSIEGIYETLKECAIISKSAGGIGVSIHDIRATGSYIRGTNGTSNGIVPMLRVFNDTARYVDQGGGKRKGAFAVYLEPWHADMFEFLDLRKNHGKEEHRARDLFYALWVPDLFMERVQSNGQWSLFCPSEAPGLTDCWGEKFEELYLQYEREGKAMKVVQAQSLWFEILKSQIETGTPYMLFKDTCNRKSNQQNLGTIKSSNLCTEIIEYSSPTETAVCNLASIALPRYVREKGVPMESHPSKLVGSTCSGNRYFDFDKLAEITALVTTNLNKVIDVNYYPVENAKRSNLRHRPIGIGVQGLADTFILLGMAFDSPEAQQLNKEIFETIYYHALKTSCGLAAKEGPYETYSGSPISKGILQPDMWGVAPSNRWDWDALREMISKNGVRNSLLVAPMPTASTSQILGNNECFEPYTSNIYSRRVL

SEQ ID NO: 122899 - protein, 427 aa, Glycine max
  Coding DNA Sequence Number=SeqID_6121
  Gene Ontology: Mol. function=nucleic acid binding; Cellular component= nucleus; Biological process=mRNA processing
  Homolog annotation: Hit_ID=Q1SR98; Match level="QueryCoverage=85%, HitCoverage=63%, E-value=1e-171, Identity=82%"; Hit description=RNA -binding region RNP-1
  Pfam annotation: Domain name=RRM_1; Domain location=164-235; Score =100.4; E_value=5.3e-27; Accession=PF00076.12; Description=RNA recognition motif. (a.k.a. RRM, R
  Pfam annotation: Domain name=RRM_1; Domain location=335-411; Score =13.9; E_value=0.0075; Accession=PF00076.12; Description=RNA recognition motif. (a.k.a. RRM, R
  Pfam annotation: Domain name=RRM_1; Domain location=62-132; Score =45.4; E_value=1.9e-10; Accession=PF00076.12; Description=RNA recognition motif. (a.k.a. RRM, R
  Pfam module annotation: Pfam domain module=RRM_1::RRM_1::RRM_1; Domain location=164-235::335-411::62-132
MTTVVSLRHYPLSRLGAVLNSNISYVCLDLCYKLYNLNIRRFRDKKEAAEPEADPERDQRTVFAYQMPLKASERDAYEFFSKAGKVRDVRLIMDRNSRRSKGVGYIEFYDAMSVPMAIALSGQLLLGQPVMVKPSEAEKNLVQSNATSGAAGVVGPYGAVDRKLYVGNLHFNMTESQLREIFEPFGPVEIVQLPLDLETGHCKGFGFVQFAHLEHAKAAQSLNGKLEIAGRTIKVSSVTDHVGNQDTTAKSADFDDDEGGLSLNAQSRALLMQKLDRSGIAASIGLPIANGSSPAQQAIMPIGNPGIVPAVAPAVPTQIMPIPVTEPVGNPSECLLLKNMFDPNTETEPDFDLDIKEDVEEECSKYGRVKHIYVDKRSAGFVYLQFETVEAASAAQRAMHTRWFAGRMISAIYMLPQMYETKFKGDA

SEQ ID NO: 122900 - protein, 90 aa, Glycine max
  Coding DNA Sequence Number=SeqID_6122
  Gene Ontology: Mol. function=nucleic acid binding
  Homolog annotation: Hit_ID=Q1SR99; Match level="QueryCoverage=74%, HitCoverage=27%, E-value=5e-28, Identity=89%"; Hit description=Alba, DNA binding
  Pfam annotation: Domain name=Alba; Domain location=17-89; Score=74.6; E_value=3e-19; Accession=PF01918.11; Description=Alba
MDRYQRVEKPKAETPINENEIRVTTQGRMRNYITYATTLLQEKGSSEIVLKAMGRAINKTVMIAELIKVGGSISLWNMVACTCSSYFREL

SEQ ID NO: 122901 - protein, 106 aa, Glycine max
  Coding DNA Sequence Number=SeqID_6123
MTKIENEKLHTMVFYFKTCPEADNDTIFMGPQQQLVVSCGHTRVRLGMVLDDRYGQEVGGGGFWMVVGGGSEVSLMVVVMEFLGRAGVFRGGRLWWLMGFEEDEKC

SEQ ID NO: 122902 - protein, 105 aa, Glycine max
  Coding DNA Sequence Number=SeqID_6124
MAEASPSRKSKPQMMESDMEAAQHLIQLSEDSSCSDNISGKRNRSCDGEEVHHITAANKIREIFGEDKVYQPKKKKKKKKRRYRSLVNIYMATAPISMLQRFFFV

SEQ ID NO: 122903 - protein, 58 aa, Glycine max
  Coding DNA Sequence Number=SeqID_6125
MENLSSRPLMLIQEEINEEDERLMEAFALKEPGQQKTLADLIVQRIKEKDASVASGNT

SEQ ID NO: 122904 - protein, 143 aa, Glycine max
  Coding DNA Sequence Number=SeqID_6126
  Gene Ontology: Mol. function=protein binding; Cellular component =cytoplasm; Biological process=cell adhesion
  Homolog annotation: Hit_ID=Q6EQN5; Match level="QueryCoverage=66%, HitCoverage=20%, E-value=9e-39, Identity=80%"; Hit description =Bystin (51.6 kD)-like
  Pfam annotation: Domain name=Bystin; Domain location=1-134; Score= -52.6; E_value=5.6e-14; Accession=PF05291.2; Description=Bystin
MFDNILHVQSRTCTLREAVIIGSIIEKVSIPPLHSSVALLKLSGMEYCGTTSYFIKLLLEKKYALPYRVVDAVVAHFTRFLNETRIMPVIWHQSLLAFVQRVSNTAIPIKKCLVVKVDIGKLSIDYLHISLYNFFQKLVPPMN

SEQ ID NO: 122905 - protein, 244 aa, Glycine max
  Coding DNA Sequence Number=SeqID_6127
  Homolog annotation: Hit_ID=Q589Y3; Match level="QueryCoverage=37%, HitCoverage=20%, E-value=9e-15, Identity=42%"; Hit description =Glucosyltransferase NTGT4
EDCIIEPGQNQQLNALRERARVAEVEAYGIVEYQRVTGRKVWCVGPVSLSNKDDLDKDQRGNKRNTNDDEVDYVKWLDSWPQRSVIYVCLGSLNRVAPKQLIELEENIGVNGKVAVGREFYNEKFAVQVAEIGVSVGAEIAVHLGQEDKVGECVRVNREKDMTNGMASQGRFEVKSTLAQSHLPPPPPPCSWSTPTPRTLLLYFPIFAINESGFVTVFGLVRNPCLTMSVVRAATTSVVESWLL

SEQ ID NO: 122906 - protein, 178 aa, Glycine max
  Coding DNA Sequence Number=SeqID_6128
  Gene Ontology: Mol. function=structural molecule activity; Cellular component=viral capsid
  Homolog annotation: Hit_ID=Q1SRA6; Match level="QueryCoverage=94%, HitCoverage=78%, E-value=7e-53, Identity=58%"; Hit description=24 kDa protein SC24
  Pfam annotation: Domain name=Alginate_lyase2; Domain location=37-178; Score=51.4; E_value=3e-12; Accession=PF08787.1; Description=Alginate lyase
MGTLYQIALLNMVLYVSLMMNPTNTSSMDLTLGFTELPLNTTNFDHHKPYDLPVTERYSFTDGVHKLWVYSTDKPLSQNSTTRPRSEIRIRGYDYSSGVWQFEGQGFVPNGTSGVCIMQVFGADPPRATTLMVRAYNDSLKYYEAPILVPNIWGRWFQLTVIHDVEASNVKVYFDRVQ

SEQ ID NO: 122907 - protein, 174 aa, Glycine max
  Coding DNA Sequence Number=SeqID_6129
  Gene Ontology: Mol. function=nucleic acid binding
MEKKANCRIQEVHRSRLRSMTKFLVVPIREKSMKEVVGCCQRFSWRIVCSRKYVTGEKHWLQSDKRQVNKDFEITGGGFSIMDVHNRLFMAGFDLVEDRKKTVGKLMKVDFKTLRVKHGCFAYKKIDDPVATSDHNEANSNNGIAVGKQLTEIIGVIDHYNEGNCYYSGGAFAL

SEQ ID NO: 122908 - protein, 72 aa, Glycine max
  Coding DNA Sequence Number=SeqID_6130
  Gene Ontology: Mol. function=cytochrome-c oxidase activity; Cellular component=membrane; Biological process=electron transport
MDIGFFSLVLKRHPVEFLAYNSGGTGDWGILLLASLGDRKERTIFPSNVEPTEFYTCYNRFDIVLGRATILG

SEQ ID NO: 122909 - protein, 386 aa, Glycine max
  Coding DNA Sequence Number=SeqID_6131
  Gene Ontology: Mol. function=cytochrome-c oxidase activity; Cellular component=membrane; Biological process=electron transport
  Homolog annotation: Hit_ID=Q9FGG3; Match level="QueryCoverage=84%, HitCoverage=91%, E-value=1e-108, Identity=61%"; Hit description =Nodulin-like protein
  Pfam annotation: Domain name=DUF6; Domain location=15-148; Score =31.6; E_value=2.7e-06; Accession=PF00892.11; Description=Integral membrane protein DUF6
  Pfam annotation: Domain name=DUF914; Domain location=64-329; Score= -211.5; E_value=0.046; Accession=PF06027.3; Description=Eukaryotic protein of unknown function (DUF914)
  Pfam annotation: Domain name=TPT; Domain location=183-306; Score= -24.3; E_value=0.015; Accession=PF03151.7; Description=Triose -phosphate Transporter family
  Pfam module annotation: Pfam domain module=DUF6::DUF914::TPT; Domain location=15-148::64-329::183-306
MKGNNPYLIVVLVQAIYAAMFLLSKAAFDHGMNNFIFVFYRQAVATIFLTPFTFFFEWKTAPPMPFRTFCKIFFLSLFGITLSLDIYGIGLIYTSATLAAATTNCLPAITFFLAFLLRIESLKIKTTPGIAKLIGVVACLAGAATFAFYKGPSLKFLSHFHLLDYHKSIQHQGHAQSGAWIKGCFLMLLSNTFFGLWLVLQTFIIKGYPSKLLFTTIQCFLSSIQSFVIALAVERDIEQWKLGWNVRLLAGIMVTGVSYYLQTWVIEKKGPVFLAMSTPLALIITIFASAAVLGEIISLGSDCFDQSSRRVRIDSRTVQRIVGKEQGAHAKSHIRHGASIIGLMRVMGLMQLAIAMICEKRKYILRSVAKILPTTNTIVITYIKAL

SEQ ID NO: 122910 - protein, 152 aa, Glycine max
  Coding DNA Sequence Number=SeqID_6132
  Gene Ontology: Mol. function=heat shock protein binding; Cellular component=integral to membrane; Biological process=protein folding
  Homolog annotation: Hit_ID=Q1SQA8; Match level="QueryCoverage=60%, HitCoverage=35%, E-value=4e-35, Identity=77%"; Hit description=Heat shock protein DnaJ, N-terminal
  Pfam annotation: Domain name=DnaJ; Domain location=89-151; Score =23.1; E_value=2.5e-05; Accession=PF00226.21; Description=DnaJ domain
MDTKVVFPIKVNQNLVSILVENHKRKLNKRASPGAAIKLCLGDLLVMGSNPETASLHMQGEHSNRTNKWKNESDIEHDDDDDSCVGSCSDRTVLGLPPTGPLKIEDVKNAFQLSALKWHPDKHQGPSQAMAEEKFKLCVNAYKTLCNALSPS

SEQ ID NO: 122911 - protein, 338 aa, Glycine max
  Coding DNA Sequence Number=SeqID_6133
  Gene Ontology: Mol. function=cytochrome-c oxidase activity; Cellular component=membrane; Biological process=electron transport
  Homolog annotation: Hit_ID=Q9FGG3; Match level="QueryCoverage=94%, HitCoverage=91%, E-value=2e-88, Identity=52%"; Hit description =Nodulin-like protein
  Pfam annotation: Domain name=DUF6; Domain location=15-148; Score =27.8; E_value=3.9e-05; Accession=PF00892.11; Description=Integral membrane protein DUF6
  Pfam annotation: Domain name=DUF6; Domain location=192-317; Score =42.0; E_value=2e-09; Accession=PF00892.11; Description=Integral membrane protein DUF6
  Pfam annotation: Domain name=TPT; Domain location=183-317; Score= -23.8; E_value=0.014; Accession=PF03151.7; Description=Triose -phosphate Transporter family
  Pfam module annotation: Pfam domain module=DUF6::DUF6::TPT; Domain location=15-148::192-317::183-317
MKGNNPYLVVILIQTIYAAMILLSKVAFDHGMDSFIFVFYRQAAATLFLTPFTFFFEWKTAPPMPFWTFCKIFFISLFGITLTLEIYGIALIYTSVTLAAATSNSLPAITFFLALLLRIESLKIKTTPGIVKLIGIVACLAGAATLAFYKGPPLKFLSHYHLLDYHKTLQHQGRAPSGAWIKGCFLMILSNTCFGLWFVLQAFIIKVYPSKLLFTTIQCFLSSIQSLVIALAVERDIEQWKLGWNARLLAGIMVTGVTYYLQTWVIEKKGPVFLAMSTPLVLIITTFASATILGEIISLGSLLGGFILILGLYSVLWGKSKEHHMPKVSLDVEQTSSN

SEQ ID NO: 122912 - protein, 89 aa, Glycine max
  Coding DNA Sequence Number=SeqID_6134
MGEHKQALYSKKPKKVVDHGNELKPEELLMHIMESQSQEQQQEMQTQTQSSSEDAERDQDQNQDQSGYQNQMVDNNNNNNSPSSIAIMS

SEQ ID NO: 122913 - protein, 172 aa, Glycine max
  Coding DNA Sequence Number=SeqID_6135
MYKDNWAQPWPMGSEIYPKVHENPRAFFSSSSPIFLEPLAHDPETKPKMKGKRLILQYWIVPFAEASNQLVWASEVSSNLSKQLAWDMQIRRRRSSAKLGRSHNEEELLGMFDSKADEESPKESSPTSKKVVNNNPLEGHPLERNSLPKEWKTAKDLFVYNIIDDIAKGVST

SEQ ID NO: 122914 - protein, 94 aa, Glycine max
  Coding DNA Sequence Number=SeqID_6136
MTLLAIALTPQVPLPSVKDVKVLEAKDNLEALLEQLKCAIKKARLVINNKKLKAYKNFLNFTKASSSPFMVCLATERKLWYLDSGCSRHVTRDE

SEQ ID NO: 122915 - protein, 35 aa, Glycine max
  Coding DNA Sequence Number=SeqID_6137
MSSNKEGIHSLGIKLPELWIVRSHLSFTTSNIKVS

SEQ ID NO: 122916 - protein, 71 aa, Glycine max
  Coding DNA Sequence Number=SeqID_6138
MAPKKLSAKRSRKDATAEGTSAAPEFDSHRFRSAEHQQRFEAIKGWSFHRERRVQLRDDEYTGFPGRDSSA

SEQ ID NO: 122917 - protein, 189 aa, Glycine max
  Coding DNA Sequence Number=SeqID_6139
ESPVVAILADLFDTFDWRGCINYNPALAIRKLGYPMRGAPTEESLSPFLVRDLGAQGLKVIQRIHKAWRSPLKKDKELRGIRNGVIGGYHGWLRILAQGLDWLSKLKVINEENFEAPAILAKEKFKSAATHIRKECTELQEENAATARALEQETKRARKEEYGREKFRGALWGSNNELKLRREERDRSR

SEQ ID NO: 122918 - protein, 382 aa, Glycine max
  Coding DNA Sequence Number=SeqID_6140
  Gene Ontology: Mol. function=helicase activity; Biological process =viral genome replication
  Homolog annotation: Hit_ID=Q1SRJ5; Match level="QueryCoverage=99%, HitCoverage=48%, E-value=2e-88, Identity=43%"; Hit description =Probable helicase [imported]-Arabidopsis thaliana-related
MFHPQTVLDPNGYPIYRRRNDGRTISKNGVIIDNRYIVPYNAKLLRKYQAHINVEWCNQNTSIKYLFKYINKGYDRVTAVVIHDANGTLENAISQNDEIKEYVDCRYISPCEATWRIFGFPIHARKPAVERLHFHLPGQHNVFYEDDDDIDDILSKPSISDSKFLAWMNSNKCFSDGRNLTYSQFVSKFVYNQKARSWNLRKKDNTIGRLIWVPPTTGELFYLRMMLTACKGATSFEDIRTVENVLYLTYREACFAMGFLQDDREFMEAIKEAKDWGVITKPKELWSQTWNWLAEDIAYHYKKTTLNTKSHIDDEQLKNLTLLEIEKLLHPNQRSLRDYPTMPYPEGGNPASCLKNSLILSELNYNNDEARSEFKNLFLSMT

SEQ ID NO: 122919 - protein, 80 aa, Glycine max
  Coding DNA Sequence Number=SeqID_6141
  Gene Ontology: Mol. function=nucleic acid binding; Biological process= regulation of transcription, DNA-dependent
  Homolog annotation: Hit_ID=Q0ZCD0; Match level="QueryCoverage=98%, HitCoverage=7%, E-value=5e-21, Identity=58%"; Hit description =Integrase
MSPYRVVFGKACHLPVEIEHKAYWAVKTRNFSIDQAGEERKLQLSELDEIRLEAYEISKFYKKKTKNFHNSLIAKDFVVG

SEQ ID NO: 122920 - protein, 145 aa, Glycine max
  Coding DNA Sequence Number=SeqID_6142
  Subcellular localization annotation: CTP_CleavageSite=81; ConfidenceScore=5.47e-01
MSISPCGSISWSVSSRHRDHTHKAPSGPRGVQQGPGVSNSGYGPFSVLQGTCPPSKGSRPQDTQWTRRSPTGPWGFQLWLRASFYEAPVAPSRVIRPPINRAFIKKYCAPGRRRVRHHSSLGMVNSRQQMHHRHLQSPSAHPQKG

SEQ ID NO: 122921 - protein, 122 aa, Glycine max
  Coding DNA Sequence Number=SeqID_6143
WRKHRDFLSLTSYPELRRSEFLIGGYVGARASLLSTTPPFVAMTQELVARGDTLRLSAPRHSVTPSVIHEQRPIWSSTPFPEMSAFSDGNFSSLTSYPELRRSEFLIGGYVGARALLLSAAP

SEQ ID NO: 122922 - protein, 202 aa, Glycine max
  Coding DNA Sequence Number=SeqID_6144
  Subcellular localization annotation: CTP_CleavageSite=96; ConfidenceScore=5.52e-01
MMSMKKIMEANAVAVAATSAVAKVNSTPPSGLNQMNHSTSDMVGKDLGSMGGPPLFANSKTSTLSRHMACLPTICHPTWRTLPMRMSITPLLYSLRANNLNLIMHMAIVGDMPLQNTLEGPQYHPQPHPLHSTTGKNPHAMVEMGKLDHLEERLRAIAGGEDYAFANLEELFLVPNIITPPKFKVADFDKYKGTTCPKNHLK

SEQ ID NO: 122923 - protein, 70 aa, Glycine max
  Coding DNA Sequence Number=SeqID_6145
MRVHCNQASRRPNMITDSPPLLMFPRARGGDCRQRIKLNVLMMPKDYMFLKVLFKTKKSKIFKMDDQDSL

SEQ ID NO: 122924 - protein, 89 aa, Glycine max
  Coding DNA Sequence Number=SeqID_6146
MRTEETAKPRHPPPPHDEEFVEPPIPEVSIASDLPTHSVVDCEGCQGMAEDLERVINLRMVTEGTDLYDIMTRCLRGTRGDAADGSLRS

SEQ ID NO: 122925 - protein, 137 aa, Glycine max
  Coding DNA Sequence Number=SeqID_6147
  Gene Ontology: Cellular component=membrane; Biological process =protein transport
  Homolog annotation: Hit_ID=Q8GVS9; Match level="QueryCoverage=99%, HitCoverage=60%, E-value=3e-33, Identity=58%"; Hit description =Putative endosomal Vps protein complex subunit
  Pfam annotation: Domain name=Snf7; Domain location=2-100; Score= -39.3; E_value=0.023; Accession=PF03357.11; Description=Snf7
MTLVVFAAIARTVGHLSKSAEVMKLVNNLMKAPEMAVTMQEFSKEMTKAGVIEEIVNDAIDTALDSEDIEDEIEEEVDKVLTAIAGETAAQLPEAVRKERVKLPGQSVGAEEEVIAEGVDDEEEMEEIRARLAKVRS

SEQ ID NO: 122926 - protein, 129 aa, Glycine max
  Coding DNA Sequence Number=SeqID_6148
MTELSIACLLPYLLRNASMKAPMIPSFRGLGNLLAGNVKPKRSSGIRREGRRVLAQREIDEPSSSAGSNFHRFCQKDQILKQLFLWATFILSDPSKNQFSALGSIGNGEGDEHSEAKAKSAATIEGLAA

SEQ ID NO: 122927 - protein, 83 aa, Glycine max
  Coding DNA Sequence Number=SeqID_6149
MEKDASHIRPWNGGFNPFFFSLTFEKPNRATGGGALESTKNATIDNGERLSDYIEECDNSLPVCCLCLDPVMILNFVFGGADD

SEQ ID NO: 122928 - protein, 112 aa, Glycine max
  Coding DNA Sequence Number=SeqID_6150
MGCYNHAGSFFLCLIDEAGRLTPYVLFLGSHGRQGVNTPSRGFGDCNGLVCGSYRDSSMSLSVNYDLVQVRMGLNISLDVNYDSFLMGMVHLKRRAPLHSGCRDLFTSLIVD

SEQ ID NO: 122929 - protein, 113 aa, Glycine max
  Coding DNA Sequence Number=SeqID_6151
MHARIVRTLTNFCYIPKLKKNLLVWVPWIQKGTKQGNLYILQVSIMVGFVSTVSQAGSHASSGASNDNCLWHMHLGHVFRCPTYYHISEGKLEPRAKKGVFMAHGEGVKGFRI

SEQ ID NO: 122930 - protein, 103 aa, Glycine max
  Coding DNA Sequence Number=SeqID_6152
MAPSKSEMARLLVEKERKEQVATLATARVVEVVIINVVDGSTTSIALLQNVLDVKNTPISRKRNTSRFKRKFDFKNQESRFKVQASKNQDQDSRLKIQESREE

SEQ ID NO: 122931 - protein, 142 aa, Glycine max
  Coding DNA Sequence Number=SeqID_6153
  Homolog annotation: Hit_ID=Q1T192; Match level="QueryCoverage=39%, HitCoverage=8%, E-value=9e-07, Identity=51%"; Hit description =Polynucleotidyl transferase, Ribonuclease H fold
MAEKVMPNVVAVNNESTIQFVEGFKPVMEQVKLKRGRSNAEYMSGHVDYVISTMYKWWFQCSCRLCQDSDHVQMVVLMFLSKEYTQKVGSTTSIGIIAFDLATRVKRVCRWTSEELCDRTTKSKGPVRPTMFERVQGVSLIH

SEQ ID NO: 122932 - protein, 90 aa, Glycine max
  Coding DNA Sequence Number=SeqID_6154
MQSLQSLGLPSIMSTDEFLTRVAWPRVQPSPSEGEDESVPPKPFIFETDLVTQEEAAAQEPTSPVYTSPAPILEDSQPSAPASEPEQPTV

SEQ ID NO: 122933 - protein, 52 aa, Glycine max
  Coding DNA Sequence Number=SeqID_6155
MCFHEENSSRGASVTHPRCFREQIHKDFPPFFTGLHPFFVLSSVFNRRYLAK

SEQ ID NO: 122934 - protein, 146 aa, Glycine max
  Coding DNA Sequence Number=SeqID_6156
RDSNVSMTDLVSAEDDDVYTDNHSGISTRQRDSNVSMTDLVSAEDDQKNVYTDNHLGISARQRNSNVSMTDLVSAEDDINLRQKNVYTDNHSGIFARQRDSNVSMTDLVSANDDQKNVYTDNHSGISARQHDSNVSMTDLVSAEDD

SEQ ID NO: 122935 - protein, 119 aa, Glycine max
  Coding DNA Sequence Number=SeqID_6157
  Gene Ontology: Mol. function=RNA-directed DNA polymerase activity; Cellular component=mitochondrion; Biological process=DNA integration
  Homolog annotation: Hit_ID=Q1S7S0; Match level="QueryCoverage=53%, HitCoverage=4%, E-value=8e-18, Identity=60%"; Hit description =Integrase, catalytic region; Peptidase aspartic, catalytic
  Subcellular localization annotation: CTP_CleavageSite=34; ConfidenceScore=5.35e-01
LRVTTTPAALNAPLQSASHSPFRLRNCWEGRSVRASSLLRQLAKGGCAARRLSWVLKIGIYSNWMLIMPSYMAIFIKSYIWSYHRVLFQLPQIKCVVSPSLSMVLSKPAINGLPSCPTS

SEQ ID NO: 122936 - protein, 416 aa, Glycine max
  Coding DNA Sequence Number=SeqID_6158
  Gene Ontology: Mol. function=hydrolase activity, acting on glycosyl bonds; Cellular component=cellular_component; Biological process =carbohydrate metabolic process
  Homolog annotation: Hit_ID=Q9FV64; Match level="QueryCoverage=89%, HitCoverage=91%, E-value=1e-100, Identity=49%"; Hit description=NTS1 protein
  Pfam annotation: Domain name=Glyco_hydro_28; Domain location=72-416; Score=387.5; E_value=2e-113; Accession=PF00295.8; Description =Glycosyl hydrolases family 28
MATARALFLLGAALLSCTLIGASSRGVENRRSLLLPVPNNGPAIFDVTKFGAVADDQTDNIDAFRAAWGEACKNSTTQAKVLIPAGTFRAAQTMFAGPCTSPKPIIVEVIGTVKANTDPSEYVTPEWFSFLDIDGLVLTGNGVFDGQGAASWPYNDCAKTKGDCAPLPASLKFAKVNNSIVTDITSLNSMQFHFHIHGCSNFSLSNINITAPGNSPNTDGMHISSSDSIKVFDSVIGTGDDCISIGHSTTNIAITNITCGPGHGISVGSLGKRPEERSVNGISVTNCTFVNTTNGARIKTWMGTVPAEATNITYEGLIMKGVQNPIIIDQSYGSNKKTTPSTSVWKISNIHFRKIQGTTVSNIAVSLQCSTSNPCEGVEIADVDLAYSGGPHNTTFVSSCSNAKAVFGGILNPPAC

SEQ ID NO: 122937 - protein, 69 aa, Glycine max
  Coding DNA Sequence Number=SeqID_6159
MLKIASLSVIKNPLVLAAWPLSYPNQGIFDSNRATPEEEIEKAADMNTGVQTAKPKRKVTRPAYLRDYA

SEQ ID NO: 122938 - protein, 75 aa, Glycine max
  Coding DNA Sequence Number=SeqID_6160
  Homolog annotation: Hit_ID=Q1M2R7; Match level="QueryCoverage=98%, HitCoverage=6%, E-value=2e-11, Identity=42%"; Hit description=PDR -like ABC-transporter
MAMTNFFRTDMHRDLVTHGGIHVGFLFSTSKRDCLFFPSWVYALPPWNPKNSHDFFKKRMFGVSLTDVIGFEPYV

SEQ ID NO: 122939 - protein, 53 aa, Glycine max
  Coding DNA Sequence Number=SeqID_6161
MLRGNSGGQRKCVTTAKALFIDEILVRDSCSSAGFEGQRPPRKKKRAEKESRE

SEQ ID NO: 122940 - protein, 38 aa, Glycine max
  Coding DNA Sequence Number=SeqID_6162
MGDQFGDQVQAKGRTHLVAHDPGNLNKTSASSEGRKIP

SEQ ID NO: 122941 - protein, 240 aa, Glycine max
  Coding DNA Sequence Number=SeqID_6163
  Homolog annotation: Hit_ID=Q9XGV6; Match level="QueryCoverage=22%, HitCoverage=17%, E-value=7e-18, Identity=76%"; Hit description =Bacterial-induced peroxidase precursor
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDKGLIHSDQELFNGGSTDSLVRTYSTNPASFFADFSAAMIRMGDISPLTGSRGEIRDQAYRYRRPRGGARYQLLFPLVRVNFELGVIMVIAVSCVKLLSAHNSTQHTSRKHKV

SEQ ID NO: 122942 - protein, 275 aa, Glycine max
  Coding DNA Sequence Number=SeqID_6164
  Gene Ontology: Mol. function=pectinesterase activity; Cellular component=cell wall; Biological process=cell wall modification
  Homolog annotation: Hit_ID=Q9M5J0; Match level="QueryCoverage=82%, HitCoverage=82%, E-value=1e-118, Identity=86%"; Hit description =Pectin methylesterase isoform alpha
  Pfam annotation: Domain name=Pectinesterase; Domain location=4-260; Score=490.6; E_value=1.9e-144; Accession=PF01095.10; Description =Pectinesterase
MTWVILVKDRKRTEKIEIHNWCRVMRRKKTMDRKAIKVMYKYVETVVGAGFIAKGITFENSAGPDKHQAVALRSGADFSAFYQCSFVGYQDTLYVHSLRQFYRECDIYGTVDFIFGNAAVVFQNCNLYARKPNENQKNLFTAQGREDPNQNTGISILNCKIAAAADLIPVKSSFKSYLGRPWKMYSRTVVLKSFVEDLIDPAGWLEWNETFALDTLYYGEYMNRGPGANTNGRVTWPGYRVINSSTEATQFTVGQFIQGNDWLNSTGIPFFSGLV

SEQ ID NO: 122943 - protein, 133 aa, Glycine max
  Coding DNA Sequence Number=SeqID_6165
  Gene Ontology: Mol. function=metal ion binding; Cellular component =integral to membrane; Biological process=ubiquitin cycle
  Homolog annotation: Hit_ID=Q8LF65; Match level="QueryCoverage=58%, HitCoverage=33%, E-value=6e-24, Identity=56%"; Hit description=RING -H2 finger protein ATL4G
MGDRDALGLNFGWFCVRVTLIATAIIRIIRGRLDWRGVSANRGSAKWTVRVRVEPNVNAMGVESVVTVRKEAAFFAVGELRQADGAIVDGEVGVGGIRKGGKEFENGRAKALVKSHGGNGSNGVAVAAVAAEA

SEQ ID NO: 122944 - protein, 553 aa, Glycine max
  Coding DNA Sequence Number=SeqID_6166
  Gene Ontology: Mol. function=enzyme inhibitor activity; Cellular component=cell wall; Biological process=cell wall modification
  Homolog annotation: Hit_ID=Q7XAF8; Match level="QueryCoverage=98%, HitCoverage=97%, E-value=0.0, Identity=61%"; Hit description =Papillar cell-specific pectin methylesterase-like protein
  Pfam annotation: Domain name=PMEI; Domain location=23-175; Score =94.4; E_value=3.3e-25; Accession=PF04043.6; Description=Plant invertasepectin methylesterase inhibitor
  Pfam annotation: Domain name=Pectinesterase; Domain location=240-538; Score=714.3; E_value=8.3e-212; Accession=PF01095.10; Description =Pectinesterase
  Pfam module annotation: Pfam domain module=PMEI::Pectinesterase; Domain location=23-175::240-538
MGKKKLTFLILLLASQALAEITPNTSVSPGTICKSTPDPSYCNSVLPPQNGNVYDYGRFSVRKSLSKATNFLNLVNRYHRSYLSTSAIHALEDCQTLAELNIDFLSSSFETLNRTTRLLPTSQADDIQTLLSAILTNQQTCLEGLQATASAWRVRNGLSVPLSNDTKLYSVSLALFTKGWVPSDANVSVFQPNAKQRGFRNGRLPLEMSSRTRAIYESVSKRKLLQAATVGDVVKVKDIVTVSKDGSGNFTTIGDALAAAPNKTASTAGYFLIYVTAGVYEENVSIDKKKTYLMMVGDGINKTIITGNRSVVDGWTTFKSATFAVVGAGFVGVNMTIRNTAGAEKHQAVALRNGADLSTFYSCSFEGYQDTLYTHSLRQFYRECDIYGTVDFIFGNAAAVFQNCNIYPRLPMSGQFNAITAQGRTDPNQNTGTSIHNCTIRPADDLATNIDAAETYLGRPWKNYSRTVFMQSFMDIVINSAGWREWDGDFAFSTLYYAEFNNTGPGSSTVNRVTWPGYHVINATDAANFTVSNFLLGDNWLPQTGVAYASNLI

SEQ ID NO: 122945 - protein, 364 aa, Glycine max
  Coding DNA Sequence Number=SeqID_6167
  Gene Ontology: Mol. function=enzyme inhibitor activity; Cellular component=cell wall; Biological process=cell wall modification
  Homolog annotation: Hit_ID=Q42534; Match level="QueryCoverage=76%, HitCoverage=50%, E-value=8e-52, Identity=41%"; Hit description =Pectinesterase-2 precursor
  Pfam annotation: Domain name=PMEI; Domain location=45-200; Score =121.6; E_value=2.3e-33; Accession=PF04043.6; Description=Plant invertasepectin methylesterase inhibitor
  Pfam annotation: Domain name=Pectinesterase; Domain location=250-363; Score=-92.7; E_value=1.2e-14; Accession=PF01095.10; Description =Pectinesterase
  Pfam module annotation: Pfam domain module=PMEI::Pectinesterase; Domain location=45-200::250-363
MNNLTLASILTVISALLLFLGTTHFTNTPITITRAPDQKHLHHFQKHIQVVAKSTCQGTLYPDLCVSTLATFPDLATKSVPQVISSVVNHTMYEVRSSSYNCSGLKKMLKNLNPLDQRALDDCLKLFEDTNVELKATIDDLSKSTIGSKRHHDLQTMLSGAMTNLYTCLDGFAYSKGRVRDRIEKKLLEISHHVSNSLAMLNKVPGVKKLTTSESVVFPEYGNMKKGFPSWVSSKDRKLLQAKVKETKFDLLVAKDGTGNFTTIGEALAVAPNSSTTRFVIHIKEGAYFENVEVIRKKTNLMFVGDGIGKTVVKGSRNVVDGWTTFQSATVDHGLLLGFVRASCTALKNSVVEVDAFSDALCCP

SEQ ID NO: 122946 - protein, 180 aa, Glycine max
  Coding DNA Sequence Number=SeqID_6168
  Gene Ontology: Mol. function=enzyme inhibitor activity; Biological process=metal ion transport
  Homolog annotation: Hit_ID=Q1S041; Match level="QueryCoverage=94%, HitCoverage=94%, E-value=6e-50, Identity=61%"; Hit description =Pectinesterase inhibitor
  Pfam annotation: Domain name=PMEI; Domain location=27-171; Score =84.1; E_value=4.3e-22; Accession=PF04043.6; Description=Plant invertasepectin methylesterase inhibitor
MESKTNYLPVLAICMCLIIAHGAAEEKIGKELIKSICKNRGNDELCMQVLSSDPDSDHADLQELALISLKAAASNASGILNDCKRMIDNQDLEPKIQQGLADCKENLLDAEGQIQDAVASILNNDKLDAQVWLKAALAAIDTCDDSIPGDDDVLSRKSVSFRQLCNIAVAINKAMLAART

SEQ ID NO: 122947 - protein, 534 aa, Glycine max
  Coding DNA Sequence Number=SeqID_6169
  Gene Ontology: Mol. function=oxidoreductase activity; Cellular component=membrane; Biological process=electron transport
  Homolog annotation: Hit_ID=Q9AYM8; Match level="QueryCoverage=97%, HitCoverage=97%, E-value=1e-174, Identity=59%"; Hit description =CPRD2 protein
  Pfam annotation: Domain name=BBE; Domain location=468-526; Score =116.5; E_value=7.8e-32; Accession=PF08031.2; Description=Berberine and berberine like
  Pfam annotation: Domain name=FAD_binding_4; Domain location=78-217; Score=102.6; E_value=1.2e-27; Accession=PF01565.13; Description=FAD binding domain
  Pfam module annotation: Pfam domain module=BBE::FAD_binding_4; Domain location=468-526::78-217
  Subcellular localization annotation: CTP_CleavageSite=86; ConfidenceScore=5.18e-01
MMPLSSLFPVLVIALVSSFTSSAVNTNYENFIQCLYSYSHNSSSISKVVYTKTNASYSSILHFSIQNLRFSSNTTPKPLVIVTPTEVSHIQAAIICSQRHGLQIRTRSGGHDFEGLSYVAEAPFVVIDLINYRRIDVDVNKRVAWVQSGATVGELYYSISEKSKTLGFPAGVFTTVGVGGQFGGGGYGFLLRKHGLAADNIVDAYIVDAKGRLLDREAMSEDLFWAIRGGGGASFGVIVAWKVKLVPVPPTVTVFRVARTLEQNATKLIHKWQLVASKLDGDIAINILVHRVNSSRKGEFTIEALFQSLYLGGLDKLMHLMQENFPELGLKREDCAEMTWIDSVLYFVGYQSREALLNRSQTTTDSFKAKSDFVRNPIPEAGLEGLWQMLYEDGAQGALLVLFPFGAIMDTIPESEIPFPHRSGNLYLVQYTVHWLEEEDEIAQKHISWVRRLYTYMEPFVSKSPRAAYVNYRDLDIGVNNNIGYTSYKQASIWGSKYFKNNFNRLAHVKTKVDPLNFFRYEQSIPSLLPEGRK

SEQ ID NO: 122948 - protein, 33 aa, Glycine max
  Coding DNA Sequence Number=SeqID_6170
MALESGLCQSPPPELCIKKLEVGMEMEQEMVSE

SEQ ID NO: 122949 - protein, 167 aa, Glycine max
  Coding DNA Sequence Number=SeqID_6171
  Gene Ontology: Mol. function=DNA binding; Cellular component =mitochondrion; Biological process=DNA integration
  Homolog annotation: Hit_ID=Q1SDN3; Match level="QueryCoverage=96%, HitCoverage=15%, E-value=2e-28, Identity=38%"; Hit description =Polynucleotidyl transferase, Ribonuclease H fold
MLSVVVGYIRLNIELMECYKTYLVAKNCSQMEGMNYTNIFSPVAKITTVQLLLALAAMNNWYLKQLDDNNAFLHGDLNEEIYMMLPPGLTSSKLGKFVSQSSMTTLLVDVDDTVLTANNITEIVHIAEELDKAFKNKDLGDLKFFLGFEGSHQLIQVGTSIYTRYTI

SEQ ID NO: 122950 - protein, 191 aa, Glycine max
  Coding DNA Sequence Number=SeqID_6172
  Homolog annotation: Hit_ID=UPI0000162C35; Match level="QueryCoverage =55%, HitCoverage=15%, E-value=3e-08, Identity=35%"; Hit description =protein binding
  Pfam annotation: Domain name=Ank; Domain location=134-166; Score =20.7; E_value=0.0052; Accession=PF00023.20; Description=Ankyrin repeat
  Pfam annotation: Domain name=Ank; Domain location=85-120; Score=22.0; E_value=0.0021; Accession=PF00023.20; Description=Ankyrin repeat
  Pfam module annotation: Pfam domain module=Ank::Ank; Domain location =134-166::85-120
MDIEEAAANQVEAPDLDEDISAVFSPPSLPSSSPHKNGSSNQNFKRFDCKLYFAAVKDDFKKFMNIRIWRILEKCRNLVLLPNAKGETLLHIAARYGHSNIAKLLVQRVKAFPPADIENGIGADQKFIRATNDEKDTALHEAVRYHHIEVVKTLLQMDPDYSYRANNANETTLYLASQRQISKWWLRYQTK

SEQ ID NO: 122951 - protein, 429 aa, Glycine max
  Coding DNA Sequence Number=SeqID_6173
  Gene Ontology: Mol. function=transporter activity; Cellular component= integral to membrane; Biological process=transport
  Homolog annotation: Hit_ID=Q6ERI3; Match level="QueryCoverage=71%, HitCoverage=42%, E-value=5e-35, Identity=30%"; Hit description =Ankyrin repeat family protein-like
  Pfam annotation: Domain name=Ank; Domain location=115-150; Score =30.9; E_value=4.4e-06; Accession=PF00023.20; Description=Ankyrin repeat
  Pfam annotation: Domain name=Ank; Domain location=164-196; Score =17.4; E_value=0.051; Accession=PF00023.20; Description=Ankyrin repeat
  Pfam annotation: Domain name=Ank; Domain location=198-230; Score =10.3; E_value=1; Accession=PF00023.20; Description=Ankyrin repeat
  Pfam annotation: Domain name=Ank; Domain location=231-266; Score =13.0; E_value=0.42; Accession=PF00023.20; Description=Ankyrin repeat
  Pfam annotation: Domain name=Ank; Domain location=267-299; Score =10.2; E_value=1.1; Accession=PF00023.20; Description=Ankyrin repeat
  Pfam annotation: Domain name=Ank; Domain location=301-333; Score =21.4; E_value=0.0032; Accession=PF00023.20; Description=Ankyrin repeat
  Pfam annotation: Domain name=Ank; Domain location=335-367; Score=8.3; E_value=2; Accession=PF00023.20; Description=Ankyrin repeat
  Pfam annotation: Domain name=Ank; Domain location=371-403; Score=1.4; E_value=19; Accession=PF00023.20; Description=Ankyrin repeat
  Pfam module annotation: Pfam domain module=Ank::Ank::Ank::Ank::Ank::An k::Ank::Ank; Domain location=115-150::164-196::198-230::231-266::267 -299::301-333::335-367::371-403
METETIANQAEATDLDENMSAPPSPSLHDIGGGSNKNITCRIDGALYFAAVEGNFQEFINIHNLENLLTPNKNTILHIHLTSTTSKSGKTTPASAQFVTQILVKCGRLVLLPNAKGETLLHVAARYGHSNIAKLLLEHAKAKISPDIENGVGADQKFIRATNDELDTALHEAVRYDHIEVVKTLLEMDPDYSYYANNAKETPLYLASERQNLQVVREILKKVKSPSYDGPNNQTALHAAVINQDIAMARDLLKNEHVRVAVKLADKKGWVPLHYAVKTRNAVLTKLLLKEDENTAYMQDNEGRTALHIAADSDSRRIVKMIIKYYPDCSEIVDNKGWNALHYAVNGGKQNTIRRIMRNLYLSNLYNEKDVDGNTPLHYLPNSNLVACHKLVGHPRVDKLAVNKKDQTVLDVAYVKTEDPDPESDKRTRE

SEQ ID NO: 122952 - protein, 82 aa, Glycine max
  Coding DNA Sequence Number=SeqID_6174
  Subcellular localization annotation: CTP_CleavageSite=48; ConfidenceScore=5.16e-01
ASIGGLVGACTLSVTLDRLARISEFRLSTRLLAERMNSSSALIGMSPRSSNTHNSSFFKIPPHAQPKECCAQQMARYASRLA

SEQ ID NO: 122953 - protein, 150 aa, Glycine max
  Coding DNA Sequence Number=SeqID_6175
MATPLNETREPEWKKAWTARNTLLSAPPLPILAIVGIVVFLLWVSSQLNNNVLLIHANSHNQRELVPLVFASVLTLIAQGTRLVLPAPSATRLHDEDVESSSMPWGWISNRLHLIFVIAIVFLLGVGFVVAGFEGPAPLGEEEKKKISSR

SEQ ID NO: 122954 - protein, 99 aa, Glycine max
  Coding DNA Sequence Number=SeqID_6176
GWAKASVSDFRVVHCGDEFYQGWAKAKFSFKPMASPATRNSINWSPPISGHLKCNLDAGFAHGTNITEMGCCVRNHVVALVASYMNSRSPCMDVKEGET

SEQ ID NO: 122955 - protein, 397 aa, Glycine max
  Coding DNA Sequence Number=SeqID_6177
  Gene Ontology: Mol. function=zinc ion binding; Cellular component =nucleus; Biological process=ubiquitin-dependent protein catabolic process
  Homolog annotation: Hit_ID=Q1S7F8; Match level="QueryCoverage=69%, HitCoverage=68%, E-value=3e-46, Identity=39%"; Hit description =Ubiquitin; Seven in absentia protein
  Pfam annotation: Domain name=Sina; Domain location=197-388; Score= -20.4; E_value=1.2e-05; Accession=PF03145.7; Description=Seven in absentia protein family
MVKISLGGYDDGEGPSNRTHKRRREEDDDDEEEEQQQQRSFEMVDPSIGTQEQEDHAAPPHDGSNSNANGAGTSSRDRSVPIFVSDPDVLDCCICYEPLAAPVFQVFLSLKFAFLFGFSYGIACECYFFSCLLGELILDGGKKGSYAFDLGIKAQPLGSDLGWLVVTMTCLKAHWALTDHPTTSNKCPMCLMPIGYNRCRAIEKVLECIKMSCPNANYGCKETFSYSRKNNHEKECIYLPCSCPLTGCDFVASSKELFLHFSHRHVGMGTRFAYDKFFTVFLSINQRTIVLQEKNDGNLFIVHNNHEHLGNIVRISCIGPKSMAEFQYEVLARHQGNALILQSFTKIVQGQYADAPSIVAGKVFVQSHWAELFIGLYGYCGNEMYFISSAFNWRILC

SEQ ID NO: 122956 - protein, 162 aa, Glycine max
  Coding DNA Sequence Number=SeqID_6178
  Homolog annotation: Hit_ID=Q8ZL02; Match level="QueryCoverage=65%, HitCoverage=93%, E-value=3e-37, Identity=76%"; Hit description =Putative outer membrane lipoprotein
  Pfam annotation: Domain name=DUF1375; Domain location=50-123; Score =124.3; E_value=3.3e-34; Accession=PF07119.2; Description=Protein of unknown function (DUF1375)
MGLQPGFSSMTTALFFALSCISHRLGQQHKGLNCDGCHSAGLSGYPFWIRLAITLSCSGVVLLCGCSSVMSHTGGKEGTYPGTRASAAMISDDDTNWGTKSLVILDMPFTAVADTLLLPWDLFRKGRLRALTGREKRAGKSGDKRRHSARKDAAALVLARFR

SEQ ID NO: 122957 - protein, 152 aa, Glycine max
  Coding DNA Sequence Number=SeqID_6179
  Gene Ontology: Mol. function=protein binding; Cellular component =integral to membrane; Biological process=defense response
  Homolog annotation: Hit_ID=Q0WX05; Match level="QueryCoverage=98%, HitCoverage=34%, E-value=1e-51, Identity=70%"; Hit description =Polygalacturonase inhibiting protein precursor
  Pfam annotation: Domain name=LRR_1; Domain location=47-69; Score=6.5; E_value=17; Accession=PF00560.23; Description=Leucine Rich Repeat
  Pfam annotation: Domain name=LRR_1; Domain location=71-93; Score =13.4; E_value=0.84; Accession=PF00560.23; Description=Leucine Rich Repeat
  Pfam annotation: Domain name=LRR_1; Domain location=96-118; Score =0.8; E_value=2e+02; Accession=PF00560.23; Description=Leucine Rich Repeat
  Pfam module annotation: Pfam domain module=LRR_1::LRR_1::LRR_1; Domain location=47-69::71-93::96-118
MKIVDLSRNMLEGDASVLFGSEKHTERIYLANNLFAFDLGKVRLSKTLGLLDVGHNLIYGTLPKGLTSLKDLYYLDVSYNNLCGEIPRGVSNFVRITFDLDLRNNRIYGTLPQGLATLKFLHHLNGGNLQRFDVSSYVNNMCLCGSPLPACT

SEQ ID NO: 122958 - protein, 527 aa, Glycine max
  Coding DNA Sequence Number=SeqID_6180
  Gene Ontology: Mol. function=protein kinase activity; Cellular component=integral to membrane; Biological process=protein amino acid phosphorylation
  Homolog annotation: Hit_ID=UPI000034EDBF; Match level="QueryCoverage =75%, HitCoverage=50%, E-value=6e-23, Identity=22%"; Hit description =ATP binding / protein binding / protein kinase/ protein serine/threonine kinase/ ...
  Homolog annotation: Hit description=protein-tyrosine kinase
  Pfam annotation: Domain name=LRR_1; Domain location=119-142; Score =4.3; E_value=44; Accession=PF00560.23; Description=Leucine Rich Repeat
  Pfam annotation: Domain name=LRR_1; Domain location=143-166; Score =13.6; E_value=0.72; Accession=PF00560.23; Description=Leucine Rich Repeat
  Pfam annotation: Domain name=LRR_1; Domain location=168-192; Score =9.1; E_value=5.7; Accession=PF00560.23; Description=Leucine Rich Repeat
  Pfam annotation: Domain name=Pkinase; Domain location=265-501; Score=- 95.5; E_value=0.0072; Accession=PF00069.15; Description=Protein kinase domain
  Pfam annotation: Domain name=Pkinase_Tyr; Domain location=278-501; Score=-160.0; E_value=0.012; Accession=PF07714.7; Description =Protein tyrosine kinase
  Pfam module annotation: Pfam domain module=LRR_1::LRR_1::LRR _1::Pkinase::Pkinase_Tyr; Domain location=119-142::143-166::168 -192::265-501::278-501
MVTISSTWYLFLPIILSLCPITLCASVLEDLKNLHQPPDFNSTIFSNCLKNPSLRYCSSSPMLDLDEIFKFTIVASHLCNESKNPNCVESFPKVDLRNRPNIAPLYLSFDFFWKYCPLSIMSIDLSNNSMKGDFPTDVLYCTQIQSLDLSINAFSGDIPIQSFSPLTNLTFLNLSYNCFSESKLSDSQFFKRFNSSSFLHSGALLDQKRFTVKAIFLLVGFPILVILMVICFLWLCFQRPDFLPSKLQRSRRFTPAILKAATNDFSNKYLVGKSDVVHIYKGILRDGTEVKIEMYWDDIPRDSYRKFVEECKVLSKLHHKNLVRFLGWCRSRKFRAIITEWTREENVEMWLSGSGPPWNHRLKVLMGVVACMRYLQEEWPEVDYELNTSSILLSDNVEPLISRFKVGDQNSNRRKIHGFGVFLLEMILSRKVQEEFDGGDAGFIRFMRTLNLADLKQMIDERMKVTETIFHQVKQALSLGLMCIDQSNSDKPSLAMIFNTIARAYKASHALPSANHRFKRHMPVQTK

SEQ ID NO: 122959 - protein, 314 aa, Glycine max
  Coding DNA Sequence Number=SeqID_6181
  Gene Ontology: Mol. function=methyltransferase activity; Cellular component=cytosol
  Homolog annotation: Hit_ID=Q10CT5; Match level="QueryCoverage=86%, HitCoverage=73%, E-value=6e-93, Identity=55%"; Hit description =AFR615Wp, putative, expressed
  Pfam annotation: Domain name=DUF858; Domain location=65-291; Score =437.4; E_value=1.9e-128; Accession=PF05891.2; Description=Eukaryotic protein of unknown function (DUF858)
  Pfam annotation: Domain name=Methyltransf_11; Domain location=128 -233; Score=32.0; E_value=2.1e-06; Accession=PF08241.2; Description =Methyltransferase domain
  Pfam annotation: Domain name=Methyltransf_12; Domain location=128 -231; Score=17.8; E_value=0.013; Accession=PF08242.2; Description =Methyltransferase domain
  Pfam module annotation: Pfam domain module=DUF858::Methyltransf _11::Methyltransf_12; Domain location=65-291::128-233::128-231
  Subcellular localization annotation: CTP_CleavageSite=35; ConfidenceScore=5.46e-01
MVYFLSSYSLLSTSTLGLTASYFSSFSFPSNSKIRCMDAGGLDSDGREFNTAEDMWREQAGDPSKKTQWYRDGVSYWEGVKANMDGVLGGFANVNEPDISCSEDFLNILLSERFPPAADARRQPLVALDCGSGIGRVTKNLLIRYFNEVDLLEPVSHFLETARETLASGCQTNSDMHKAVNFYCVPLQDFTPDTARYDVIWIQWCIGHLTDEDFVSFFKSAKVGLKAGGFFVLKENIARSGFVLDNEDRSVTRSDLYFKELFSRCGLHVYKSKDQKGFPEELFAVKMYALTTDPPKKAPRAKSKTSTNRPRTIM

SEQ ID NO: 122960 - protein, 53 aa, Glycine max
  Coding DNA Sequence Number=SeqID_6182
MEFLELKQGNMIVAEYAAKFEEVVRVFASFHSWLTCAGFGMKTLEIGRAIIGV

SEQ ID NO: 122961 - protein, 183 aa, Glycine max
  Coding DNA Sequence Number=SeqID_6183
  Homolog annotation: Hit_ID=Q47336; Match level="QueryCoverage=19%, HitCoverage=40%, E-value=2e-13, Identity=94%"; Hit description=LacZ -alpha peptide
AIGAGLFAITPAGERGMCCKAIKWGNARVFPVTTLNSIARADPVDRVRLNHADGRFPDPRATGQRFVDPPFASIPGHRRTCKAFAQLRHASSLSIPSTSRGGPVPAFVPFSEVGKPVVPAALMNRPTRGERRFAYWALAECILAYYVGTDEGVSEVLHVAEKKGCTGASAEYVIQDIFRFLAH

SEQ ID NO: 122962 - protein, 78 aa, Glycine max
  Coding DNA Sequence Number=SeqID_6184
  Subcellular localization annotation: CTP_CleavageSite=65; ConfidenceScore=5.30e-01
MVNVDSRTFPLHLMMKFMHFQRKGESGRASASKPHAKRKISALSTAGAFSQAKLETSLSPISLSRAKREGGAKCSVAI

SEQ ID NO: 122963 - protein, 336 aa, Glycine max
  Coding DNA Sequence Number=SeqID_6185
  Gene Ontology: Mol. function=protein binding; Cellular component =integral to membrane; Biological process=defense response
  Homolog annotation: Hit_ID=Q0WX04; Match level="QueryCoverage=95%, HitCoverage=95%, E-value=1e-180, Identity=96%"; Hit description =Polygalacturonase inhibiting protein precursor
  Pfam annotation: Domain name=LRRNT_2; Domain location=25-65; Score =51.9; E_value=2.1e-12; Accession=PF08263.3; Description=Leucine rich repeat N-terminal domain
  Pfam annotation: Domain name=LRR_1; Domain location=123-145; Score =11.4; E_value=2.1; Accession=PF00560.23; Description=Leucine Rich Repeat
  Pfam annotation: Domain name=LRR_1; Domain location=147-169; Score =13.5; E_value=0.75; Accession=PF00560.23; Description=Leucine Rich Repeat
  Pfam annotation: Domain name=LRR_1; Domain location=171-193; Score =1.5; E_value=1.5e+02; Accession=PF00560.23; Description=Leucine Rich Repeat
  Pfam annotation: Domain name=LRR_1; Domain location=196-218; Score =7.3; E_value=12; Accession=PF00560.23; Description=Leucine Rich Repeat
  Pfam annotation: Domain name=LRR_1; Domain location=219-240; Score =8.0; E_value=9.1; Accession=PF00560.23; Description=Leucine Rich Repeat
  Pfam annotation: Domain name=LRR_1; Domain location=266-288; Score =9.7; E_value=4.4; Accession=PF00560.23; Description=Leucine Rich Repeat
  Pfam annotation: Domain name=LRR_1; Domain location=290-311; Score =6.9; E_value=14; Accession=PF00560.23; Description=Leucine Rich Repeat
  Pfam annotation: Domain name=LRR_1; Domain location=72-96; Score=4.7; E_value=37; Accession=PF00560.23; Description=Leucine Rich Repeat
  Pfam annotation: Domain name=LRR_1; Domain location=98-121; Score =6.1; E_value=21; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=25 -65::123-145::147-169::171-193::196-218::219-240::266-288::290 -311::72-96::98-121
MSHLSILFLLLVALSFTPALSELCNPLDKQALLQIKRELGNPTNLSSWNPKTDCCNNNWVGVSCDTVTPTYRVDNLDLSEIYLTKPYPIPPSIGNLPYLKFLFITNSPNIVGTIPTTITKLTKLRELYIRYTSVSGQIPHFLSQMKTLQFLEFSNCKLSGNLPTWLPSLPDLYGVAFDNNRISGAIPDSFGFVSKRFGYMTLSGNRLSGKIPSSLGKLDLKTVDLSRNKLEGDASVLFGSEKRTEMIYLAHNLFAFDFGKVRVPKVLDSLDVGHNRLYGTLPKGLTSLKNLYRFDVSYNKLCGEIPRGGKLQEIDESFYANNKCLCGSPLPSCKRF

SEQ ID NO: 122964 - protein, 129 aa, Glycine max
  Coding DNA Sequence Number=SeqID_6186
  Gene Ontology: Mol. function=protein binding; Biological process =defense response
  Homolog annotation: Hit_ID=Q0WX04; Match level="QueryCoverage=79%, HitCoverage=36%, E-value=5e-33, Identity=74%"; Hit description =Polygalacturonase inhibiting protein precursor
MGYLAGDIGVSDVELTKLGEFGDGGGYCANDVGVVGDVKKFEAGKATYGGGNRVGFAEVKFGEVEVVDASVFGCHEERVVGLPSSFLIWSSVCLSCGLHSSESAREKDMTMSRRMLKRDIFEGILINSV

SEQ ID NO: 122965 - protein, 336 aa, Glycine max
  Coding DNA Sequence Number=SeqID_6187
  Gene Ontology: Mol. function=oxidoreductase activity; Cellular component=membrane; Biological process=electron transport
  Homolog annotation: Hit_ID=Q9SZ46; Match level="QueryCoverage=98%, HitCoverage=64%, E-value=2e-89, Identity=50%"; Hit description =Cytochrome P450-like protein
  Pfam annotation: Domain name=p450; Domain location=1-322; Score=16.6; E_value=9.9e-12; Accession=PF00067.12; Description=Cytochrome P450
MTFNTIVRMIAGKRFGGDTVNQEENEAWKLRKTIKDATYLFGTFVVADAIPSLSWFDFQGYLSFMKSTAKQTDLILEKWLEEHLRKRRVERDGGCESDFMDAMISKFEEQEEICGYKRETVIKATSMLLILTGSGSIAITLTWTLSLLLNHPKVLKAAQQELNTHIGKERWVLESDIKNLTYLHAIIKETLRLYPPAPLTGIREVMEDCCVAGYHVPKGTRLLINLWNLQRDPQVWPNPNEFQPERFLTTHQDIDFMSQNFELIPFSYGRRSCPGMTFGLQVLHLTLARLLQGFDMCPKDGVEVDMTEGLGLALPKEHALQVILQPRLPLELYECL

SEQ ID NO: 122966 - protein, 214 aa, Glycine max
  Coding DNA Sequence Number=SeqID_6188
  Subcellular localization annotation: CTP_CleavageSite=71; ConfidenceScore=5.33e-01
MHGLKLTERFKSTEVHAFGSSSSKTNCGNSSKALVAAATKPHNYLNRNKTMLPSWSKTKSRTTNNNSTSSVADLAPSVVCVVELATIAEEGSVNLTAERNFVVPTLHYNKIPLHYSSNLWACTITKHTLDAFTRIEVVGHNNSEKGNTVACSGATRCDTETKDGRQCTTPPSFGRGHDGATEMQANDRAHDEVTAEISDKRGGKLEREVGVFIN

SEQ ID NO: 122967 - protein, 101 aa, Glycine max
  Coding DNA Sequence Number=SeqID_6189
  Gene Ontology: Mol. function=protein binding; Biological process =defense response
  Homolog annotation: Hit_ID=Q0WX02; Match level="QueryCoverage=99%, HitCoverage=30%, E-value=1e-18, Identity=56%"; Hit description =Polygalacturonase inhibiting protein precursor
MIYLKDVFLRPEQHRHITHQHVLRQVHKIKDELRQCLQNPPSEAVVRESYQLEGLREGAEGVRDGGRDAVAIEGDSVEVGDQREPKREVSGEVVIEEDNGF

SEQ ID NO: 122968 - protein, 204 aa, Glycine max
  Coding DNA Sequence Number=SeqID_6190
VSTFDDLLPCIEKITLLFEEEDRILEAHEDAPPSQPQFEHQQFNILRQSVETRGLARRRETVDAATYSLPPMPERQHGMYYTPSTFTQKPSQMPPMYSYPHDFQPGYSFAGIFGSSPSSTETPSFTQSGQVSTPNAPLAGPWNVPGDIPDMDDLLGVDLRHDFSAEADQVDERANPRRRNPDRAARNWDRPCGTSSRHHRHSDD

SEQ ID NO: 122969 - protein, 224 aa, Glycine max
  Coding DNA Sequence Number=SeqID_6191
  Gene Ontology: Mol. function=sequence-specific DNA binding; Cellular component=nucleus; Biological process=regulation of transcription, DNA-dependent
  Homolog annotation: Hit_ID=Q9SA80; Match level="QueryCoverage=85%, HitCoverage=47%, E-value=9e-24, Identity=37%"; Hit description =Probable WRKY transcription factor 14
  Pfam annotation: Domain name=WRKY; Domain location=37-88; Score=61.4; E_value=3e-15; Accession=PF03106.6; Description=WRKY DNA -binding domain
MYHAYFYWMTKEGSKKTSTCGMISLVVFFPLFVTQCFGHSQLEVQKTTRGYYRCSSSKGCPARKQVERSRTDPNMLVITYTSEHNHPWPTHRNALAGSSRSQPSKNNNIAASKNEEEEEEESNSGSNNVNNSAFVREEEKQLEMDDGEFSDIGIPYCKPISKMKNSQQLDQGLLAELGEIEFADSVNLLSPPQGFDNQKRESNTLDSFHFFDWRGDNSTKYHLV

SEQ ID NO: 122970 - protein, 207 aa, Glycine max
  Coding DNA Sequence Number=SeqID_6192
MDNYQGDLSDIIRASGASYGTCSTGTPSSEAANPFSRGHLQFSSDPMIFSCVLEGFNSNFGDPFSNMRDPFLHELDLPPSAYFNITTSSSAEMSSSGALEEATCFGGGVVAGSSSSSSNSCVLAQKILEDDDMRRPCNSIFSNMIQISPNDKLPISPAVDALSRALKPSSMVISGDNMIDSKTSIDHCLVDNTEVQISSPRNPGLKR

SEQ ID NO: 122971 - protein, 261 aa, Glycine max
  Coding DNA Sequence Number=SeqID_6193
MVRVSPSSARRRNTREAHWCPRWYFSSQLKHSPRSRREAISSEVRRLNGGGGLGRGFGEGNRGFCLGEGEGKEDGEGERRGGFGEARGLGEGKGLVGLDFTADFRREAGNETANEEGGGNANDAVRDILKLRQDWERREARKREWQNLDICSSRNQNPLSLSPTTKQVSSKLKYQAKFLSRPLYIISQWVAVFVPPYQPLWSLIFVPHSLAQPLCLCSLCISFSRETLIATESQREHHYRKSRPLRRSATLATVSQSPEPP

SEQ ID NO: 122972 - protein, 207 aa, Glycine max
  Coding DNA Sequence Number=SeqID_6194
  Homolog annotation: Hit_ID=Q1SI74; Match level="QueryCoverage=52%, HitCoverage=52%, E-value=5e-45, Identity=77%"; Hit description =Ribulose bisphosphate carboxylase, large chain
  Pfam annotation: Domain name=DUF640; Domain location=5-132; Score =196.4; E_value=6.9e-56; Accession=PF04852.3; Description=Protein of unknown function (DUF640)
MSAAVAATAAAAMSVYQHSSSSRQEQHRDHELPLTPQRVCVSPPLSRGAHVLEFLRYLDQFGKTKVHAETCAYFGNSHPPGPCACPLRQAWGSLDALIGRLRAAFEENGGTPEMNPFGTRAVRLYLREVRDAQAKARGIAYEKKKRRNKPQHSGHDHHDEVMVNYSSGYGGGFVPQQQMLSDSNGTASTSDGVSYFSSSSSQCGGFN

SEQ ID NO: 122973 - protein, 1328 aa, Glycine max
  Coding DNA Sequence Number=SeqID_6195
  Gene Ontology: Mol. function=RNA-directed DNA polymerase activity; Cellular component=chromatin; Biological process=chromatin assembly or disassembly
  Pfam annotation: Domain name=Chromo; Domain location=1061-1109; Score= 34.6; E_value=3.5e-07; Accession=PF00385.14; Description='chromo' (CHRromatin Organisation MOdifier
  Pfam annotation: Domain name=RVP_2; Domain location=17-123; Score= -44.6; E_value=0.003; Accession=PF08284.2; Description=Retroviral aspartyl protease
  Pfam annotation: Domain name=RnaseH; Domain location=503-621; Score= -22.2; E_value=0.0068; Accession=PF00075.14; Description=RNase H
  Pfam annotation: Domain name=rve; Domain location=756-912; Score =86.1; E_value=1.1e-22; Accession=PF00665.16; Description=Integrase core domain
  Pfam annotation: Domain name=zf-H2C2; Domain location=697-738; Score =27.4; E_value=5e-05; Accession=PF09337.1; Description=His(2)-Cys(2) zinc finger
  Pfam module annotation: Pfam domain module=Chromo::RVP_2::RVT _1::RnaseH::rve::zf-H2C2; Domain location=1061-1109::17-123::242 -411::503-621::756-912::697-738
MAGHLAPKTLCFIATIASNDVVLLVDGGSSHNFIQQQLVTQLSLPCKTTTPLRVMVGNGNQLECNTICKDILVTIQAHNFHVDLYVLPISGANVVLGVQWLKSLGPVLKDYNTLLMKFFHNGGLITLQGDMDASLTSLSFFRRLSRKPDNAMYYHITLLPDLNSTTHPLPQPVQTLLDKFDSFFQPPKSLPPPRHTDHHIHLLPHAAPVNVKPYRYPHYQKREIEEQMDSMLQRGLIQPSTSLFSSPVLLVKKSDGSWRFCVDYRALNALTVRDRFPIPTIDELLDELGGACYFSKLDLLQGYHQIRMHPGDIPKTAFRTHHGHYEFKVMSFGLYNAPSSFQATMNQIFRPYLRQFIIIFFDDILVYSYSMDDHLHHLELTFQVLLANHFILKLSKCFFAQLQVEYLGHLVSRSGVEPLPSKITAIQQWPVPQTTKAVRSFLGLAGFYRRFIRGYATIAAPLVKATTVDPLQWTPETQLAFENLKQALSSAPVLALPDFSIPFTVETDASGVGMGAILSQKGHPIAFFSKPFSAKLLRSSTYVQELFAITAAIKKWRQYLLGHRFIILTDHRSLKELLTQAVQTPEQHMYLARLMGYDYQIMYRSGAHNQAADALSRAPVSPSTLYMILSVPCFTFLEELIQQLKLHDDYLRQRQNITTDPTNFEGFTLTEDFILFRNRIWLPRDLPIIPTLLREYHATPTGGHAGITKTLTRLSENFFWSGMRSDVSTFVANCFECQCTKYETKKKPGLLCPLPVLQQPWEDLSLDFITGLPPYQGHTVILVVVDRFSKGVHLGMLPTAHTAHAVASLFLNIVVKIHGPPRSLVSDRDPLFISNFWRELFRMSGTQLRMSSAYHPESDEQTEVINRVIELYLRAFVHRKPTSWGRLLPWAEYSHNTSWSSSTGTTPYEVTFGRKPFNFLTYLTGQSTIDTVDTILTDRDEVFHMIHKKLLKTQEAMKHKADLKRREVTYNPGDWVLLKLHPHRQVSAKGSEQVTNKLSKRFFGPFQVVERVGKVAYRLQLPPKAKLHPVFHCSLLKLFHGDPAVASNTFTSISFDQQRPVAPLVILATRRKGDALIEVLVQWQGLSPDDATWENWDTLRDEFHLEDKVLFHGPWNDTEEQTLQPTITEERATTMAANQENAEATEQRVPGSSKTSFLSQPRIRGQVESENLRDGGERECARRKHNRREKLIALTVRGEKERQIGRSKEAESERATARTVTPNFPDRLLPLFSPVIVGTQRASLMEQYEKVEKIGEGTYGVVYKGRDRVTNETIALKKIRLEQEDEGVPSTAIREISLLKEMQHRNIEFDPHVCVYGKISVVRGQPLK

SEQ ID NO: 122974 - protein, 111 aa, Glycine max
  Coding DNA Sequence Number=SeqID_6196
MHACGLITHLCLRSKLKVVGKHSANPHELVGVDIQGVDAEVVSSIDVVVDDYLLVLSIRLAFSAIRHLSSAAKEEGSPFGEPDLCNQYGLAYAALSMAVWNMLILKLQVLI

SEQ ID NO: 122975 - protein, 62 aa, Glycine max
  Coding DNA Sequence Number=SeqID_6197
MKNLMLEDTGTQRSDRMVSQKTNLKSVILKRLMIEFRVLPLRSKMKRDLLNLVENKERGGGI

SEQ ID NO: 122976 - protein, 83 aa, Glycine max
  Coding DNA Sequence Number=SeqID_6198
MAAEECRTSRDEHKLSGQVEPNEMMLSNTKVKTFQILSDFEDSSKRFMHGPCYHDYQHYLFCLDNNPKNSIVNNPSKFWLSKI

SEQ ID NO: 122977 - protein, 342 aa, Glycine max
  Coding DNA Sequence Number=SeqID_6199
  Gene Ontology: Mol. function=nucleic acid binding; Cellular component= intracellular
  Homolog annotation: Hit_ID=Q2Z1Y7; Match level="QueryCoverage=90%, HitCoverage=88%, E-value=1e-99, Identity=58%"; Hit description=Pm27 protein
  Pfam annotation: Domain name=DUF1644; Domain location=48-211; Score =363.6; E_value=3.1e-106; Accession=PF07800.3; Description=Protein of unknown function (DUF1644)
MAKGSRGRHRIASRQFRVTPYPLASCKRDICEDLCQNKCSKALEKKEWEDVTCSVCMEYPHNAVLLLCSSHDKGCRPYMCGTSFRHSNCLDQYKKAYTKAISPNRQPMQGTPGLLQDSNMHLEKSESTELACPLCRGQVKGWTVVEPVRDYLNAKKRGCMQDDCSFVGNYKELKKHVRAEHPSARPRMVDPADEQKWRWLEWEREREDVISTVTSAMPGAVVFGDYVIEGHHNDFDTDEEEGAGNAERNGRFQMGLEAMNFFLLLHAVRQGNELNNLGRRLRPELTHNRVAGQNAAAVLDISDEDNDNDGSRLHRHGGGRVLLGRSGRRRRCREARARIGDS

SEQ ID NO: 122978 - protein, 500 aa, Glycine max
  Coding DNA Sequence Number=SeqID_6200
  Gene Ontology: Mol. function=DNA binding; Cellular component=beta -galactosidase complex; Biological process=DNA integration
  Homolog annotation: Hit_ID=Q1SLU3; Match level="QueryCoverage=98%, HitCoverage=34%, E-value=1e-166, Identity=59%"; Hit description =Integrase, catalytic region
MKAELQALQSNDTWRLTPLPPHKTAIGCRWIYKIKHRADGSIERYKARLVAKGYTQMEGLDYLDTFSPVAKLTTVRLLLALAALNQWHLRQLDVNNAFLHGELDEEVYMQVPPGLSVPNSQMVCRLQHSLYGLKQASRQWFTKLLGLLTSHGFKQSHSDHSLFLCFTGSITTILLVYVDDIILTGNSDSEIQDVIMLLDQTFKIKDLGNLKYFLGLEIARSSSGIHLCQRKYALDILSDSGMLGCRPNATPMDYSTKLQAATGTPLSAEASSSYRRLVGRLIYLTNTRPDITYAVQQLSQYMSSPTSAHLQAAYRVLWYLKGTPGSGIFLSATGTPQLRAFSDSDWAGCQDSRKSTTGFMVYLGSSLISWQSKKQSTVSRSSSEAEYRALASTTCELQWWTYLLQDFRLKFTKPATIYCDNQSTIQISINPVFHERTKHIEIDCHIVRQKVTMGLLKLLPVSSSLQLADIFTKALPPTIFQNLCNKLGMMNIHSNLRGGS

SEQ ID NO: 122979 - protein, 384 aa, Glycine max
  Coding DNA Sequence Number=SeqID_6201
  Gene Ontology: Mol. function=DNA binding; Cellular component=beta -galactosidase complex; Biological process=DNA integration
  Homolog annotation: Hit_ID=Q1SS72; Match level="QueryCoverage=98%, HitCoverage=27%, E-value=3e-74, Identity=36%"; Hit description =Integrase, catalytic region
  Pfam annotation: Domain name=zf-CCHC; Domain location=135-152; Score =11.3; E_value=0.014; Accession=PF00098.13; Description=Zinc knuckle
  Pfam annotation: Domain name=zf-CCHC; Domain location=171-188; Score =12.1; E_value=0.0098; Accession=PF00098.13; Description=Zinc knuckle
  Pfam module annotation: Pfam domain module=zf-CCHC::zf-CCHC; Domain location=135-152::171-188
YSQGDLLRIFDLQQEASTLRQGALSVTKYFTWLRVIWDEIENFRPNPVCTCNIRCSCSAFAIIAQRKLEDRAMQFLRGLNEQYINIRSHVLLMDPIPAISKIFSYVVQQERQLLGNSSPNLNFEPKDVSINATKTICDHCGRIGHTKNVCYKKHGMPLNHEARNKSMGGRKTCTHCGKIGHTIDVCYRKHGYPPGYKPYNGRPTVNNVTMMDSKPLEDQNQHHESQDLVRFSLEQYKALLTLIQQSSGGNTTLEQTKQVASISSCAIDKPSSPGMFQPFTSSWILDSGATDHVTCSLNNLHSYERINPVTVMLPNGNHVHATHSGTVHLSRTITLFNVLYIPTFTFNLISISKLVSSTNCALIFSSTSCMLQDASNRMKIGIVE

SEQ ID NO: 122980 - protein, 500 aa, Glycine max
  Coding DNA Sequence Number=SeqID_6202
  Gene Ontology: Mol. function=protein serine/threonine kinase activity; Cellular component=membrane; Biological process=protein amino acid phosphorylation
  Homolog annotation: Hit_ID=Q7XTK4; Match level="QueryCoverage=93%, HitCoverage=94%, E-value=1e-107, Identity=63%"; Hit description =Putative mitogen-activated protein kinase 1
  Pfam annotation: Domain name=Pkinase; Domain location=226-480; Score =291.8; E_value=1.3e-84; Accession=PF00069.15; Description=Protein kinase domain
  Pfam annotation: Domain name=Pkinase_Tyr; Domain location=226-480; Score=145.4; E_value=1.5e-40; Accession=PF07714.7; Description =Protein tyrosine kinase
  Pfam module annotation: Pfam domain module=Pkinase::Pkinase_Tyr; Domain location=226-480::226-480
  Subcellular localization annotation: CTP_CleavageSite=56; ConfidenceScore=5.45e-01
MDWRRRTKNKKHHPPPPPQPQPQPQPRLERLNAKKGINYQPPPSPPSPSSSSASVSSSSLLDHQTSFRLFGFDGEFDRIFQTLGLSGPEDFSIPTADWEARKARLSGPTTPPPPPPPPHALPTSLQDDAVSLPVAVSSSSPWSSGEHNVGTRGSVGRLNLRHGERSVLFTDSSSFTTSHDDDSDVGCERERERERACLAPNSAPADELVIPFNSSGEWFRQTFTSWQKGDVLGNGSFGTVYEGFTDDGFFFAVKEVSLLDEGSQGKQSFFQLQQEISLLSKFEHKNIVRYYGSDKDKSKLYIFLELMSKGSLASLYQKYRLNDSQVSAYTRQILSGLKYLHDHNVVHRDIKCANILVDVSGQVKLADFGLAKATKFNDVKSSKGSPYWMAPEVVNLKNQGGYGLAADIWSLGCTVLEMLTRQPPYSDLEGMQALFRIGRGEPPPIPEYLSKEARDFILECLQVNPNDRPTAAQLFGHPFLRRTFLSPLSFASPHRNIYRL

SEQ ID NO: 122981 - protein, 44 aa, Glycine max
  Coding DNA Sequence Number=SeqID_6203
MVVSNTIVAIGCVDLLVIVMSKFNMGLSIFHGDKHKKTLSRVKG

SEQ ID NO: 122982 - protein, 188 aa, Glycine max
  Coding DNA Sequence Number=SeqID_6204
  Gene Ontology: Mol. function=chitin binding; Cellular component =extracellular region; Biological process=chitin metabolic process
  Homolog annotation: Hit_ID=UPI0000612705; Match level="QueryCoverage =83%, HitCoverage=91%, E-value=8e-14, Identity=30%"; Hit description =UPI0000612705 related cluster
MSKSCGFGMTGPLDESISSFLIRVDPGLLVPITFRGLHVLANRGLHALTFRGLHVLALRGLHALTLGLHVLANRGLHALTLRGLHVLALEGYLPSPLRGLHVLALRGLHILTFRGLHVLAIRGLHVLAIRGLHALTSRGLPVLALRGLHALTLGTSYPRLERTTRPHHERAARPHLQRTISPRLERAT

SEQ ID NO: 122983 - protein, 103 aa, Glycine max
  Coding DNA Sequence Number=SeqID_6205
MSWFLHHEVIWWPKRARGLPGRARVQENNGKDPFALFLAEVEHQLRASMDCGDGLLICLVNVYPLMFLKDICIMGTAWGTSIFAGTPSSFQKHRKYPYGYFRL

SEQ ID NO: 122984 - protein, 60 aa, Glycine max
  Coding DNA Sequence Number=SeqID_6206
MSCRRGVRPSSARSSGSAYAQALTKNAGLGWKQSQGALGISRFELKQLRENCMLRECGPH

SEQ ID NO: 122985 - protein, 79 aa, Glycine max
  Coding DNA Sequence Number=SeqID_6207
  Homolog annotation: Hit_ID=Q53KU9; Match level="QueryCoverage=78%, HitCoverage=7%, E-value=6e-08, Identity=50%"; Hit description =Probable protein kinase [imported]-Arabidopsis thaliana
MGSSLRCSFGVVVLESVSGLKAVDFRQLEVLLVKKVHQFEVTKSPLEALVDMGLNGEYNLKELMTLVSLGAEHGREHGE

SEQ ID NO: 122986 - protein, 177 aa, Glycine max
  Coding DNA Sequence Number=SeqID_6208
  Gene Ontology: Mol. function=DNA binding; Cellular component=nucleus; Biological process=regulation of transcription
  Homolog annotation: Hit_ID=Q1SZA2; Match level="QueryCoverage=89%, HitCoverage=47%, E-value=1e-73, Identity=81%"; Hit description=No apical meristem (NAM) protein
  Pfam annotation: Domain name=NAM; Domain location=11-141; Score =281.3; E_value=1.9e-81; Accession=PF02365.6; Description=No apical meristem (NAM) protein
MDKDANSKIQLPPGFRFHPSDEELIVHYLRNKVTSSPFPTSFIAEIDLYNYNPWELPSLCKALFREDEWYFFTPRDRKYPNGVRPNRAAASGYWKAIGTDKPIFTSCGIKSIVVKKALVFYKGRPPKGSKTDWIMHEYRLHDSTISNSKQGGSMRVGQFHEFNFSIWWFLMTNSVNY

SEQ ID NO: 122987 - protein, 437 aa, Glycine max
  Coding DNA Sequence Number=SeqID_6209
  Homolog annotation: Hit_ID=Q9FIY7; Match level="QueryCoverage=17%, HitCoverage=6%, E-value=1e-08, Identity=62%"; Hit description =Putative SWI/SNF-related matrix-associated actin-dependent regulator of chromatin subfamily A member 3-like 3
MASLEEEMDEEEEVESSPVPPMQKKAQPKKKAVIGDDVETVEVQKPVEKRNIPNILNLEEGEFLEECRWFLLGKKVEVAVSTARRVSRLVDNEIVHFNFPCRSYPSKSQWIVRASTKCYGEDMTKSKGKDPLEGLGGPMTRARARKAKEALQQVLSILFEYKPKFQGEKSKANPDEASALPLIKRRKGGEPIVEQNNDEQALLESALTKLVGAAKIYNLRIENLVFQLQFLSSNLSLVSLVINPFASYMSLGEGLPDELTTMKFDSLGSSDVDALTFTSLYLQIIELLVDVWDDLLPAKRLYAQGMGKLEFKLGKLDRRVKELISRLSTLYLRVESMLKESSALPSNSVVELGKVFSSTSINGASCRKGWILRVQKEIYIPAGQPTLCNRTIYVNIFTGEVSKKLPKAMQMARGVSKCNGTWKDCYDNCFDTPYRRQ

SEQ ID NO: 122988 - protein, 140 aa, Glycine max
  Coding DNA Sequence Number=SeqID_6210
MFDVCPLCVKAAFEKFYRKPTKFIGNIFLCHFAITIPPLPMSLRYGDLGFTIVHELTLRIDNFGIRLKKKERYRPKLSYSSAGFKKKTEANNPRPETRTACLAMMSFLGAENSTALATLQGFDSKPTVSEYMLPHNAHMP

SEQ ID NO: 122989 - protein, 64 aa, Glycine max
  Coding DNA Sequence Number=SeqID_6211
MTLITLTWMWMLGGCGTANNYSEKEHIERREGEALSGEVGAKGGSGGEEVVVLRHSGVGAAARQ

SEQ ID NO: 122990 - protein, 460 aa, Glycine max
  Coding DNA Sequence Number=SeqID_6212
  Gene Ontology: Mol. function=transferase activity; Cellular component= nucleus; Biological process=regulation of transcription
  Homolog annotation: Hit_ID=Q1SV87; Match level="QueryCoverage=70%, HitCoverage=79%, E-value=7e-76, Identity=35%"; Hit description =Pentatricopeptide repeat
  Pfam annotation: Domain name=PPR; Domain location=149-183; Score =43.5; E_value=7.2e-10; Accession=PF01535.11; Description=PPR repeat
  Pfam annotation: Domain name=PPR; Domain location=184-218; Score =10.2; E_value=0.46; Accession=PF01535.11; Description=PPR repeat
  Pfam annotation: Domain name=PPR; Domain location=220-254; Score=6.3; E_value=1.3; Accession=PF01535.11; Description=PPR repeat
  Pfam annotation: Domain name=PPR; Domain location=286-320; Score=6.3; E_value=1.3; Accession=PF01535.11; Description=PPR repeat
  Pfam annotation: Domain name=PPR; Domain location=48-82; Score=40.6; E_value=5.4e-09; Accession=PF01535.11; Description=PPR repeat
  Pfam module annotation: Pfam domain module=PPR::PPR::PPR::PPR::PPR; Domain location=149-183::184-218::220-254::286-320::48-82
MEEASKLFREMPSPDVLSWNSIISGLAQKGDLNLAKDFFERMPHKNLISWNTIIAGYEKNEDYKGAIKLFSEMQLEGERPDKHTLSSVISVSTGLVDLYLGKQLHQLVTKTVLPDSPINNSLITMYSRCGAIVDACTVFNEIKLYKDVITWNAMIGGYASHGSAAEALELFKLMKRLKIHPTYITFISVLNACAHAGLVEEGWRQFKSMINDYGIEPRVEHFASLVDILGRQGQLQEAMDLINTMPFKPDKAVWGALLGACRVHNNVELALVAADALIRLEPESSAPYVLLYNMYANLGQWDDAESVRVLMEEKNVKKQAGISISTRCQIMPLLEMLAFNLTMLILSDRKNDLDCFPVSTVRDFNLGWLEDWRSNFKSQPFHQFRYAEYHDIGPRMECFGLSSEKAEVARGAWYKVTLTGLHNILKLSGTISLLKEIHEAYLEMRRGFFNVNLSLKFEEH

SEQ ID NO: 122991 - protein, 229 aa, Glycine max
  Coding DNA Sequence Number=SeqID_6213
MEVVRKFDYSPFQISWEEGDRDYGDGNPIVVSSSSEKSKVKTGQQQYPFSHSRRPNHSLHGAHLNLDIQKISSGNSLNVSTSRELNGVSSASKDNLSPNSRVVLSPVGATRSTSISAPSRSLSNNSTPSAWITLEKRPTFPIQSRNDFFKNLSRKSSVEKPCSDVLPIDMSCALEKSEASTRSVSSCPILESRDASLVDTSAVNMLTDYGSTITENGNAANEPLKLSSS

SEQ ID NO: 122992 - protein, 118 aa, Glycine max
  Coding DNA Sequence Number=SeqID_6214
  Subcellular localization annotation: CTP_CleavageSite=79; ConfidenceScore=5.03e-01
MTLSSWQNKLDKYFMCKTLVMKGGAWIMASPHASPPPPLPPPSDALALPSSMKWTRKASRLRSLSTRPPDAERPVVHVNPATGKADGPHRKKLRIYLGIVARDKVDVTFENWKEVPTA

SEQ ID NO: 122993 - protein, 203 aa, Glycine max
  Coding DNA Sequence Number=SeqID_6215
MEGSDHSLVPQWLKGSGNDSRVAGINNQFTSSPYSDHIAYSGRQWSSSSKGLGHSRSYSSSERSWQDTDWEKVDGNGLTSVSHDILMTVGSSIKAMTMHQYNVSTSTSSITLGTMGLSMAETLAQGPPRSHSPQNFSTLMVYFSLQLSASTQKLEELALKQSRLLIPVTPSTPRSLGFMCNRKFHGTSICGIMIDVPPENLLN

SEQ ID NO: 122994 - protein, 945 aa, Glycine max
  Coding DNA Sequence Number=SeqID_6216
  Gene Ontology: Mol. function=DNA binding; Cellular component=beta -galactosidase complex; Biological process=DNA integration
  Homolog annotation: Hit_ID=Q1S1E0; Match level="QueryCoverage=99%, HitCoverage=83%, E-value=0.0, Identity=39%"; Hit description =Integrase, catalytic region
  Pfam annotation: Domain name=zf-CCHC; Domain location=65-82; Score =9.5; E_value=0.027; Accession=PF00098.13; Description=Zinc knuckle
  Pfam module annotation: Pfam domain module=RVT_2::zf-CCHC; Domain location=444-700::65-82
MQFLRGLNEQYNNIRSHVLLMDPIPTIPKIFSYVAQQERQLTGNNSLPSFNLETKEDPSINAVKSVCEFCGRIGHNESVCYKKHGVPPNYDGKGKGKLGYTIDVCYKKHGYPPGFKFNNGKVIANNVVAVEGKATNDQIQRQEYQELVRFSPEQYKAFLALIQQPSAGNSTSTKPRVASISSCSSNDATGITLSYEKANSTSWILDSGATDHVSSSLTNFHSYHQINPITVRLPNGHLVHATHSGTDTNTKARIGIAEVSRGLYQFTPETTKPHTICSAITHPKCKVIPINLWHFRMGHPSLESTLQNHRQKLDPRAHPCIFLGFKPHTKGYLVYNLHSHNITASRNIVFYEDHFPLLHEHQDSNNTHTRISPTLFSNNTEILDTIITPTINLNNPTPLTIPTINSLSSPTHNPNLRRSTRTRHPPTYLQDFHHALTSLADTTSTKVELKALQQNQTWILTTLRPHKTAIGCRWVYKIKHSVDGTIERYKARLVAKGYTQMEGLDFLDTFSPVAKLTTVRLLLALAALHNWHLRQLDVNNAFLHGDLNEEVYMKLPPGLIVDNPNLVCRLQHSLYGLKQASRQWFTRLSSFLLSQGFRQSSVDHSLFLYSDNDNDITAILVYVDDIILTGNNLETIAHVTKLLDQTFSIKDLGILKFFLGLEVARSSHGIHLCQGKYVLDILSDSGMLGSRPTSTPMDYSTRLSASMGTPLSETSASSYRRLIGRLIYLTNTRPDIAHAVQQLCQYMANPTSTHSQAAFQVLRYLKGTPGFGIFFAAQGTLTLKAFSDSDWAGCRDTRRSIIGFSVYLGESLISWRSKKQSTASRSSPEAEYRALASTTCELQWLTYLLHDFRVPFLQPATLYCDNQSAIQIASNPVFHERTKHIEIDCHIVRDKVNKGLLKLLPVSSSMQLADIFTKPLSPALFHGLCSELGMMNIHSQLAGGS

SEQ ID NO: 122995 - protein, 242 aa, Glycine max
  Coding DNA Sequence Number=SeqID_6217
  Gene Ontology: Mol. function=transferase activity; Biological process= protein metabolic process
  Homolog annotation: Hit_ID=Q9SJA2; Match level="QueryCoverage=99%, HitCoverage=35%, E-value=5e-76, Identity=55%"; Hit description =Putative glucosyltransferase
MAPSFDFSNRWMKETQKSTPVVVTMENPTFSVVEINGVDAAFRPVEKTRSKNAKQVTWFLFLKAYHAIGCVTWFATVLWSLMGAKRKRLIDREGVTLESEKMEKGKVLFTVIKVFLVSSLVVLVFEVVAYLQGWHFGNPSLHIPRAADLEGLMHLVYVAWLRFRGEYIAPPMQALSKFCIVLFLIQSVDRMVLCFGCFWIKYKRIKPKIDGDALKVDDIEGSACSHPMVLVQIPMCNEREIW

SEQ ID NO: 122996 - protein, 222 aa, Glycine max
  Coding DNA Sequence Number=SeqID_6218
  Gene Ontology: Mol. function=binding; Cellular component =intracellular; Biological process=mRNA editing
  Homolog annotation: Hit_ID=Q2QTL4; Match level="QueryCoverage=99%, HitCoverage=77%, E-value=6e-33, Identity=33%"; Hit description =Pentatricopeptide, putative, expressed
  Pfam annotation: Domain name=PPR; Domain location=134-168; Score=5.7; E_value=1.6; Accession=PF01535.11; Description=PPR repeat
  Pfam annotation: Domain name=PPR; Domain location=171-205; Score =24.1; E_value=0.0005; Accession=PF01535.11; Description=PPR repeat
  Pfam annotation: Domain name=PPR; Domain location=7-41; Score=35.6; E_ value=1.7e-07; Accession=PF01535.11; Description=PPR repeat
  Pfam annotation: Domain name=PPR; Domain location=72-106; Score=36.8; E_value=7.6e-08; Accession=PF01535.11; Description=PPR repeat
  Pfam module annotation: Pfam domain module=PPR::PPR::PPR::PPR; Domain location=134-168::171-205::7-41::72-106
MKRRDTVTWNSMISGYVQRREIARARQLFDEMPRRDVVSWNLIVSGYFSCCGSRFVEEGRRLFELMPQRDCVSWNTVISGYAKNGRMDQALKLFNAMPEHNAVSYNAVITGFLLNGDVESAVGFFRTMPEHDSTSLCALISGLVRNGELDLAAGILRECGNGDDGKDDLVHAYNTLIAGYGQRGHVEEARRLFDVIPDDDDDGNEGNSLIGWWSGITVLGTL

SEQ ID NO: 122997 - protein, 134 aa, Glycine max
  Coding DNA Sequence Number=SeqID_6219
  Gene Ontology: Mol. function=transcription factor activity; Cellular component=nucleus; Biological process=regulation of transcription, DNA-dependent
  Homolog annotation: Hit_ID=Q1SQ04; Match level="QueryCoverage=94%, HitCoverage=33%, E-value=2e-15, Identity=41%"; Hit description =Pathogenesis-related transcriptional factor and ERF
  Pfam annotation: Domain name=AP2; Domain location=70-132; Score=-7.2; E_value=0.0036; Accession=PF00847.10; Description=AP2 domain
MVMMKENIIEVRLGRSQMSMVEGEFQGTWGVKRRQREVAAAASSGDDNHHQQLPQQEVGENSSISTTKRSSRLRGVNSSLVGQTLLEHNTEEEREARCYFLNIAGAYDEEESATLKYWGNSTFTNFPHLTAADG

SEQ ID NO: 122998 - protein, 101 aa, Glycine max
  Coding DNA Sequence Number=SeqID_6220
  Subcellular localization annotation: CTP_CleavageSite=40; ConfidenceScore=5.14e-01
MTEPINALLLRVKSRAVARAQPPTAVAAATGGPSGATGCRANHQAAAVRCSRTIFQKQKNNEKKGTVVPTLVKVKQRYKDVDDYIATYESLVFEEAKSQII

SEQ ID NO: 122999 - protein, 89 aa, Glycine max
  Coding DNA Sequence Number=SeqID_6221
MQLCSLSTIAREYLAVRTISCLPYKDLILNAVGENFGTEAEGWKIPIPLREYVESAFNQYQREAITAGLSSKVFVLIQVIFDVMFIGVC

SEQ ID NO: 123000 - protein, 310 aa, Glycine max
  Coding DNA Sequence Number=SeqID_6222
  Gene Ontology: Mol. function=endonuclease activity; Cellular component=nucleus; Biological process=tRNA processing
  Homolog annotation: Hit_ID=O23408; Match level="QueryCoverage=84%, HitCoverage=38%, E-value=2e-52, Identity=42%"; Hit description=SEN1 like protein
MAKILLRRLGLSFPLELEVLEMRRIIQPEEGVTSLSERGGLCEERIRSFPSREFYEDSLEDGDEVKSRAIHAWHDYRCFGPFCFFDIHEGKEARPPGSGSWINVEEVDFVLFLYQKLISLYPTLKSGNQVAIISPYSQQVKLFQKRFEDTFGMSAEKIVDICTVDGCQGREKDIAIFSCVRASKDKGIGFVEDIRRMKVGITRAKSAVLVVGSASTLRRSEQWNKLVENAEKRNCFFKVSQPYSSFFSDESLTSLQTKVAEPSQVTGPVDTLDNDVQSDNAAAFDVQAQAEDNDDGEGDVGMNDACFDDD

SEQ ID NO: 123001 - protein, 79 aa, Glycine max
  Coding DNA Sequence Number=SeqID_6223
MMKKKGPVEDPDSSRQASTTPCRVSSRLLFDFNCHQTTLAGGDEGGDIDVGDGDKGGVMTIDLDHPSGGGGRVGQEWGW

SEQ ID NO: 123002 - protein, 379 aa, Glycine max
  Coding DNA Sequence Number=SeqID_6224
  Gene Ontology: Cellular component=nucleus; Biological process =regulation of transcription, DNA-dependent
  Homolog annotation: Hit_ID=Q1SAU7; Match level="QueryCoverage=70%, HitCoverage=40%, E-value=3e-30, Identity=36%"; Hit description =Paired amphipathic helix
  Pfam annotation: Domain name=PAH; Domain location=107-153; Score =51.6; E_value=2.7e-12; Accession=PF02671.11; Description=Paired amphipathic helix repeat
  Pfam annotation: Domain name=PAH; Domain location=193-233; Score=0.8; E_value=4.7; Accession=PF02671.11; Description=Paired amphipathic helix repeat
  Pfam module annotation: Pfam domain module=PAH::PAH; Domain location =107-153::193-233
  Subcellular localization annotation: CTP_CleavageSite=37; ConfidenceScore=5.31e-01
MVGLDKSRTSFSSQVFHSLRIQRKITLCLSPTSGVVQLGKVAHESQPGSEIFRSLTLTGKLKTHSIEAAALSTRSERNRRGAKKQRPMADSALAYLSTVKDAFKDDREKFDKFLELMKNFTADRFNLVSGIEEVKELLKGHRDLIFGFNVFLPKGFEIKLPLEDEQPPQKKLDVFVEAKKIMHKIETRFHGQDNVYKAFLAILKMHKDGNRTPLQLTRRLESDLSEWEKDYRDYYQDGIQKLLSLKWRYGCMVRPFCNADEHFGMHPMSCTCSDQSSKKSGERFAFCAKVKDKVQNPKNYFSKHVGIYSKEKITQQELQLWATDFLRVYPDLMKGFNECVTQCKKMNEEVYVGSVKKSNLTFSATSGTKTHGFIRILEG

SEQ ID NO: 123003 - protein, 104 aa, Glycine max
  Coding DNA Sequence Number=SeqID_6225
MKGWKVPLAGNRKCKSILRFTASNFRTKKMFLGLEGFPNHTENATDVQDGMDRLSKLLDDISSVHNEAVPISINYTLLDDQREGVRFLHGFLNNDHGGILGDNM

SEQ ID NO: 123004 - protein, 108 aa, Glycine max
  Coding DNA Sequence Number=SeqID_6226
MVFLSQRFKNRIKVLSWLQDWNNNNNNNNPLMKNIGGEGRNKRILRTLWVNKAMEMELTSLSLSQAKEEPEVIVISFDGELEEKPTVKGKIYQEECQSLQFSPIYYKQ

SEQ ID NO: 123005 - protein, 172 aa, Glycine max
  Coding DNA Sequence Number=SeqID_6227
  Gene Ontology: Cellular component=ribonucleoprotein complex; Biological process=rRNA processing
  Homolog annotation: Hit_ID=Q8S1Z1; Match level="QueryCoverage=86%, HitCoverage=60%, E-value=2e-33, Identity=51%"; Hit description =Probable U3 small nucleolar RNA-associated protein 11
  Pfam annotation: Domain name=Utp11; Domain location=1-152; Score= -28.8; E_value=4.1e-07; Accession=PF03998.4; Description=Utp11 protein
SEANKYTQQELMLMKTQDMGYILQKIQSERNKIERLTASLHSIDKQPVNKHVLFAEEREEAKELESQYQKSKIPFTSEDIPAGIKRKTAQSYQELEARRSRLNQLEKIYMDMAMQKELQNAEKGYSIYEQKKGRKRKLGEDEIVCPTSKPLKNLHVLDEAPTLLAAASNVLH

SEQ ID NO: 123006 - protein, 283 aa, Glycine max
  Coding DNA Sequence Number=SeqID_6228
  Gene Ontology: Mol. function=zinc ion binding; Cellular component =integral to membrane; Biological process=defense response to bacterium
  Homolog annotation: Hit_ID=Q1S7E5; Match level="QueryCoverage=87%, HitCoverage=89%, E-value=8e-85, Identity=66%"; Hit description=MtN3 and saliva related transmembrane protein
  Pfam annotation: Domain name=MtN3_slv; Domain location=12-100; Score =120.1; E_value=6.3e-33; Accession=PF03083.6; Description=MtN3saliva family
  Pfam annotation: Domain name=MtN3_slv; Domain location=134-220; Score= 138.9; E_value=1.4e-38; Accession=PF03083.6; Description=MtN3saliva family
  Pfam module annotation: Pfam domain module=MtN3_slv::MtN3_slv; Domain location=12-100::134-220
MAIFNGHNHLALGFGMLGNVISFMVYLAPLPTFYRIYKKKSTEGFQSLPYLVALFSSMLWLYYASLKPADATLLITINSLGCVIEIVYIIMFTIYATKDARNLTVKLFMVMNVGSFALIFLVTYFAMHGSLRVQVVGWVCVSIAVGVFAAPLSIVAQVIRTKNVEFMPFNLSLFLTISAVMWFFYGLLLKDICIAIPNILGFTLGLLQMLLYAIYRNGKTNNKEVVTKEEHALEAMKNVVVVNPLGTCEVYPVIGKEINNNGQGIEGAEEKEKGVELGKECPV

SEQ ID NO: 123007 - protein, 131 aa, Glycine max
  Coding DNA Sequence Number=SeqID_6229
MKDFWGLHMPLVCPDGTVVAYAWKRQLTGQVGASTIDRTRWKLGDLEKRTCQVLCRLRDEGDEAKETLKEVLSQNSSKQYDSDFANTCESFVETVQRAFPLSDKLMLNVKKAYKEAKGTFSAKARAKREDV

SEQ ID NO: 123008 - protein, 217 aa, Glycine max
  Coding DNA Sequence Number=SeqID_6230
  Gene Ontology: Mol. function=transferase activity, transferring glycosyl groups; Biological process=metabolic process
  Homolog annotation: Hit_ID=Q8S9A3; Match level="QueryCoverage=51%, HitCoverage=31%, E-value=1e-14, Identity=40%"; Hit description =Glucosyltransferase-6
MAKTTHIAIISSPGFSHLVPIIEFSNQLVKHHQNFHVTCITPSLAPSNFASAAYLETENEDPLKFLPSGCLERTKEKGLVVASWAPQPLWLELDFGECARGSASKIAWPLFAEQNMNAVMLVDSLKGKKGQSNLEARNQVIQLSPTISVQEGVPLIPCSLFADHDPMSLIIFKTAAYLCDWNLILESVQEGVPLIPWSLFAEQKMNAVMLVDGLKVG

SEQ ID NO: 123009 - protein, 80 aa, Glycine max
  Coding DNA Sequence Number=SeqID_6231
  Gene Ontology: Mol. function=transferase activity, transferring glycosyl groups; Biological process=metabolic process
  Homolog annotation: Hit_ID=Q8S996; Match level="QueryCoverage=77%, HitCoverage=11%, E-value=2e-10, Identity=56%"; Hit description =Glucosyltransferase-13
MYLKFNENDIVEKEEIAKVIKCLMEGEEGKGIGERMMNLKHYAANALKDGPSTQNLSQLASHWEYLEQNRGFSRVSINWI

SEQ ID NO: 123010 - protein, 448 aa, Glycine max
  Coding DNA Sequence Number=SeqID_6232
  Pfam annotation: Domain name=DUF793; Domain location=64-447; Score =641.3; E_value=7.8e-190; Accession=PF05633.2; Description=Protein of unknown function (DUF793)
MKLDKFLRLFEHMGIFVRDQGSKTETGKFNAAVSEGSHVISVVLVRFIADLEEAFAEVCDSVTMPSTENQGSSSSFSSFGRSIFGARQEQVHSVEASNESDSCNLELGLFQKHVTDRFQVLSAASDEEFLSIDWIQKLLGAFISCQEEFRAILLNNKEQVTKPPFDRMISEFFERSVKALDICNASRDGIEKIRTWQKHLEIVFCALGSSKRALTEGHFRRARKALMDLALATLDEKESGSVFSQRNRSFGRHNSSKDHHSSSGHSRSHSWSVSRSWSAAKQLQSIANNLVSPRATEIAAASGLVIPVYTINCILLIVLWTLVAAIPCQDRGLSIHFSVPRQLSWSTPVTALYERITEESKKRERRNSNGLLKEIYQVEVSSRRLTDLIDSAQFPLANDQKTEVERDVMELMSVCEAFRNGLDPLERQVREVFRKIMACRTEGLDYLG

SEQ ID NO: 123011 - protein, 119 aa, Glycine max
  Coding DNA Sequence Number=SeqID_6233
  Subcellular localization annotation: CTP_CleavageSite=42; ConfidenceScore=5.39e-01
MELHNIGFKKTDVNYFMLTSSFFSFSSRLKSVGNRSLDTHIVFNTGGNRSLEPTEPPTEENPTLLLELWLEENPTYTPPVGTRVLKHSSVLKAQSFLHEIEGNMEDVEEANRAAVESCH

SEQ ID NO: 123012 - protein, 191 aa, Glycine max
  Coding DNA Sequence Number=SeqID_6234
  Gene Ontology: Mol. function=nucleic acid binding
  Subcellular localization annotation: CTP_CleavageSite=65; ConfidenceScore=5.26e-01
MATNLSESVNSMLKNTRHMSVSSLVEKTYFKTAQLFANRGRRQTQVMINSGSQYSEVVFDAKHLPCSHVMAACKSINVDPMTYVPMLFTLQHILHIYDNSFGLLPHESMWQEYEGDQWGPNPRRNRTAKGHPVSTCIPTEMDEDENERTCRKNVDFATWKEPLFASAFSPLMFVIVTLSEPLVLDECLNVG

SEQ ID NO: 123013 - protein, 66 aa, Glycine max
  Coding DNA Sequence Number=SeqID_6235
MEIVVSLKLVVADLTNERISWQESFWRPPSYYQWELFSECILDYREIHFTDVMSCTWRPMQNAAEI

SEQ ID NO: 123014 - protein, 190 aa, Glycine max
  Coding DNA Sequence Number=SeqID_6236
METQIEEIQSTRSLRIPKISSVARDSDIIENLQYTSLKDIKCNTPTRYYLTLYEENDFNSTLAIRNELAKEQGCFLFNMEGFRSCKPIQGLSCPNLPVSESHVGEYSEEMILIKDILPENTGIAKSIEAAGSTMSDTMSRTSCPKILELLKALKLQDPRCRIRCPGHLARKYWTYKSVISLTDYCAVSKR

SEQ ID NO: 123015 - protein, 64 aa, Glycine max
  Coding DNA Sequence Number=SeqID_6237
MALRKKKNEVLCEDEEESKGLTVLLQALGSASADNLKFSAYQLDLEKIQIITMCMWELSNKQVP

SEQ ID NO: 123016 - protein, 96 aa, Glycine max
  Coding DNA Sequence Number=SeqID_6238
MFVKFLIFFCKASICSLKSATTIVSLETEDELEIRIAARLPWWHCRMKLPENAQQLPLADMDKSSEQAAGTEPQSRRRRSNSAWEEEEEEEATSSS

SEQ ID NO: 123017 - protein, 175 aa, Glycine max
  Coding DNA Sequence Number=SeqID_6239
  Homolog annotation: Hit_ID=Q1SAU7; Match level="QueryCoverage=29%, HitCoverage=5%, E-value=6e-07, Identity=57%"; Hit description=Paired amphipathic helix
KRRRSLPPSSPRRARLLPPEGTTFWGTSWKAQHVTKLHGLSNDGCQVPRSGQMRVASQQTDGPRAKLGQVEVVVVVVVVAIVVVVVVAVVVVVVGVGGVVVVVGGGGGGGGAIVKELFKEHTDLILGCNTFLQDEYKIKLPLKDKNPPQKMLGGLEEAAHFVKKVKYCHNICYSP

SEQ ID NO: 123018 - protein, 45 aa, Glycine max
  Coding DNA Sequence Number=SeqID_6240
  Gene Ontology: Mol. function=zinc ion binding
MACIMVFGMDKRYWFIPAYSKEDIRRMAILQGLEYPSTPDFNAQE

SEQ ID NO: 123019 - protein, 305 aa, Glycine max
  Coding DNA Sequence Number=SeqID_6241
  Gene Ontology: Mol. function=DNA binding; Biological process =regulation of transcription, DNA-dependent
  Homolog annotation: Hit_ID=O80383; Match level="QueryCoverage=48%, HitCoverage=54%, E-value=2e-40, Identity=40%"; Hit description=98b
  Pfam annotation: Domain name=HMG_box; Domain location=205-265; Score =29.3; E_value=1.3e-05; Accession=PF00505.9; Description=HMG (high mobility group) box
SSVSFPKIPIGCGLNNAGTFDSKCSGIIGLGAHINLERVNSTDQILSLCYKSPPNNAIEVPIITTHFAGTDIVLNSLNTFVSVSDDAMCFAFAPVASGSIFGNLAQMNQLVGYDFLRKTVSFKSTAQCFLCIDGLVQIKKANPEAEFKEISTMVIAKEKRETESMRLLEDEQKQRTAMELLEQYMQFKQEAEKDGKKNKEGSIETKAPHVSYFLFTNDRGAALAAENKNFLEVPKITSEEWKNMTEEQKRPYEEEQYALEMEAYKQKKDEEAGHFMKEEEDHMKLQKQEALQLLKKKEKTENIIK

SEQ ID NO: 123020 - protein, 71 aa, Glycine max
  Coding DNA Sequence Number=SeqID_6242
  Homolog annotation: Hit_ID=Q9FUZ0; Match level="QueryCoverage=86%, HitCoverage=17%, E-value=2e-08, Identity=75%"; Hit description =Peptide deformylase, mitochondrial precursor
MFYWLFIYAIIVLEDTKEYISYVSKEEAKTQDRRPADLLVCYFNTSFISSLEASDPESQARQEGQEDCSIF

SEQ ID NO: 123021 - protein, 137 aa, Glycine max
  Coding DNA Sequence Number=SeqID_6243
CNRQKGSTECGYYVMHWMSTIILGTFRNNWEAYFNDPRPLEPKRLKALRIQWVQFYLQCPQPKSKAPARWIVVKCNRQKGSTECGYYVMHWMSTIILGSFRNNWEAYFNDPRPLEPERLKALWIQWAQYYLRVRDQT

SEQ ID NO: 123022 - protein, 260 aa, Glycine max
  Coding DNA Sequence Number=SeqID_6244
  Gene Ontology: Mol. function=molecular_function; Cellular component =membrane; Biological process=auxin mediated signaling pathway
  Homolog annotation: Hit_ID=Q9C9F2; Match level="QueryCoverage=89%, HitCoverage=70%, E-value=9e-46, Identity=39%"; Hit description=MtN21- like protein; 91922-89607
  Pfam annotation: Domain name=DUF6; Domain location=74-203; Score =40.0; E_value=7.9e-09; Accession=PF00892.11; Description=Integral membrane protein DUF6
  Pfam annotation: Domain name=TPT; Domain location=65-203; Score= -23.1; E_value=0.012; Accession=PF03151.7; Description=Triose -phosphate Transporter family
  Pfam module annotation: Pfam domain module=DUF6::TPT; Domain location= 74-203::65-203
MEKLNVRTAAGKAKVMGTIIGIGGSMLLTFFKGQEINVKSFGTNLLQKNEQVVALHTDSGKKFLGVLCGFGSCFSFALWLIIQSKMSKEYPSHHSSTALMSLMAAIQATAFALYVEKDWSQWKLGSSIRILTVAYTAIVASGLVVIVIAWCVRMRGPMFVSVFNPLMLVLVAVADSLMFGENLYVGSVMGAMLIVGGLYMVLWGKSKEMKKANLSVSSEINQEHEATEVVVMSTTINDDNCDRVNNTDANCKSNIVAKVS

SEQ ID NO: 123023 - protein, 349 aa, Glycine max
  Coding DNA Sequence Number=SeqID_6245
  Gene Ontology: Mol. function=carboxypeptidase activity; Cellular component=membrane; Biological process=auxin mediated signaling pathway
  Homolog annotation: Hit_ID=Q9C9F2; Match level="QueryCoverage=88%, HitCoverage=96%, E-value=2e-54, Identity=37%"; Hit description=MtN21- like protein; 91922-89607
  Pfam annotation: Domain name=DUF1538; Domain location=87-277; Score= -133.5; E_value=0.016; Accession=PF07556.2; Description=Protein of unknown function (DUF1538)
  Pfam annotation: Domain name=DUF6; Domain location=175-304; Score =37.5; E_value=4.6e-08; Accession=PF00892.11; Description=Integral membrane protein DUF6
  Pfam annotation: Domain name=DUF6; Domain location=19-131; Score=5.0; E_value=0.034; Accession=PF00892.11; Description=Integral membrane protein DUF6
  Pfam annotation: Domain name=TPT; Domain location=166-304; Score= -13.2; E_value=0.0033; Accession=PF03151.7; Description=Triose -phosphate Transporter family
  Pfam module annotation: Pfam domain module=DUF1538::DUF6::DUF6::TPT; Domain location=87-277::175-304::19-131::166-304
MKKVMQELKPVLLMVLVQLGYASTSILLKFAINDGMSIRVIVAYRHIFGAALSCSLALFFERGSLFQNLAFVALALVSATFQVAIFNLVPAVTFILSILCGYEKLNMRTAATNAKVLGTILGITGSMLLSFLKGVEINIWKDIHINLFHKNINSQLGTSHGREWLGVLCGIGSCLSFSIWLIIQAKVSKEYPSHHSSTALMTLMAAIQGAVYALCFETEWSQWKLGSGIRLLTALYTGIVATGLVNIATSWCVRKRGPLFASVFNPLCLVLVAFASSLLLQEHLYLGSVIGAVLIVCGLYIMLWGKSKEMKTATHMVSSDNTVGEFGVTEAVVVSTTDNSDDGSKCQHQ

SEQ ID NO: 123024 - protein, 122 aa, Glycine max
  Coding DNA Sequence Number=SeqID_6246
  Subcellular localization annotation: CTP_CleavageSite=50; ConfidenceScore=5.17e-01
MSFLGETSSQTITNSILAFIFPNGSISYNQTGVYFQSLIPTPMRVPNNCSFDTLKRRMHNTLQLTNDQLLDEIYYRQPFIDAELLCTIIRTPDAILNLLQSTITPTHDAIMYYNGKWNIPRQ

SEQ ID NO: 123025 - protein, 109 aa, Glycine max
  Coding DNA Sequence Number=SeqID_6247
MSLVALSKELIDAIRGDGCVKYHSIELKDNNDVRNMFFIFSEFSSKEPIKLYAMVGQSPKDILGLLHKTRKPRFVEEIIALMYGSIATSSNEDDNFVLVFSIDEIYVGC

SEQ ID NO: 123026 - protein, 401 aa, Glycine max
  Coding DNA Sequence Number=SeqID_6248
  Gene Ontology: Mol. function=protein binding; Cellular component =clathrin vesicle coat; Biological process=intracellular protein transport
  Homolog annotation: Hit_ID=Q5KDW0; Match level="QueryCoverage=99%, HitCoverage=89%, E-value=1e-104, Identity=50%"; Hit description =Clathrin assembly protein AP47, putative
  Pfam annotation: Domain name=Adap_comp_sub; Domain location=159-401; Score=178.1; E_value=2.2e-50; Accession=PF00928.11; Description =Adaptor complexes medium subunit family
  Pfam annotation: Domain name=Clat_adaptor_s; Domain location=4-142; Score=-59.3; E_value=0.026; Accession=PF01217.10; Description =Clathrin adaptor complex small chain
  Pfam module annotation: Pfam domain module=Adap_comp_sub::Clat _adaptor_s; Domain location=159-401::4-142
MAGAASALFLLDIKGRVLIWRDYRGDVTAVEAERFFTKLIEKEGDPQSQDPVVYDNGVTYLFIQHSNVFLMMATRQNCNAASLLFFLHRIVDVFKHYFEELEEESLRDNFVVVYELLDEIMDFGYPQYTEAKILSEFIKTDAYRMEVTQRPPMAVTNAVSWRSEGINYKKNEVFLDVVESVNILVNSNGQIIRSDVVGALKMRTYLREDYWFEGKFNAVEVYSGKLSSSFYGNLYKQVVTTGKLSTLQQASTLGYVSSNFRQTFDYFFGTLQVPLNFFREVKPLVWVEAQVEKHSKSRIEIMVKARSQFKERSTATNVEIELPVPADATNPNVRTSMGSASYAPEKDALIWKIRSFPGGKEYMLRAEFRLPSIVDEEATPERKAPIRVKFEIPYFTVSGIQ

SEQ ID NO: 123027 - protein, 91 aa, Glycine max
  Coding DNA Sequence Number=SeqID_6249
  Subcellular localization annotation: CTP_CleavageSite=69; ConfidenceScore=5.45e-01
MARVIGFRLLLQLGGIGASDFVSSVYRWKRMLDSIRGAVRSNPPRSLMSSFALSATRSARRVLMEACLRSFYGGSMRSFHGDFQPWSCSGR

SEQ ID NO: 123028 - protein, 223 aa, Glycine max
  Coding DNA Sequence Number=SeqID_6250
  Homolog annotation: Hit_ID=Q1XKS0; Match level="QueryCoverage=82%, HitCoverage=16%, E-value=8e-12, Identity=26%"; Hit description =Hypothetical protein precursor
MDREFTNGRITMGMSIQQLDEFEIAEIFRSGQVHPDKVLVINPFEKNSDQILKNQNILASVQFNPTEKSGWNGNYRFISNDNLINANFSNEEREQTSHFLNLGYWFNKEFRVDWENSVHDIKNSSQLFATRDYRLNNFETKPKATYKFTDAIQAELSSAFRQKQRIDGEELLKAFDVTGTIQWERKKTSIRGNFSFINNNFTGNNFSIVGNQMLDGLKPGKNQ

SEQ ID NO: 123029 - protein, 62 aa, Glycine max
  Coding DNA Sequence Number=SeqID_6251
PNPLAHGSDDWSLPREDCIKFPCSAAMVESSMKIKRREECEDEGKGRESRAIEHDDEREEEK

SEQ ID NO: 123030 - protein, 76 aa, Glycine max
  Coding DNA Sequence Number=SeqID_6252
MVPTREVLEFTTQDVLLARQKLLTRTIEEFTQQVSHLLQQLKLQPTTSIPKFKCFACETYGGGHATNECAMVQEEV

SEQ ID NO: 123031 - protein, 309 aa, Glycine max
  Coding DNA Sequence Number=SeqID_6253
MKRAQLIFAIIKGLSIDIGQTFSHEIFSMAGKKSLPPSLSALIITLCVKKGLDIFEDWAQPFVDLQPTIDAPYIEKRIWIDGDSLPRLEPLPPKPLSLNEILEKMHEEITLKFDAKHRSNLILFDHLRGTLRPKGLWAIETGGADGDATNEDHVVRVNVDVAKNMEPTTETRTDEDVELNDVGVVDGDVVFEKTSARDFTTEDDEIASKETNEVLNIIGNAIFAINEETIFEKEAQKDIVVEVEATGDTTESVTDEVANIIGIVIFSINEETIVEKEAQKDIVVEVEAIGDTTESVTNEDQIEEEIATK

SEQ ID NO: 123032 - protein, 103 aa, Glycine max
  Coding DNA Sequence Number=SeqID_6254
MAAQFIHDRVEMECLEGVWETLEGNARCRFRGTFRLTATSLVHPEELARTLQCTVEWILPTPTPYLLVEPVQVIEVTSSKEDPEEDPEELPPEPAVDALDFLE

SEQ ID NO: 123033 - protein, 292 aa, Glycine max
  Coding DNA Sequence Number=SeqID_6255
  Gene Ontology: Mol. function=iron-sulfur cluster binding; Cellular component=intracellular; Biological process=metabolic process
  Homolog annotation: Hit_ID=Q1H0G0; Match level="QueryCoverage=98%, HitCoverage=70%, E-value=1e-119, Identity=74%"; Hit description =Radical SAM
MEQVVEVARVLREVHDFRGYIHLKTIPDASPELMARAGLYADRLSINVELPTISSLQTLAPEKDGQAIRRSMGQLRLKIEESKDKTLTGKKPKRFAPGGQSTQMIVGADATDDRAILDTSANLYGAYRLRRVYYSAFSPIPDASKMLPLKAPPLVREHRLYQADWLLRFYGFEADEIVTGHDGMLDLDVDPKTAWALQHREQFPVDLNRASKAMLLRVPGLGVTSIARILAARKVRAIRYDDLARLRVSLKKVLPFILLPDYHPGHRLDDQYLKQRLQRTIPPQQFGLFESV

SEQ ID NO: 123034 - protein, 75 aa, Glycine max
  Coding DNA Sequence Number=SeqID_6256
MGCPKCLFKIESNQPSLKNHRIRNIHTCTCTCISCDSKEQNRLRPRSEVRTSRWQKSTKVCVGEKRKRSLNVNRV

SEQ ID NO: 123035 - protein, 397 aa, Glycine max
  Coding DNA Sequence Number=SeqID_6257
  Gene Ontology: Mol. function=sugar binding; Cellular component =integral to membrane; Biological process=transcription
  Homolog annotation: Hit_ID=UPI0000E4A6CC; Match level="QueryCoverage =75%, HitCoverage=30%, E-value=4e-18, Identity=25%"; Hit description =PREDICTED: similar to WD repeat domain 60
MNKRHDSEEESDVDSEEKKYGRLEKQKTRRHNSDDEDSDKDGVRRALGQDRYVSRGSYTSSNKSSSDSDSDSGSSDHRREKTKKGGSVAAKKVKGYGMEENRFRDEARDSGADKGKYGANVDALGSLTKSYGRDITKGSNSRSREMTHGNRKIDGDREREPVTVVKHDEDDRKMESESKSARFAGPDDDSSEQRGRNYNKDVESHFVGRTARYGEDHETRRRRKDDDNHREHEHTRDNDDHGERKHGRDEDDRTGRKHAREEDVREKKHGKDEDDPKEKHRRHDDGLGDYRMGRKHARDEDDLGERKHARDEDDSKEGKHRRYDDGRGERKNLRDEDDRAERKRGRDEDYRTGRKQARDEDEHRERKFRRNEDDREGRKFRRDDDVYGERKNLRDGD

SEQ ID NO: 123036 - protein, 60 aa, Glycine max
  Coding DNA Sequence Number=SeqID_6258
  Gene Ontology: Mol. function=nucleic acid binding; Cellular component= intracellular; Biological process=regulation of transcription
  Homolog annotation: Hit_ID=O49591; Match level="QueryCoverage=57%, HitCoverage=8%, E-value=5e-12, Identity=82%"; Hit description =Putative zinc finger protein
MPGLTCNACNTEFKDDTEQKLHYKSEWHRYNLKRKFIQIASYNVGTWEGDVVTKEAYQVR

SEQ ID NO: 123037 - protein, 430 aa, Glycine max
  Coding DNA Sequence Number=SeqID_6259
  Gene Ontology: Mol. function=nucleic acid binding; Cellular component= intracellular; Biological process=chromatin modification
  Homolog annotation: Hit_ID=Q5Z8K9; Match level="QueryCoverage=99%, HitCoverage=100%, E-value=1e-124, Identity=54%"; Hit description =Zinc finger protein-like
  Pfam annotation: Domain name=zf-C2H2; Domain location=255-282; Score =10.6; E_value=0.74; Accession=PF00096.16; Description=Zinc finger, C2H2 type
  Pfam annotation: Domain name=zf-C2H2; Domain location=4-28; Score =9.6; E_value=0.95; Accession=PF00096.16; Description=Zinc finger, C2H2 type
  Pfam annotation: Domain name=zf-C2H2; Domain location=91-115; Score =14.9; E_value=0.25; Accession=PF00096.16; Description=Zinc finger, C2H2 type
  Pfam module annotation: Pfam domain module=zf-C2H2::zf-C2H2::zf-C2H2; Domain location=255-282::4-28::91-115
MPGLTCNACNTEFKDDTEQKLHYKSEWHRYNLKRKFIQIASYNIRTWEEDVVTIEAYQVAGVPGVTEALFLARQSVLAQEKNKLGETPMLYSCGLCGKDYKSSKAHAEHLKSRGHMMQASEGTSHADEKAIVKPLPQRVVNRPPPRREVDNSENEESEDEWEEVDPEEDLVDGAAKSLTDLNVNEHGENVDMEVDDDFEELDPSCCFMCDQEHKSIENCMVHMHKHHGFFIPDVEYLKDPKGLLTYLGLKVKRDYMCLYCNDRCYPFSSLEAVRKHMEAKSHCKVHYGDGDDDEEVELDEFYDYSSSYVDDQGKQLVASCDASNNVELVGGSELIITTKSGERSSTKTLGSREFLRYYRQKPRPSLANMAITAALASRYRSMGLTTIQSREKIVRMKVLKEMNRSGVDNMRTKMAMKSNVIRNLPKNVPY

SEQ ID NO: 123038 - protein, 48 aa, Glycine max
  Coding DNA Sequence Number=SeqID_6260
MPCLKGVKKGQGRANKTDGIYGVVNRSMEGGVDPTRCAMFKTNGHVFI

SEQ ID NO: 123039 - protein, 368 aa, Glycine max
  Coding DNA Sequence Number=SeqID_6261
  Gene Ontology: Cellular component=spliceosome; Biological process =mRNA processing
  Homolog annotation: Hit_ID=Q9U213; Match level="QueryCoverage=31%, HitCoverage=27%, E-value=1e-16, Identity=43%"; Hit description =Hypothetical protein rsr-2
  Pfam annotation: Domain name=cwf21; Domain location=95-139; Score =69.8; E_value=8.6e-18; Accession=PF08312.2; Description=cwf21
MGWGRGYSIPDWYGDEPINLNPSGMGYGYENMLESRVLISVGVDMYNGIGLQTPRGSGTNGYIQSNKFFVKPKISKVAENTKGFEADQGTAGVSRKPNKEILEHDRKRQIQLKLTILEDKLIDQGYTDAEIAEKLVEARQNLEAATASKETDGPASVSASDKKRGWFDWERSMVEELEAYEQLYDIFKGPQVQGNLSQVWRMKIPLKLGASNVFCPLCNSGSESVNHILFCAQRFYKYGRVSNTQTHQIAARKEKQMEALKAALGIVSSEANEINEDGTDGLGNDGKNGPNVEGNSKPEDSFLDRDFSRKKQMDDSSDSDSSLSDEKRGTRKRGKDYTSSSDESDSDSDAKRKLKAEKKRKIPKHRKK

SEQ ID NO: 123040 - protein, 40 aa, Glycine max
  Coding DNA Sequence Number=SeqID_6262
MNCMISFLLHVNPANKKMLGSGGADGAIYRAAGTLLKHVG

SEQ ID NO: 123041 - protein, 104 aa, Glycine max
  Coding DNA Sequence Number=SeqID_6263
ITPTRHPADPEKSNRVLGFPALITGLCQFYGVPVAPNKPGDGRQRAINAPPLALEPLSPNRRPSPKPKLPAKRSRKGTIEEDSSVAPQVDTGFDKHRFQSVEHQ

SEQ ID NO: 123042 - protein, 257 aa, Glycine max
  Coding DNA Sequence Number=SeqID_6264
  Gene Ontology: Mol. function=transcription factor activity; Cellular component=nucleus; Biological process=regulation of transcription
  Homolog annotation: Hit_ID=Q1SA40; Match level="QueryCoverage=94%, HitCoverage=93%, E-value=1e-74, Identity=65%"; Hit description =TAFII55 protein conserved region
  Pfam annotation: Domain name=TAFII55_N; Domain location=1-147; Score =197.2; E_value=3.8e-56; Accession=PF04658.4; Description=TAFII55 protein conserved region
MEEQFILRVPPNVAERIECLLNENNAPSSEDKSLDLSFSEDGRSGTFMIGNEHFAASLLDLPCVVESYNKTYDDNSLIKTADIGQMIMVRESGDAAPDVIEYRHGLTPPMRDARKRRFRREPDLNPELVSRVEKDLLKIMAGGTADNLDILTSLFVSNSNLAKFSILKYKSMFSLKLVVIVIVAVAYFFPFYLFLSSLIDIWDSHVEAAEQEEGDENARGANKKAAPKPAPKHDAPENLTNAGELDRSDSEESDDSV

SEQ ID NO: 123043 - protein, 62 aa, Glycine max
  Coding DNA Sequence Number=SeqID_6265
MCSKETQKVTTELMATHDIDNETMTNTNNKHTRINEDEPPINEDQTLIEEKKMRGEMQKKIP

SEQ ID NO: 123044 - protein, 90 aa, Glycine max
  Coding DNA Sequence Number=SeqID_6266
MGNFSNFSLAVVMVGVPEKEKTGPKEAISDRSAFDDEVTARGIHWERDYQGAMANADDKCEDDKLCATADDEREYEEKGRAWWPVAMKIS

SEQ ID NO: 123045 - protein, 111 aa, Glycine max
  Coding DNA Sequence Number=SeqID_6267
NPQRVVLGDYVIEYGDDDARDEFEGFPGDEGNWDNRRLSYDTSNSDEGSVVSMEYADYRIEEIDDEIVSTSGSSRGSSGYRRINSFLALKLYFSKAQHSKQLLVSTVPLSR

SEQ ID NO: 123046 - protein, 121 aa, Glycine max
  Coding DNA Sequence Number=SeqID_6268
MESTRQIQTAVTFDSDVRFRQYIETLKIVQQNLSRNSNGDKFTLGSRFRPIIYREARNSTTEALGNSYGQKISPGCPIQAHNILRCLKLNIKAQGKFERPKLLTRMSDSGQIYIETLEIVQ

SEQ ID NO: 123047 - protein, 201 aa, Glycine max
  Coding DNA Sequence Number=SeqID_6269
MNCVFVHASSTHEFGAMHSDCLVQFSILNPFSEPHECHCLVLFMCPPPSSLEPRECHCLALFASSPFSTFSEPHECYCPALFMHPPPKEFGAMLHDCLSVDPLVQSSILNPFSEPHECHCLALFMCPPTSSLEPRECHCLVLFANSPFSTFSEPHECYCPALFMHPPPKEFGAMLHDCLSVDPLVQSSILHFFRSPMNVIA

SEQ ID NO: 123048 - protein, 68 aa, Glycine max
  Coding DNA Sequence Number=SeqID_6270
MTIICLCVPSDMIVSEWQKGCGMTIICLRMSHDLSFWVMVTKSGAVDKSEAPAPMYPPMRNSNLRRSG

SEQ ID NO: 123049 - protein, 81 aa, Glycine max
  Coding DNA Sequence Number=SeqID_6271
  Homolog annotation: Hit_ID=Q8H3G8; Match level="QueryCoverage=46%, HitCoverage=4%, E-value=4e-07, Identity=68%"; Hit description=Myosin heavy chain-like protein
MMFLHIKWYQALNESPVGHNQSPKVTSEAVAIADDINDISCECWEKAENEGTSLKKQVHALTLRNSTLEDRVTHLDSALKE

SEQ ID NO: 123050 - protein, 158 aa, Glycine max
  Coding DNA Sequence Number=SeqID_6272
MGEVEEIQEKMKVNMEAMKERMATMMAMISIRKIMEANAVTIAATSTVAKVNLMPPSGLNQMNHPTLDMTHEIPHHNLADFEPCLGYATEGQAIGGIPLQNTSKGPQYHPQLHLLPSTTSKNPHPMAKVKKLDHLEERLRAIEGGEDYAFANLEELFL

SEQ ID NO: 123051 - protein, 107 aa, Glycine max
  Coding DNA Sequence Number=SeqID_6273
MIIRGQDSYSSQDEGTTSPSFSESGDAIGEESSEAIYPQEVRDLLMARRLLGGQSSKDDDKGDDKKLKIESRTLQDSSGNLNSRIKNQDSRIKLQESRSRFKNQEKT

SEQ ID NO: 123052 - protein, 138 aa, Glycine max
  Coding DNA Sequence Number=SeqID_6274
  Gene Ontology: Mol. function=RNA-directed DNA polymerase activity; Biological process=RNA-dependent DNA replication
GAASMPHMLPCLLILFIPTSLIIDMNTVGGIFTWRRNGPNGSQINKKLDRCLANSDWHLTFPHALVELLPPYNSDHIPIFSSVAAAWLTHPRYPIVVESAWDKPSMSVLAKMNHVKKDSIKSDCSGIEKEKDEWRHYF

SEQ ID NO: 123053 - protein, 143 aa, Glycine max
  Coding DNA Sequence Number=SeqID_6275
MTVRRKLLFPICRQIWQCFCTCLVLVIYRKCYLQETASSKMHTWHNCQYSYRRKKPGGKISKNWTGSFSWLKWRGLLELRHQTEEDAEHRLLMEAPMKGVETSAQEILCRAVGSKNYNEISEWSKGLRSKGFCFMTKKRLLHD

SEQ ID NO: 123054 - protein, 234 aa, Glycine max
  Coding DNA Sequence Number=SeqID_6276
  Gene Ontology: Mol. function=catalytic activity; Cellular component =nucleus; Biological process=protein modification process
  Homolog annotation: Hit_ID=O82692; Match level="QueryCoverage=81%, HitCoverage=59%, E-value=3e-80, Identity=76%"; Hit description =Ubiquitin activating enzyme
  Pfam annotation: Domain name=ThiF; Domain location=42-179; Score= -17.3; E_value=9.9e-05; Accession=PF00899.11; Description=ThiF family
MVSWNRLRLGMDGDGEELTAQETALYDRQIRVWGADAQRRLSKSHVLVYGMKGTVAEFCKNIVLAGVGSLTLVDDRAATEEMLSSNFLIPPDENVYSGKTLAELCCNSLKDFNPMVHVSVEKGDLSSFDVEFLSKFDVVVVSCCTLSAKKLANGKCRKLSKRVAFYAVDCRDSCGEIFVDLQDYKYSKKKQDETVECDLKYPSFEGLDVLQIAIVKAFTVFEMIYFYHQQTKRI

SEQ ID NO: 123055 - protein, 37 aa, Glycine max
  Coding DNA Sequence Number=SeqID_6277
MTGAADAVQTEGVATDGSLGSPAADEGTTRSEVGLPR

SEQ ID NO: 123056 - protein, 48 aa, Glycine max
  Coding DNA Sequence Number=SeqID_6278
MKFKRIVKSALPPKIGEHCWRDGGTRLGESNNHYDVSMNFREIRKNKK

SEQ ID NO: 123057 - protein, 68 aa, Glycine max
  Coding DNA Sequence Number=SeqID_6279
MARTYSPLKVIGTSTQGSTFMRKQEIDSSKGQIDCPFEKGDNSCNLILSFANLSGNSLRVYVLFDLVT

SEQ ID NO: 123058 - protein, 99 aa, Glycine max
  Coding DNA Sequence Number=SeqID_6280
MKSLRGKEITLVKVQWGPDEGDSTWELKDRVRELYPTKRIQKLFSLILTLLFLPFSSTIEASIKAPNFTHHFCSKSQKEAIFGVVKRTSMLWDFKFRYG

SEQ ID NO: 123059 - protein, 295 aa, Glycine max
  Coding DNA Sequence Number=SeqID_6281
  Gene Ontology: Mol. function=sequence-specific DNA binding; Cellular component=intracellular; Biological process=regulation of transcription, DNA-dependent
  Homolog annotation: Hit_ID=Q47129; Match level="QueryCoverage=93%, HitCoverage=98%, E-value=2e-56, Identity=46%"; Hit description =Transcriptional activator feaR
  Pfam annotation: Domain name=HTH_AraC; Domain location=249-292; Score= 36.3; E_value=1e-07; Accession=PF00165.13; Description=Bacterial regulatory helix-turn-helix proteins, araC family
PLLFEGRDHDGIGNVPGLRLRRVAGENQHRLRQILRKNAGAGLQRGDAGVSRPCAAPERGRRVSSPAVPHAARDRPQRRRALFYRLPTARQRVDGAGRSPDGALSRRHHADRRLTAQQLHLPARFAPNLPVVAARLPAGAAALRPASRGRAQRGAPQPPAGAEQHAGSSTRRGGKRGGAECAGGAAAPGAGARTGAPGGATAGFRQGAGVDRQAYSVAAAAPGMGGGRVGGVAAQPVSAVRPSGAGGGAALRSAAGQEKLAGVGLDWGFADHSHFSTAFKQRFGMSPSEYRRQYQ

SEQ ID NO: 123060 - protein, 155 aa, Glycine max
  Coding DNA Sequence Number=SeqID_6282
  Homolog annotation: Hit_ID=Q1S0F5; Match level="QueryCoverage=78%, HitCoverage=25%, E-value=3e-09, Identity=32%"; Hit description=IMP dehydrogenase/GMP reductase
MGSSQMPSLKRRFYQVKVKSLGTTSLKELGQLMGQLQRQAFRKAYGKIWDLAMVEVSTGAIASLAQYYDQPLRCFTFGDFQLSLIVEEFEEILGCPLGERKPYLFSGFYPSLARISKIVQISVQELDHKKQVENGERSTLFSPIITTRKARLSLC

SEQ ID NO: 123061 - protein, 198 aa, Glycine max
  Coding DNA Sequence Number=SeqID_6283
HGPEIYPKTHENPKAFSCIFGPIFLESSIQCPWGVRLHHEAPASSEVFPSSAPAPIPYVPSASTSILPAPLSAGPVDFIFTPQMLHSMLQSIHRGQSIIMQSLQGLGLPSIMSMEEFDALVAWPRDQPYSSGEGGASAAQEPVTEEPPAPAPSLGAGEKETTPDQTPKPSPSSAPAPKETQPSALDLNEDQPQEEQDV

SEQ ID NO: 123062 - protein, 120 aa, Glycine max
  Coding DNA Sequence Number=SeqID_6284
DELATQLAQASQVASSRSNRLLEEHPGRPEWAWVPSTSKRSTKGCMPSNNSPRTKLGYDNGIDPMMSPVKLVNQADDEEEEDWELPPELQRMVEQEDREMKPHQEETEIVNLGVGEEKQE

SEQ ID NO: 123063 - protein, 102 aa, Glycine max
  Coding DNA Sequence Number=SeqID_6285
MHSEAEALEHMKKRHTGHQSVSLENKTGDSTVLKIGDSAKVVIKQDMKGGEHKYGFNNNKREKPEKERVMDDETGDKHELFEVLRMPSRCVFFKVFMSFLHH

SEQ ID NO: 123064 - protein, 188 aa, Glycine max
  Coding DNA Sequence Number=SeqID_6286
DSLEEQTTQGSFVPHGRDDILNTAIGKPEHPGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKGSNVETADVDPSGDKNVSLKPTMGLYVQRQHTTVLVALGKICEGGSAIHNVTYADDVVR

SEQ ID NO: 123065 - protein, 50 aa, Glycine max
  Coding DNA Sequence Number=SeqID_6287
MDLAQAGGFAWGAAALVHIAGYMSTFLQCIHASYMMLMMRGAHGRAGGLR

SEQ ID NO: 123066 - protein, 362 aa, Glycine max
  Coding DNA Sequence Number=SeqID_6288
  Homolog annotation: Hit_ID=Q84VH5; Match level="QueryCoverage=99%, HitCoverage=52%, E-value=1e-119, Identity=66%"; Hit description =Envelope-like protein
  Subcellular localization annotation: CTP_CleavageSite=21; ConfidenceScore=5.27e-01
MATSPKEISAPGSPSVPSSPSSTKAPSHQERREFNIQPIQMIPGSAPVPEKLVPKRQQGVKTSENPSLATSPREVDTEMDKKIRSIMFQHPPTQMFLSLMLIQMFQHLPPQMFLCLMLKKMFQHPSTPNAEVLPSPSEEESTEEEDQATEETPAPRAPEPAPGDLIDLEEVESDEEPIANKLAPGIAERLQSRKGKTPIKRSGRIKTMAQKKSTPITPTTSRWSKVAIPSKKRKEISSSDSDDDVELDVLDIKRAKKSGKKVPGNVPDAPLDNISFHSIGNVERWKFVYQRRLAVERELGRDALDCKEIMDLIKAAGLLKTVTKLGDCYESLVREFIVNIPSDITNRKSDDYQKVFVRGRMC

SEQ ID NO: 123067 - protein, 75 aa, Glycine max
  Coding DNA Sequence Number=SeqID_6289
MSGHRVRHRGSCSFTSALDFYLALYSNSSILGQDQLQYSRAGCQDIVSDIVDPATSLLHLPFYLALYIVQPDLIP

SEQ ID NO: 123068 - protein, 161 aa, Glycine max
  Coding DNA Sequence Number=SeqID_6290
  Pfam annotation: Domain name=zf-CCHC; Domain location=1-18; Score =28.6; E_value=1.9e-05; Accession=PF00098.13; Description=Zinc knuckle
MTCFNCKQKGHIQKDCPYPKKEQNGRGLNDQNGHLKAMGRVFTLNGIEASKSKDLIQGKCFISGVVATYPSAGGRRETRGMRVPRKEYARSRHQRLFEENVGKTGKDAIYELLSERFGSCIYARGRSKNDEERMKNIEERLKPLRNSSRKTLRKRFGSAST

SEQ ID NO: 123069 - protein, 81 aa, Glycine max
  Coding DNA Sequence Number=SeqID_6291
MSRQTVFAIVVEELPFKQEGRQGIMGDSFMLVHYHKLNMGILFFSWVDEDIDVGATEIGRIEPIPDFGLRLRRKILQREVR

SEQ ID NO: 123070 - protein, 164 aa, Glycine max
  Coding DNA Sequence Number=SeqID_6292
MGVPNNCSFDTLKRRMHNTLQLTNDQLLDEIYYQQPFIDAELLCTIIRTPDAILNLLQSTITPTHDAIMYYNGKWNIPRQGEFLGYSFAGTNLIIRFGIPPGCGMKKLKDLIKQVAPIGVSPNGIHGSQLVRRLFFRQSGHSKYSENLIEYEITELKNDEDVLK

SEQ ID NO: 123071 - protein, 110 aa, Glycine max
  Coding DNA Sequence Number=SeqID_6293
MQDLEAATTPEEEPRSSEASSSFPIADHSHIEPVEDPIMAQEPRRVTLEDYSSSIVLQFFTSIAQPEVQAQTITYPPSLIHLIQNNLFHGLPNEDPYAHLATYIETCNTI

SEQ ID NO: 123072 - protein, 169 aa, Glycine max
  Coding DNA Sequence Number=SeqID_6294
MVERGKLDHIEERLRAIEGGGDYAFADMEELFLVPNMAIPPKFKTSDFDKYKGTTCPKNHLKMYCQKMGAYSKDEKLFMHFFQESLSGAAVTWWRDLAAQVAPLMVEKEMITMILDTLLVFYYERMVGYTPSSFADLVFVGERIEVGLRRGKFDYPALMNGKPGANGEN

SEQ ID NO: 123073 - protein, 428 aa, Glycine max
  Coding DNA Sequence Number=SeqID_6295
  Gene Ontology: Mol. function=peptidyl-prolyl cis-trans isomerase activity; Cellular component=periplasmic space; Biological process =protein folding
  Homolog annotation: Hit_ID=Q7CIB6; Match level="QueryCoverage=34%, HitCoverage=53%, E-value=1e-57, Identity=73%"; Hit description =Putative enzyme
  Pfam annotation: Domain name=FKBP_C; Domain location=184-276; Score =5.9; E_value=0.0011; Accession=PF00254.18; Description=FKBP-type peptidyl-prolyl cis-trans i
  Pfam annotation: Domain name=FKBP_N; Domain location=58-182; Score =56.2; E_value=1.1e-13; Accession=PF01346.9; Description=Domain amino terminal to FKBP-type peptidyl-prolyl isomerase
  Pfam module annotation: Pfam domain module=FKBP_C::FKBP_N; Domain location=184-276::58-182
KQTRRKPSRRRHWPSGWQRRWRKATKSTLQLAKTTEQVKKNALALADANQTQQALREELDGLRSRAKWLPDAQALEKKPAQQSYAAGVALGRDIQTMLAERKNWGINPDKTVLLAGVIDTFNGHYQLSDAQLTRALAESEKAVNDARNQAAKVQTSKGEAFVTEFKKKKGTQKSPSGFWYRIDYAGDEAIKENARVDIVVKESLTDGSVIQDMDRSGKVMSQPLSAYPPLFREAIGHLKNHGSLTMVVPPALAYGETGYAPQIPPNATMVYELRIVDVNNGNSASDSLVIQPAGDAHIGDLHVDEAALLQPTFQRLGGRDEIHIAHLRITIARHQHLVAIAFHHQRFQHQFTFSHQLVFQLIQMIERRAAVIQHPHREHGVECRQFRQLLDAERQQEQLHRIDADGEVCAGANHAPQVITAAAADVEN

SEQ ID NO: 123074 - protein, 267 aa, Glycine max
  Coding DNA Sequence Number=SeqID_6296
  Subcellular localization annotation: CTP_CleavageSite=58; ConfidenceScore=5.18e-01
MEAGKKGGGGSSNQKKLLKDVETMNKALYLDRNSSRSSIPSANSRSKFTGKPQLPDPRSKSKASNDHNGENAQKDKKSIWNWRPLRALSHIRNKRFNCSFYLQVHLIEGLPPSFDDAGLAVYWKRRDGVLVTQPAKVVQCVAEFEEKLTYTCSVYGSRSGPHHSAKYEAKHFLLYASLLSVPEMDLGKHRVDLTRLLPLTLEELEEEKSSGKWTTSFRLMGLAKGATMNVSFGYTVVGDNASATRDSLPKALSSRQNSFSLTPTKFD

SEQ ID NO: 123075 - protein, 421 aa, Glycine max
  Coding DNA Sequence Number=SeqID_6297
  Gene Ontology: Mol. function=pseudouridylate synthase activity; Cellular component=chromatin; Biological process=RNA processing
  Homolog annotation: Hit_ID=Q1H048; Match level="QueryCoverage=65%, HitCoverage=78%, E-value=5e-97, Identity=61%"; Hit description =Pseudouridine synthase, Rsu
  Pfam annotation: Domain name=PseudoU_synth_2; Domain location=194 -324; Score=24.9; E_value=1.7e-08; Accession=PF00849.12; Description =RNA pseudouridylate synthase
  Pfam annotation: Domain name=S4; Domain location=160-205; Score=38.9; E_value=1.7e-08; Accession=PF01479.15; Description=S4 domain
  Pfam module annotation: Pfam domain module=PseudoU_synth_2::S4; Domain location=194-324::160-205
HTFEQVVQSLINAETLQEVLETDGGLEVHEMTMQTAELLTQQVWGQGFPQPVFYDRFQVVQQKVLGEKHLKLRLQKHNQQFEAIYFRHAELLPEQIEIAYALQRVCPKYGKIQPSFKRLSMARPFKSPKTVSGTRPPKEQTPLAETAEGVDAPSVPRSGQRLHKLLALAGFGSRRDMETLIESGRITINGQVAQVGAVVDEHDIDDPEGRATVFDKLPRIKQGKWIAIGRLDMNTSGLLIFTNSGELANHFMHPRYEVEREYAVRILGELTPEQMSQLTHGIELEDGPANFESIYANGGEGANKWYQVVIKEGRNREVRRLFEAFHLPVSRLMRVRFGPIALPPRLKRGTMLKLEQKQVVALLEWAGLPVPRKPLKQMSPHDRDRATRVFTPKVRKQRRSLLDAANNPAGTQQERPARAPS

SEQ ID NO: 123076 - protein, 99 aa, Glycine max
  Coding DNA Sequence Number=SeqID_6298
  Subcellular localization annotation: CTP_CleavageSite=30; ConfidenceScore=5.13e-01
MDMWLCLAFHCCPSFLFWFGFGIWVFNYFSSSRVTSERKNSTSAPLGIERKSIERFHWIVTGGHLSKLENSRVIRVLIGGGSYCGFRATVVEHSHLQIA

SEQ ID NO: 123077 - protein, 55 aa, Glycine max
  Coding DNA Sequence Number=SeqID_6299
MAVQKLNGDNFTLDEDPRVSSVLLRMLLYKEYPNGAQYSYDFCYGIEYRTSVKSV

SEQ ID NO: 123078 - protein, 767 aa, Glycine max
  Coding DNA Sequence Number=SeqID_6300
  Pfam annotation: Domain name=LysM; Domain location=729-766; Score =7.4; E_value=0.098; Accession=PF01476.10; Description=LysM domain
MVDTVCTLGISGIQISSEDSVKHDFLDEANDSSKDQGVVEEFASIKAPEDASTVDTSCTLGISGRQVSSEDSVEHDFLDEANGLDTNELLMQELESALNSVSNLERVALESPKTTEAKSEHKMTKSHSLDDVTASVATEFLSMLGLDHSPMGLSSESEPESPRELLLRQFEKEALNGGFSSLFDFDMNYDSEAAGGYDASASSEQWNFSEGVKSSSFLQDLLEEPPVESQDVRSKQRAQMLEDLETEALMRQWGLNENAFHHSPPKDFAGFGSPIHLPPEEPPTLPPLDDGLGPFLQTKDGGFLRTMSPSIFKNSKSCGSLIMQVSNPVVVPAEMGSGIMEVLQCLASVGIEKLSMQAKELMPLEDITGKTMQQIAWEAMPSLEGAERQCHLRHDPITVPDSAGVQRDLKGMPSKQKSGKFSSRTVANQTGSEFVSVEDLAPLAMDKIEALSMEGLRIQSGMSEEEAPSNIIAQSIGDISALQGKGVDISGSLGLDGAAGLQLMDVKDGGDGVDGIMSLSLTLDEWMKLDSGEIDDIDNISEHTSKLLAAHHANSFDFIRGSSKGEKRRGKSRCGLLGNNFTVALMVQLRDPMRNYEPVGTPMLALIQVEREFMLPKQRIFNSVSEIRKNYYEDDESNIVAKLKTKDTEKEEKSSEEEGGIPQFRITEVHVAGLKPEPQKKKLWGTSSQQQSGSRWLLANGMGKSNNKLSLMKSKAASKSNAPVTTKGQPGDSLWSISSRIDGARGKWKELAALNPHIRNPNVILPN

SEQ ID NO: 123079 - protein, 429 aa, Glycine max
  Coding DNA Sequence Number=SeqID_6301
  Gene Ontology: Mol. function=nucleic acid binding; Cellular component= beta-galactosidase complex; Biological process=DNA integration
  Homolog annotation: Hit_ID=Q1RWN2; Match level="QueryCoverage=92%, HitCoverage=46%, E-value=2e-51, Identity=39%"; Hit description =Peptidase S8 and S53, subtilisin, kexin, sedolisin; Integrase, catalytic region; Zinc finger, CCHC-type
MVRSMLTDKNIRKTFWPETVNWTIYVLRVSEESKGYKLFDPVAKRVVWDWDGKQIAVDIKWDESKNENGENNDKEIRETCDEGVGDVSSESEVRLRESRQPRERQPPTWMGDYVSCEGLSDDEVHMALMVSTDPLCFEEVVKSANWRLAMDNEIKSIEKNQTWTLTELPAGAKRIGVKWVYKTKYNEHGKIAKYKARLVAKGYSQKHAVDYIEVFALVARMDTPRGYEKEGSEHLVYKLHKALYGLKQTPRAWFNQIEAHFISEGFQRCDSEQTLFTKRNREGKIIILVGSLMYITTTRPDMMFVTGLPIVTLSTTEAEFVAAVVCVCQGVWMKSILEELGQSHEGCITIMCDNSSTIKLSKNPDMHGRRKHIDVRFHFLRNLSKESTIELVHCGSQDQVVDIMTKPLKLEVFQMFRKLLGVCEIPNIN

SEQ ID NO: 123080 - protein, 61 aa, Glycine max
  Coding DNA Sequence Number=SeqID_6302
MGYGDVEVVDGGRGRYARMRHVGNDGEQGSKGVKHDNKARGDDAMERSHYSCLSKESQKMP

SEQ ID NO: 123081 - protein, 265 aa, Glycine max
  Coding DNA Sequence Number=SeqID_6303
  Gene Ontology: Mol. function=nucleic acid binding; Cellular component= proton-transporting two-sector ATPase complex; Biological process=DNA integration
  Homolog annotation: Hit_ID=Q1RWN2; Match level="QueryCoverage=61%, HitCoverage=14%, E-value=3e-40, Identity=45%"; Hit description =Peptidase S8 and S53, subtilisin, kexin, sedolisin; Integrase, catalytic region; Zinc finger, CCHC-type
  Pfam annotation: Domain name=zf-CCHC; Domain location=182-199; Score =16.4; E_value=0.002; Accession=PF00098.13; Description=Zinc knuckle
MTTKGSFVQPAIPRFDGHYDHWSMLMENFLQSKEYWELIEPGYVEPASGATQTEAQQKKNDELKLKDLKKNTAKEIWDAMKKKFKGNARVKRAHLQALRREFEILEMKTSEGVTEYFSRVMTVANKMRIYGEDMPDVKVVEKILRFLTESFNYVLCSIEESKDIDEGNRKRKRSNNFNKAIVECYQCHQLRHFLYECPQKKEANYAEHNEAEEMLLMSYVKLHEANREDGSVKLLLNGVNFVFPEVYYVPELNNNLLCIGQLQER

SEQ ID NO: 123082 - protein, 92 aa, Glycine max
  Coding DNA Sequence Number=SeqID_6304
  Pfam annotation: Domain name=Transposase_23; Domain location=19-80; Score=-6.0; E_value=0.0052; Accession=PF03017.5; Description =TNP1ENSPM transposase
MTSKRLALLPVPEVGPSTARVITKKSCVDPLRVYDRSTTIHNIPLGNDQVKVDVEEVRDVDARVSVPTQEVQLVGQTLNTFLAWLTHLVKHF

SEQ ID NO: 123083 - protein, 37 aa, Glycine max
  Coding DNA Sequence Number=SeqID_6305
MAGDGLRPMLHPKAMGHATLPPFSCYSCLNMCPPGAR

SEQ ID NO: 123084 - protein, 174 aa, Glycine max
  Coding DNA Sequence Number=SeqID_6306
MRGAPTEESLSPFLVRDFGAQSFKIIQRVHKAWESPLRKDKELRGIRNGIIGGYHEWLKVCTRGLDCLSKLKIIDEESFEAPEEDEEVRALKTKLGKARLAKEKFKLVATDVRKKCVGLREENAATARALEQETKRACKEEHGRDKFRGALWGSNSELKLRREERDQSRAHSMV

SEQ ID NO: 123085 - protein, 58 aa, Glycine max
  Coding DNA Sequence Number=SeqID_6307
MAARRLLTRILLPTLCHCHSAPTNKGTVLSLSRPPGCACNSPPPIGDQPGSPKVFPTR

SEQ ID NO: 123086 - protein, 67 aa, Glycine max
  Coding DNA Sequence Number=SeqID_6308
MSGPSDEDKARNKGKEPLEGLGGPMARARTKKAKEALQQVLTMLFEFRPKLQVEKLQIVNYTMFQEE

SEQ ID NO: 123087 - protein, 89 aa, Glycine max
  Coding DNA Sequence Number=SeqID_6309
MDQLKRLSIPSEMLRFSNHACHPRLGHPTRSVHFAPHKHTQHPMYERGPKQEPKTVEGQYTSPPQTYTTCTCQCISNINQHSIFTSFSA

SEQ ID NO: 123088 - protein, 290 aa, Glycine max
  Coding DNA Sequence Number=SeqID_6310
MGEGSVEGQECEFSQRRNRADGFDEEAIAQLLCIPGQDFARTAVGRRVRIMRTSMTTLTQMWMTLLLSNVLPSDHNSDLPLPKCQLVYAILTRMSVHVAQLIADAIYLFAGMPPTRHPLDPDKSNRALWFPALITGLCQSFGVPITPSKVIRPPITRAFIEKYCTPRQAQGDAPQVAHAPPPPHQADPAGSLGMERYLKHLVLQQAANHQGQVQIHECLYQLSLSQQGQGFAPFACPTPDQFRAEVAWPRDWPKAQVGEAPAEAPGDAEEARMDEEMMDLLGFLGGSGAI

SEQ ID NO: 123089 - protein, 73 aa, Glycine max
  Coding DNA Sequence Number=SeqID_6311
MVWRLLSTLLLLHFAAIKIQEAKDSIDEEDPRPTSSNGVTSHLYLLPRTQGLRSSQDPNTNSTLGVSYHIPNY

SEQ ID NO: 123090 - protein, 37 aa, Glycine max
  Coding DNA Sequence Number=SeqID_6312
MWDIPFIPEPNQTLTYVMSSRSTSLELKSQLTINLDP

SEQ ID NO: 123091 - protein, 104 aa, Glycine max
  Coding DNA Sequence Number=SeqID_6313
MTEKEMITMIVGMLPVLYYEKMVGYTPSSFSDLVFVDERIEVGLKRGKFDHPTFMNKKHGANRESKNEGGTHVVTVIRTWPNFPPAQQCKYSANINHSHYPPPY

SEQ ID NO: 123092 - protein, 110 aa, Glycine max
  Coding DNA Sequence Number=SeqID_6314
NWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 123093 - protein, 394 aa, Glycine max
  Coding DNA Sequence Number=SeqID_6315
  Subcellular localization annotation: CTP_CleavageSite=46; ConfidenceScore=5.52e-01
MWSSAPFPEMSASSGGDFFKSHKISRSKSIAFVGRPTRSVILTLRSCDMRRQNLVIPHPFAIQTQSCPMARRDKIWSFCTLVSSRGGGPDDTRRYLTVIRTLVSSRGGRPDDTRRYLTVICTLLSSRGGGPDDTQRQNLDILKPCVVRLQAHDTRRYLMVIRTLLSSRGGGPDDKAETKFGHSAPMIRGDTLWLFAPFCHPEAAGPMTRRDQVWSFCTHDTRRYLMVIRTLLSSRGGGPDDKAETKFGHSAPMIRGDTLWLFAPFCHPEAAGPMTSRDQVWSFCTHDTRRYLMVIRTLLSSRGGGPDDKAETKLGHSAPMIHGDTLWLFAPFCHPEAAGPMTSRDQVRSFCTHDTRRYLMVIRTLLSSRGGGPDDKAETKLGHSAPMIRGDTLW

SEQ ID NO: 123094 - protein, 157 aa, Glycine max
  Coding DNA Sequence Number=SeqID_6316
  Gene Ontology: Cellular component=periplasmic space; Biological process=conjugation
  Homolog annotation: Hit_ID=Q3IUW0; Match level="QueryCoverage=68%, HitCoverage=50%, E-value=2e-15, Identity=43%"; Hit description=TraW precursor
MKGTIDTFRQQTAQSALDKERLAALTKRFGSALDASLSDWQAAHGGVILVKGAVVAGVTDITPGKELGTLGHLFPIAEPDLLAFIGQRLQGMKDSGELDRLQREAEARVKAHAVRPAPVAGLTPAKADRTFLYDPTFTVRETIRDMRDNVIARAGDR

SEQ ID NO: 123095 - protein, 133 aa, Glycine max
  Coding DNA Sequence Number=SeqID_6317
  Gene Ontology: Mol. function=helicase activity; Biological process =protein amino acid phosphorylation
  Homolog annotation: Hit_ID=Q1SN45; Match level="QueryCoverage=99%, HitCoverage=10%, E-value=3e-26, Identity=38%"; Hit description=AAA ATPase
MTDEQASIYNHIVEVVDKDEGGMFFLYGYGGTGKTYIWKTLTSSLRDDNKIVIMVVSSVIASLLLPGAPMAHKFCFEALDHSLRDIIKHNSRDNKIFGGKVMVFGGDFRQILPVIPRGSHSDIVNATINSCYL

SEQ ID NO: 123096 - protein, 108 aa, Glycine max
  Coding DNA Sequence Number=SeqID_6318
MERSMIDASSGGALGDMTPTEARNLIEKMASNSQQFSARNDAIVLRGVLEITIQIFAFLSSNLESMSNLKLMLQTFIIDLFSSKTNSSRIIMTFQATHTIQIGGIIQI

SEQ ID NO: 123097 - protein, 220 aa, Glycine max
  Coding DNA Sequence Number=SeqID_6319
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=7e-33, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSTSEDYMSSTSKDYTFSPLEDYMSLPYEGYTASPFEDYTPSPSEDYTSSASEDYTSSPSEDCTGLHVLTFKGLHVLAFSGLQALAFVGLHAPTLKGLLILTFRGLHVLTFSGLHALALTGLHVLTYRGLHNLAFRGLDALAFRGVHILPLRGLHALTFVGLHTLTFKGVHILNFRGLYIVAIRGLHILAFRGLHVLPFRGQHDLPFRGMQALALTGLH

SEQ ID NO: 123098 - protein, 110 aa, Glycine max
  Coding DNA Sequence Number=SeqID_6320
  Gene Ontology: Cellular component=membrane; Biological process =cellular response to starvation
  Homolog annotation: Hit_ID=Q6D5S9; Match level="QueryCoverage=94%, HitCoverage=15%, E-value=9e-46, Identity=85%"; Hit description =Carbon starvation protein
MPTAKVWCTTSTRKNGAFADVARNAAQHLGRHHEPPAINHLRRIFHRGANQRGRGVHGKVDARIKHRCANQRHDRHKGFHQHRAVADKADMTFALHQFRRGAARNQRMET

SEQ ID NO: 123099 - protein, 121 aa, Glycine max
  Coding DNA Sequence Number=SeqID_6321
MKEFYANLYVPEDKYPKKVRVRGHPIKFDVDSLNNFLETPVVVEQGESLPSYSRFAILRPDPQELAARLCIPGRGFVLIAEGLPWNLLRKDLTTLAQTWSVLSYSNLAPTSHTSDLNLDRA

SEQ ID NO: 123100 - protein, 76 aa, Glycine max
  Coding DNA Sequence Number=SeqID_6322
MSILTLRRKNGRKQKKKRRKVPNQKVGESKKEKKENSQIKEWEKEKEGKKIPDQGSKENKGNVQKGRWTRRYLNNT

SEQ ID NO: 123101 - protein, 108 aa, Glycine max
  Coding DNA Sequence Number=SeqID_6323
VGWKTLTSPGKSRPEDADISGKGAANETFSQSRPEDADIFGKGAGDDIANETFSQSRPKDADISENGAGHLRVPKDSQVTIAKGGAIEKSEAFAPTYPQFVMRNSDLR

SEQ ID NO: 123102 - protein, 140 aa, Glycine max
  Coding DNA Sequence Number=SeqID_6324
MPPTVPVNHYSDPEGQHNRIRILWCYPMLMYTERRLALSTLISSKSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 123103 - protein, 125 aa, Glycine max
  Coding DNA Sequence Number=SeqID_6325
  Homolog annotation: Hit_ID=Q1RYJ7; Match level="QueryCoverage=39%, HitCoverage=3%, E-value=3e-12, Identity=68%"; Hit description =Timeless protein; Timeless C-terminal
MVYGFQEEMRLGFHFLEKRTEGGPGMITIVIQERMNGIGFSPAAYKIWPLFSPMVLPHFKHSRFKDDQHCSHRIAEVLDPDGKISPAQISNMLKRLGLAVAPRRKMCDADAEGPLARKPKDLFIQ

SEQ ID NO: 123104 - protein, 88 aa, Glycine max
  Coding DNA Sequence Number=SeqID_6326
MKKICSNLQGKDNAPPPPPQWIEAKSHVQQGAYECGYYVMHWMWCIVSAGLKNELHNYFSDGTALDTDTMTTIHKKWAAYLLEVGKWM

SEQ ID NO: 123105 - protein, 186 aa, Glycine max
  Coding DNA Sequence Number=SeqID_6327
  Homolog annotation: Hit_ID=Q0KIN0; Match level="QueryCoverage=45%, HitCoverage=4%, E-value=8e-08, Identity=37%"; Hit description =Integrase core domain containing protein
MKVTALKQISHDMIAHVGKARVVVEELRKFLVADSLEKVNRKLDKFYMVLILRSLHSDFDHVRDQVLAGDQVPSMDSLITRLLRVPHVSKDENPTDGVETSAMVASRGRGGGRNIRRGRSGRDGRPHCTYCKRMEKAESRFFDEEYQEYLKLKSDKSNSQAQSSSVPYIPHIVTVANGSKVASQGS

SEQ ID NO: 123106 - protein, 117 aa, Glycine max
  Coding DNA Sequence Number=SeqID_6328
  Subcellular localization annotation: CTP_CleavageSite=33; ConfidenceScore=5.31e-01
MSISAAPAWFFSFFSLFLALSPHLLLWLFSYFHASKLSCSTTITTQDERSFNVLVKDVENTQGEGQKAYLGEQGYFRVKQQLAWASSSLPRRATKVPSARGAEGRVQHSVLRVFSEH

SEQ ID NO: 123107 - protein, 53 aa, Glycine max
  Coding DNA Sequence Number=SeqID_6329
  Subcellular localization annotation: CTP_CleavageSite=50; ConfidenceScore=5.31e-01
MKSGDMRGYLMVTRTFCHPGTASQILLSSSRNIQARRRARFFSAGQGRSSAMA

SEQ ID NO: 123108 - protein, 74 aa, Glycine max
  Coding DNA Sequence Number=SeqID_6330
MRMSPPPLEPHNHSQTHLKLSGQLPLQAPFSADEVRNKIDIKESSLKHNLTASVSLKHKCLSYSLITTSKRSNL

SEQ ID NO: 123109 - protein, 128 aa, Glycine max
  Coding DNA Sequence Number=SeqID_6331
MRLLRCLDQKTLTSSGKVKVTMFVIACYQSRPKEAYISGKGAANETLSKSQPEDANISGRGAANETISQSRLEDSDIFGEAKVTFSQSRPENADFFGKGAEDADIYGEEDVDILRKGEGDDVYHPMLS

SEQ ID NO: 123110 - protein, 114 aa, Glycine max
  Coding DNA Sequence Number=SeqID_6332
  Gene Ontology: Mol. function=DNA-directed RNA polymerase activity; Cellular component=RNA polymerase complex; Biological process =transcription, DNA-dependent
  Homolog annotation: Hit_ID=Q9FJ98; Match level="QueryCoverage=77%, HitCoverage=59%, E-value=1e-20, Identity=60%"; Hit description=DNA -directed RNA polymerase II subunit-like protein
MVLDVLQIVENSGLSDEGAKEDLENKNDELTKEPIDTQDKEEEQPVERPRKTSKYMTKYEHARILGTCALQIRFVQDIYDVPVMVELEGETDPLELVEALRRTRNAVKSKNHIL

SEQ ID NO: 123111 - protein, 83 aa, Glycine max
  Coding DNA Sequence Number=SeqID_6333
MEGRQDVNHDRAEELVQHRGLEEQADHANDGVECRDLDVGLDDDDARQHINDAKQHSFGRFGKTSIATSSEAIEESKKSSTSD

SEQ ID NO: 123112 - protein, 177 aa, Glycine max
  Coding DNA Sequence Number=SeqID_6334
  Gene Ontology: Mol. function=microtubule motor activity; Cellular component=microtubule associated complex; Biological process =microtubule-based movement
  Homolog annotation: Hit_ID=Q84VC0; Match level="QueryCoverage=51%, HitCoverage=14%, E-value=9e-15, Identity=59%"; Hit description =Kinesin-like protein
MVTFSPAYISLANINAEETLKYANRARNIQNKCSKLPQFFVNRDLISNEMQQLRQQLKYLQAKLCSRGGAPVDEVWFSRKGLLGLSLLMRTFVENFTNITVDVTVAFTTVYPLNSFFLSSSSKLSFSRSPLNLSQKNDNLGLIHRWIVIKFKHKSEKNWRNLRDAAIAIGRHVSPLR

SEQ ID NO: 123113 - protein, 189 aa, Glycine max
  Coding DNA Sequence Number=SeqID_6335
  Gene Ontology: Mol. function=identical protein binding; Cellular component=chloroplast; Biological process=thiamin biosynthetic process
  Homolog annotation: Hit_ID=O23787; Match level="QueryCoverage=89%, HitCoverage=48%, E-value=8e-56, Identity=69%"; Hit description =Thiazole biosynthetic enzyme, chloroplast precursor
  Pfam annotation: Domain name=Thi4; Domain location=1-128; Score=38.1; E_value=2.5e-14; Accession=PF01946.7; Description=Thi4 family
MSKILARPNVKRFNAVVAKDLIMKEGRVVTNLALVSMNHDTQSCMDPNVMEAKVVVSSCGHDGPLSATGVKRLKSIGMIDNVPGMKALDTKSIGMVVVRLTREIVLGMIVTGMEVAEIGGSPRMGPYLSMMFKLTFKLMERVELKALGRNNAIDGTCGVGTEEPHLIFASTVEFHDGLESMMLDQVASE

SEQ ID NO: 123114 - protein, 141 aa, Glycine max
  Coding DNA Sequence Number=SeqID_6336
  Gene Ontology: Mol. function=DNA binding; Biological process=DNA integration
MSLYGVVFGKACLFPVEIEHKAYWAVKTCNFFIDQAGEEKKLQLSELDEIRLEAYEIPNFYKEKTKKFHDSLIVKKDFMVGQKVLLYNFRLGLMSVEIKRESTDKSFKVKGHWLKPFLTNPPLGDVGGEEPPLLPPTFFPP

SEQ ID NO: 123115 - protein, 104 aa, Glycine max
  Coding DNA Sequence Number=SeqID_6337
  Gene Ontology: Mol. function=unfolded protein binding; Cellular component=cytosol; Biological process=cellular protein metabolic process
  Homolog annotation: Hit_ID=Q2R330; Match level="QueryCoverage=54%, HitCoverage=9%, E-value=7e-19, Identity=76%"; Hit description =Metallopeptidase family M24 containing protein, expressed
MTVTDDPGYYEDGEFGIRLENVLIVKEADTNFNFGDRGYLSFEHITWAIADIIRTTLGPRFMLKMLFDASGGIMVTNDGNAILHEIDLARPTAKAWLITLAPLL

SEQ ID NO: 123116 - protein, 136 aa, Glycine max
  Coding DNA Sequence Number=SeqID_6338
PNSQKCPQWSRQLSQRALLRASEARLTGALSKGGNMRGVATNEGISTSHVEKSGALAPTYPPSKRKSYLRSSFFKGEELATQLAQASKVASSRSNNLLAFWRKNVEGPTFEEVTKTHGLRKTPPFDFRHITEFSWI

SEQ ID NO: 123117 - protein, 86 aa, Glycine max
  Coding DNA Sequence Number=SeqID_6339
MRRGKSEANIEKKKDTTPNEGKEVHYSLVPSRKEKERHLARFLDIFKKLEITLPFGEALQQMPLCAKFLKDMLTKKNRKSSRRLGS

SEQ ID NO: 123118 - protein, 72 aa, Glycine max
  Coding DNA Sequence Number=SeqID_6340
KNPKEECKAVMTRSRRATHLDKSEVEKKIEEHKQQLAPKPALEPVSNSVELEEINEEPKDDKEEETPIKEKE

SEQ ID NO: 123119 - protein, 84 aa, Glycine max
  Coding DNA Sequence Number=SeqID_6341
MDDMGLNQYRFFNMVHDILVKVKLEVTRTSTILNVFGSKRSSDMKMQGSRMSKHENKRYAVCRTKSMLNAYDDAMTHAKCDAGI

SEQ ID NO: 123120 - protein, 71 aa, Glycine max
  Coding DNA Sequence Number=SeqID_6342
MEVWKYVSYPRGQTRGRNRRIGGRGRMSILHAVPMKATMAFTPGSTFIPFSLCLGLVVNHTPHTSLSSSIP

SEQ ID NO: 123121 - protein, 68 aa, Glycine max
  Coding DNA Sequence Number=SeqID_6343
MRGRKEKLASERSGDVKQVCGRKDRVCYSKREGGGSIQAQQIGETREEAINPQWQLNWTSLSDKRRIF

SEQ ID NO: 123122 - protein, 84 aa, Glycine max
  Coding DNA Sequence Number=SeqID_6344
MSDKPAKTKAFRSYYSIPKSNISPNFKEKLGLCENQIINFLNKNRQRKKLCLRCGQGFPYLIKIGEKCIESCQIKFMKESYEFE

SEQ ID NO: 123123 - protein, 147 aa, Glycine max
  Coding DNA Sequence Number=SeqID_6345
  Homolog annotation: Hit_ID=Q1SQL2; Match level="QueryCoverage=72%, HitCoverage=81%, E-value=3e-16, Identity=37%"; Hit description=4Fe -4S ferredoxin, iron-sulfur binding
  Pfam annotation: Domain name=DUF1677; Domain location=38-147; Score =149.2; E_value=1.1e-41; Accession=PF07911.4; Description=Protein of unknown function (DUF1677)
MEQNQQKLRKAVSDVSKEIGRYYNDLELERQLGAIEEVEQAECQCCGIKEDCTTVYITEVQECYCGKWVCGLCSEAVKERVGRSPKVAMQDALNSHRDFCQEYNATTRLNPQLSITLSMREIAKRSLENRKSKGLSIKKLSRTSSYP

SEQ ID NO: 123124 - protein, 50 aa, Glycine max
  Coding DNA Sequence Number=SeqID_6346
MALGVMAACPGELLLQPEVTLLAQVKARVPKELKISVISKKKVLCNNNIS

SEQ ID NO: 123125 - protein, 136 aa, Glycine max
  Coding DNA Sequence Number=SeqID_6347
  Homolog annotation: Hit_ID=Q337Z8; Match level="QueryCoverage=64%, HitCoverage=87%, E-value=1e-14, Identity=44%"; Hit description =Expressed protein
  Pfam annotation: Domain name=DUF1677; Domain location=32-131; Score =133.7; E_value=4.9e-37; Accession=PF07911.4; Description=Protein of unknown function (DUF1677)
TTVSDITLIERNKEVAIEETHDEYILPTVSEVENAKCECCGMFEECTREYIRRVREMFLGRLICGLCGEAVNVEMEKNGGKREKALKEHMSDCVRFNRLGRSYPALYQAEDVKEILKKTQKKAMSNTPDDSKGSPS

SEQ ID NO: 123126 - protein, 135 aa, Glycine max
  Coding DNA Sequence Number=SeqID_6348
  Gene Ontology: Mol. function=protein serine/threonine kinase activity; Cellular component=integral to membrane; Biological process=protein amino acid phosphorylation
  Homolog annotation: Hit_ID=Q8S7A6; Match level="QueryCoverage=99%, HitCoverage=49%, E-value=2e-24, Identity=38%"; Hit description =Putative receptor protein kinase
  Pfam annotation: Domain name=LRR_1; Domain location=114-133; Score =5.6; E_value=26; Accession=PF00560.23; Description=Leucine Rich Repeat
  Pfam annotation: Domain name=LRR_1; Domain location=19-41; Score =13.8; E_value=0.65; Accession=PF00560.23; Description=Leucine Rich Repeat
  Pfam annotation: Domain name=LRR_1; Domain location=43-65; Score =13.8; E_value=0.63; Accession=PF00560.23; Description=Leucine Rich Repeat
  Pfam annotation: Domain name=LRR_1; Domain location=67-88; Score =17.9; E_value=0.038; Accession=PF00560.23; Description=Leucine Rich Repeat
  Pfam annotation: Domain name=LRR_1; Domain location=90-112; Score =19.0; E_value=0.017; Accession=PF00560.23; Description=Leucine Rich Repeat
  Pfam module annotation: Pfam domain module=LRR_1::LRR_1::LRR_1::LRR _1::LRR_1; Domain location=114-133::19-41::43-65::67-88::90-112
MDDNLFNGSIPISMMKLSSLSWLNLASNKLSGYIPKEIGQLRSLKYLLLGFNNLSGTIPPTIGMLANLVELNLSSNSISGQIPSVRNLTNLESLKLSDNSLSGPIPPYIGDLVNLIVFEIDQNNISGLIPSSIGN

SEQ ID NO: 123127 - protein, 90 aa, Glycine max
  Coding DNA Sequence Number=SeqID_6349
MCGNKFKGASFETLELHNLYIEGERNIFCPENSNSFETKASLKQAMLPLKWCYKKAFPLLRSLKIPISQKNPSTRNTAMKKLRRQEGMRE

SEQ ID NO: 123128 - protein, 72 aa, Glycine max
  Coding DNA Sequence Number=SeqID_6350
MTNLWLSECCLAKPSVARAKRCPRGLSAIRCGMHKAKPALIAKPLCEIKMESRKRKSTASRPQAQYDTRRFL

SEQ ID NO: 123129 - protein, 294 aa, Glycine max
  Coding DNA Sequence Number=SeqID_6351
  Gene Ontology: Mol. function=protein serine/threonine kinase activity; Cellular component=cytoplasm; Biological process=protein amino acid phosphorylation
  Homolog annotation: Hit_ID=Q66MH6; Match level="QueryCoverage=89%, HitCoverage=79%, E-value=8e-73, Identity=50%"; Hit description=MAPKK
  Pfam annotation: Domain name=Pkinase; Domain location=12-273; Score =235.5; E_value=1.1e-67; Accession=PF00069.15; Description=Protein kinase domain
  Pfam annotation: Domain name=Pkinase_Tyr; Domain location=12-273; Score=36.2; E_value=1.1e-14; Accession=PF07714.7; Description =Protein tyrosine kinase
  Pfam module annotation: Pfam domain module=Pkinase::Pkinase_Tyr; Domain location=12-273::12-273
SSPGIIKDLSDLEKLAVLGHGNGGIVYKVYHTKNRSFYALKVLRLNENGIGILEAEILKRVNSPYIVRCHAVFDNDNCSEGDIGFVMEYMEGGSLHDVLQEHHRLPEEVISVLAKRVLEGLNYLHGMHIVHRDIKPSNLLVNDKGEVKIADFGVSHVVEGKFEVSDSNAGTCAYMSPERIDPDRWGGENADEFAGDVWATGVVMLECFLGYFPLIGPGQRPDWATLMCAICFGEKLEMPEKASPEFQNFVRRCLEKNWRKRATVLELLHHPFVGRNCCCSSTGLGDYVLRGQVH

SEQ ID NO: 123130 - protein, 170 aa, Glycine max
  Coding DNA Sequence Number=SeqID_6352
MNSSSPAHSSLSTTAVVGGGGGGGGSSNATVSIDDFHLPCDPISSQERKDEAMLVLKSDLMAALNKEVKSLVEDNWKFEGPRSRIHLVSHRGVDGLMLRSLISSWCEISVFGSSLKVPHPVRLGRIHVHSLNSRWRGCFHEPVTSDSQGSNLTVVPRLALGLDIKKMYTL

SEQ ID NO: 123131 - protein, 681 aa, Glycine max
  Coding DNA Sequence Number=SeqID_6353
  Gene Ontology: Mol. function=signal transducer activity; Cellular component=membrane; Biological process=response to light stimulus
  Homolog annotation: Hit_ID=Q9FKB6; Match level="QueryCoverage=90%, HitCoverage=96%, E-value=0.0, Identity=72%"; Hit description=Non -phototropic hypocotyl-like protein
  Pfam annotation: Domain name=BTB; Domain location=80-192; Score= -14.0; E_value=0.075; Accession=PF00651.21; Description=BTBPOZ domain
  Pfam annotation: Domain name=NPH3; Domain location=272-531; Score =388.5; E_value=1e-113; Accession=PF03000.5; Description=NPH3 family
  Pfam module annotation: Pfam domain module=BTB::NPH3; Domain location= 80-192::272-531
MAKELPQQQHLQLGLSLSLHYYLKPTTTLLLSFLSHSVLFYYITCFFSLPMDRTTDKQQHQQQQLSLAKGTRQRNNEWIFRDVPSDVTIEVNRGTFSLHKKFLYDCSNSYFFCMKFPLVSRSGRIRRLVAEHRDSDISRVELLNLPGGAECFELAAKFCYGINFEIRSTNVAQLCCVSDYLEMTEDFSKDNLGSRAEEYLDSIVCKNLEMCVEVLQQCESLLPLADELKVVSRCIDAIASKACAEQIASSFSRLEYSSSGRLHMSRQAKCDGDWWIEDLSVLRIDMYQRIITAMKCRGVRPESIGASLVNYAQKELTKKSSLWNPSSQTKVDSNSTLHEKLVVETVVSLLPVEKLAVPINFLFGLLRSAVMLDCTIASRLDLERRIGSQLDVATLDDILIPSFRHAGDTLFDVETVHRILVNFCQQDDSEEEPEDTSVFESDSPPSPSQTALIKVSKLVDNYLAEIAPDANLKLSKFMVIAETLPAHARTVHDGLYRAIDIYLKAHQGSTDLDKKKLCKLIDFQKLSQEAGAHAAQNERLPLQSIVQVLYFEQLRLRNSLSCSYAEDDTKPIHQSWRISSGALSAAMSPRDNYASLRRENCELKLELARLRMRLNDLEREHVCMKRDMTKSGSRKFMSSFSKKIGKLSLFGHSSSRGSSSPSRNSQRTDSKVIERTCASTE

SEQ ID NO: 123132 - protein, 113 aa, Glycine max
  Coding DNA Sequence Number=SeqID_6354
  Gene Ontology: Mol. function=transition metal ion binding; Cellular component=cytoplasm; Biological process=fucose metabolic process
MGDRLKDMIRDLGQESFQQAHAPMYDTLQTDSKKPLYPGCKNSLTLLSAVLSLVNVKARYGWSDKSFSSLLQVVHDMLPEENALPKSYYQAKKILCLMGMEYQKIHACLNDCI

SEQ ID NO: 123133 - protein, 102 aa, Glycine max
  Coding DNA Sequence Number=SeqID_6355
MGIQVIIILFYWKASFISHIGRSSFSMHHHDLGTRILDDTGDNTAGKKMINTRQKAGDFHSLLKDVIGLIGSHFPVCIDFIPRTRMSELFLWKIKSKGTPKD

SEQ ID NO: 123134 - protein, 66 aa, Glycine max
  Coding DNA Sequence Number=SeqID_6356
MGDCMRHTARVLIIGEVSATLKEVIDDIEGGNVSKVIVVDKGDGVDGEMKSELMVFSQGKSDVNSS

SEQ ID NO: 123135 - protein, 766 aa, Glycine max
  Coding DNA Sequence Number=SeqID_6357
  Gene Ontology: Mol. function=transferase activity, transferring hexosyl groups; Cellular component=mitochondrion; Biological process= metabolic process
  Homolog annotation: Hit_ID=Q84KB6; Match level="QueryCoverage=72%, HitCoverage=93%, E-value=2e-72, Identity=27%"; Hit description =Fertility restorer homologue
  Pfam annotation: Domain name=PPR; Domain location=235-269; Score =24.1; E_value=0.00051; Accession=PF01535.11; Description=PPR repeat
  Pfam annotation: Domain name=PPR; Domain location=270-304; Score =24.9; E_value=0.00028; Accession=PF01535.11; Description=PPR repeat
  Pfam annotation: Domain name=PPR; Domain location=344-378; Score =22.5; E_value=0.0015; Accession=PF01535.11; Description=PPR repeat
  Pfam annotation: Domain name=PPR; Domain location=379-413; Score =45.2; E_value=2.3e-10; Accession=PF01535.11; Description=PPR repeat
  Pfam annotation: Domain name=PPR; Domain location=414-448; Score =38.7; E_value=2e-08; Accession=PF01535.11; Description=PPR repeat
  Pfam annotation: Domain name=PPR; Domain location=449-483; Score =32.7; E_value=1.3e-06; Accession=PF01535.11; Description=PPR repeat
  Pfam annotation: Domain name=PPR; Domain location=484-518; Score =38.1; E_value=3.1e-08; Accession=PF01535.11; Description=PPR repeat
  Pfam annotation: Domain name=PPR; Domain location=519-553; Score =37.9; E_value=3.4e-08; Accession=PF01535.11; Description=PPR repeat
  Pfam annotation: Domain name=PPR; Domain location=554-588; Score =26.2; E_value=0.00012; Accession=PF01535.11; Description=PPR repeat
  Pfam annotation: Domain name=PPR; Domain location=589-623; Score =34.5; E_value=3.7e-07; Accession=PF01535.11; Description=PPR repeat
  Pfam annotation: Domain name=PPR; Domain location=624-658; Score =33.3; E_value=8.2e-07; Accession=PF01535.11; Description=PPR repeat
  Pfam annotation: Domain name=PPR; Domain location=682-716; Score =41.5; E_value=2.9e-09; Accession=PF01535.11; Description=PPR repeat
  Pfam annotation: Domain name=PPR; Domain location=717-751; Score =41.7; E_value=2.5e-09; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=235-269::270 -304::344-378::379-413::414-448::449-483::484-518::519-553::554 -588::589-623::624-658::682-716::717-751
MVLMSATLPVSEFIWLPCKLFFCLKCLQTFAQIHVKEGTVSNLQCPEAKCACMIPTGLLKPFLDDTDYERWESMILEKTLASMSDAGMMPCWHSMHESRYEASDFAVFLHVVNMLSWVWFDPPPSALPTPMLVQVLFLCFFCIDVRRPLSRVFKSLSWSVARKKKFGNWVECHGFSHSISCFRIIVHAFALAGMRLEVWALLRDIVGFCNEAKYDTFELFSAFLDSPQHVERSGVVFDVLISVFASNSMLENALDVFSNAKHVGLEPDIRTCNFLLKCLVEANRVEFVRRVFEELKDRGPSPNIYTYTIMMNFYCSDVGCDAGMRQAAVILGKIYRSGEKPTVVTYSTYIHGLCKVGNVEAALMLIRNLHYTNQPLNSHSFNDVIYGFCKRGEVFEALQVLEEMKSSGILPDVYSYSILINAFCGKGDVMKCLDLMEEMEHSQIKPSIVSYTSLIHGLCKKNMLQNAVDIFHSIGASSCKYDSTVYETLIDGFCMQGDMDSAIKLLEEMICNELVPTAFSCRSLIRGYYKLGLFDQALEVFNAMLRDGIWPDTIACNYILDGSCRAGYFKEALTLLEDFQEHGFNLNPHSYNAIIYKLCKEGYPERALELLPRMLKRNVLPSVVNYSTLISGFAKQSNFKRAVNLFTRMVKVGITFNIATEMKKAWALFEEMSREGCSPNVITYTCIIDGFCKSNRIDLATWVFDKMNRDSVIPDVVTYTVLIDWYHKHGYFDQAHKLYDVMKDKGVLPDDITHNVLGLKAGTVQE

SEQ ID NO: 123136 - protein, 76 aa, Glycine max
  Coding DNA Sequence Number=SeqID_6358
MVQWSLSATVGVIDYAYQLPMWISNGLVAHFCEDVRVALTDILKLPLMDKSNGCSFSSISSIAVFSSAVSVVSLIP

SEQ ID NO: 123137 - protein, 135 aa, Glycine max
  Coding DNA Sequence Number=SeqID_6359
  Gene Ontology: Mol. function=transferase activity; Cellular component= mitochondrial inner membrane; Biological process=transport
  Homolog annotation: Hit_ID=UPI0000D55940; Match level="QueryCoverage =84%, HitCoverage=49%, E-value=2e-23, Identity=46%"; Hit description =PREDICTED: similar to asparagine-linked glycosylation 14 homolog
  Pfam annotation: Domain name=Alg14; Domain location=1-124; Score =112.1; E_value=1.6e-30; Accession=PF08660.1; Description =Oligosaccharide biosynthesis protein
GHTAEMLNLLAVLQKGRFNPRFYIAAATDNMSLQKAQLLENSLAAENATRVTDTAQFMKIYRSREVGQSYITSVWTTFVAMVHALWLMIKIRPEVILCNGPGTCIPLCAIAFIFKYRKSEKALLERPAPVQVADG

SEQ ID NO: 123138 - protein, 927 aa, Glycine max
  Coding DNA Sequence Number=SeqID_6360
  Gene Ontology: Mol. function=ATPase activity, coupled to transmembrane movement of substances; Cellular component=integral to membrane; Biological process=transport
  Homolog annotation: Hit_ID=Q8LPK2; Match level="QueryCoverage=99%, HitCoverage=99%, E-value=0.0, Identity=61%"; Hit description =Multidrug resistance protein 2
  Pfam annotation: Domain name=ABC_membrane; Domain location=42-319; Score=143.7; E_value=5.1e-40; Accession=PF00664.13; Description=ABC transporter transmembrane region
  Pfam annotation: Domain name=ABC_membrane; Domain location=682-927; Score=74.5; E_value=3.3e-19; Accession=PF00664.13; Description=ABC transporter transmembrane region
  Pfam annotation: Domain name=ABC_tran; Domain location=394-578; Score= 212.7; E_value=8.4e-61; Accession=PF00005.17; Description=ABC transporter
  Pfam module annotation: Pfam domain module=ABC_membrane::ABC _membrane::ABC_tran; Domain location=42-319::682-927::394-578
MSDRGTLSGDSAVDDAKSNKKEHKVSLLKLFSFADFYDYVLMGVGSVGAIVHGASVPVFFIFFGKLINVIGLAYLFPKEASHKVAKYSLDFVYLSIAILFSSWTEVACWMHTGERQAAKMRMAYLKSMLNQDISLFDTEASTGEVISSITSDIIIVQDALSEKVGNFMHYISRFVAGFVIGFVRVWQISLVTLSIVPLIALAGGLYAYVTIGLIAKVRKAYVRAGEIAEEVIGNVRTVQAFAGEERAVRSYKAALMKTYVNGRKAGLAKGLGLGSMHCVLFLSWSLLVWFTSIVVHKNIANGGESFTTMLNVVIAGLSLGQAAPDISAFIRAKAAAYPIFEMIERDTVSKSSSKTGRKLGKLEGHIQFKNICFSYPSRPDVAIFNNLCLDIPSGKIVALVGGSGSGKSTVISLIERFYEPLSGQILLDRNDIRELDLKWLRQQIGLVNQEPALFATSIKENILYGKDDATLEELKRAVKLSDAQSFINNLPDRLETQVGERGIQLSGGQKQRIAISRAIVKNPSILLLDEATSALDAESEKSVQEALDRVMVGRTTVVVAHRLSTIRNADMIAVVQGGKIVETGNHEELMANPTSVYASLVQLQEAASLHRLPSIGPSMGRQPSITYSRELSRTTTSLGGSFRSDKESIGRVCAEETENAGKKRHVSAARLYSMVGPDWFYGVAGTLCAFIAGAQMPLFALGISHALVSYYMDWETTCHEVKKIAFLFCGAAVITVTVHAIEHLSFGIMGERLTLRVREMMFSAILKNEIGWFDDTNNTSSMLSSQLETDATLLRTIVVDRSTILLQNIGLVVASFIVAFILNWRITLVVIATYPLIISGHISEKLFMKGYGGNLSKAYLKANMLAGEAVSNIRTVAAFCSEEKVLDLYANELVDPSKRSLQRGQIAGIFYGISQFFIFSSYGLALW

SEQ ID NO: 123139 - protein, 114 aa, Glycine max
  Coding DNA Sequence Number=SeqID_6361
MNTSKPYTGAMRVTVHEPQPYTGAMRGIVYEPQVNIGADQKFSPVDGFKQKKGQTLEFTLQTAPWPSLQNGQVTKSNGTYTRREFPERFAKDRIRLHELSPLSKGQSICVFQKN

SEQ ID NO: 123140 - protein, 192 aa, Glycine max
  Coding DNA Sequence Number=SeqID_6362
MTNLWLSECCLAKPSVARAKRRPRGLSAIRYGMHKAKPVLLAKPLFEIKMASRKRKNTASRSQAQYDTKQFHSLDAWNRYTDNILGRNILPERNVQIYHTEFDEFKVELERHNLHKCLANLQDGSIDVAVVKEFYANLYTTKDQSPKQARVRGHLIKIDTDSLNEFLQTPVVLEEGESLPTYSRFCRLRTNP

SEQ ID NO: 123141 - protein, 60 aa, Glycine max
  Coding DNA Sequence Number=SeqID_6363
MVFYPKVQQQNKNEGSKELTCIVAALMQKKAKMKENECEREDADSTAVSNKSHRLGLACR

SEQ ID NO: 123142 - protein, 160 aa, Glycine max
  Coding DNA Sequence Number=SeqID_6364
MYKQNQKDFPRLVVRLGYKNSLVFLRLKGLDSKRAQILDLSQWVQNFDNIIQLKKGAKDIIIIQVRVTTSPDDKSERSAIPLTGEVGRSAVSLAGELGGAAASSDDASKMIIRGGDGGTTSRSREDSGFTTGDYGSAGSGSTCTSVGSGGAASLGLTNGS

SEQ ID NO: 123143 - protein, 199 aa, Glycine max
  Coding DNA Sequence Number=SeqID_6365
  Homolog annotation: Hit_ID=Q6CQF2; Match level="QueryCoverage=19%, HitCoverage=48%, E-value=3e-10, Identity=76%"; Hit description =Kluyveromyces lactis strain NRRL Y-1140 chromosome D of strain NRRL Y- 1140 of Kluyveromyces lactis
MCPGRMWNGESRSADRLGTLTDADCDGGQARAVDMLVETSSSRLWMAARALGVPRHLRAPGVGLWAPHSARLETRTKESDMCASQRASKPVRRKEADWWDPPHTCRDPKDGELCLSGAKPEETLVEARSDTDVQIVRLTWVGRCGCSVEPRHGIESSKWAIFGKQNWRCGMNRKLGYGAQLRANLDPTKGVGRLRQQDG

SEQ ID NO: 123144 - protein, 239 aa, Glycine max
  Coding DNA Sequence Number=SeqID_6366
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=1e-33, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
DYTSSPLEDYTSLPFRGQHDLPFRGLHALTLTGLHVLTFRGLHVLAFRGLHVLAFRGLQVLPFGGLHVLSLRGLHVFTFRGLHALTFRGLHALALTGLHVLTFRGLHNLAFRGLDALAFRGVHILPLRGLHALAFVGLHTLTFKGVHVLNIRGLYIVAIRGLHVLAFRGLHVLHFRGLHAHTFKGLAQATFIGLHALGFVRLHALTFRGLHMLAYRGLHAFAFVGLHALTFRGLHILVF

SEQ ID NO: 123145 - protein, 63 aa, Glycine max
  Coding DNA Sequence Number=SeqID_6367
MDIYLHITKPSSMTSFVFTKTMTKFKYFFHSCHEKIDKYTEKKNQRPERREREDIEGLYNGAL

SEQ ID NO: 123146 - protein, 88 aa, Glycine max
  Coding DNA Sequence Number=SeqID_6368
MAHGLVKPSSWCLITLDDWKENSNGKAGGADGGSPTNLPTITNGERQKRKAKGSEILFLSSFKEIKVHWREVPMEKGISLPMEKEHVL

SEQ ID NO: 123147 - protein, 116 aa, Glycine max
  Coding DNA Sequence Number=SeqID_6369
  Gene Ontology: Cellular component=integral to membrane
  Homolog annotation: Hit_ID=P64485; Match level="QueryCoverage=50%, HitCoverage=71%, E-value=5e-17, Identity=74%"; Hit description =Hypothetical protein yeaQ
  Pfam annotation: Domain name=Transgly_assoc; Domain location=13-61; Score=69.0; E_value=1.5e-17; Accession=PF04226.4; Description =Transglycosylase associated protein
MPGKDGGGFIVTVILGIIGAVVGGWISTLFGFGKVDGFNFGSFVVAVIGAIVVLFIYRKDGKAQPDCFPAGEAARKAKPAPPVACCTTSNSPLFVRYKYFVSEPDGGVADSANKMN

SEQ ID NO: 123148 - protein, 180 aa, Glycine max
  Coding DNA Sequence Number=SeqID_6370
MKTLDEAMDLIESMAASDIAILRDRAYIPTKKSLLELTSQDALLAQNKLLSKQLETLTETLRCTIYGGAHESRCCIPNEEQIAHEVNYMGNQPRGNFNTSGFPGFQNNKQYQQQRQWKNHPGNQFNRDQGGSSTRPQQQMPSLYDRTMKLEETLAQLMQVSMSNQKSTKSAIKNLEVQVG

SEQ ID NO: 123149 - protein, 127 aa, Glycine max
  Coding DNA Sequence Number=SeqID_6371
MDFAMEGWIRNQFKVPTLRRSIDFLSQLLTALEFTEIRKCDCHFNFRECMLDDCLDECSEIREQEEEGVADALNGVGIDGVRNAEKKNKMVRVEEKNKNNSIGERSLVGPSLFQAFAMERNCVHYRS

SEQ ID NO: 123150 - protein, 365 aa, Glycine max
  Coding DNA Sequence Number=SeqID_6372
  Gene Ontology: Mol. function=acyl carrier activity; Cellular component=chloroplast; Biological process=fatty acid biosynthetic process
  Homolog annotation: Hit_ID=Q9SQI3; Match level="QueryCoverage=70%, HitCoverage=60%, E-value=4e-76, Identity=55%"; Hit description =Myristoyl-acyl carrier protein thioesterase, chloroplast precursor
  Pfam annotation: Domain name=Acyl-ACP_TE; Domain location=90-360; Score=338.2; E_value=1.4e-98; Accession=PF01643.8; Description=Acyl -ACP thioesterase
  Subcellular localization annotation: CTP_CleavageSite=49; ConfidenceScore=5.60e-01
MAAISNISLQFPGNLTDAKKDNNVLRLSFCSPRNTTNMSSEKRRFLSVSASYSDSPRKIDTANRVNVNGIHVAEAPLQAGKLANDPSAADEAIVTSLRGRFVEDKTATMETLMNFLQETALNHVTSSGIGGEGFGATREMSLRKLIWVVTRIQVQVQRYNKWGDEIEVDTWVDAAGKNGMRRDWIIRDHYTKEIITRATSTWVIMNRQTRRLSKIPEEVKQELLPFYLNRLAVPTEETDCEKIDKLTDETAQIRILSGLAPRWNDMDANQHVNNVKYIGWILESVPIEVLEHYNMTSMTLEFRRECTQSNLLESMTCPTARVMESNNNSKNRKPDMQYTHLLRLQQDKADVVRARTEWNFKQKHQ

SEQ ID NO: 123151 - protein, 77 aa, Glycine max
  Coding DNA Sequence Number=SeqID_6373
  Homolog annotation: Hit_ID=O48783; Match level="QueryCoverage=88%, HitCoverage=21%, E-value=2e-11, Identity=59%"; Hit description =Expressed protein
MPLKCSIKGKPDISVTVQEVLEKARSEVKDEFFLSVLMSAWHPSSLPLWGFGFWFWSMCSRIRKRSVKGFTSIELQI

SEQ ID NO: 123152 - protein, 249 aa, Glycine max
  Coding DNA Sequence Number=SeqID_6374
  Gene Ontology: Mol. function=acyl carrier activity; Cellular component=chloroplast; Biological process=fatty acid biosynthetic process
  Homolog annotation: Hit_ID=O04794; Match level="QueryCoverage=97%, HitCoverage=56%, E-value=6e-54, Identity=47%"; Hit description=Acyl -ACP thioesterase
  Pfam annotation: Domain name=Acyl-ACP_TE; Domain location=13-244; Score=170.7; E_value=3.8e-48; Accession=PF01643.8; Description=Acyl -ACP thioesterase
MSPAVGEVRTVLELLRKWTFAISFGLLLVFKFKYRDIANDNHKYDRRDEIEVETWFDVAGKNGTRRDWIVRDHYTKEIIAKATSIWAIVNQETRRLCKIPEEVRQELVTFYFNRFAIAREEIDHQKIQKLTDDTAESFRFGVTPGRNDMDVNQHVNNVKYITWILESVPREVLEDYKMTSITLEFRRECTQSDLLESLIGPSSSVIGASDNNSINRKPGLQYIHLLRLQDNKAELVRARTDWHLKQNHE

SEQ ID NO: 123153 - protein, 159 aa, Glycine max
  Coding DNA Sequence Number=SeqID_6375
  Gene Ontology: Mol. function=molecular_function; Cellular component =integral to membrane; Biological process=biological_process
  Homolog annotation: Hit_ID=Q2R3W9; Match level="QueryCoverage=87%, HitCoverage=96%, E-value=1e-42, Identity=57%"; Hit description=HVA22- like protein e, putative, expressed
  Pfam annotation: Domain name=TB2_DP1_HVA22; Domain location=4-101; Score=166.8; E_value=5.5e-47; Accession=PF03134.9; Description =TB2DP1, HVA22 family
MGKLWTLIIQLHSIAGPVVTLLYPLYASVVAIESQSKLDDEQWLAYWIIYSFLTLAEMVLQPILEWIPIWYDVKLLTVAWLVLPQFAGAAYLYERFVREHIRKYITERQYLYGNHQQQSKKSPNNGGKAKKFVEFVTPKKGRGKMEKGIWVAAQESNTL

SEQ ID NO: 123154 - protein, 431 aa, Glycine max
  Coding DNA Sequence Number=SeqID_6376
  Gene Ontology: Mol. function=RNA-directed DNA polymerase activity; Cellular component=intracellular; Biological process=RNA-dependent DNA replication
IPMLQANPLPNHGTAVNMIQDCDENGVILYVQHIRTPLVPIHIKMCEAALFDHDHAACEICPVNVKGCPKVQGDIQGLIDSRELTITRKDREVCVITPEFQRLEISYNSGESTTTPLVISLPGPMPYASLKAVPYKYSATMLEGGQEVPLPSPTLAISVDNIASDGKVLRNGRVIPTLFAKKVNDPAVKQATVNGPGTRKEVGQSNGTSKNSDHDEILKLIQKKAHREALMKVLDQAFVERDVTVNQLDSIVGNITACNNLSFSDEELPEEGRNHNLALHISVNCKSDALSNVLVDTGSSLNVMAKSTLDQLFYQGPPMRRSGVVVKAFDGSRKSVIGEVDLPITIGPFVFQITFQVMDIQAAYSCLLGRPWIHEAGAVTSTLHQKLKFVRNGRLITVSGEEALLVSHLSAFSFIGADETEGTSFQGLTVE

SEQ ID NO: 123155 - protein, 156 aa, Glycine max
  Coding DNA Sequence Number=SeqID_6377
  Gene Ontology: Mol. function=nucleic acid binding; Cellular component= chromatin; Biological process=DNA integration
MVCMEEQKVILGTHSLVEEAEYWLENTRQCLEAEGQAVTWETFKRVFMEKYFPKDVRNKEMKFLELKQGNMTVVEYASKFEELVRYFPHYLGRDGESSKCVKFLNGMRPKIWDEDSQYWAAYYRSRDPMKNKKNGSQNWGIPYPTPPKQHGNRPNN

SEQ ID NO: 123156 - protein, 97 aa, Glycine max
  Coding DNA Sequence Number=SeqID_6378
MVQGKFVPNLGEVIIKKKGKYGEGMNEKVKVILWMNALLEPKLLNPRKTMNCWQPNPITSLESPSDSFLCVHYCMIGDEMQRLELVLVVYDGISLNT

SEQ ID NO: 123157 - protein, 264 aa, Glycine max
  Coding DNA Sequence Number=SeqID_6379
MAEIKEVQEKMKADMEALKDQMASMIEAILSMKRMMESNEVLVSTSIQHIGHNRNAYPPPPNYTPPNAIHIPNENANRAVPVPLEGQQPQLVGDTREEPRDHAQGEFDLYPTFTTEGPAFNAMPQPITMGAPQHRPLQPLHFSVGRLPSTMEEREKLDLIEERLRVFEVFGDFPFADIVDLCLVPDVIIPSKFKVSDFVKYKGTTCPKNYLKMYCRKMGAYSRDEKLLMHFFQESLAKVPVSWYTNLEASRIHSWKDLITAFIR

SEQ ID NO: 123158 - protein, 112 aa, Glycine max
  Coding DNA Sequence Number=SeqID_6380
  Subcellular localization annotation: CTP_CleavageSite=43; ConfidenceScore=5.07e-01
MFSNTYGQISPSGVVLQTISPDGALFKDFPAWGTFGRVLHACSTQTARTTGEFGVCEKIAIHTGDTPRYAAVQAVAVQVQSRQQGAEQITIPIGDLRFTGIASMAGGLCFVL

SEQ ID NO: 123159 - protein, 243 aa, Glycine max
  Coding DNA Sequence Number=SeqID_6381
  Gene Ontology: Mol. function=hexokinase activity; Biological process =glycolysis
  Homolog annotation: Hit_ID=Q93IS7; Match level="QueryCoverage=99%, HitCoverage=48%, E-value=1e-109, Identity=78%"; Hit description=SciI protein
  Pfam annotation: Domain name=DUF877; Domain location=1-236; Score =252.0; E_value=1.3e-72; Accession=PF05943.2; Description=Protein of unknown function (DUF877)
MPRFLARLPYGIRTNPVDSFDFEEQTDGSNHNGYTWSNAAYAMAANINRSFKEYGWCTAIRGVESGGAVENLPCHTFPSDDGGVDMKCPTEIAISDRREAELAKNGFMPLVHRKNSDFAAFIGAQSLQKPAEYHDADATANARLAARLPYLFACCRFAHYLKCIVRDKIGSFRERDEMERWLNDWVMSYVDGDPANSSQETKSRKPLAAAEVSVEEQEDNPGYYAAKFFPASALPAGRPDGVT

SEQ ID NO: 123160 - protein, 84 aa, Glycine max
  Coding DNA Sequence Number=SeqID_6382
MALAQHNGLERVELNLQQSFTIKRDGKSIGILIQGRGWVKEVHPVCFIGWSRDGEHVDQFLLTIGQDEWEATGCHKISAVGVIS

SEQ ID NO: 123161 - protein, 146 aa, Glycine max
  Coding DNA Sequence Number=SeqID_6383
  Homolog annotation: Hit_ID=Q13YG2; Match level="QueryCoverage=99%, HitCoverage=100%, E-value=1e-08, Identity=24%"; Hit description =Putative cytoplasmic protein
  Pfam annotation: Domain name=DUF796; Domain location=4-122; Score =70.1; E_value=7e-18; Accession=PF05638.2; Description=Protein of unknown function (DUF796)
MAIDMFLKVDGVTGESKDSNHTGWTDITSFGWGATQPGNMAVGGGGGAGKAAFNNLAVDALIDKSTTAILKHCASGGQQVEYARITLEDVLVVSVNYNGSNNGDVLGVSYAFQAAKVKQQYWEQTSSGGKGAESSAGWNIKENKEA

SEQ ID NO: 123162 - protein, 68 aa, Glycine max
  Coding DNA Sequence Number=SeqID_6384
  Subcellular localization annotation: CTP_CleavageSite=35; ConfidenceScore=5.12e-01
MAGVGRYMTPTDIFQPTLRNFFYKRWPIMTARFFRASSTEGSDVNLTRNGSLDTGYEDLDDATSSEGR

SEQ ID NO: 123163 - protein, 109 aa, Glycine max
  Coding DNA Sequence Number=SeqID_6385
  Gene Ontology: Mol. function=RNA-directed DNA polymerase activity; Cellular component=intracellular; Biological process=RNA-dependent DNA replication
MEEDYKPLAQPQRRINPTMKKVVRKEVVKLLKAEMIYPISDSQWVTPVQVVPKKGGMIVIKNGKTNELIPTHTVMGWRMCIDYKKLNKATRKDHFSLSFMDQMLEKLAW

SEQ ID NO: 123164 - protein, 182 aa, Glycine max
  Coding DNA Sequence Number=SeqID_6386
  Homolog annotation: Hit_ID=Q84VH5; Match level="QueryCoverage=79%, HitCoverage=25%, E-value=9e-60, Identity=73%"; Hit description =Envelope-like protein
KLSAGKLSVKYAILHRIGAANWVPTNHTSTVATESFAVKLPIAFPTVLCGIMLSQHPNILNNIDSVMKRESALSLHYKLFEGTHVPDIVSTSGKAAASGAVSKDALIAELKDTCKVLEATIKATTEKKMELERLIKRLSDSGIDDGEAAEEEEEAAEEEEEAAEEDAAEDTESDDDDSEATP

SEQ ID NO: 123165 - protein, 91 aa, Glycine max
  Coding DNA Sequence Number=SeqID_6387
  Subcellular localization annotation: CTP_CleavageSite=81; ConfidenceScore=5.82e-01
MPPKAAGTSLRGGRSSGKGFKLALPEPTTKKSSSKSSGSPTQAGSSTQKTKVEWSSTQIISVKPESYTQESPKSTTAKQTSADYAWSIQIQ

SEQ ID NO: 123166 - protein, 826 aa, Glycine max
  Coding DNA Sequence Number=SeqID_6388
  Gene Ontology: Mol. function=protein binding; Cellular component =membrane; Biological process=defense response
  Homolog annotation: Hit_ID=Q1SW19; Match level="QueryCoverage=96%, HitCoverage=84%, E-value=1e-172, Identity=43%"; Hit description =Disease resistance protein
  Pfam annotation: Domain name=LRR_1; Domain location=606-627; Score =8.6; E_value=6.9; Accession=PF00560.23; Description=Leucine Rich Repeat
  Pfam annotation: Domain name=LRR_1; Domain location=629-650; Score =11.5; E_value=2; Accession=PF00560.23; Description=Leucine Rich Repeat
  Pfam annotation: Domain name=LRR_1; Domain location=778-800; Score =2.2; E_value=1.1e+02; Accession=PF00560.23; Description=Leucine Rich Repeat
  Pfam annotation: Domain name=NACHT; Domain location=194-350; Score= -39.3; E_value=0.067; Accession=PF05729.3; Description=NACHT domain
  Pfam annotation: Domain name=NB-ARC; Domain location=157-465; Score =276.5; E_value=5.1e-80; Accession=PF00931.13; Description=NB-ARC domain
  Pfam module annotation: Pfam domain module=LRR_1::LRR_1::LRR _1::NACHT::NB-ARC; Domain location=606-627::629-650::778-800::194 -350::157-465
MEKLQEIAASLAVDYLLPPLKKAVNSVMEVPRDVAEMKDKLDGIQAIIHDVDKMAAAEEGNSHDGLKAKVKQLVETSFCMEDIVDEYMIHEEKQLGDDPGCAALPCKAIDFVKTTASRFQFAYMNEDVKSEFGGIKERNGSEDSSQIQSSGGNQNIPFDNLRMAPLYLKEAEVVGFDGPRDTLEKWLKEGRKKRTVISVVGMGGLGKTTLAKKVFDKVRTHFTLHAWITVSQSYTIEGLLRDMLLKFVEEEKRVDHSSMDKKSLIDQVRKHLHHKRYVVVFDDVWNTLFWQEMEFALIDDENGSRILITTRNQDVVNSCKRSAVIKVHELQPLTLEKSLELFYTKAFGSEFGGHCPSNLKDISTEIVKKCHGLPLAIVVIGGLLFDEKKEILKWQRFYENLSSELGKNPSLSPVKKILNFSYHDLPYNLKPCFLYFGIYPEDYKVERGTLILQWIAEGFVKSEATETLEEVAEKYLNELIQRSLVQVSSFTKGGKIKSCGVHDLVHEIIREKNEDLSFCHSASGRENLPRSGMIRRLTIASGSDNLMESVVNSNIRSLHVFSDEELSESSVERMPTNYRLLRVLHFEGDSLYNYVPLTENFGDLSLLTYLSLKNTKIENLPKSIGALHNLETLDLRYSGVRMMPREFYKLKKLRHLLAHDRFFGLMGRVQMEGGIGVLTSLQTLRDMEADYDAEEVMKELERLTQLRVLGLTDVREEFTSSLCSLINKLQHLEKLYIKAQYKLGVNDLQFDVCAPVLQKVRIVARLKEFPNWVAKLQNLVRLSLGKSCLTDDPLPLLKDRQIYCIGFFLKTIYETGSVSKLIATGV

SEQ ID NO: 123167 - protein, 198 aa, Glycine max
  Coding DNA Sequence Number=SeqID_6389
  Subcellular localization annotation: CTP_CleavageSite=44; ConfidenceScore=5.68e-01
MGKNKGRQSHSAAKQIMVKGTTSGSGKSQTSTTSSLASCLDVVQANQNAYTASQDNLVGKVLVKKVGTSSAKIDDVAHQMFDNLSECSAESESSLEVSCTLGDNDSTTDDDSSHSCGYKSSPQLDDNKTPTPWVNLFKDNRNPSKGFGMKFSPPPSNDEVLLEEIDLQPLEEAWGHNLIGYVVGRFPGKKALLDCCQK

SEQ ID NO: 123168 - protein, 399 aa, Glycine max
  Coding DNA Sequence Number=SeqID_6390
  Gene Ontology: Mol. function=ubiquitin-protein ligase activity; Cellular component=ubiquitin ligase complex; Biological process =protein ubiquitination
  Homolog annotation: Hit_ID=Q2HVY1; Match level="QueryCoverage=90%, HitCoverage=94%, E-value=1e-153, Identity=73%"; Hit description=U box
  Pfam annotation: Domain name=U-box; Domain location=5-80; Score=74.0; E_value=4.6e-19; Accession=PF04564.6; Description=U-box domain
MDEIEIPAHFLCPISLQLMRDPVTVCTGITYDRENIERWLFSCKNNTCPVTKQCLLDHGLTPNHTLRRLIQSWCTLNASLGVERIPTPKSPIDKTQIVKLLTEAKRFPEKQLKCLTRLRSVAFEGQRNKTCLESAGVIEFLATTMKNNNTQEDSTVLSEAAIEVLFHLNLSEARLKTLINNEEFHFIESLFHVLRLGNYQSRVYATMLLRSAFEVADPIQLISVKTALFVEIMRVLCDQISHQASKAALKLIVELFPWGRNRIKGVEDGTVSVLIELLLGTSERRTCELILIALDQLCGCAEGRAELLNHGAGVAIVSKKILRVSHVASERGVGAVSKLCLVLQVNCGFKTKERAKENYKCSKEFKLADFTEMGVRFEGVIAHLTPQILMSAAIATNYR

SEQ ID NO: 123169 - protein, 419 aa, Glycine max
  Coding DNA Sequence Number=SeqID_6391
  Gene Ontology: Mol. function=ubiquitin-protein ligase activity; Cellular component=ubiquitin ligase complex; Biological process =protein ubiquitination
  Homolog annotation: Hit_ID=Q3HLY8; Match level="QueryCoverage=99%, HitCoverage=99%, E-value=3e-92, Identity=44%"; Hit description=U-box protein
  Pfam annotation: Domain name=U-box; Domain location=5-82; Score=94.1; E_value=4.3e-25; Accession=PF04564.6; Description=U-box domain
MTEIEIPQFFLCPISLQIMKDPVTTVTGITYDRESIEKWLLKAKDCTCPITKQPLPRSPEFLTPNHTLRRLIQAWCSANEANGVDQIPTPKSPLSNSNAEKLVKDLEVSSRFQKALEKLHALAMENERNRRCMASAGVAEAMVHVITKIFKQGNKTTPCVEEALRILRLLWSSANMVDSNNNNNNKIKRMVGENFDFLNSLTWALQLQTKNNVKLTNEAMPILKLVIEAKDSTPLGNLKLEFFKVVVSVMKNRELSQQAVKSALHVLIETCPLGRNRMKIVEAGAVIELIELALEKPEKNMTELVFILLANLCSCADGREQFLQHAAGIAVVSKRILRVSPTTNDRALHIFSLVSKFSASNEVVQEMLRVGAVSKLCMVLQADCASYLKEKARGVLRLHSKTWNNSPCIQVYLLTRFHR

SEQ ID NO: 123170 - protein, 67 aa, Glycine max
  Coding DNA Sequence Number=SeqID_6392
MVRQLSPVLSRTLESDQFPLLNDPNKACIYLIKVKAYSGQGGIFWSIGDFRLFLFIGQLMMDGDHLD

SEQ ID NO: 123171 - protein, 126 aa, Glycine max
  Coding DNA Sequence Number=SeqID_6393
  Gene Ontology: Mol. function=ribonuclease H activity
  Homolog annotation: Hit_ID=Q1RYI2; Match level="QueryCoverage=86%, HitCoverage=16%, E-value=2e-09, Identity=29%"; Hit description =Ribonuclease H
MELFACNLGRSSVLQAGLWAIFHGIQLARERVLFKLEFQSDSREAIDLVNEGWDDSNEAFPMVRAIKEAIQPYLQVIFKHILREGNLTAGAMAKFGLSMGQSLFFVDPPDFVLPMLCADKTAFSVP

SEQ ID NO: 123172 - protein, 270 aa, Glycine max
  Coding DNA Sequence Number=SeqID_6394
  Gene Ontology: Mol. function=nucleic acid binding; Biological process= regulation of transcription
  Homolog annotation: Hit_ID=Q69XQ3; Match level="QueryCoverage=91%, HitCoverage=83%, E-value=5e-70, Identity=56%"; Hit description=KH domain-containing protein / zinc finger protein-like
  Pfam annotation: Domain name=KH_1; Domain location=145-207; Score =63.4; E_value=7.5e-16; Accession=PF00013.19; Description=KH domain
  Pfam annotation: Domain name=zf-CCCH; Domain location=237-262; Score =40.1; E_value=7.4e-09; Accession=PF00642.15; Description=Zinc finger C-x8-C-x5-C-x3-H type (and similar)
  Pfam annotation: Domain name=zf-CCCH; Domain location=72-98; Score =34.1; E_value=4.8e-07; Accession=PF00642.15; Description=Zinc finger C-x8-C-x5-C-x3-H type (and similar)
  Pfam module annotation: Pfam domain module=KH_1::zf-CCCH::zf-CCCH; Domain location=145-207::237-262::72-98
MLTWLLLCMGALLDLCAVTAGCPFGEGCHFLHYVPGGYNVVAHMMNLKPAAPPPRTVAAPPPIPNGSAPSAVKTRICNKFNTAEGCKFGDKCHFAHGEWELGKPIAPSIDDHHHHRPLGPPAGGRMAGRIEPPPAMAGSFGAISTAKISVEASLAGAIIGKGGVNSKQICRQTGAKLSIREHESDPNLRNIELEGTFEQIKEASNMVKDLLLTVSMSAPPKSTPGVPGAPAPPGSNFKTKLCENFAKGSCTFGERCHFAHGAAELRKSGV

SEQ ID NO: 123173 - protein, 83 aa, Glycine max
  Coding DNA Sequence Number=SeqID_6395
MCLQFMILLWKLLKKRRCKKLLVNSLSKADWLSESHPLSEADNSLSGCKTLEEDKSEISVLSAQPARPTRMLSLLALSTPKLA

SEQ ID NO: 123174 - protein, 112 aa, Glycine max
  Coding DNA Sequence Number=SeqID_6396
  Subcellular localization annotation: CTP_CleavageSite=80; ConfidenceScore=5.23e-01
MTRKSEINSLSLLTLTKELGFLISPLTLSLFSSPHCLLLSLLSPLKAVRSTIPSLTLRFSHENSISVQASLTVTSPLTVVALAASVDIRGFGRQSHQACKTTTFILYQCLTL

SEQ ID NO: 123175 - protein, 120 aa, Glycine max
  Coding DNA Sequence Number=SeqID_6397
MHEQKKRKRVCFKAGEEAFSGEFGFRVLTTTARSSPRLFRSEPPTSLSPRIQVPGDHFPACHPPPAEEVVKRERKKKGKKENFWVIFTGRATGGESEKGGGREVALLLSGSETVSGVRYR

SEQ ID NO: 123176 - protein, 179 aa, Glycine max
  Coding DNA Sequence Number=SeqID_6398
  Homolog annotation: Hit_ID=Q00M75; Match level="QueryCoverage=35%, HitCoverage=11%, E-value=6e-10, Identity=58%"; Hit description=PPR -repeat containing protein
MVSANNNSKGGSFAVAYSRGKGKGDERRFLGIQGWEVPGGIESLIFMGHFPKGKEKVECRRKNKRKLLPNVNQLIKVAPDAKSTTLGTTPARTGSGWVGILKDMSKFNKLEQEGFLEGNMKASRSFGVTLLVWYTLALQVPAIDDGFCRASPGAAVKLCLGDLLVMGSNPETASLHMQG

SEQ ID NO: 123177 - protein, 499 aa, Glycine max
  Coding DNA Sequence Number=SeqID_6399
  Gene Ontology: Mol. function=malate transporter activity; Biological process=response to aluminum ion
  Homolog annotation: Hit_ID=Q14UU8; Match level="QueryCoverage=62%, HitCoverage=80%, E-value=2e-56, Identity=42%"; Hit description =Putative aluminum activated malate transporter
  Pfam annotation: Domain name=UPF0005; Domain location=44-339; Score =201.2; E_value=2.4e-57; Accession=PF01027.11; Description =Uncharacterised protein family UPF0005
MASVNGNNEGGGAAGARVTKFLQWLMALPSEFSAKVVDVMSQIKKVGKEDPRRVIHALKVALSITLVSAFYYVNPLYDGFGSSAMYAVFTVIVVSEFSVGNYRDHEVLDIALKRVISIISGGLISVSVSIFVCPIWAGGDLHNLESKNIEKLGNFLEGFGEEYFGRSEGGESNKLFMQGYKSVLTSKQVEETLANFARWEPCHGRFRFRHPWQQYLKIGNLSRQCAYRIDALNGFLNSAKTPLEMRGKIPDPCIKMSTEAGKALKELAMAIHKMIPPSAANPHIAKSKIAATNLRSIMKTGLWEDTNLFEVIPVLTVASLLLHVVSCTEKLAESIQELSTLAKFKNQDSEFVPKSPQQKETPQPCCHNSGPHHRGDSWKAIRNNLAPPTTCPCRREGSSTRSVAALSDFSTLSCFFMKERMMALEENEVHRAEVVDGAASGLKERGDELAGGREGTEVRLGEELEEDLVAKDVNEGGEGEVVIGSEVGVGDGENGKGGE

SEQ ID NO: 123178 - protein, 423 aa, Glycine max
  Coding DNA Sequence Number=SeqID_6400
  Homolog annotation: Hit_ID=Q10JE0; Match level="QueryCoverage=98%, HitCoverage=76%, E-value=1e-79, Identity=42%"; Hit description =Expressed protein
MEGEGGGEGLNQAVQQQLNLKQVKTRAISLFKAISRILEDFEAYGRTNSTPKWQDILGQYSMVNLELFNIVDDIKKVSKAFVVHPKNVNAENATILPVMLSSKLLPEMETDDTAKRDQLLLGMQNLPIGMQMEKLKARLDLISAACEGAEKVLADTRKAYCFGTRQGPAIAPTLDKGQAAKIQEQENLLRSAVNAGDGLRIPGDQRHITPAQPPLHLADALPVIVNDPTAQPQLSSNTMPAQNSLLQTSSASQLLGRSAASPSGATSTTSFDNTTASPIPYANSPRSSTNMMNTPSPQPQTTQQQPQVQQQQRQKLMQLPKQQQQHHQILAQQQQFRQSAMQGLGQLACFHHQLHGQHQMQFSQPLGHQQFQGRQLPSGHVQHGIGQSQLNQGNQMTRLSQFSGPANSALFSAAQTTPNTQMV

SEQ ID NO: 123179 - protein, 95 aa, Glycine max
  Coding DNA Sequence Number=SeqID_6401
  Gene Ontology: Mol. function=calcium ion binding
  Homolog annotation: Hit_ID=O82062; Match level="QueryCoverage=87%, HitCoverage=23%, E-value=6e-15, Identity=50%"; Hit description=39 kDa EF-Hand containing protein
MGSRNVSGYEAEMVSIFSQIESPDRSLHDHIIEALGKLIVEQGIPYVTKKVLSNIVEPALLSQDGSDLDKPVSQETFLEEFKIVTMSVANRVNVN

SEQ ID NO: 123180 - protein, 115 aa, Glycine max
  Coding DNA Sequence Number=SeqID_6402
MYQCPCIISEVIELDDENDDIWLPTIPDMMVKRRIVVVLGSVNSDFKLSGITSQECQQEWMCIPMLWVDNLRKVQKCLSSYAAEISSSFGWKVPTGSDSDDGGDGSINQKTQLKS

SEQ ID NO: 123181 - protein, 449 aa, Glycine max
  Coding DNA Sequence Number=SeqID_6403
  Gene Ontology: Mol. function=malate transporter activity; Biological process=response to aluminum ion
  Homolog annotation: Hit_ID=Q14UU8; Match level="QueryCoverage=91%, HitCoverage=85%, E-value=1e-89, Identity=42%"; Hit description =Putative aluminum activated malate transporter
  Pfam annotation: Domain name=DUF939; Domain location=50-359; Score= -173.3; E_value=0.064; Accession=PF06081.2; Description=Bacterial protein of unknown function (DUF939)
  Pfam annotation: Domain name=UPF0005; Domain location=36-416; Score =403.3; E_value=3.6e-118; Accession=PF01027.11; Description =Uncharacterised protein family UPF0005
  Pfam module annotation: Pfam domain module=DUF939::UPF0005; Domain location=50-359::36-416
MAMLAGAEHTTGYTHTCKTLLEKSQAKLVNFTNMVISLGKDDPRRVIHSFKVGLALILISILQYFRPSFYAFGDNIMWAVLTVVLVLEFSVGATLGKGLNRVLATGLAGAFGVSIRRIASFSGDKGKAVLTSMFVFFIAGTVTFMRFSPRLKASYDYGLIIFILTFCLVSLSDNTENELLEVAQERLLTIIIGSCIAIVVSICICPVWIGQDLHNQIAGNIQKLADFLEGFGDEYFNNLGNTEEAAGDNKPFFHRYESVLSSKGSEETMAVLARWEPCHGGFRFHHPWKQYLKVGNQIRLCAYKIKALSVFLLRSEQTPYELRNRIQEPCTNISMESGMALKESLLILKHMTKSSMPNPHVANAKNAAESLKSVLRTNPWEGADHLEIIPAATVASLLIDIVICVENICEAVDELATLANFVPSELLHRGTVQPISNSDGLVHVISVAE

SEQ ID NO: 123182 - protein, 785 aa, Glycine max
  Coding DNA Sequence Number=SeqID_6404
  Gene Ontology: Mol. function=DNA binding; Cellular component=beta -galactosidase complex; Biological process=DNA integration
  Homolog annotation: Hit_ID=Q1RSI0; Match level="QueryCoverage=94%, HitCoverage=92%, E-value=1e-103, Identity=44%"; Hit description=IMP dehydrogenase/GMP reductase
  Pfam annotation: Domain name=zf-CCHC; Domain location=200-217; Score =14.4; E_value=0.0042; Accession=PF00098.13; Description=Zinc knuckle
  Pfam annotation: Domain name=zf-CCHC; Domain location=224-241; Score =7.3; E_value=0.062; Accession=PF00098.13; Description=Zinc knuckle
  Pfam module annotation: Pfam domain module=RVT_2::Retrotrans_gag::zf -CCHC::zf-CCHC; Domain location=416-560::26-131::200-217::224-241
MGFLTGTISISARTNPLFSYWECCNTLLMSWLIHFVSPSIAQSIIFFENAAAIWTDLRERFSQGDLLRFAELQEEIYSLKQGSTSVTDYYTTLKSLWEELDNFRPLTPCTCSAKDFHHQDFIIRFLKGLNERFAMVRSQILLLDPLPSANKVFSMIIQHEQHHSTNISPSLDVNLFANVVSSRSRGIPQSGGGKSNSSNRKCDHCGRLGHTSDACYQKQGNTIPKCEHCTRYGHTMDICYARFGYPPGHPKYSSRPHLPNKTGTFRGGAAGGAAVNNTIREGNQTLHGEAHKDGSATIPRPNITQAQFQQLMALLQKTQVGGANTNDIPIRANISHSSPNSVSDLCGWIFELQWGPLMVIFHHGDAAEDKGKELSNMFNQLQRALIPFNPPSHMTGYLPLIIDTSCLCPLSLSPPAFKKPFNINTPPRVRPIGCKWVYKIKRLPDGSIERHKACLVAKGFSQIEGVDYFETFSPVVKMSTIRVVLALASINHWTIQQLDVSNAFLHGDLSEDVYMMIPSGLPVAHSSQGISLCQRKYCLDLLKDYGMLGCKPSSTPMDSTLRLHADSSSLLPNPLPYRRLVGRLIYLTSTRPDIAFAMQQLSQFMSKPTKAHHHAAIKVLRYLKSDPSLAIAFFIGNSLVSWKTKKQNTVSRSSSKAEYRALASATCELQWLTFLLRDLQVPCSPQPSLYCDNQSALHIAANLVFHERTKHLDIDCHLVREKSQIGLMRLLPVSSSNQLADIFTKALSPRLFTMNLSKLQLADIYLPPTCGGLKEEDHNPNLITT

SEQ ID NO: 123183 - protein, 369 aa, Glycine max
  Coding DNA Sequence Number=SeqID_6405
  Gene Ontology: Mol. function=binding; Cellular component=nucleus; Biological process=protein kinase C activation
  Homolog annotation: Hit_ID=Q2HSJ6; Match level="QueryCoverage=99%, HitCoverage=89%, E-value=1e-157, Identity=54%"; Hit description =Tetratricopeptide-like helical
  Pfam annotation: Domain name=PPR; Domain location=1-35; Score=7.5; E _value=0.97; Accession=PF01535.11; Description=PPR repeat
  Pfam annotation: Domain name=PPR; Domain location=164-198; Score =27.5; E_value=4.8e-05; Accession=PF01535.11; Description=PPR repeat
  Pfam annotation: Domain name=PPR; Domain location=199-233; Score =13.7; E_value=0.18; Accession=PF01535.11; Description=PPR repeat
  Pfam annotation: Domain name=PPR; Domain location=279-313; Score =12.2; E_value=0.27; Accession=PF01535.11; Description=PPR repeat
  Pfam annotation: Domain name=PPR; Domain location=63-97; Score=41.6; E_value=2.7e-09; Accession=PF01535.11; Description=PPR repeat
  Pfam annotation: Domain name=SLEI_Leptospira; Domain location=178 -190; Score=7.0; E_value=5.8; Accession=PF07620.2; Description=SLEI
  Pfam annotation: Domain name=SLEI_Leptospira; Domain location=213 -225; Score=3.3; E_value=46; Accession=PF07620.2; Description=SLEI
  Pfam annotation: Domain name=SLEI_Leptospira; Domain location=77-89; Score=5.7; E_value=12; Accession=PF07620.2; Description=SLEI
  Pfam module annotation: Pfam domain module=PPR::PPR::PPR::PPR::PPR::SL EI_Leptospira::SLEI_Leptospira::SLEI_Leptospira; Domain location=1 -35::164-198::199-233::279-313::63-97::178-190::213-225::77-89
MVDTALIDMYAKCGRVESARLAFDQMGVRNLVSWNMMIDGYMRNGRFEDALQVFDGMPVKNAISWTALIGGFVKKDYHEEALECFREMQLSGVAPDYVTVIAVIAACANLGTLGLGLWVHRLVMTQDFRNNVKVSNSLRDMYSRCGCIELARQVFDRMPQRTLVSWNSIIVDFAANGLADEALNNFNSMQEEGFKLDGVSYTGALMACSHAGLIDEGLGIFENMKRRLEEALNVLKNMPMKPNEVILGSLLAACRTQGNISLAENVMNYLIELDPGGDSNYVLLSNMYAAVGKWDGANKVRRRMKKRGIQKKPGFSSIEIDSSIHKFVSGDKSHEEKDHIYAALELMSFELQICGYIPDFSGKESYEDD

SEQ ID NO: 123184 - protein, 164 aa, Glycine max
  Coding DNA Sequence Number=SeqID_6406
  Gene Ontology: Mol. function=diacylglycerol kinase activity; Cellular component=intracellular; Biological process=protein kinase C activation
  Homolog annotation: Hit_ID=Q2HSJ7; Match level="QueryCoverage=98%, HitCoverage=62%, E-value=8e-55, Identity=54%"; Hit description =Tetratricopeptide-like helical
MVLAHKPFDRHTLPVVLKSCAGLSALRLGQQVHGAVLVNGFGLDLANSNALMNMYGKGGHLVCARKVFDRMWKRNEIAFSTMMAGYGMHGKCGESWGFIDKGREYFEMMEVRFGVKPGLQHYTCMVDMLGRVEQGACKTHGKLEVTERVVERVYGRELRFASSV

SEQ ID NO: 123185 - protein, 124 aa, Glycine max
  Coding DNA Sequence Number=SeqID_6407
MDKGSGRKWRKMEKNGDEILQMNVPFDSNMNRLVSASQDDESTGALARGYEAPSKKTGVPPVEEVGEAGGQIGQVVLTVKDARESWCSLARRKEHSSRKSKSPLWDYASIYLCWDKLGKQNQQF

SEQ ID NO: 123186 - protein, 76 aa, Glycine max
  Coding DNA Sequence Number=SeqID_6408
  Homolog annotation: Hit_ID=Q2HV05; Match level="QueryCoverage=75%, HitCoverage=5%, E-value=6e-14, Identity=63%"; Hit description =Peptidase S8 and S53, subtilisin, kexin, sedolisin; WD40-like
MAECFPPSDGVGRGATGGRDLASNSQIITSMLVPTTTRCGCKCEKSNENTPIVGCRCGACEKSKHTCHRCAARRAN

SEQ ID NO: 123187 - protein, 105 aa, Glycine max
  Coding DNA Sequence Number=SeqID_6409
MASKFIFTTVVLLMLLCLLLMREPSGCGSAYECFGANAADLRDIPNRKVLSVLKDKKTSALKASLQGSSSNKYGEKPLNWELRKVPSGPDPLHHNGVNPKKPQTP

SEQ ID NO: 123188 - protein, 154 aa, Glycine max
  Coding DNA Sequence Number=SeqID_6410
  Gene Ontology: Mol. function=RNA-directed DNA polymerase activity; Cellular component=intracellular; Biological process=RNA-dependent DNA replication
VTLEDPLALDPECSPIKQNLRRMKPEMSLKIKEEGKKKFDAGFLAIARYPEWVANIVPVPKKNGKLKNTGATYQWAMVALFHNMMHKEIEVYMDDMIAKLRKYRLRLNLAKCIFEVKSEKLLDFIMSQKGIEVDPDKVKAILEMPEPRTEKQVR

SEQ ID NO: 123189 - protein, 214 aa, Glycine max
  Coding DNA Sequence Number=SeqID_6411
  Subcellular localization annotation: CTP_CleavageSite=71; ConfidenceScore=5.37e-01
MAEPSKKRKGTSSRSQQHSGSQEAPIPPSIPSGSLFSSEEQRTRYTNLFSSRSIVDPKFIDMEFFSNENFECFQAFENFNLIPFMSLKLPVYSELVKAFYSNLEIHEGTLNSEVYGIKMVIDQSLFYDLTKLPSEGVPFEGALIYEWKFDFSVHDARRLVCINQADMTGRLLAGSLAFESRILHYLIVRILLPRSSNLAQVFEDDLIVMWAFHK

SEQ ID NO: 123190 - protein, 137 aa, Glycine max
  Coding DNA Sequence Number=SeqID_6412
SVGDCLDAIFSRSMKYPFFAQFEKVYPGQRFTRYAILGDDVCIADENVASLYRQTVACFQAGPAARKRSLPVLTWISGDGIRRPEATSSRGRSLALGDRLAAFSDRGSLAVVWVELKPSPLEPYAGELARAVLRGES

SEQ ID NO: 123191 - protein, 64 aa, Glycine max
  Coding DNA Sequence Number=SeqID_6413
MAAEWRKGKGDWRCDLFEGRQVHRITQVSSGGCEGRWSTCWSSYWATDATNSLPNCWIEWPQNN

SEQ ID NO: 123192 - protein, 35 aa, Glycine max
  Coding DNA Sequence Number=SeqID_6414
MASKFIFTTVVLLMLLCLLLMREPSGTTRNNELAK

SEQ ID NO: 123193 - protein, 169 aa, Glycine max
  Coding DNA Sequence Number=SeqID_6415
  Gene Ontology: Mol. function=protein serine/threonine kinase activity; Cellular component=nucleus; Biological process=protein amino acid phosphorylation
  Homolog annotation: Hit_ID=Q0WPH8; Match level="QueryCoverage=97%, HitCoverage=17%, E-value=3e-87, Identity=92%"; Hit description =Protein kinase like protein
  Pfam annotation: Domain name=Pkinase; Domain location=8-166; Score =32.0; E_value=1.8e-10; Accession=PF00069.15; Description=Protein kinase domain
  Pfam annotation: Domain name=Pkinase_Tyr; Domain location=8-167; Score=-95.7; E_value=1.4e-06; Accession=PF07714.7; Description =Protein tyrosine kinase
  Pfam module annotation: Pfam domain module=Pkinase::Pkinase_Tyr; Domain location=8-166::8-167
MESRMDHYEIMEQIGRGAFGAAILVNHKAEKKKYVLKKIRLARQTERCRRSAHQEMALIARIQHPYIVQFKEAWVEKGCYVCIVTGYCEGGDMAALMKKSIGVYFPEEKLCKWFTQILLAVEYLHSNFVLHRDLKCSNIFLTKDQDVRLGDFGLAKTLKADDLASSDSC

SEQ ID NO: 123194 - protein, 72 aa, Glycine max
  Coding DNA Sequence Number=SeqID_6416
  Gene Ontology: Mol. function=DNA binding; Biological process=DNA integration
MVIEGIVLGHKISVHGIEVDKAKAEVTEKLSPPTNVKGIRSFLGHEFDLEIKDKKGSENHLADHVSKLTIDE

SEQ ID NO: 123195 - protein, 750 aa, Glycine max
  Coding DNA Sequence Number=SeqID_6417
  Gene Ontology: Mol. function=protein serine/threonine kinase activity; Cellular component=nucleus; Biological process=protein amino acid phosphorylation
  Homolog annotation: Hit_ID=Q2HSJ8; Match level="QueryCoverage=93%, HitCoverage=67%, E-value=0.0, Identity=62%"; Hit description=Protein kinase
MTLVVGTPNYMCPELLADIPYGFKSDIWSLGCCIYEMAAHRPAFKAFDMAGLISKINRSSIGPLPPCYSPSLKTLIKGMLRKNPEHRPTASEILKHPYLLPYVDQYRSSFCTPTAGSPERPISAVHHPRKNKPESQNSSSSLSPEKDSFMSSEKNTANEVKKCDRKITEIDLTSIEDDSSEQLLPEEEGNGSSRVNAKTDEKELTKQSNNVHHSNAVSKQPKPIKNVVTALKDGKLRETSSPIRGNRIKVGGVLTHKINSETVSKLPKPNFGAYDLKPNLEVPTTAPSKTTPDSAKRMQGLHTSKHQLPMIESTPKTKPRHNAIPPSGPVKQVEGREVPSKPRQKTRPSLLKPPSFPGHVRQAGFDVPNATNNTGKSSPKKMVWEPKMSHHQLTNTHLPHVSRETTREPLKTFETSSKGMQTDSSNSVSSSLSIQGFELSDFATTFIDLSEPTLPDHESLNHTENVESCPYSISCASYLHLEMSEQLSGETPVVTPCFQDITSNEKVSPSLTLDHSGQDAEVMFASDDSFSINQRTASAGSRCDNLSVDPSAEITQEIKDPQDSKEMSSAKSLQQSLLISGEKSVCEEFGPSSKGSNRLDKVSRPKLMCISTGDDKFMVRERLSSVDETAPSIISTKISSQKVLQEEKGMVLQNPAPERPAVGHLPPAFDDVIHVIRHSSYRVGSEQPGKESVEMGVQNVDVDLLQQNRLEELAVVLKPFGKDKVSPRETAIWLAKSLKGLMIEESGGRS

SEQ ID NO: 123196 - protein, 229 aa, Glycine max
  Coding DNA Sequence Number=SeqID_6418
MTYKDLLPSLIANQLDMVIPGMIFQSSLPKCKVQSLIEAGWLTFQEDGPNIKTNPLSNHGGGAVNAIEAGVIPRGGHKEDSCLMHLRVLHNMETCSVVRDLLQQMIDQGRHECWALDLFLFLKRTAAQFRGGTPPGARSCVRTPLLPTHPMNVKGKAKVTEGEDVKAIPTPDEVVLTEEFAEGRESRGKKKVLNEARVAQDISIDGFVGIVNNIIANNYLTFAEEEIPA

SEQ ID NO: 123197 - protein, 65 aa, Glycine max
  Coding DNA Sequence Number=SeqID_6419
ARDRQVITRPAQDVKEALLGGNLEVAMKKLPAKRSRKGTIEEDSNVAPQADTGFKKYQFQSVEHQ

SEQ ID NO: 123198 - protein, 163 aa, Glycine max
  Coding DNA Sequence Number=SeqID_6420
  Homolog annotation: Hit_ID=UPI0000612705; Match level="QueryCoverage =46%, HitCoverage=93%, E-value=2e-07, Identity=31%"; Hit description =UPI0000612705 related cluster
MLLIRVKPWVLVPSPSEDYMSSPPEDYMSSPLEDYASSPSEDYTSSLSEDCTSSPSKGCTPSPSKGDTSSTLEGCTPSPLEGYASSFSVCFISAPSENSRASSFLLSVPGPPPNIERRPTMQAQPEREAITQLLCIPGQDFTRAAAKRRVWVMRTNMTTLTQI

SEQ ID NO: 123199 - protein, 92 aa, Glycine max
  Coding DNA Sequence Number=SeqID_6421
MGEKEEKKRRNSSPICFRLLLEEVTQLAWASWAATSSPWLCISAVFGEKNYFREENSSQGASVTLSRRLREGIGEGFPSFFTVLHPFFVLQR

SEQ ID NO: 123200 - protein, 159 aa, Glycine max
  Coding DNA Sequence Number=SeqID_6422
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=80%, HitCoverage=63%, E-value=1e-29, Identity=43%"; Hit description =Protein ULTRAPETALA2
MILDFKRGEDYIEVLCGATNKKYGDYVGRLKINNEGQYFITCECCPECPLVNVTLEAFEKHALRDGSGRWKRNIWVHCEDEDKIPLWKTPLIKDEFLRCTRCGKEHRFHLKSRPDIKKYHDALNNKCWTCSLWPYQNWYLVLQNTLYAGKRYWGLTMCQ

SEQ ID NO: 123201 - protein, 84 aa, Glycine max
  Coding DNA Sequence Number=SeqID_6423
  Homolog annotation: Hit_ID=Q8H6Q8; Match level="QueryCoverage=100%, HitCoverage=2%, E-value=7e-11, Identity=41%"; Hit description=CTV.20
MVATTYQTSHECSEETIIDILVAGFSGQLKGWWDNYLTNDEKTLADFRWYRDTFLTRVYPREDSQQPFWKEKCLARLPRSLGDK

SEQ ID NO: 123202 - protein, 50 aa, Glycine max
  Coding DNA Sequence Number=SeqID_6424
MKLIRQALKSAIFHLLAKPADWLSELPLSARKTLEEDEFYKFAKRTASSN

SEQ ID NO: 123203 - protein, 168 aa, Glycine max
  Coding DNA Sequence Number=SeqID_6425
MKKSRVLNYCKCNPFIRKLGGNRKRSNFQNKNWIQHKQLSPKFSNKIKTPHTKRICRSFRPDPSLDYGHLPSLFASTSGVRGDWREIVLQRHRSTLFGSQILSLSLAQIFSLSHIHQMGRGEKGNWLTSHFPPRRWQPQAHTLAFLDRADISILGLGMNLATTLAAEC

SEQ ID NO: 123204 - protein, 53 aa, Glycine max
  Coding DNA Sequence Number=SeqID_6426
MVDRGVTSSEALLRHDKWLQKKGIKNSNFAVVTWSNWNKEFYLKCFFLEHTEQ

SEQ ID NO: 123205 - protein, 69 aa, Glycine max
  Coding DNA Sequence Number=SeqID_6427
  Pfam annotation: Domain name=DVL; Domain location=23-41; Score=19.7; E_value=0.011; Accession=PF08137.3; Description=DVL family
MGNPSMGGSKRRLSSRGLGGALRQQRARLYIIRRIDLQLISFVYLLSKLSDSSFNYNNQSLSHQAGILA

SEQ ID NO: 123206 - protein, 395 aa, Glycine max
  Coding DNA Sequence Number=SeqID_6428
  Gene Ontology: Mol. function=protein serine/threonine kinase activity; Cellular component=membrane; Biological process=protein amino acid phosphorylation
  Homolog annotation: Hit_ID=Q9T020; Match level="QueryCoverage=97%, HitCoverage=48%, E-value=1e-87, Identity=44%"; Hit description =Putative receptor-like protein kinase
  Pfam annotation: Domain name=Pkinase; Domain location=189-395; Score =46.2; E_value=2.6e-11; Accession=PF00069.15; Description=Protein kinase domain
  Pfam annotation: Domain name=Pkinase_Tyr; Domain location=189-393; Score=52.7; E_value=1e-15; Accession=PF07714.7; Description=Protein tyrosine kinase
  Pfam module annotation: Pfam domain module=Pkinase::Pkinase_Tyr; Domain location=189-395::189-393
MPQNIAPPNVYSTSRSMGNNKDVNMGFNLTWIFQVDPGSMYLTRLHFCDYFYSKVNEIVFKIFINNQTAEAEADVIGWTGGKGVPTYTDYVIYVKDEAGDDQLWLALHPALETKPEFYDSLLNGVEVFKLNDTDLSGPNPRPSEMNSHTAGTKTSGSGKSVGSANISAMAQGLCRYFSLQEMKQATKNFDESNVIGVGGFGKVYKGVIDNGFKVAIKRSNPQSEQGVNEFQTEIEMLYKLRHKHLVSLIGFCEEGNEMCLVYDYMAHDTLREHLYKGNKPLDTLSWKQRLEICIGAARGLHYLHTGAKYTIIHRDVKTTNILLDENWVAKVSDFGLSKTGPNMNQGHVSTPLKGSFGYLDPEYFRRHQLTEKSNVYSFGVVLFEALYLRKVALDT

SEQ ID NO: 123207 - protein, 225 aa, Glycine max
  Coding DNA Sequence Number=SeqID_6429
  Homolog annotation: Hit_ID=Q10NT0; Match level="QueryCoverage=39%, HitCoverage=10%, E-value=8e-31, Identity=81%"; Hit description =Expressed protein
  Pfam annotation: Domain name=DUF593; Domain location=74-167; Score =177.4; E_value=3.6e-50; Accession=PF04576.6; Description=Protein of unknown function, DUF593
MSLEVKMPTVNNHLPSLLELNENEEEKVPYTPTSLESLHQLHKKLLLLERKESGTEESLDGSVISDIEGGEVTIDKLKSALKSERKALSTLYAELEEERSASAIAANQTMAMINRLQEEKAAMQMEALQYQRMMEEQSKYDHEALQLLNELMMKREKEKLELEKELEVYRKKVHEKMMMSRRDGSMRSRTSSPSCSNAEDSDGLSIDLNHEAKEENRFYSHQDQE

SEQ ID NO: 123208 - protein, 91 aa, Glycine max
  Coding DNA Sequence Number=SeqID_6430
  Subcellular localization annotation: CTP_CleavageSite=48; ConfidenceScore=5.40e-01
MSNTDALSIWVFKTQTSYGLAKRGLPASASFSQLVSTIQLTVELAKCNCALSECCLSDTSNFLELGLASLLAKPVLSSRVVALNAPCNAKS

SEQ ID NO: 123209 - protein, 128 aa, Glycine max
  Coding DNA Sequence Number=SeqID_6431
MRGYLMVIRIFCQPEASEPVDTQRLTSSSAPLSSRDSESDDMQGDDESDDMRGYLMVIRIFCQPEASEPIDTQRLTSSSTPLSSRDGESDDMRGYLKVICTFCQPEASEPVDTRRLTSSSAPFVNRGQ

SEQ ID NO: 123210 - protein, 128 aa, Glycine max
  Coding DNA Sequence Number=SeqID_6432
MGVKYLEVVKRRSYPTKQMGSKDKTLISFEWNIIRPVNIPTSGTWIAPIRHPVDPEEPNRALGFPALVTGLCQSYRVPVPPARSCHRDIEFQQGPGVSSSDYEPFQFYEVPVATSKVIRPPTNRAFIK

SEQ ID NO: 123211 - protein, 123 aa, Glycine max
  Coding DNA Sequence Number=SeqID_6433
  Homolog annotation: Hit_ID=UPI000044A741; Match level="QueryCoverage =58%, HitCoverage=17%, E-value=5e-09, Identity=53%"; Hit description =PREDICTED: similar to Ac1147, partial
MGGGAWPFLVGGAICLIIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 123212 - protein, 62 aa, Glycine max
  Coding DNA Sequence Number=SeqID_6434
MAMVFCLLKEMVSREEERWRWCLGKKKGKQSNIKISHLKIRGLNFMIEKQEMKIADFVPKED

SEQ ID NO: 123213 - protein, 256 aa, Glycine max
  Coding DNA Sequence Number=SeqID_6435
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-28, Identity=22%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=29; ConfidenceScore=5.04e-01
VLHALTFRGLHVLTFIRIHALTFRGLHVLAFRVLHALTFRGLQVLTFRGLRTLTFRELNILTFRGLHALSFRALHVLTFRGLHALTFRGLHVLTFRGLRALTFRGLHVLTIRELHVLTFRGQHALTIRGLHVLALRGGLHILTFKGLHVVTIRELQVHAFRGLHALTFRGLHVHTFRGLRALTFRGLHALSLRGLQVLAFRGLHTLTFRGLQVLTFRGLRTLTFRGLHVHTFRGLRALTFRGLHALTFRGRHVLTL

SEQ ID NO: 123214 - protein, 508 aa, Glycine max
  Coding DNA Sequence Number=SeqID_6436
  Homolog annotation: Hit_ID=Q1SDS1; Match level="QueryCoverage=54%, HitCoverage=55%, E-value=1e-29, Identity=30%"; Hit description=IMP dehydrogenase/GMP reductase
MVEEFEEILGCPLGGRKPYLFTRFYPSLARISKIVQILVQELDHRKQVENGVVGIPRKYLEAKARILAGKGEWAPFIDILALLIFGGVLFPNVDGLVDLAAIDVFLTYHNHKESPVVAMLADLYDTFDRRCEESNARIVCCTPALYVWLVSHLFRQEVRHACPLESHRSCTEKGGANWDQLLASKEEASVNWFPRWKEGRTGVLISCGGFPNVPLMVMRGCISYNPILAIRQLGYPMRGAPLEDGLAPKVRKAWGVVQKKDKELIGSGPIGGYREWLKAHVQCLDWLPSLRTAKREEVEAPEEDEEVQALRTKLEQAQTVKERFKSVALRIRKENAELRDVNIATTKALEQKTKRARREEHGQNKFRGALWGSNNELKLWREERDQSRVDSLILKDELKACSRSKRSLSQRLCETETNMLAIITKYQEELSLATAHEHRVADEYAQVYAEKEARGRVIDSLHQEATMWMDRFALTLNGSQELSRLLAKAKAVANTYSTPEEIHELLSY

SEQ ID NO: 123215 - protein, 252 aa, Glycine max
  Coding DNA Sequence Number=SeqID_6437
  Gene Ontology: Mol. function=RNA-directed DNA polymerase activity; Biological process=RNA-dependent DNA replication
MDIQAAYSCLLGRPWIHEAGAVTSTLHQKLKFVRNGKLITVSGEEALLVSHLSAFSFIGADETEGTSFQGLTLEGKKPEKNEVSFATWKSAQKVVQEGTGVGWGKVVQLLESKNREGLGFASSAGSATNSVGSSSITSTFLLGIYEPVEHNNPALSPNYESPVYEAEEEEDDEIPKELARLLEYEKKTIRPHEEVVEVINLGTEEDKKEVKIGASLEATVKRRVIELLKEYVDVFAWSYQDMPGLDPRIVEH

SEQ ID NO: 123216 - protein, 62 aa, Glycine max
  Coding DNA Sequence Number=SeqID_6438
MENWRTVLGNDIRGAPDSKRLAMSFMGLRKKVENGELANRARQSHSRGSRLEGGGHMNSARQ

SEQ ID NO: 123217 - protein, 130 aa, Glycine max
  Coding DNA Sequence Number=SeqID_6439
MFKHICTAAVDDCTVSLSPSLYAAQRTRVKNDVHIKFAVNNAMKKICSNLQGKDNAPPPPPQWIEAKSHVQQGAYECGYYVMHWMWCIVSGGLKNELHNYFSDGTALDTDTMTTLRKKWAAYFLEVGKWM

SEQ ID NO: 123218 - protein, 78 aa, Glycine max
  Coding DNA Sequence Number=SeqID_6440
MSQNFTDCLTMGVKYLEAVKRGSHAIKQWSPDEIGNVIRPVNIPTSGTSAIALDHPWMTKGAGDDVSLLVLSCVESYR

SEQ ID NO: 123219 - protein, 541 aa, Glycine max
  Coding DNA Sequence Number=SeqID_6441
  Gene Ontology: Mol. function=nucleoside-triphosphatase activity; Biological process=defense response
  Homolog annotation: Hit_ID=Q1STU5; Match level="QueryCoverage=74%, HitCoverage=90%, E-value=8e-42, Identity=30%"; Hit description =Leucine-rich repeat
MGLGAAAFPRPLPFSLKKLTLERLPKLENIWNEDPHGILSVQHLQLVIVEKCKCLTSVFPASVAKDLEKLVVKDCEGLMEIVAEDNADPRGANLDLMFPCPCVRSLKLQGLPKFKYFYYCSLQCDMFQTPTEDGKLTSNLQCLSLGEKGLEMIKRGEFQRNFLHKLQVLTVGFHIGSDEFPYEILQLAPNIEKLVVCDGSFKEIFCFDSLNVDEAGLLLQLKVLCLDSLPELVSIGLENSWIQPLLGNLETLEVIGCSSLKDLVPSTVSFSNLTYLQVERCNNLRHLFASSTARSLGQLKRMEIKRCDSIEEIVSKEGDESHENEIIFPQLNCLKLEELRKLRSFYKGSLLSFPSLEELSVMECAWMETLCPGTLKADKLVQLQLDRYLYEREESSDAIKLENDLNSTMREAFREKLAIIWAISFGTEPPYSSQSASRSPELALTTDSCHFSNPTQQPPLFRRDFGEEGQSRRSSEEMQGGRATRNDKPPVVVESDQEGGAHDGETAMVTAWGWRSELGGKVLTENPTILFLSLFDGHGHF

SEQ ID NO: 123220 - protein, 1477 aa, Glycine max
  Coding DNA Sequence Number=SeqID_6442
  Gene Ontology: Mol. function=nucleoside-triphosphatase activity; Cellular component=membrane; Biological process=defense response
  Homolog annotation: Hit_ID=Q1SI90; Match level="QueryCoverage=96%, HitCoverage=91%, E-value=1e-163, Identity=27%"; Hit description =Disease resistance protein; AAA ATPase
  Pfam annotation: Domain name=AAA; Domain location=60-286; Score= -35.2; E_value=0.096; Accession=PF00004.19; Description=ATPase family associated with various cellular activities (AAA)
  Pfam annotation: Domain name=LRR_1; Domain location=1069-1096; Score =5.0; E_value=33; Accession=PF00560.23; Description=Leucine Rich Repeat
  Pfam annotation: Domain name=LRR_1; Domain location=1241-1265; Score =0.4; E_value=2.4e+02; Accession=PF00560.23; Description=Leucine Rich Repeat
  Pfam annotation: Domain name=LRR_1; Domain location=1267-1289; Score =3.1; E_value=74; Accession=PF00560.23; Description=Leucine Rich Repeat
  Pfam annotation: Domain name=LRR_1; Domain location=1291-1312; Score =5.4; E_value=28; Accession=PF00560.23; Description=Leucine Rich Repeat
  Pfam annotation: Domain name=LRR_1; Domain location=1315-1339; Score =3.0; E_value=78; Accession=PF00560.23; Description=Leucine Rich Repeat
  Pfam annotation: Domain name=LRR_1; Domain location=468-489; Score =6.4; E_value=18; Accession=PF00560.23; Description=Leucine Rich Repeat
  Pfam annotation: Domain name=LRR_1; Domain location=491-512; Score =0.4; E_value=2.4e+02; Accession=PF00560.23; Description=Leucine Rich Repeat
  Pfam annotation: Domain name=LRR_1; Domain location=514-535; Score =12.1; E_value=1.5; Accession=PF00560.23; Description=Leucine Rich Repeat
  Pfam annotation: Domain name=LRR_1; Domain location=537-560; Score =13.1; E_value=1; Accession=PF00560.23; Description=Leucine Rich Repeat
  Pfam annotation: Domain name=LRR_1; Domain location=699-720; Score =4.6; E_value=40; Accession=PF00560.23; Description=Leucine Rich Repeat
  Pfam annotation: Domain name=LRR_1; Domain location=787-809; Score =1.1; E_value=1.7e+02; Accession=PF00560.23; Description=Leucine Rich Repeat
  Pfam annotation: Domain name=LRR_1; Domain location=811-831; Score =3.4; E_value=67; Accession=PF00560.23; Description=Leucine Rich Repeat
  Pfam annotation: Domain name=LRR_1; Domain location=898-919; Score =1.5; E_value=1.5e+02; Accession=PF00560.23; Description=Leucine Rich Repeat
  Pfam annotation: Domain name=LRR_1; Domain location=982-1002; Score =2.6; E_value=92; Accession=PF00560.23; Description=Leucine Rich Repeat
  Pfam annotation: Domain name=NB-ARC; Domain location=20-354; Score =50.8; E_value=1.6e-13; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::LRR_1::LRR_1::LRR _1::LRR_1::LRR_1::NB-ARC; Domain location=60-286::1069-1096::1241 -1265::1267-1289::...
  Pfam module annotation: Domain location=1291-1312::1315-1339::468 -489::491-512::514-535::537-560::699-720::787-809::811-831::898 -919::982-1002::20-354
MTEDVKNLIDECSKFKEVAYRENITSNDVTLSNAGYVEFGSRKSILEGVMAQLEDSTVRMIGLHGPGGVGKSTLIKDIAKKSLDKKLFDVVVKLEITANPNLQKIQEEIAYVLGLRLEGEGENVRADCLRRRLKQEKESILVILDDLWDRLDLNKLGVPLDGDVDHNDLSKKTLDGDVDHNDLSKKTSKAKMGPKEANKEKSLGDCKGCKILLTSRDKNVLTDKMEVKSTFCVEELDDDDALRLFQKEARIQGEMSKWKQEIVKKYCAGLPMAIVTVGRALRDKSDSEWEKLKNQDLVGVQNSMEISVKMSYDRLENEELKSIFFLCAQMGHQPLIMDLVKYCFGLGILEGVYSLGEARSRISTLIQKLKNSGLVLDGSSSIHFNMHDLVRDAALSIAQKEQNVFTLRNAKLDDWPQLERCTSISICNSDIIDELPEEINCPQLKFFQIDSDDPSLKIPDSFFKGMKKLKVLMLTGIQLSRLPSSIESLSDLRLLCLERCTLDHNLSIIGKLKKLRILSFSGSRIENLPAKLKDLDKLQLLDISNCSMVKMIPPNLISKLTLLEELYVRKSFIEVLEEGERNHSQISFLSELKHLHQLQVVDLSIPCAEAFPDELFFDNLTDYKIEIGNFKTLSVGDFRMPNKYEKFKSLALKLKDDTDNIHSQKGIKLLFKRVENLLLGELNGVQDVINELNLDGFPYLKHLSIVNNPSIKCIINSKDLFYPQDVFPKLESLCLHKLRKIEMIYFSSGTKMIFTDCSFTNLKTIKVEMCDQLKNLFSSCMVKLLVSLETIGVSHCFSLEEMVKIPDNSDKIEFLKLKSLSLQSLSSFTSFYTTVEGSSTNRNHIQITVIETEHSEMAPPLFGELVEIPNLENLNLISMNKIQKIWSDQPPSNFCFQDLIKLVVKDCHNLRYLCSLSVASSLRKLKGLFVSNCKMMEKIFSTEGNSADKVCIFPKLEEIHLDQMIELTDIWQAEVSVDSFSSLTSVYIFRCDKLNKIFPSHMEGWFASLNSLKVHYCESVEVIFEIKDSLQVDASGGIDTNLQVVDVCNLPKLEHVWSRDPGGILNFKNLQSIEVSCCNRLRNVFLASVAKDVPKLEYMSVQSYGIVEIVACEDGSETNTEQLVFPELTYMTLYNLSSIQHFYRGRHPIECPKLKKLEVNKCNKELKTFQTRECSNEEDEVVLSAENIFPNLEYLDIDFDEAQEWLLSNTVKHRMHNLKELRLCYVNDGERLCQILYRMPNLEKLYLFNSEHLLKESSESRLGTVIQLKELVLWSSKIKDIGFEREPVLQRLELLSLHWCHKLRNLAPPSVSLAYLTNLEVRNCGRLRNLMASSTAKSLVQLKSMKISECDELEEIVSNEGNEEEEQIVFGKLITIELEYLLNLKSFCSYNNCEFKFPSLEILIVRECRMMQTFTEGGARAPKLQNIGGGVEKGKEEAMWQWEGDLNATIQKGFYQELGRRISRKKDERGFELEYYH

SEQ ID NO: 123221 - protein, 106 aa, Glycine max
  Coding DNA Sequence Number=SeqID_6443
  Gene Ontology: Mol. function=RNA-directed DNA polymerase activity; Biological process=RNA-dependent DNA replication
MCVDYRQLNKVTIKNKYPLPRIDDLTDQLRGPLGPSRFFLQKAIASRGSNLARLGELGGKLGGKLLPYFAINRGRSEEGKGSAFLALCIHLKLLRKIVSVKKIQAE

SEQ ID NO: 123222 - protein, 155 aa, Glycine max
  Coding DNA Sequence Number=SeqID_6444
MPISPCRCISWDRTHKIPSGPKDVQQGPGISSSGYGPLLVLQGARSSSKGSHPQDTQWSRRRPIGPWGFQLWLRASISPTGCPFPQQGIAPTKTPSGPGEVQQGPGVSSSGIVPARHLVDPKKSNRVLELSSSNYGSMSVLRSACHLQQGHQASY

SEQ ID NO: 123223 - protein, 88 aa, Glycine max
  Coding DNA Sequence Number=SeqID_6445
MHRRPQTHRHHLIKLIQLGHLALSGIYNTWFASRRPTTGGRAEVEWPGDWSEAQAGEAPAEAPDDMEGARMDEEMTDLLDFLGGRGAT

SEQ ID NO: 123224 - protein, 93 aa, Glycine max
  Coding DNA Sequence Number=SeqID_6446
MKAWVIGGQITLLGVTGTPNDWQRPVIIAGNPKALLDLSGSRGCLREVGVMIAGQDVPEQQRHPHLGQGGHAGAHDPYPPPGSGPGKILTRYA

SEQ ID NO: 123225 - protein, 229 aa, Glycine max
  Coding DNA Sequence Number=SeqID_6447
  Gene Ontology: Mol. function=hydrolase activity; Biological process =aromatic compound metabolic process
  Homolog annotation: Hit_ID=Q1CVN3; Match level="QueryCoverage=89%, HitCoverage=78%, E-value=2e-53, Identity=50%"; Hit description =Hydrolase, alpha/beta fold family
  Pfam annotation: Domain name=Abhydrolase_1; Domain location=1-203; Score=68.7; E_value=1.8e-17; Accession=PF00561.10; Description =alphabeta hydrolase fold
MPDARGHGMSSAPQHGYTYQDHANDVIELIRTLDIKNPYLLGHSMGGMTAAMVASRLGFAISGIILADPTFISPEWQDQVYESGIVDQHRQMLKSTREALFKEAKAKHRFRSSELLEHIVEARLQTSVKAFDVLIPPNPEFEELIRNIYVPTLLVLGSEGIVSSETARELHEINPDLQYKLIPDVGHGLPYDEPVRLAAAIDAFLKPRFKTKQRMKTPSKYSVYTTNAF

SEQ ID NO: 123226 - protein, 69 aa, Glycine max
  Coding DNA Sequence Number=SeqID_6448
MDEFKAQVAWPRAQPSPSGGGGASAAQEPTSKEPAAETQPSTPVTEPEQPIQDSSAAPALDQPQDEQDI

SEQ ID NO: 123227 - protein, 71 aa, Glycine max
  Coding DNA Sequence Number=SeqID_6449
MVTKECKEASVSSKSDQGVPTDPKRIKVIPDWPPPPSVEGRSPEYEEPRDLRSNPFQGGGDDAILPPKGIG

SEQ ID NO: 123228 - protein, 119 aa, Glycine max
  Coding DNA Sequence Number=SeqID_6450
MGVIELCVEVDVASASTLNVKNSLLSCGNNIADNESKVQRFTINLDDDSYDDDYMISNSYVEDSLDEEEDIDDISDTDEKLTLIGVIRMKKTFVVSIWDQPSILAKNYLLAWNLKAKIQ

SEQ ID NO: 123229 - protein, 36 aa, Glycine max
  Coding DNA Sequence Number=SeqID_6451
LYEGPSTEQVEKVGGLHPSPYRRFHKAVAIGGWSDA

SEQ ID NO: 123230 - protein, 91 aa, Glycine max
  Coding DNA Sequence Number=SeqID_6452
TYQGNPCGVYPDLSSFTGSGIIQIPVACIKRSAPSQAINSWGSGPDGGGCMNNARQSIRGASDLMMEDARTALSNQFMGLRTQWWRMNEQC

SEQ ID NO: 123231 - protein, 222 aa, Glycine max
  Coding DNA Sequence Number=SeqID_6453
  Gene Ontology: Mol. function=zinc ion binding
  Homolog annotation: Hit_ID=Q1SA17; Match level="QueryCoverage=70%, HitCoverage=14%, E-value=1e-59, Identity=70%"; Hit description =Pleckstrin-like; Regulator of chromosome condensation/beta-lactamase- inhibitor protein ...
  Homolog annotation: Hit description=II; Zinc finger, FYVE/PHD-type
  Pfam annotation: Domain name=PH; Domain location=21-122; Score=14.7; E_value=0.092; Accession=PF00169.19; Description=PH domain
MADHQKTAPGERDIEQAIISLKKGSYLLKYGQRGKPKFCPFRLSNDESLLLWYSGKDEKQLKLSTVSRIIPGQRTATFQRYPRPEKEYQSFSLIYNDRSLDLICKDKDDAEIWFPGLKAIVTRGNNRKWRFESRTDDSLYSDSPKSGTRRSTPSIAPFSDPGDAGGGFIDLQNRWIKAFSEIISYSAASKSSSQAESLANSSLSSGSVDNSSNRNSASEAFR

SEQ ID NO: 123232 - protein, 146 aa, Glycine max
  Coding DNA Sequence Number=SeqID_6454
  Gene Ontology: Mol. function=zinc ion binding
  Homolog annotation: Hit_ID=Q9C9L3; Match level="QueryCoverage=92%, HitCoverage=11%, E-value=3e-23, Identity=41%"; Hit description =Putative regulator of chromosome condensation; 48393-44372
  Pfam annotation: Domain name=DZC; Domain location=84-133; Score=62.2; E_value=1.6e-15; Accession=PF08381.1; Description=Disease resistancezinc fingerchromo
MVERLPEGHNTDSSTEPFAENTSSILHNSLDESHIRNTVIPKNEGSSIVTNLILANGTKTQSGKAEWVVQDEPGVYVSLSSQPGGGNELKRVRFRFHAHFTEILSCFYSRRHFTEEQAEKWWAENGTKILERHNIVALLNARESVP

SEQ ID NO: 123233 - protein, 87 aa, Glycine max
  Coding DNA Sequence Number=SeqID_6455
MIPTQAGDQPIDGPAADPEEYIQPSNPQDDYDGYEVITQRLERVLNLRMVTVGTEYYEIMQDCLTIARGGANADGSVRARQRRRTEH

SEQ ID NO: 123234 - protein, 67 aa, Glycine max
  Coding DNA Sequence Number=SeqID_6456
MLDITSKGELGRLTSFAEKKKNKLCAWLAEKKKQFAEKEKKLHGIAGRQNGPFIKIAGCTSNIAGCT

SEQ ID NO: 123235 - protein, 192 aa, Glycine max
  Coding DNA Sequence Number=SeqID_6457
  Gene Ontology: Mol. function=catalytic activity; Biological process =carbohydrate metabolic process
  Homolog annotation: Hit_ID=P39657; Match level="QueryCoverage=91%, HitCoverage=70%, E-value=8e-20, Identity=37%"; Hit description =RuBisCO-associated protein
MAETCDSNNKVIREYHHDASFMSRCDIFTDVTEYQPCLAYAGESGKGNFEPKWDTDNVTPHLIEQFKLNCAASNLPVKVFVSIGGDDPFKVAAGGADDWVLNATTTLHHMINEYHIDGIDVNYTTILCNQKLFVNCFKDLIRGLREALCTTGFVASLAPDAATYVVFQCFVDFEPRDPNRPVKSLVQHTYQN

SEQ ID NO: 123236 - protein, 71 aa, Glycine max
  Coding DNA Sequence Number=SeqID_6458
DNLTTVLKVTRLCPWKSRDMLLKNKEKVEKHIKVAIFISKTSWVQRRWKNTLKLRFLSQKLHGFRFEGTKA

SEQ ID NO: 123237 - protein, 359 aa, Glycine max
  Coding DNA Sequence Number=SeqID_6459
  Gene Ontology: Mol. function=RNA-directed DNA polymerase activity; Biological process=RNA-dependent DNA replication
APVASVSISCPSCSATDGVVRNGKSTAGHQRWQAAQLLGRAIGAGLFAITPAGERGMCCKAIKLGIRYWMQCFPIPKYVVHKIEAICRSFLWTGGQELKRKSPVAWDSVCKPKDYGGLNIIDLSVWNKVTMLKLLWNLSGKSDSLWVKWVNAYYLNKDTLMNVSVKIHNSWIMKSILKHRSSILDIQSIWDSMLEKNRFGMKEVYKSLCTNTSKVRWRNLFRGNTARPRALMTLWLACHGRLATKNRLKKFGMIEDSKCCFCPAEESINHLFYGCPELKIIWTKVLDWVQIKRVPREWNDELEWLISSTKGKGKRHAILKLAAAETLYGIWRYRNDKSFGNTVDNTKIADNIIDMIVYR

SEQ ID NO: 123238 - protein, 251 aa, Glycine max
  Coding DNA Sequence Number=SeqID_6460
  Gene Ontology: Mol. function=tryptophan synthase activity; Cellular component=chloroplast; Biological process=tryptophan biosynthetic process
  Homolog annotation: Hit_ID=Q9FFW8; Match level="QueryCoverage=96%, HitCoverage=48%, E-value=1e-109, Identity=77%"; Hit description =Tryptophan synthase beta chain
  Pfam annotation: Domain name=PALP; Domain location=1-210; Score= -102.5; E_value=0.03; Accession=PF00291.15; Description=Pyridoxal -phosphate dependent enzyme
MLLKLGITISEAVEVAAKNAYSKYCLHNHILLHHSVIGEEWIKQMEAIGETPDVIKGCTGGGSNFAGLSFPFLREKLNKKINPVIRAVEPAACPSLTKGVYTYDYGDTAGMTPLIKMHTLGHDFVPDPIHAGGLRYHGMAPLISHVFDLGLMEAIAIPQTECLGAIQFARSEGLIPASEPTHAIAATIREAIRCRETGEAKVILTAMCGHGHFDLPAYEKYLQGNMVDLSFSEDKMKASLANIPQVTAYLS

SEQ ID NO: 123239 - protein, 99 aa, Glycine max
  Coding DNA Sequence Number=SeqID_6461
MQKQELDAQTLQMEQKLETRKKGNSLWRHGIWIPDISYKTSSHKHPLERTVNGETPKQRQQTVEITSAKKALNKEEGTNSKILRCPSREWPNWGRLSAT

SEQ ID NO: 123240 - protein, 406 aa, Glycine max
  Coding DNA Sequence Number=SeqID_6462
  Pfam annotation: Domain name=DUF1262; Domain location=23-406; Score =332.9; E_value=5.4e-97; Accession=PF06880.2; Description=Protein of unknown function (DUF1262)
MYVTRPLSMYRRSPSTLSMPPPDGPYSGYLVITDEEAEAEDTCCWRLCRRKKVKKLPFPQDKIFSVTHASEYEQTSSTKVWFLPVPDHPLASNRYYVIRAKGRQKGKAYKCSREADIVTCCFTDILNDQRPKPFNLKDLYQIFKIHSHQSGGFFARSITPDGIPPSFLRKKGWRIRTSGSYRSCKLSEALGVDAPLREKLPDFNFPISRKRSPPVTVGRWYCPFIFVRDNGTRVKHQMKKSMYYSMTLEQRWEEVYTCGNDHHHEKSDEGDDNGGGGGGGVVIVNVCVEREVVLVSGMEATRNGSTDANGFFWYRAYDAYNKRRANVGLSSAIVEHMRWVQEAGGWAYGHGRERVVRVREEARCQSEWLRFGCYVLVESFCLRTLDGKLVLRYDFRHTHKVKCKWE

SEQ ID NO: 123241 - protein, 257 aa, Glycine max
  Coding DNA Sequence Number=SeqID_6463
  Subcellular localization annotation: CTP_CleavageSite=50; ConfidenceScore=5.04e-01
MQGSFVPHGRDDILNTAIGRPKHPGRVHAVGTGVTISQYFGQVSRGSNTSSASISQQKLVDIIGKLKEELRREVEKENKNLKEEWRRQVEEENIQSLEKMKQELKETIKIDLSQMVSHHSPLLSTKGSCFEDVANPSGENAGLIMPPTMGLYVEGKVYDRASTICNVPYANDVVKVSVVEVYNGDAQKSVELLWDVTKFGISDVEASFFITHSNLWKMFMDEWSTTLGHGSVYGFLEPQFIHNAKDRHEECQHYIET

SEQ ID NO: 123242 - protein, 383 aa, Glycine max
  Coding DNA Sequence Number=SeqID_6464
  Gene Ontology: Mol. function=phosphoprotein phosphatase activity; Cellular component=intracellular
  Homolog annotation: Hit_ID=Q8LL04; Match level="QueryCoverage=77%, HitCoverage=24%, E-value=7e-17, Identity=30%"; Hit description=CTD phosphatase-like 3
MKTLKTSSTDKSDHSAPHWIEVKWFGGGIPLDIKAITTIRKKWACHVVCSNLQLLSFVKDQQQAALFSPEHIKESKFPFTNDKIPSPTPSSDCEDEIVDTNEEVSSASTGDFLTSTKPTLLDQPPVSATSMDRSNFHGFISSRVDAVGPGSLPVKSSAKNRAPRLHFTNSDASAVDNPSTLIHNMPKVEYVGTTISRKQKAAEEPSLDVSVSQRQKSSLENTEHNMNEVRTGSGGWLEENTGPGAQFTERNHLMDKFGPEPKKTLNTVSSSCTSSDNLNATSIRNEQAPITSGNVLASLPALLNGAVVNPIMLVNLLRIAEAQQKSTDSTSNMMLHPTSSNSAMGTDSTASIGSSMATGLLQSFVGMVPVSSQSTSTVKCCLS

SEQ ID NO: 123243 - protein, 160 aa, Glycine max
  Coding DNA Sequence Number=SeqID_6465
MGFTLVDLQKVAYKDKHFIMAEQVRQVFYIQDPCNSRWSVVLQGRTGEHEVDDAHANHNDHDEDAHSKATSKSRQSTRLRRLTVRNLDQSRLMVNVNLVTSRRSRPPKEKFHNYLGEKFDIPEGSNAKKKVMSMVATRWRQFKSSLTTKYVYVANNGQAK

SEQ ID NO: 123244 - protein, 71 aa, Glycine max
  Coding DNA Sequence Number=SeqID_6466
  Subcellular localization annotation: CTP_CleavageSite=32; ConfidenceScore=5.25e-01
MKRQQQPTPNPNKPFPYLPFSFMRTLSFRLMMACMNQTFYNAGHDPSYEGKNVAERHRRVITSVRVHYDDE

SEQ ID NO: 123245 - protein, 286 aa, Glycine max
  Coding DNA Sequence Number=SeqID_6467
  Gene Ontology: Mol. function=protein binding; Cellular component =membrane; Biological process=defense response
  Homolog annotation: Hit_ID=Q1SWV1; Match level="QueryCoverage=73%, HitCoverage=33%, E-value=9e-50, Identity=60%"; Hit description =Disease resistance protein
  Pfam annotation: Domain name=NB-ARC; Domain location=15-272; Score= -10.4; E_value=1.3e-09; Accession=PF00931.13; Description=NB-ARC domain
MAEAILGVVVAKLSSRWRRAGTISGDVAHELDDIMDECAYEKPGLEFQGIKFKPDFSLKRMTKAIIEAASGCACDDLDLEPLQKKLQDLLQRKRYFLILDDVWNDEQENWQRLKSVLACGAKGASILVTTHLSSVATIMGTTPPHELSMMPKKNCWELFKHRAFGPDEVMQVELEVIGKEIVKKCGGVPLAAKALGSLLCFERKEEAWLNAALISLLTTVKPKLEDSEKQFSNRAIKDAAHNLNDIMDECATQELELQYQGVKCGEVPLAAVALGIFHILKERKQE

SEQ ID NO: 123246 - protein, 232 aa, Glycine max
  Coding DNA Sequence Number=SeqID_6468
  Gene Ontology: Mol. function=ribonuclease H activity; Biological process=RNA-dependent DNA replication
  Homolog annotation: Hit_ID=Q1RYI2; Match level="QueryCoverage=81%, HitCoverage=41%, E-value=6e-13, Identity=35%"; Hit description =Ribonuclease H
MGDFCYVGSRCRHPGWLLVLFVCLVVGGVILVCFILSGDTESMKKVHWVAWKDLYQPKENEDIGMRLERHVNDSFMIKVAWELCMKPSHLWVKVVRAKYACRDDHWHIIEKKKRGSNLWSSIKYVWDAFQENCVVNGMNVAWRSSSYRNFKVKNVYHCVANLENSPNTMLFRIIWRWEGAKRSRVLLWKMAKGALATNEARREMGFTESWSCPMCENEKETTFHCMRDFQHA

SEQ ID NO: 123247 - protein, 62 aa, Glycine max
  Coding DNA Sequence Number=SeqID_6469
MSPFVQYYYKISPPYLLGLPLGQAGWVMISFSISGLLWSSNGEFIQTFSRRMSHCSILEAKL

SEQ ID NO: 123248 - protein, 103 aa, Glycine max
  Coding DNA Sequence Number=SeqID_6470
  Subcellular localization annotation: CTP_CleavageSite=66; ConfidenceScore=5.26e-01
MELDKIGSSLSFMLVRMYGNVGSQPGVQQSQTSLPPNPFGSAFNVAGSGLIRGGLGAYGGKILGSSSEYVQSNSISLSGITSQKQIQSLFLSCWYIILAILIY

SEQ ID NO: 123249 - protein, 209 aa, Glycine max
  Coding DNA Sequence Number=SeqID_6471
  Gene Ontology: Mol. function=proline dehydrogenase activity; Cellular component=mitochondrion; Biological process=glutamate biosynthetic process
  Homolog annotation: Hit_ID=Q6RUF9; Match level="QueryCoverage=99%, HitCoverage=42%, E-value=1e-108, Identity=92%"; Hit description =Proline dehydrogenase
  Pfam annotation: Domain name=Pro_dh; Domain location=1-208; Score =28.2; E_value=3.6e-09; Accession=PF01619.8; Description=Proline dehydrogenase
MPLLVDAEHTTVQPAIDYFTYSSAIRHNKDDNPIVFGTIQTYLKDAKERLLLATKAAEKMGVPMGFKLVRGAYMSIESKLAESFGYASPVHNTIQDTHNCFNDCSSFMLEKIANGIGSVVLATHNIESGKLAVAKAHELGVGKVNHKLEFAQLYGMSEALSFGLNNEGFQVSKYMPFGPVDMVMPYLLRRAEENRGLLAASGFDRQLMR

SEQ ID NO: 123250 - protein, 226 aa, Glycine max
  Coding DNA Sequence Number=SeqID_6472
  Homolog annotation: Hit_ID=Q6RUF9; Match level="QueryCoverage=45%, HitCoverage=33%, E-value=3e-24, Identity=58%"; Hit description =Proline dehydrogenase
MRLDPLSRQDALFFFLELVIYGWMKLVVADIKGTREKGSSNGVQIDRVSEIANGSCLVVLATHNVESGKLATSKAHELGVAKVKHKLEFAQLYGMSGALSFDLSDARVEKNKGPLAASGFDRQLMSYGLGWALVKGLILCFPRSFVSNLLPERAILSPSLSLSVANSNIKQPPEEIRHLSLLRNLPLEKANHILIELQSLSHHLKVVEIAILANEDLPKDLVFNNP

SEQ ID NO: 123251 - protein, 201 aa, Glycine max
  Coding DNA Sequence Number=SeqID_6473
  Gene Ontology: Mol. function=proline dehydrogenase activity; Cellular component=mitochondrion; Biological process=glutamate biosynthetic process
  Homolog annotation: Hit_ID=Q6RUF9; Match level="QueryCoverage=95%, HitCoverage=37%, E-value=7e-73, Identity=75%"; Hit description =Proline dehydrogenase
  Subcellular localization annotation: CTP_CleavageSite=57; ConfidenceScore=5.49e-01
MATRVIPPRMILKNIRYNTATKPLKTTHPSLSPVTATASLVKKPSSPATDAWASFAQASVTTETAALNLEDAEQLFASVSTRKLLQSSAVMHATAVGPVVDLGMRVMKSRVFQSGVLRNLLMAATKETFYAQFCAGEDAATAGRSISALNEVGLRGMLVYGVEDAHENDGCDRNLKGFLHTVDVSKSLPPSSFETTKRASG

SEQ ID NO: 123252 - protein, 587 aa, Glycine max
  Coding DNA Sequence Number=SeqID_6474
  Gene Ontology: Mol. function=DNA binding; Biological process =regulation of transcription
  Homolog annotation: Hit_ID=Q10PU3; Match level="QueryCoverage=65%, HitCoverage=62%, E-value=2e-20, Identity=31%"; Hit description=No apical meristem protein, expressed
VEAAGARAVGIGVCGFWVGSDGCGPWWKGGPLGRETVPAAGRQALGHMSGWIIGKRELMGFGMYKENGKVGKENEKPQVVLRVQPWQKQECKWESMDLRRMAWCDGIEEVFHGRWTEQNENTDLEKTSANVILARCPTLSAFDGRATIKVEDYEIPSSSVDKGKEASIQLDFPIPKVKKEIPEGIVDDLDHIVLKERLRMLLARKLPGLSNASLEGGNAGLLETITEQTVKKVNEEINFADGKAAEARDQVYDNPEGSNISLSLGATCGSSLLTDYATSKSTGSVISSGLLEDDHLLKSRGIVEQFDSHEEHNVINNDGPISSTSPTFIKVKDEPWDIGENYNVTKDAMGSISFKLSNVKSEREVHNEYHDDQAEHMNLIDRLNFLMAGADSSLNISTSYSLKTQPSSSMSSPIFSKSAEPSSIKSRRKRKKTATDSVQEALEEDAPGLLQVLLDKGVLVDEIKLYGEKEDDEALDESFCEDSFSKLEALITKVGEDLSEGEAKVLMEYGWTPNTGLGTMLNYCGRVVHDRKSEDNSSEWRSKIGKLLMDGYNGGTIVMPTVPKKVAEYMCSQSPDSDISCSSPMSD

SEQ ID NO: 123253 - protein, 108 aa, Glycine max
  Coding DNA Sequence Number=SeqID_6475
SCREPVRAATVVIAGRKKGRGDWVATAVLGEGHPLRIRGGVERQQGWPRRPQGGRRQPWKLRLASGSHGRQRRQVEPIVMSRGHEGEEGDNWPYFEGRLPPNYTKLLL

SEQ ID NO: 123254 - protein, 85 aa, Glycine max
  Coding DNA Sequence Number=SeqID_6476
MANYRYMETLTEKEKTTGIGRGCKYFNQRGGIDEVLICKVLMNKCVRSMLKVDSNQALDLFLYPDLALIDRGLNCMGGNSFFRCK

SEQ ID NO: 123255 - protein, 206 aa, Glycine max
  Coding DNA Sequence Number=SeqID_6477
  Subcellular localization annotation: CTP_CleavageSite=41; ConfidenceScore=5.03e-01
MNNYSFVNVGNNPYLLSNPNLNPLFLNGTNLFQTNKEPHVVFSGSEEYANPGLYSQAQSECSQQDVSKSWADLEGGSIPQDTDYNKISNTTTSRENQAENPLPALVAFSTKMGTFNQMDSNIAQTSTESPSNTFFDDWEKLLDDETSGRSYWKEILELSPKREIAASSKLLDIHFCVTNFVVEESSVHLFQDNPINLWIYITYRRK

SEQ ID NO: 123256 - protein, 304 aa, Glycine max
  Coding DNA Sequence Number=SeqID_6478
  Gene Ontology: Mol. function=kinase activity; Biological process =inositol and derivative phosphorylation
  Homolog annotation: Hit_ID=Q1S3P6; Match level="QueryCoverage=99%, HitCoverage=94%, E-value=3e-81, Identity=65%"; Hit description =Inositol 1, 3, 4-trisphosphate 56-kinase
  Pfam annotation: Domain name=Ins134_P3_kin; Domain location=1-244; Score=366.5; E_value=4.3e-107; Accession=PF05770.2; Description =Inositol 1, 3, 4-trisphosphate 56-kinase
MAEEKRFRIGYALLPKKQNSFIRDSLVNLARSRGIDLIRVDPNRSLTDQGPFDCVLHKLYDDDWKRQLTDFTVKYPNVVVLDSPESIERLHNRILMLQVVSELNVDDQSETFGILKQIVIYDKDTLFDRRNWEALKFPVIAKPLVADGSAKSHKMALVFNHDGLNSLKPPVVVQEFVNHGGVIFKVYVAGERVRCVKWKSLLDVGEDELDSRCGNRYLIVDINYFPGYAKMPGYETVLTDFFCDVFCMKQQWGEDCSENAGFDSVMGNKDVRQIMSNTCCGDGDEGGLQVSPLSVEEKDSSVQV

SEQ ID NO: 123257 - protein, 54 aa, Glycine max
  Coding DNA Sequence Number=SeqID_6479
MCRDQVAAHNNQTNEYEASKEPKSDNAFSFSDFLSGFRILIPALYPLQLIEANE

SEQ ID NO: 123258 - protein, 195 aa, Glycine max
  Coding DNA Sequence Number=SeqID_6480
  Subcellular localization annotation: CTP_CleavageSite=60; ConfidenceScore=5.40e-01
MDTQLKKLHAPNFSQVNSSIACTSQMVPSFWLLQARSNKSVPEPAFENVAGPITNATDYCATTVDNKNCFPNGGLSYSSVVPSQFFHLITIHQSLHALIWMCFLTLVSSGRSNPKASSKSVSSYLPQRQANNWKTFMVKYEDCSRTTMRKSIQSKSSNLMNPQDSLREFSKVFDLPPIPRSLGDIRQHQPRKQDF

SEQ ID NO: 123259 - protein, 130 aa, Glycine max
  Coding DNA Sequence Number=SeqID_6481
MCPVVGFGPWLGLGKPLVEILPPGQLRGFCPLLAWLGSAVLGYGPVLSFGLVGPLLPPVISFVARILPTLACAPLAKSVPRWWLILWGGGGGGKKMLTVIEVGSSRIYYLSGEDCKKNMLHRKTMTYEQV

SEQ ID NO: 123260 - protein, 336 aa, Glycine max
  Coding DNA Sequence Number=SeqID_6482
  Subcellular localization annotation: CTP_CleavageSite=52; ConfidenceScore=5.59e-01
MDTQLKKLHAPKFSQVNSFIACTSQMVPSSWLLQARSNGRMTLLVKYEDCSRTTMGKSVQFESSNSMTPQDTLKEFSKFSDLPPVPRSLGDIRQHQHQKRDFQQNFKPFVQPYGLPGKTYMARPNAFSNQDVEGIHGRTRFNQDGINAAIEPKVDQEMERMSQNPTNNIVDIEDMQGRTGFNQDWINATEKIIEPKANKEMEWMSLNPTVIEDMEDIQSKADPEKERMFPNPAVYTAYMEDIQGKIGLNQDEVNATKEVIEPKVDEEKEKKSPNPTLNIANMVDIEGRIGFNQDGINATKEIIEPKADKEMERMSPNPTVTVDMEGIQVEPGSTRT

SEQ ID NO: 123261 - protein, 98 aa, Glycine max
  Coding DNA Sequence Number=SeqID_6483
MEEFTVGRGGGNDIVWVSDSTRVVLDEIQRHECRALRAVTIGDRGEGWGEGERSGDDVVSGSGGWGESGDDVVSGGGREKAWKKKSKMKILKIERCIK

SEQ ID NO: 123262 - protein, 182 aa, Glycine max
  Coding DNA Sequence Number=SeqID_6484
  Gene Ontology: Mol. function=hydrolase activity, acting on ester bonds; Cellular component=nucleus; Biological process=lipid metabolic process
  Homolog annotation: Hit_ID=Q9FHQ1; Match level="QueryCoverage=89%, HitCoverage=46%, E-value=8e-71, Identity=76%"; Hit description=GDSL -motif lipase/hydrolase-like protein
  Pfam annotation: Domain name=Lipase_GDSL; Domain location=4-178; Score=-3.3; E_value=0.0033; Accession=PF00657.12; Description=GDSL -like LipaseAcylhydrolase
IQRLSFDDQINNFKKTKEVITANIGEAAANKHCNEATYFIGIGSNDYVNNFLQPFLADGQQYTHDEFIELLISTLDQQLQSLYQLGARKIVFHGLGPLGCIPSQRVKSKRRQCLTRVNEWILQFNSNVQKLIIILNHRLPNAKFIFADTYPLVLDLINNPSTYGNLASLPYILIYMLMVVNN

SEQ ID NO: 123263 - protein, 115 aa, Glycine max
  Coding DNA Sequence Number=SeqID_6485
  Gene Ontology: Mol. function=hydrolase activity, acting on ester bonds; Biological process=lipid metabolic process
  Homolog annotation: Hit_ID=Q9FHQ1; Match level="QueryCoverage=99%, HitCoverage=25%, E-value=8e-21, Identity=63%"; Hit description=GDSL -motif lipase/hydrolase-like protein
MSMPRLVFAACIFSLAAIALATLPVTYIFGDSLTDVGNNNFLQYSLAKSNYPWYGIDYSGGQATGRFTNGRTIGDFILKLNKSLTSVSVNVENFILSTNKKPCCKAWNLITTSLS

SEQ ID NO: 123264 - protein, 543 aa, Glycine max
  Coding DNA Sequence Number=SeqID_6486
  Gene Ontology: Mol. function=damaged DNA binding; Cellular component =nucleus; Biological process=nucleotide-excision repair
  Homolog annotation: Hit_ID=Q7EY71; Match level="QueryCoverage=82%, HitCoverage=48%, E-value=4e-62, Identity=38%"; Hit description =Putative xeroderma pigmentosum group C protein
MPRRGGGSQRKKQPLASTSENQTGAQQNSEGGNRFQSPSDNGTLTEISREAVGNLIRRANKVGISRKKKTPEFEPEQNGTQVLAPMLKQKTSEIGHCGRNSMENASAEEKCGNSGLHCFDNKEELDDSDWEDGTVARDDHPVTIELNMTAHSTVQKQIRRASAEDKDLAELVHKIHLLCLLARGRLIDNACDDPLIQASLLSLLPAQLLQLSNVTKLTSNALYPLISWFHDNFHVKNCTNRETSPHFGLASALESHEGSSEEVLSFSFNKVSIHRCSTSMIAALSVALLRALNLTARFVSILDVAPLKPVQVASGSSNGIFKTSTPMISKRKLDFKSPQESISCNEIENVCESSLVHSRKSKKCHATNHTDQSSDPPVVDVRNDSVANSKASETRDSNSELCLTDKSHKSKRKGDIEFEMQLEMALSATTVECKDSKTEASANPDSSSFSCPSKRVKRVIGEDSSTSPQVISTAIGSMKVGSPLYWAEVYCSEENLTGKWVHVDALNLIIDGEDKVESMVAACKTSLRYVVAFAGQGAKDVTR

SEQ ID NO: 123265 - protein, 394 aa, Glycine max
  Coding DNA Sequence Number=SeqID_6487
  Gene Ontology: Mol. function=damaged DNA binding; Cellular component =nucleus; Biological process=nucleotide-excision repair
  Homolog annotation: Hit_ID=Q9FMD4; Match level="QueryCoverage=98%, HitCoverage=45%, E-value=1e-117, Identity=57%"; Hit description =Similarity to DNA repair protein
  Pfam annotation: Domain name=Rad4; Domain location=2-308; Score=80.6; E_value=5e-21; Accession=PF03835.5; Description=DNA repair protein Rad4
MKWYKIASHRVNSTWWDSVLKPLRDLESGATGGVAHLGTNQIISTESNMNDSVVPTRSSIEDIELETRALTEPLPTNQQAYKSHPLYAIEKWLTKYQVLHPKGPVLGFCSGHPVYPRTCVQTVKTKERWLREGLQVKPNEHPVKDLQRSMKPQKVQDSEADDYGCTDSIEQIKLYGKWQLEPLNLPHAVNGIVPKNERGQVDVWSEKCLPPGTVHLRFPKAFSVAKRLEIDYAPAMVGFEFKNGRSYPVFDGIVVCAEFKDVLLEAYAEEEERRQAEEKKRDETQALSRWYQLLSSIVTRQRLNNRYINNSLSSDKLTGVLCINNDESSATVCDNNDKSPNQRDQQVDKCDTNVDVSLSTSVKDHEHVFLKEYESFDEGTSLLTKRCHVDFQSK

SEQ ID NO: 123266 - protein, 71 aa, Glycine max
  Coding DNA Sequence Number=SeqID_6488
MGLFWKYFLHDVVFDVKSMQIAEAIGDFGLASRVAGRVVGEVSFIRLELPGVLANCAVVGVASSTGELSLE

SEQ ID NO: 123267 - protein, 437 aa, Glycine max
  Coding DNA Sequence Number=SeqID_6489
  Gene Ontology: Mol. function=nucleic acid binding; Cellular component= proton-transporting two-sector ATPase complex; Biological process=DNA integration
  Homolog annotation: Hit_ID=Q1S4N1; Match level="QueryCoverage=99%, HitCoverage=65%, E-value=4e-98, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MRGKSFSLDPMEEEQAANTTAMTNTETWHKRLGHFHHTKILNMQKKELVHDLPHIESNLPSCKACHFGKQAKLSFQKGSWRANMKLQLIHTDVVGPHKTPSLNRSKYYIVFIDDYTRMCCIYFLGFKSKVAGFAAKGDEDNVYLLKNALYGLMQAPRAWYSRTDEYLLKLGFVKSFSESTLYVKGDNDNIFVVSLYVDDLLITGSNIELIQQFKEDMMRVFEMTDLREIMSTPTCQKEKLCKDDGKAKVDESEYRSLVGCLMYLTAIRPNIMYDFCLTPSFELQGYSDSDWVGSLDDMKRTFSFYFNFGSKIFTWSSKKQEIVAQLTVEAEFIAATAFVNHALWVRKFLNDLHLEQKTITKVMVDNQTAIAISNDPIFHGKTKHFSIKLLFIRDIQKDGAVRLKYYNTEDQLANIFRKPLAKSRFKDLRERLGIRTY

SEQ ID NO: 123268 - protein, 309 aa, Glycine max
  Coding DNA Sequence Number=SeqID_6490
  Gene Ontology: Mol. function=ubiquitin thiolesterase activity; Cellular component=intracellular; Biological process=ubiquitin -dependent protein catabolic process
  Homolog annotation: Hit_ID=Q5VPU9; Match level="QueryCoverage=95%, HitCoverage=76%, E-value=8e-47, Identity=31%"; Hit description =Carboxyl-terminal peptidase-like
  Pfam annotation: Domain name=DUF239; Domain location=151-309; Score =131.4; E_value=2.5e-36; Accession=PF03080.5; Description=Arabidopsis proteins of unknown function
MMNILLFVLCLVTSNVNHGVDGIQNFKENLEHERQLKFINKHLVKSIHTKFGDIIDCIDINKQPAFDHPLLKNHKLQRKPNFKTSSVKNSWARLIFGLEKHQYCPTGTVPIQTITKDDLIRDKLLNSHTSTQSTPGDHFAEVSLVPGLGPYYGVSGSLSIYNPKVEKDQSSASVLWVRNEDANRIVLGWHVNPSLYGDDATHIYSRWTRDNYEKTGCFNMQCPGFVQTNKRIYLGTRVDITSIYGGRTIETNVSITQDPITKNWWLNIENTNIGYFPIALFSNMASAQQGGWGGKTHAPPGAPSPPMGS

SEQ ID NO: 123269 - protein, 73 aa, Glycine max
  Coding DNA Sequence Number=SeqID_6491
MGFFLKHILEMGLFWKYFLYGAVSDVKNMQIAEVIGDFGLAVTRGTGLASATGDFRMHGTRKFDWQVVLGEPG

SEQ ID NO: 123270 - protein, 349 aa, Glycine max
  Coding DNA Sequence Number=SeqID_6492
  Gene Ontology: Mol. function=ubiquitin thiolesterase activity; Cellular component=intracellular; Biological process=ubiquitin -dependent protein catabolic process
  Homolog annotation: Hit_ID=Q5VPU9; Match level="QueryCoverage=96%, HitCoverage=83%, E-value=7e-45, Identity=30%"; Hit description =Carboxyl-terminal peptidase-like
  Pfam annotation: Domain name=DUF239; Domain location=105-304; Score =190.2; E_value=4.9e-54; Accession=PF03080.5; Description=Arabidopsis proteins of unknown function
MKTKFGEIIDCIDINKQPAFDHPLLKNHKLQRKPNFKISSVKDSTTRFIFGLKKDQYCPSGTVPIQRITKGDLIGDKLLNSHTLTQSTPGDHFAEVSLVPGLGPYYGVSGSLSVYNPKVEKDQISASTLWVQNGDANRIEFGWHVNPSLYGDDTTYIYSRWTRDNYKQTGCFNMQCPGFVQTHKGIYLGTRVDNTSIYGGTIVEANVSIAQVKYDILFTKNYTPFQDPITKSWWLSLESTTIGYFPIALFSNLTSAEQGGWGGRTHAPPGAPSPPMGSGYFPDDNLVHACYFRQVSFKNGSIQDYGPEEYHVHTNTDNPSCFGVEYYGDQGRQAGYSLQFGGPGGNCDN

SEQ ID NO: 123271 - protein, 81 aa, Glycine max
  Coding DNA Sequence Number=SeqID_6493
  Homolog annotation: Hit_ID=Q10L92; Match level="QueryCoverage=63%, HitCoverage=25%, E-value=2e-07, Identity=50%"; Hit description =Glutaredoxin family protein, expressed
  Subcellular localization annotation: CTP_CleavageSite=32; ConfidenceScore=5.16e-01
MTLWLPLHSSHTMNLKPPQESQALFWLERWRRSMSQWSSSLSWSWWTSSAPPTQESKEAPESGGRNERDRISEEPRVSKYT

SEQ ID NO: 123272 - protein, 59 aa, Glycine max
  Coding DNA Sequence Number=SeqID_6494
MAHSSKKGTRESRKVQSSVSLIRKRKEILGDDVSSLLENDEVAMVKLELHIATITRKEV

SEQ ID NO: 123273 - protein, 48 aa, Glycine max
  Coding DNA Sequence Number=SeqID_6495
MGFPFADGHLPRRKFTRSEDLLFSFQVLAFVIRSPLRRFCCPLLRGKG

SEQ ID NO: 123274 - protein, 294 aa, Glycine max
  Coding DNA Sequence Number=SeqID_6496
  Gene Ontology: Mol. function=tRNA methyltransferase activity; Cellular component=nucleolus; Biological process=tRNA processing
  Homolog annotation: Hit_ID=UPI00003652CE; Match level="QueryCoverage =74%, HitCoverage=82%, E-value=6e-30, Identity=37%"; Hit description =Homolog of Homo sapiens "RNA (Guanine-9-) methyltransferase domain containing 2
  Pfam annotation: Domain name=tRNA_m1G_MT; Domain location=132-291; Score=111.9; E_value=1.9e-30; Accession=PF01746.11; Description=tRNA (Guanine-1)-methyltransferase
MPESPGGGDAGAPPQTTETENRKTDQTAADPPVLSKNARKKLAKQQRFEAKKAEKKAAAKEQKRRDVERKRKEWEESLAGVSEEEKAKLIESRRNLRKERMEKRSQEKEDKRERLTVAREKGQNVVVDLQFSHLMNPNEIHSLVQQIMYCYAVNGRCASPAHLWLTGCEGEMDSGLKRIPGFDKWIIEKENRSYIEALSDRKEDLVYLTADSETVLEELDLNKVYVIGGLVDRNRWKGITLKKAEEQGIPTAKLPIGNFMKMSSSQHRRGISKIRIIAHLWHCPLFYLYFPSVS

SEQ ID NO: 123275 - protein, 275 aa, Glycine max
  Coding DNA Sequence Number=SeqID_6497
MENEVKKDNKQITILTKGAWRYLKKELNMKLGKEYTPNLFKKKSNQLGGKWNDLTSLLKMETELGDKSSTRRIIAINDQWNKLCEKYTFAKQFKKEECLYYDKLCVVFWDKTPSSANQHPSTKSPSINDDDDNEEDTNFDQEGDVHQPKRKTIVHVSEDKKKLKARKSDQMTFANALTNFGETQNKLEILEKMSADHVTTSTFSATGEVNGQKSQNNKQDKESILACVRILQGLQGIDGASFTKALKLLKEDALWRCVFLALSDERKKDWALNLP

SEQ ID NO: 123276 - protein, 219 aa, Glycine max
  Coding DNA Sequence Number=SeqID_6498
  Gene Ontology: Mol. function=structural molecule activity; Cellular component=chloroplast
  Homolog annotation: Hit_ID=Q9ZP40; Match level="QueryCoverage=84%, HitCoverage=53%, E-value=1e-50, Identity=58%"; Hit description =Plastoglobulin-1, chloroplast precursor
  Pfam annotation: Domain name=PAP_fibrillin; Domain location=145-218; Score=-22.8; E_value=0.00028; Accession=PF04755.3; Description=PAP _fibrillin
  Subcellular localization annotation: CTP_CleavageSite=62; ConfidenceScore=5.75e-01
MVQISVSVVSLYRHPVPMALLAVTSRAPFLFSPNPKPLSPSSFYSHLSLSPRSPRFPSLRFRSATGDASDAGKPAGKISDEWGEDYDPEAEALTSKLPDSDPPKDEDEWQEGGAPDAGGYVDGGNGTPVTGAEDPAEEEVDDKLEALKRALVDTLYGTELGIRAGSEVRAEVSELVSQLEAANPTLAPVEEPALLNGNWVLLLDKFGRCSEGTGTVLHG

SEQ ID NO: 123277 - protein, 77 aa, Glycine max
  Coding DNA Sequence Number=SeqID_6499
MKNDPQKLLNRPMIFIKHSIVSPFPDPPPDGYCKKENMAATQKSQTDPHFPSMRAVPKAMKHILRLVGTVGVRSLSS

SEQ ID NO: 123278 - protein, 179 aa, Glycine max
  Coding DNA Sequence Number=SeqID_6500
  Gene Ontology: Mol. function=structural molecule activity; Cellular component=chloroplast; Biological process=response to abscisic acid stimulus
  Homolog annotation: Hit_ID=Q9ZP40; Match level="QueryCoverage=62%, HitCoverage=31%, E-value=1e-40, Identity=75%"; Hit description =Plastoglobulin-1, chloroplast precursor
  Pfam annotation: Domain name=PAP_fibrillin; Domain location=2-170; Score=195.7; E_value=1.1e-55; Accession=PF04755.3; Description=PAP _fibrillin
MGRALGQCRERYTASSELLPLLAAGRLPLLKVDKITQTIDTSSSTIINSTTLSSPFASLSFSASASFEVRTPTRIQVTFKEGSIQPPEIKSNVELPENVDIFGQKLSLQPLQQSLGPLQGLVENISRVISGQPPLKIPIPGERTSSWLLTTYLDKDLRISRGDGGLFVLAREGSPLLDQ

SEQ ID NO: 123279 - protein, 187 aa, Glycine max
  Coding DNA Sequence Number=SeqID_6501
MFWRSEVCNSFRNLALTGNSPIFKLARSECECECECLLTVYCFRAPAQDSIGCWLCSKHNGDFFPLPLGAWEVRATLVHRGGIGYTCHCLGEWNGESTNIGSTVGCKSVGAAFGAMMACVWYVGHAWGVLIGWSQIIFKDRIGIIIYQIESSNYGYIALSYFHNRLYYVDDVHCETRITLCTQGTRR

SEQ ID NO: 123280 - protein, 207 aa, Glycine max
  Coding DNA Sequence Number=SeqID_6502
MGSRLCVLLCYHISDGNNLKKEKQGMYCKISKRKKEMETEEKKVVPNLTLEDWILASPGLKPDYINIRSGEFSSSCSSKSKKKVHPCVSQVPRSLIAEAKDSLCLDRPMNRNEEMLSSTSIGRSISEKSQKKVSFKLPHNVIFYSPDEPRSPEEKEPYYCYYYNSSESEDSFYSSICREYSFDSSAEETLIKLAVDVLPHVSVSSKI

SEQ ID NO: 123281 - protein, 48 aa, Glycine max
  Coding DNA Sequence Number=SeqID_6503
MVSVQFGLEAKTMDALCGDGKDNPAKCRVRKPNQMVKHLASSISILSI

SEQ ID NO: 123282 - protein, 417 aa, Glycine max
  Coding DNA Sequence Number=SeqID_6504
  Gene Ontology: Mol. function=structural constituent of cell wall; Cellular component=cellulose and pectin-containing cell wall; Biological process=protein amino acid phosphorylation
  Homolog annotation: Hit_ID=Q9LJ64; Match level="QueryCoverage=86%, HitCoverage=38%, E-value=1e-130, Identity=62%"; Hit description =Extensin protein-like
  Pfam annotation: Domain name=LRRNT_2; Domain location=63-102; Score =17.8; E_value=0.012; Accession=PF08263.3; Description=Leucine rich repeat N-terminal domain
  Pfam annotation: Domain name=LRR_1; Domain location=136-158; Score =6.8; E_value=16; Accession=PF00560.23; Description=Leucine Rich Repeat
  Pfam annotation: Domain name=LRR_1; Domain location=160-181; Score =5.7; E_value=24; Accession=PF00560.23; Description=Leucine Rich Repeat
  Pfam annotation: Domain name=LRR_1; Domain location=184-206; Score =9.2; E_value=5.4; Accession=PF00560.23; Description=Leucine Rich Repeat
  Pfam annotation: Domain name=LRR_1; Domain location=207-226; Score =6.7; E_value=16; Accession=PF00560.23; Description=Leucine Rich Repeat
  Pfam annotation: Domain name=LRR_1; Domain location=230-252; Score =1.6; E_value=1.4e+02; Accession=PF00560.23; Description=Leucine Rich Repeat
  Pfam annotation: Domain name=LRR_1; Domain location=255-277; Score =8.2; E_value=8.2; Accession=PF00560.23; Description=Leucine Rich Repeat
  Pfam annotation: Domain name=LRR_1; Domain location=279-301; Score =7.4; E_value=12; Accession=PF00560.23; Description=Leucine Rich Repeat
  Pfam annotation: Domain name=LRR_1; Domain location=303-325; Score =10.7; E_value=2.9; Accession=PF00560.23; Description=Leucine Rich Repeat
  Pfam annotation: Domain name=LRR_1; Domain location=327-354; Score =0.2; E_value=2.6e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=63 -102::136-158::160-181::184-206::207-226::230-252::255-277::279 -301::303-325::327-354
MATSYFLLLSLFLLSSSVSHALSNVEASFIVRRQLLHLHENDELSDNYADNYETNLTFPNPRLKSAYIALEALKKAIYSDPSNFTANWEGPNVCSYNGVFCEKALDDPKIDVVAGIDLNHADIAGYIPPEIGLLTDLALFHINSNRFCGVLPKSFSKLKLLYELDISNNRFVGRFPEPVLLIPDIKFLDLRFNEFEGELPSELFNKSLDAIFLNNNRFTSTIPQNMGSSPASVMVFAYNNLTGCLPSSIGNMTKTLNEFVLINNNLTGCLPAEIGKLEQVYVFDISQNNFVGMLPRTFDGLKNAEHLSIGHNKLTGFVPRNVCSLPNLVNFTFSYNYFNGEEEGCVPPKKDVVLDDENNCIPNRPKQKVADVCNVVISKHVDCKCGSGTHLILPILQQHHLAHHQNLHLNHNLPVLL

SEQ ID NO: 123283 - protein, 342 aa, Glycine max
  Coding DNA Sequence Number=SeqID_6505
  Gene Ontology: Mol. function=nucleotide binding; Cellular component =nucleus; Biological process=fatty acid biosynthetic process
  Homolog annotation: Hit_ID=Q7XYX7; Match level="QueryCoverage=82%, HitCoverage=79%, E-value=8e-91, Identity=60%"; Hit description=AKIN beta2
  Pfam annotation: Domain name=AMPKBI; Domain location=248-338; Score =119.0; E_value=1.4e-32; Accession=PF04739.5; Description=5'-AMP -activated protein kinase, beta subunit, complex-interacting region
MLAYDLFTYKFDDIEERTAKGTPPLNVNVTREEEATVADENAMPQSPPTTPTTTHSPLLFAPQVPVVPLQRPDDIHVPSCSWMETTSGYEDMYTQVGIPTMITWSYDGKEVAVEGSWDNWKTRFRYILIFLLHQNAPAEIREGLCLNEVLPSGVYQYRFIVDGRKKYTPDSPWAQDDAGNAYNILDLQNFVSDAHDPKLISGTYFFNRLTVWESHLIAATPSPHLNCGLLLASSCPEDIGSISSFEPPQSPDSSYDNLHLSSEDYAKEPPLVPPLLQMTLLNVPATNMEIQPPMSRPRHGVLNHLYTQKGKSSPSVAGLGTTHRFLAKYVTVVLYKSLQSKP

SEQ ID NO: 123284 - protein, 187 aa, Glycine max
  Coding DNA Sequence Number=SeqID_6506
  Gene Ontology: Mol. function=manganese ion binding
  Homolog annotation: Hit_ID=Q9SU14; Match level="QueryCoverage=36%, HitCoverage=24%, E-value=2e-12, Identity=52%"; Hit description=Nudix hydrolase 7
MDSVPVPSLSASSTLTEEVQVTALQMIELLTSTTDEHGGVIVEMDKPMDSATFVSILRASISHWKQLGNMGVWIKSPIHLVSLVEALVKEEGVQHILRKGKVDKQINTKMMMSYFCGWHALAILVLIASPAAGENNHPLLELLSSRDEVVQIAGYGEEKLSTVLITGSVNCEAPHQPQPQPHAWPVQ

SEQ ID NO: 123285 - protein, 173 aa, Glycine max
  Coding DNA Sequence Number=SeqID_6507
  Gene Ontology: Cellular component=integral to membrane
  Homolog annotation: Hit_ID=UPI0000E48C33; Match level="QueryCoverage =91%, HitCoverage=73%, E-value=7e-15, Identity=31%"; Hit description =PREDICTED: hypothetical protein isoform 2
MRTGQEFLKALIGFIDVAGLYFALTQLTHRNISQNHKFQAVGLGWAFADSVLHRLAPLWVGARGLEFTWDYILQGLEANANLKISALASAQVLSISLAALGSLMWLRKNKPKTLIPIIYLSAGIVATMPSITSYLRRGLGWHFPKVVGFELFTSLVMAFISWQLFSVCQRPSV

SEQ ID NO: 123286 - protein, 1690 aa, Glycine max
  Coding DNA Sequence Number=SeqID_6508
  Gene Ontology: Mol. function=serine-type endopeptidase inhibitor activity; Cellular component=mitochondrion; Biological process =negative regulation of cell proliferation
  Homolog annotation: Hit_ID=Q5VMT5; Match level="QueryCoverage=88%, HitCoverage=92%, E-value=0.0, Identity=44%"; Hit description =Putative Spo76 protein
  Pfam annotation: Domain name=HEAT; Domain location=288-324; Score =6.1; E_value=7.7; Accession=PF02985.12; Description=HEAT repeat
  Pfam annotation: Domain name=HEAT; Domain location=330-365; Score =1.5; E_value=28; Accession=PF02985.12; Description=HEAT repeat
  Pfam annotation: Domain name=HEAT; Domain location=415-446; Score =2.6; E_value=20; Accession=PF02985.12; Description=HEAT repeat
  Pfam annotation: Domain name=HEAT; Domain location=532-564; Score =7.0; E_value=5.9; Accession=PF02985.12; Description=HEAT repeat
  Pfam annotation: Domain name=HEAT; Domain location=78-115; Score=4.4; E_value=12; Accession=PF02985.12; Description=HEAT repeat
  Pfam module annotation: Pfam domain module=HEAT::HEAT::HEAT::HEAT::HEA T; Domain location=288-324::330-365::415-446::532-564::78-115
MAQLQLKELGSKLETLPTSKDALVKLLKNGMEGKNLKWEGRSVNEGLQHSCLYALDIEGQATTCLAELDQSPSTSTLESMKPFFNAIVKPELLKHQDRDVKLLVATCVCEITRITAPEAPYSDEILKDIFQLIVGTFRGLSDTNGPSFGRRVVILETLAKYRSCVVMLDLECNDLVHEMFSIFFVVARDDHPESVLSSMQTIMVVLLEESEDVRDDLLSILLSKLGREKKGVNMAARRLAMNVIQQCAGKLEPIIKQFLLSLISGDSKPVNSQVEYHGIIYDLYCCAPQILSRILPYVTGELLTDQLEIRLKAMNLVGDIISLPGSSIPEAFQSIFSEFLKRLTDRVVDVRMSVLEHSKVSLLPFIVVLYLLILIESNLAALCERLLDFDENVRKQVVAVICDVACHALNAVPLETVKLVAERLRDKSLLVKKYTMERLTEVYRVACEKSSDNVNPNEYNWIPGKILRCFYDKDFRSDIIESVLCGSLFPVEFSISDIVKHWIGIFSGFDKVEVKALEKILEQKQRLQQEMQKYLSLRKMSQDKDIPEVQKKIVFCFKVMSRSFADPIKAEESFQILDQLKDANIWKILTNLVDPNTSLHQSRAYRDELLKILGEKHCLYEFLNTFSVKCSCLLFNKEHIIARFSPLLLRGSEEELVNLLKDNNDTIQEGVLNVLAKAGGTIREQLAVTSSSVDLILERLCLEGSRRQAKYAVHALAAITKDDGLKSLSVLYKVSGSNSGDSLSAFSDKAAYVYSLQNPLDGSLRLVDMLEDKTHLPAVLQSLGCIAQTAMPVYETRENEIEEFILNKILKSDSKEDNMKTSWDDKSGLCMLKIYGIKTFVKSYLPVKDAHVRPDIDRLLDILRNILLYGEISKDLKSSSVDKAHLKLASAKAVLRLSRLWDHKIPVDLFHLTLRVSEISFPQAKKIFLSKIHQYIKDRLLDAKYGCAFLFNIFGSKPDEFAEGKQNLFDIIQMHHQLKARQLSVQSDANSLTTYPEYILPYLVHALAHNSCPNVDYCKDVGAYDDIYRQLHLILSMLLQRDEDAKSEVTTDKEKEVISTITSIFLRIKHSEDVVDTSKSKNSHALCELGLAITKRLVQKDVDFQGLSHLVSLPPLLYKASEKEGDDTLVTEVKSWLADESALTHFESLELETVQSQSAEDEASKDDEKDGNEIPLRKMLKNIKSQGTSGKKVKRNKSVPAETKKTGNDFDILNMVREINVDNLGTPTNFEPSNGHDHSLIKKELKDPEYATGKKRKASKTTPVPVPKRRRSSSAHGKLRLSTSISKASRRVSGVDSPQPKLPLDEEVNPDADSKTMQRKMVKGSEKDLLLSSLKRKVKGSDSYHNDELNKPDEHDMMSPDSTQQSDKTVGKNNKSSTGSTKKGKRKSISGLAKCTTKEGEIDTEDLIGCRIKVWWPTDKNSNVGILMLCRFYGGTIKSYDPLKGKHVILYDDGDVEILRLEKERWELIDKGRKSIKVSEDAKEPSKISNPEETTTSKADEMYSGGSDEELTGGFNEIMTKEKKSNKNTKSISRGKRLNKEKNFHYTEESDEEKQDCSGRLSEDRESVPQGSSEEREVDESSGALRENINGQEFDSEGHHDNSKADRSPREMEKSHIEPSKSPDDDDDDTIAEISDDVPLVNNSAVAALIANGNIGRGRKAQGKNNEQFSYCYLSVKNAAELMLWYKYSC

SEQ ID NO: 123287 - protein, 111 aa, Glycine max
  Coding DNA Sequence Number=SeqID_6509
MAEIGFWILTAQGTRRRENDGSCSARSLWSMFKSQKGSRHSDECGTPKQWEAKKILAEERGGDGGINPMMVRSRSVAVTVVTTVTVVSSDGGLRPWTKGRGWFFPSPMKTF

SEQ ID NO: 123288 - protein, 130 aa, Glycine max
  Coding DNA Sequence Number=SeqID_6510
MATFAPLPEPDLSLNISPPFISDSDAKQVGISCNGLTLTTKMLYNDMCSTSDSGSSESDLSHENGFFLMDTAYNLGHHEPTLSLGIETENLNPYPVQQGALSRNNFSHHLHNYQPHTNTLDFKRNARVIH

SEQ ID NO: 123289 - protein, 47 aa, Glycine max
  Coding DNA Sequence Number=SeqID_6511
MMKANSDILTPKCNMDRRWSQSRENEIRAYVDLNSLVNLLFMVQQGP

SEQ ID NO: 123290 - protein, 548 aa, Glycine max
  Coding DNA Sequence Number=SeqID_6512
  Gene Ontology: Mol. function=oxidoreductase activity; Cellular component=membrane; Biological process=electron transport
  Homolog annotation: Hit_ID=Q43068; Match level="QueryCoverage=86%, HitCoverage=87%, E-value=1e-121, Identity=46%"; Hit description =Cytochrome P450 82A1
  Pfam annotation: Domain name=p450; Domain location=16-466; Score =205.7; E_value=1.1e-58; Accession=PF00067.12; Description=Cytochrome P450
MAFLIKRATAGSARKPPAASGGWPLIGHLHLLGGSGQPLYETLGTLADMYGPIFSIRIGVHPAVVVSSWELAKECFTTLDVTVSSRPKFTAAKILTYNYASFAFAPYGDFWRDMHKITVSELLSTRQAEMLRGIRDSEVKSSLRELQRAWAEKRGVSSGDLLVEMKQWFGEMNLNVILRMVAGKRYCVGSVDQEQARRVRGVLRDFFHLMGSLVIGDAIPFLGWLDLGGEVKEMKKTAVEIDNIVSEWLEEHKQLRRDSSEAKTEQDFMGALLSALDGVDLAGYDADTVIKATCSTLIAAATDTTTVTMIWTLSLLLNNRHALNKVQDELDEHVGKGRLVNESDINKLIYLQAVVKETMRLYAAAPLPGPREFTSECTLGGYRIQAGTRFILNIWKMQRDPRVWSDPLEFQPERFLTNHKGVDVKGQHFELLPFGGGRRRNEKASENVENPPLLSIHLARENIMQWQKVCEPHLNPAANFPHLILNGQTEWRDLSNAMLVLPYSGSPIPILVLAREIMRVIISNRKCGGIMVFHLFKRLRLQHYFCML

SEQ ID NO: 123291 - protein, 216 aa, Glycine max
  Coding DNA Sequence Number=SeqID_6513
  Gene Ontology: Mol. function=oxidoreductase activity; Cellular component=membrane; Biological process=electron transport
  Homolog annotation: Hit_ID=Q6XL72; Match level="QueryCoverage=68%, HitCoverage=57%, E-value=2e-52, Identity=71%"; Hit description =Cytochrome P-450-like protein
MKKTAKDLDYILEGWLKEYRDQGVDGGVKAEAVDLATGWNRGGTHITSQVSILTSEHISYPSPKDNNYQGNLAAIPRAGPLLGPREAQEDCNVAGYHVPAGTRLVVNLWKLHRDPRVWEEPSAFRPERFLTSDAVDVRGQNFELIPFGSGRRSCPGMSFALQVLHLTLARLLHAFEFATPSDQPVDMTESPGLTMPKATLLEVLLTSRLPAKLYAY

SEQ ID NO: 123292 - protein, 175 aa, Glycine max
  Coding DNA Sequence Number=SeqID_6514
  Gene Ontology: Mol. function=DNA binding; Biological process =regulation of transcription
  Homolog annotation: Hit_ID=Q84UP8; Match level="QueryCoverage=83%, HitCoverage=41%, E-value=2e-14, Identity=38%"; Hit description=Myb family transcription factor-like protein
MVDAVVVASVDFKNHGATPKSVLELMNVKDLTLSHVKSHLQMYRTVKSSDKGSAGYGQTGIGLSQKPGIVDLHGVLACERPDLPQPLLKFQRASWQSSKETNSINYTQNPIINSMYSHLKGNQTMVGGQHYGGLSNCMKEKLDSCSLSRSDMTLDLEFTLGRPTSCKQTTRNQEN

SEQ ID NO: 123293 - protein, 701 aa, Glycine max
  Coding DNA Sequence Number=SeqID_6515
  Gene Ontology: Mol. function=ATP-dependent helicase activity; Cellular component=nucleus; Biological process=mRNA processing
  Homolog annotation: Hit_ID=Q1SC30; Match level="QueryCoverage=80%, HitCoverage=84%, E-value=0.0, Identity=92%"; Hit description =Helicase, C-terminal
  Pfam annotation: Domain name=DEAD; Domain location=305-496; Score =231.1; E_value=2.3e-66; Accession=PF00270.19; Description=DEADDEAH box helicase
  Pfam annotation: Domain name=DUF1777; Domain location=53-203; Score= -75.7; E_value=0.0045; Accession=PF08648.2; Description=Protein of unknown function (DUF1777)
  Pfam annotation: Domain name=Helicase_C; Domain location=563-639; Score=137.9; E_value=2.7e-38; Accession=PF00271.21; Description =Helicase conserved C-terminal domain
  Pfam module annotation: Pfam domain module=DEAD::DUF1777::Helicase_C; Domain location=305-496::53-203::563-639
MKRSNDDVAAPVSTAKPVFLTKAQREQLALQRRHEDVADQKRRQEQLLSRNHSSDRDRDRERDRDHRDRDRDRDRDRDRDRERERERARDRDREAERRNREREREEETRSRERARLEKLVEREREKELESIKEQYLGSKKPKKRVIKPSEKFRFSFDWENTEDTSRDMNSLYQNPHEAQLLFGRGFRAGMDRREQKKLAAKNEKDMRDQIRKKDGIEEKPEEADAQRRKEAAADLYDTFDMRVDRHWSEKKLEEMTERDWRIFREDYNISYKGSKIPRPMRSWNESKLTSELLKAVEKAGYKTPSPIQMAAIPLGLQQRDVIGIAETGSGKTAAFVLPMLSYITRLPPISEDNEAEGPYAVVMAPTRELAQQIEDETVKFAQYLGIKVVSIVGGQSIEEQGFKIRQGCEIVIATPGRLIDCLERRYAVLNQCNYVVLDEADRMIDMGFEPQVMGVLDAMPSSNLKPENEDEELDEKKIYRTTYMFSATMPPAVERLARKYLRNPVVVTIGTAGKATDLISQHVIMMKEAEKFYKLQRLLDELNDKTAIVFVNTKRNADHVAKSLDKEGYRVTTLHGGKSQEQREISLEGFRTKRYNVLVATDVAGRGIDIPDVAHVINYDMPGNIEMYTHRIGRTGRAGKTGVATTFLTLQDSDVFYDLKQMLIQSNSPVPPELARHEASKFKPGTIPDRPPRRNDTVFAH

SEQ ID NO: 123294 - protein, 535 aa, Glycine max
  Coding DNA Sequence Number=SeqID_6516
  Gene Ontology: Mol. function=oxidoreductase activity; Cellular component=membrane; Biological process=electron transport
  Homolog annotation: Hit_ID=Q309D0; Match level="QueryCoverage=90%, HitCoverage=92%, E-value=1e-148, Identity=51%"; Hit description=P450 mono-oxygenase
  Pfam annotation: Domain name=p450; Domain location=45-520; Score =327.4; E_value=2.4e-95; Accession=PF00067.12; Description=Cytochrome P450
  Subcellular localization annotation: CTP_CleavageSite=47; ConfidenceScore=5.47e-01
MDLQYPFLLSTPSFTIFFGLLLFLFVLSSIWRRSRTRTATTRKSPPEASGAWPLIGHLHLFGASKPPHVTLGNMADKYGPIFTLRLGVHKTLVVSNWEMAKQCFTVNDKAFASRPKSVAFEVLGYNFSMIGFSPYGSYWRHVRKIATLELLSSHRIDMIKHVMESEVKAAVKEIYDIWIDKNKSGSEKVTTEMKRWFGDIMLKVMFRTVVGKRFVLETEENERIRKAMRDLFDLSGSFSVSDALPYLRWFDLDGAEKKMKTTAKELDGFVEVWLQEHKRNRNNSGSGQEKGNHDFMDLLLNLVEEGQEFDGRDGDTTIKATCLALILAGMDTTAGTMTWALSLLLNNHGILNKVVHELDTHIGTEKMVKVSDLKKLEYLQSIIKETLRLYPVGPLSLPHESMQDCTVGGYHVPSGTRLLTNISKLQRDPLLYSNPLEFCPERFLTTHKDIDVKGQHFELIPFGAGRRMCPGLSFGLQIMQLTLATLLHGFDIVIHDAKPTDMLEQIGLTNIKASPLQVILTPRLSTYIYDEIYIV

SEQ ID NO: 123295 - protein, 442 aa, Glycine max
  Coding DNA Sequence Number=SeqID_6517
  Gene Ontology: Mol. function=transferase activity; Cellular component= peroxisome; Biological process=isoprenoid biosynthetic process
  Homolog annotation: Hit_ID=Q2L8A7; Match level="QueryCoverage=85%, HitCoverage=99%, E-value=1e-151, Identity=68%"; Hit description =Acetoacetyl-CoA thiolase
  Pfam annotation: Domain name=Thiolase_C; Domain location=342-441; Score=61.5; E_value=2.8e-15; Accession=PF02803.8; Description =Thiolase, C-terminal domain
  Pfam annotation: Domain name=Thiolase_N; Domain location=72-335; Score=421.0; E_value=1.6e-123; Accession=PF00108.13; Description =Thiolase, N-terminal domain
  Pfam module annotation: Pfam domain module=Thiolase_C::Thiolase_N; Domain location=342-441::72-335
MALNIFLIKALCVEKNFIIRVNCKKNRSGDLFDIWTKEKNLSVQIPKDRLKGRLSSFLTYAPHPSMSTSAKSRDVCIVGVARTPIGGLLGTLSSLSATELGSIAIKSALERANVDPSLVQEVFFGNVLSANLGQAPARQAALGAGIPTSVICTTINKVCASGMKATMLAALTIQFGLNDVVVAGGMESMSNAPKYLAEARKGSRYGHDTIIDGMVKDGLWDVYNNFGMGACAELCADQHVITRDEQDSYAIRSFERGISAQNAGHFAWEIVPVEVSTGRGRASTIVDKDEGLGKFDAAKLRKLRPSFKEVGGSVTAGNASSISDGAAALVLVSEEKARELGLHVIAKIKGYGDAAKVVALANQKLLALNPEKVNVYGGAVSLGHPLGCSGARILVTLLGIFVICGYLSQVVLQVLRQKRGKYGVAAICNGGGGASALVLELM

SEQ ID NO: 123296 - protein, 298 aa, Glycine max
  Coding DNA Sequence Number=SeqID_6518
  Gene Ontology: Mol. function=transporter activity; Cellular component= intracellular; Biological process=transport
  Homolog annotation: Hit_ID=O48939; Match level="QueryCoverage=82%, HitCoverage=71%, E-value=1e-127, Identity=93%"; Hit description =Polyphosphoinositide binding protein Ssh1p
  Pfam annotation: Domain name=CRAL_TRIO; Domain location=106-284; Score=5.8; E_value=3.8e-06; Accession=PF00650.10; Description =CRALTRIO domain
  Pfam annotation: Domain name=CRAL_TRIO_N; Domain location=2-84; Score= 25.4; E_value=5.1e-05; Accession=PF03765.5; Description=CRALTRIO, N -terminus
  Pfam module annotation: Pfam domain module=CRAL_TRIO::CRAL_TRIO_N; Domain location=106-284::2-84
MGVGSQDAIKQFQAFIDQVEEPLRTTFQLLLFPPLELRNFNCQNVHQGFVTETLMRFLKARDWDPCKAHKMLVDCLNWRVQNEIDNILSKPIVPADLYRAVRDSQLIGLSGYSREGLPVFAIGVGLSTFDKASVHYYVQSHIQINEYRERIILPSASKKQGRPITTCIKVLDMTGLKLSALNQIKLLTIISSIDDLNYPEKTNTYYIVNAPYIFSACWKVVKPLLQERTRRKIQVLPGCGRDELLTIRACGAINLSLKFCHFFQPHACTLHCNKAPYPPYTVALHGAFETSWKMFQTS

SEQ ID NO: 123297 - protein, 588 aa, Glycine max
  Coding DNA Sequence Number=SeqID_6519
  Gene Ontology: Mol. function=serine-type endopeptidase inhibitor activity; Cellular component=mitochondrion; Biological process =negative regulation of cell proliferation
  Homolog annotation: Hit_ID=Q5VMT5; Match level="QueryCoverage=95%, HitCoverage=36%, E-value=0.0, Identity=55%"; Hit description =Putative Spo76 protein
  Pfam annotation: Domain name=HEAT; Domain location=383-414; Score =11.2; E_value=1.9; Accession=PF02985.12; Description=HEAT repeat
  Pfam annotation: Domain name=HEAT; Domain location=50-87; Score=5.8; E_value=8.3; Accession=PF02985.12; Description=HEAT repeat
  Pfam module annotation: Pfam domain module=HEAT::HEAT; Domain location=383-414::50-87
MAQKPHFQLEELGSKLQSIPSDDNVLSELLKQAAACLTDLDQSQSASTLESMKPFFGAIVKPELLKHQDSDIKLLVATCLCEITRITAPEAPYSDDVLKDIFQLIVGTFSGLSDTSGISFDQRVAILETLAKYRSCVVMLDLECDDLVNEMFGTFFVVVRDDLPKSVLSSMQTIMAVLLEESEDVHQDLLSILLSMLGRGKTNVTGAARKLSMNVIQQSMEKLEPCIKQFLLSLMSGDSKTMNSQVQYHEVIYDLYCCAPQTLSGVLPYVTEELMADRLETRLKAVNLVGDIIALPGSSTSEAFQPTFSEFLKRLTDRDFGVRMSVLEHVKNSLLSNPSRAEAPQIISALCDRLLDFDENFRKQVVDVICDVACHTLNAVPLETVKLVAERLCDKSLLVRKHTLERLAEIYRVFCENSSIAVNPSEYDWIPRKIIRCFYDKDFRSDIIESILCGSLFPSEFSINDIVKRWVEIFSGFDKVEVKALEKILEKKQRLQEEMQKYLALRQISQEKDIPEAQKKIGFCFRAMSRSFADPIKAEESFQILDQLQDANIWKILTDLVDPNTSFHQTRVYGVISSETDRYGFGDT

SEQ ID NO: 123298 - protein, 463 aa, Glycine max
  Coding DNA Sequence Number=SeqID_6520
  Gene Ontology: Mol. function=molecular_function; Cellular component =mitochondrion; Biological process=negative regulation of cell proliferation
  Homolog annotation: Hit_ID=Q5VMT5; Match level="QueryCoverage=98%, HitCoverage=29%, E-value=1e-132, Identity=54%"; Hit description =Putative Spo76 protein
MQIIARFCPDLFSGTEVELVNLLKDNNDMIKEGVLNVLARAGGTIREQLAVTSSSVDLMLERLCLEGSRRQAKYAVHALAATTKDDGLKSLSVLYKRLVDMLEEKTHLPAVLQSLGCIAQTAMPIFETRESEIEEFIINKILKSDSKEDHSRISWDDKSDLCVLKIYGIKTIVKSYLPIKDAHVRPGIDGLLDILRNMLSYGEISKDLQSSSVDKAHLRLASAKAVLRLSRLWDHKIPVDIFHLTLRATEISFPQARKVFLRKVHKYIKDNLLDAKYACAFIFNIFGTKDSKSEEFAEDKQNLDDIIHMHYQARAWQLSGQSDANSLTTYPEYILPYLVHALANISCPKIDECKDVGAYEKIYRQLHLILSMLMQRDEDDKSEVALNKEKEIISTIASIFWSIKQSDDVVDASKSKNSHAICDLGLAITKRLVQKDVDLQGLSPSVSLPPMLYKACEKEIDPM

SEQ ID NO: 123299 - protein, 549 aa, Glycine max
  Coding DNA Sequence Number=SeqID_6521
  Gene Ontology: Cellular component=mitochondrion
  Homolog annotation: Hit_ID=Q5VMT5; Match level="QueryCoverage=50%, HitCoverage=16%, E-value=2e-28, Identity=34%"; Hit description =Putative Spo76 protein
MVPSQLAEDDALKGSERDKNEMPLGKIIKDIKSQGTKGKKVKRKKAVPAETKKAENDIDILNMVREINIDNLGLSTNYESSNGHENSLSKKLQNDPECATIKKRKAEVTLVPVPKRKRSSFAHGKSRSSSTPPKAPPRVSGEDSSGVKLPSGAKFNPDTHSSAMQRKKVKDNEASIKAKVKASKSNHDDDSDKSEEHDMKSPDNTKPTDKSKSNNLKPSIGSTKKLKRKSIGGLAKCTTKEGESDAEDLIGCRIKVWWPLDKKFYEGTVKSYDSLKRKHVILYNDGDVEVLNLEKERWELSDSKPTKKLKLSKTVSSPEVSTGKKQRSSSGSASKKTKKIVNGKKSPSNHVKHGQKGASKTNSHNEDAKESSELSNPEDISKAEINSGGSEAEQAEGSDVIVTKQKKSNKKPKSVSRGKKLKKEKSLRYKKESDEEKRESDQEKQDHGERLAEENIPQGDQNDDAESSSKETDGNESRGALRENGNEEESGSGGNENDSDGEKSSPREVEKSPIESASPDGAKIAEVSDDELLVNCSSFAELWHLLLFT

SEQ ID NO: 123300 - protein, 182 aa, Glycine max
  Coding DNA Sequence Number=SeqID_6522
MPNSLKTNDFTGTPRGAQSKWEIHLRNVELVRAPAEAVASGVLFQHLRARGQGSKILQGVGHITRFNAKTINDFLDTPVALADGKDYLVDSKYLHTYPNHQAIVPKLCIPGGGFVLNANRAPWKLLRKDLTRLAQTWSILSYFNLALTSHTSDLNVDRARLIYGLVMKMDMDLGSFILGQIM

SEQ ID NO: 123301 - protein, 103 aa, Glycine max
  Coding DNA Sequence Number=SeqID_6523
MPTKRSLVELTSQDATLAQNKLLARQIEALMKTLNKLPQQRQADSELLGSSELPWVPRLQPMKTAGIQPREEFHTRLKLEESFGEPVQQGAKKSTWPEFQPRD

SEQ ID NO: 123302 - protein, 396 aa, Glycine max
  Coding DNA Sequence Number=SeqID_6524
  Gene Ontology: Mol. function=protein serine/threonine kinase activity; Cellular component=membrane; Biological process=protein amino acid phosphorylation
  Homolog annotation: Hit_ID=Q2HV29; Match level="QueryCoverage=44%, HitCoverage=94%, E-value=7e-65, Identity=59%"; Hit description=2OG -Fe(II) oxygenase
  Pfam annotation: Domain name=2OG-FeII_Oxy; Domain location=68-180; Score=1.1; E_value=0.092; Accession=PF03171.10; Description=2OG -Fe(II) oxygenase superfamily
  Pfam annotation: Domain name=Pkinase; Domain location=205-389; Score=- 82.3; E_value=0.0012; Accession=PF00069.15; Description=Protein kinase domain
  Pfam annotation: Domain name=Pkinase_Tyr; Domain location=205-367; Score=-100.3; E_value=2.6e-06; Accession=PF07714.7; Description =Protein tyrosine kinase
  Pfam module annotation: Pfam domain module=2OG-FeII_Oxy::Pkinase::Pkin ase_Tyr; Domain location=68-180::205-389::205-367
MDVLKLKAVSEENPSETVKRETEATSFTFRGLTELTYSGYQPHAYSWDDYPRLKNMLDAVYKALPGSSFNSLLLNRYNCGNDYVGWHSDDEKLYGRTPEIASLTFVLKKKPCKKSRDGSGEPASKRLKKGSHDADQHTFRLRHGSLMVMRGYTQRDWIHSVPKRAKAEATLINLTFRTKVVFGEVNDDKVKLFSLEGLEKATDNFNKNRVLGKGGQGKGMLIDGKIIATEISLLVYEFIPNGNLFEYLHGQNEDLPMTWEMRLRIATKVAGALFYLHLAASRPIYHRDIKTTNILLDEKYRAKVADFEKSVYSFGVVLVELLTGQKPISLLRPEEAKSLVIFHSLYGGKSSLNGKKPPTMKEVTMELEGIRKLEGKSNTLERHDDLEHVPTEDYQI

SEQ ID NO: 123303 - protein, 522 aa, Glycine max
  Coding DNA Sequence Number=SeqID_6525
  Gene Ontology: Mol. function=actin binding; Cellular component=proton- transporting two-sector ATPase complex; Biological process=protein modification process
  Homolog annotation: Hit_ID=Q2HV31; Match level="QueryCoverage=99%, HitCoverage=90%, E-value=1e-171, Identity=64%"; Hit description =Prefoldin
  Pfam annotation: Domain name=DUF827; Domain location=2-481; Score =286.3; E_value=5.8e-83; Accession=PF05701.2; Description=Plant protein of unknown function (DUF827)
  Pfam annotation: Domain name=Filament; Domain location=2-246; Score= -180.2; E_value=0.065; Accession=PF00038.11; Description=Intermediate filament protein
  Pfam module annotation: Pfam domain module=DUF827::Filament; Domain location=2-481::2-246
MNVLEKETQLLLAQRELNKIKKQLESAENTKSKALSELDKANVTLQELTKKLNSVRESKQSAIEAAEAVKNQAKELEQALSQKAIGYEAWKQELEHARKEYTTTVKELDASKQELNKIRQDFDTALEAKLAAFQTAGEAQRSAKLNTEKLHELKNQVATMKEQIEHLKLASSQAQEDQAKAMEEREARLSFYENAKEEAQNKLIALKNEYEPELTQSLEAKLAETSEEIQVLQKQIQEAHASEMDSVRLITLEIKEATKTLQEVAEEESSLRDLVDSLRKELEQVKKEQEELKEKEKAAEALAVDLTDQLQSKPEETMDKESDNIDEIELKIKHLSFETETARREEEEMRSKTQELKQEAEKSKAVAEELEKKLELYLKQAEEAKAAEQRAIEEMKMMSDSDNTQDTVSVADSNGKIVLTVDEFAALSGKIKESEDLIDRTETAVMAQVEAINTRKNEVDRKVEANLKAIEEIKAATDMALRNAEMADSAKVAVEGELKKWRQEEQNLDYSDNSSRPISLRI

SEQ ID NO: 123304 - protein, 309 aa, Glycine max
  Coding DNA Sequence Number=SeqID_6526
  Gene Ontology: Mol. function=transporter activity; Cellular component= intracellular; Biological process=transport
  Homolog annotation: Hit_ID=Q2HV32; Match level="QueryCoverage=99%, HitCoverage=98%, E-value=1e-136, Identity=75%"; Hit description =Cellular retinaldehyde binding/alpha-tocopherol transport; Cellular ...
  Homolog annotation: Hit description=retinaldehyde-binding/triple function, N-terminal
  Pfam annotation: Domain name=CRAL_TRIO; Domain location=82-259; Score= 22.3; E_value=1.6e-07; Accession=PF00650.10; Description=CRALTRIO domain
  Pfam annotation: Domain name=CRAL_TRIO_N; Domain location=2-72; Score= 20.2; E_value=0.00021; Accession=PF03765.5; Description=CRALTRIO, N -terminus
  Pfam module annotation: Pfam domain module=CRAL_TRIO::CRAL_TRIO_N; Domain location=82-259::2-72
MGLVSQDALNQLQALMDQVLLEEEPLQRTFQNVHQGCVAETLTRFLKAREWNATKAHKMIVDCLKWRVQNEIDNILSKPIIPTDLYRGIRDSQLIGLSGYSREGLPVFAIGVGLSTFDKASPSASKKHERPITTCVKVLDMTGLKLSALNQIKLLTIISSIDDLNYPEKTNTYYIVNAPYIFSACWKVVKPLLQERTRRKVQVLQGCGRDELLKIMDYTSLPHFCRREGSGSSRHSENGNENCYSVDHPFHKQLYNYIKEQSRIHEAVEPIKQGSFHVDFPEPPAEKAEIVKTLESELHKFKISNENGD

SEQ ID NO: 123305 - protein, 124 aa, Glycine max
  Coding DNA Sequence Number=SeqID_6527
  Pfam annotation: Domain name=zf-CCHC; Domain location=51-68; Score =31.1; E_value=3.8e-06; Accession=PF00098.13; Description=Zinc knuckle
MQEENEDEESEDEEDFSLFVKKFHKFVKNRRSERRQNFNHGKRYHEGSPTLRCYKCNQLGHIKANCPSNEQWPKKSDKKSHEERKTKKADIAWDDNNSSEESKKEEINLLTKDYESEEDITQRG

SEQ ID NO: 123306 - protein, 84 aa, Glycine max
  Coding DNA Sequence Number=SeqID_6528
MFEHNLSFTVELPNSTFTFIHHVQPITKEGGTLKFFRIAHAERETKICKILGENLYRKYDDAFLDNSSNNESGDEFFRKLEEEE

SEQ ID NO: 123307 - protein, 225 aa, Glycine max
  Coding DNA Sequence Number=SeqID_6529
  Gene Ontology: Mol. function=RNA-directed DNA polymerase activity; Biological process=RNA-dependent DNA replication
  Homolog annotation: Hit_ID=Q1S7B8; Match level="QueryCoverage=81%, HitCoverage=37%, E-value=4e-22, Identity=25%"; Hit description=RNA -directed DNA polymerase
MSSTTKFLTFEERPVKGDQLSSQVENNHLQNSNFVSSIDGIFPKGCNPSFITLIPKLGGQSIRPRIKKVLPKVIDKRQSVFLENRNLLHSVVVANEVVDEAGRKNKSSSTRKFNLQRKLQQGHPLALFLFMVVAEDLNGIMRMTTSKCLFSGYKVVKRFESIMREFCGSKKGEQNEIAWVRWKDVCCPRSHGGLGIKDLKLFNETLLAKWRWHLFHQRNTLWVMS

SEQ ID NO: 123308 - protein, 82 aa, Glycine max
  Coding DNA Sequence Number=SeqID_6530
  Gene Ontology: Mol. function=nucleotide binding; Cellular component =membrane; Biological process=small GTPase mediated signal transduction
  Homolog annotation: Hit_ID=Q40195; Match level="QueryCoverage=62%, HitCoverage=23%, E-value=7e-20, Identity=92%"; Hit description=Ras -related protein Rab11E
MLGYKGDDEYDYLFKLVLISDSGVGKSNLLSHFTRNEFNLESKSTIGVEFATIGFLFKNEILLELSSSPFGTISHPGYDEIG

SEQ ID NO: 123309 - protein, 183 aa, Glycine max
  Coding DNA Sequence Number=SeqID_6531
  Homolog annotation: Hit_ID=Q5S1T9; Match level="QueryCoverage=23%, HitCoverage=20%, E-value=9e-07, Identity=56%"; Hit description =Prenylated Rab acceptor protein 1
MVPKGELDSSNKISFLNKNPMVANSTPMVDLDSKLNSFLVKCEIRECSIEIDERLIRGTEKVEEGPRGKKANKEDERERISEERDCEDEVALEKDSSFENVEREVDRLLMKSRKARLFAEALMASLPALVVPVEVWGLEMGRTGGTVEDMMGRAYSKMIKMKRPSLYYQYNYNGQRGTRRCTL

SEQ ID NO: 123310 - protein, 333 aa, Glycine max
  Coding DNA Sequence Number=SeqID_6532
  Homolog annotation: Hit_ID=Q5ZDA3; Match level="QueryCoverage=97%, HitCoverage=83%, E-value=1e-73, Identity=47%"; Hit description =Membrane protein-like
MGEDPQKLKRLAADSYDYDNDSRWPGYWNNVLIPPHMASRDDVVSHFKRKFYQRYVDPDLVVEPMSVGGSSSQPTRSSTTSSSSSPPTNNQPRARSSGSTNRTSGTSTTAGPGPSPTPLRWDRQTVLFSVYAWVFVVAFLAAIPLVPKHLSHRAYRLCFLGTLCSSLYSLYSQYGKPRAWNLQALQVYFQSIVASKDFIYFIYCLTFVTSHLCLKFALIPILCWSFEHVAKFLRRNFSRSTLFSVTYKENSVPRRNNIALIKHGLVLSSISEVLGRALCLGGVKQFYPQYTDIACRDWTWILADHLIVLVAAEHNTNIHVLAGLFPCHRTGSE

SEQ ID NO: 123311 - protein, 107 aa, Glycine max
  Coding DNA Sequence Number=SeqID_6533
  Gene Ontology: Mol. function=transferase activity, transferring hexosyl groups; Biological process=carbohydrate biosynthetic process
  Homolog annotation: Hit_ID=Q1S568; Match level="QueryCoverage=76%, HitCoverage=29%, E-value=1e-40, Identity=89%"; Hit description =Glycosyl transferase, family 8
MVIDLERWREGDYTTKIEEWMELQKRMRIYDLGSLPPFLLVFAGNIASVDHRWNQHGLGGDNFRGLCRDLHPGPVSLLHWSGKDSYRFEVNTRQRRFKRGGKEIREF

SEQ ID NO: 123312 - protein, 593 aa, Glycine max
  Coding DNA Sequence Number=SeqID_6534
  Gene Ontology: Mol. function=signal transducer activity; Cellular component=membrane; Biological process=response to light stimulus
  Homolog annotation: Hit_ID=Q9FIK1; Match level="QueryCoverage=89%, HitCoverage=95%, E-value=1e-166, Identity=55%"; Hit description =Photoreceptor-interacting protein-like
  Pfam annotation: Domain name=NPH3; Domain location=208-458; Score =192.5; E_value=1e-54; Accession=PF03000.5; Description=NPH3 family
MKFMKLGTKADTFYTEQATRTLISEIVVDLVIQINDITYLLHKLQFPLLPKCGLLQRFCCDTSDSESVSLELHDIPGGEDAFELCAKFCYGIAINISAHNFVSALCAAKFLRMNDSIEKGNFVGKLESFFNSCILEGWKDSIATLQTTATLPEWSENLGIVRKCIDSIIEKILTPPPQLINDDSVQVKWSYTYTRPGYTKKQHHSVPKDWWTEDVSDLDIDLFRCIIMAIRSTYVLPPQLIGEALHVYACRWLPGLTKIKSSGSSASQTEESKEKNRKILETIVSMIPADRGSVSVGFLFRLLSISIHLGVSSVTKTELIRRASLQFEEATVSDLLYPSTSSSDQNYYDTELVLAVLETFLKLWKRMSPGAVDNSYFLRSIRNVGKLIDSYLQVVARDDNMQLACDLDKDLSKATYEQKESHLRGETVRMQVHPDLSKADKKRLCGILDCQRLSPEVRAHAVKNELLPLRTVVQLLYFEQDKGSKATTSHKLPKPHEILLGAKHRPATATTKEEFNREEIRERDHHKTKRSDGKLLALDLEKKMAIRGEDIEETQSEKARGVKDASSSSGKVDLDPKKIIRRARSKSEHGVKK

SEQ ID NO: 123313 - protein, 73 aa, Glycine max
  Coding DNA Sequence Number=SeqID_6535
  Gene Ontology: Mol. function=transferase activity
  Pfam annotation: Domain name=Alg14; Domain location=1-72; Score= -13.8; E_value=2.3e-07; Accession=PF08660.1; Description =Oligosaccharide biosynthesis protein
MVHALWLMIKIRPEVILGIRWSSIFYVESIARVRRLSLSGLLLYKLRMVDQLFVQWPQLQRQYPRATYVGRLM

SEQ ID NO: 123314 - protein, 177 aa, Glycine max
  Coding DNA Sequence Number=SeqID_6536
  Gene Ontology: Mol. function=catalytic activity; Biological process =lipoate biosynthetic process
  Homolog annotation: Hit_ID=Q948J9; Match level="QueryCoverage=67%, HitCoverage=43%, E-value=3e-36, Identity=65%"; Hit description =Lipoyltransferase
  Pfam annotation: Domain name=BPL_LipA_LipB; Domain location=101-177; Score=44.3; E_value=4.2e-10; Accession=PF03099.9; Description =Biotinlipoate AB protein ligase family
MKMCGVGKRLENVEDGVCEGGITECCYDYEDRGVYGVLLGSYSLASIPSSPLPLRSHPKLSSSAQHGLGKKTLREKKLQIENGGDCSDTLIILQHPSVYTLGTASTHHNLNFDIENPPFPIYRTERGGEVTFHGPGQLVMYPIINLRRHKMDLHWYLRTLEEVVIRALQRFQFRLLG

SEQ ID NO: 123315 - protein, 751 aa, Glycine max
  Coding DNA Sequence Number=SeqID_6537
  Gene Ontology: Biological process=pollen maturation
  Homolog annotation: Hit_ID=Q5Z6I4; Match level="QueryCoverage=99%, HitCoverage=79%, E-value=0.0, Identity=51%"; Hit description =Putative Osnop
  Pfam annotation: Domain name=C2; Domain location=3-82; Score=96.0; E _value=1.1e-25; Accession=PF00168.20; Description=C2 domain
  Pfam annotation: Domain name=C2; Domain location=550-632; Score=71.7; E_value=2.3e-18; Accession=PF00168.20; Description=C2 domain
  Pfam module annotation: Pfam domain module=C2::C2; Domain location=3 -82::550-632
MKLVVRVIEAKNLATTDSNGLSDLYVRVQLGKQKFKTKVVKSLNPTWDEKFAFWVDDLKDSLVISVMDEDKFFNYEYVGRLKVPISLVFEEEIKSLGTAWYSLKSKNKKYKNKQCGEIHLSIFISQNNASEELNDIGDQLLPPRKCPDAITTSLSMSSTGFSSSSSPVREETTSCSSKEEKSCMQQRSFAGRIAQIFNKGPDVSSVSPSRSIDLDQSETNKAVVGEIKIEEDQSSNETFEETMKKIQSADQGSEIPNNLSGGVLIDQLYIVAPEDLNVLLFSPDSNFPKSLSEEQGTSELQICPWKLENGGETLKRSLTYIKAATKLIKAVKGYEDQTYLKADGKNFAVLGSVSTPDVMYGTTFRVEVLYVITPGPELPSGEQCSRLVISWRMNFLQSTMMKGMIESGARQGMKDSFDQYATLLCQTVKPVVSKDLGSSKEQALATLRPEPQSILKLAMQYLANFTVFTTFLMVSYVLVHIYLAAPRTIQGLEFVGFDLPDSIGEFVVCIVLVLQGERVLGLISRFMQARARARKGSDHGIKAQGEGWMLTVALIEGSNLATVDSGAFCDPYVVFTCNGKTRTSSIKFKKSDPLWNEIFEFDAMDDPPSVLDVEVYDFDGPCDKAASLGRVEINFLKTNISDLADIWVSLEGKLALACHSKLHLKVFLNNTRGGDVVKHYISKMEKEVGKKDIEDIQIIPPTFSSMGSPIIVITLWPGRGVDARHGAKTQDEEGRLKFRFQSFVSFNVANR

SEQ ID NO: 123316 - protein, 198 aa, Glycine max
  Coding DNA Sequence Number=SeqID_6538
  Gene Ontology: Biological process=pollen maturation
  Homolog annotation: Hit_ID=Q5Z6I4; Match level="QueryCoverage=98%, HitCoverage=19%, E-value=9e-56, Identity=51%"; Hit description =Putative Osnop
MALWKARSLSPEQKVQLVEEDSETKSLRSEESGSFIGLGDVSMSEASFFMELFSGGELDRMFMEKSGCVNYSYTPWVSENSDVYERAIYYKFEKRISRYRVEVTSTQQRSLLEGKGWLLQEVMNFHGVPLGDFFNLHLHYQIEDLSPKANSCKVQVLFGTEWLKSTKHQKRITKNILKNLQERLKLTFSLVEKEFLSK

SEQ ID NO: 123317 - protein, 133 aa, Glycine max
  Coding DNA Sequence Number=SeqID_6539
  Gene Ontology: Cellular component=integral to membrane
  Homolog annotation: Hit_ID=Q1S566; Match level="QueryCoverage=88%, HitCoverage=38%, E-value=4e-21, Identity=59%"; Hit description =GNS1/SUR4 membrane protein
  Subcellular localization annotation: CTP_CleavageSite=16; ConfidenceScore=5.18e-01
MSLISAAIFTGMFSAQAEARDTRWLWRRSRTTSFEWLLCLPLRTRPSGRVFFWSYVFYLSRFLHLLRRFASPKVVVFQAVQQLRPFDHVVFMARVFTVASGAGDSVLHGGLFRRLCVPVKCNDSVYGYRTCNL

SEQ ID NO: 123318 - protein, 57 aa, Glycine max
  Coding DNA Sequence Number=SeqID_6540
MMMMKPKRGENIEMNELVLVAYNWSMYEGSNTFRRVVKLIKRKVKRSGVGERAKSRI

SEQ ID NO: 123319 - protein, 77 aa, Glycine max
  Coding DNA Sequence Number=SeqID_6541
MNVIARHRLVAQTKQIPRVGSTSTQYASIRFRIHSGYLSPRLSVYKYTVQTWASPFTTIILFSSLPSPKNLHSHEPN

SEQ ID NO: 123320 - protein, 152 aa, Glycine max
  Coding DNA Sequence Number=SeqID_6542
MQVLTNGIEVKLQRNALSVIEAPTGNEEDDDLEFENMPWNGSDLASDDTQKFHKPRHRMHRTLGSSHKTMSRSFSGDSQSKGSVSMPHGSTKVDLSKLEMAALWRYWRHFNLVDAVPNPSKEQLVDVVQRHFMSQVIVGFVQAAKRLKTVCK

SEQ ID NO: 123321 - protein, 210 aa, Glycine max
  Coding DNA Sequence Number=SeqID_6543
MSSFQVWSGFLLALSLLNSRALVYSHPTPNSPSHPPQHGDSAHKPGCYQPTPPTHRPPKIPPPPSLPSLSPLPPGAFYFFSPPPPSPPHYPKTQRPVGLGPPPPRFRINLIPGIGVRGDSLFNGRSGSIVVGRGHWLDISVVIPNDLQALYNLFGSLVLGKKGHTFDGGKLLDGIKINSWEWFPYEKQNTDRIFFSSWMLNTLLCLNSYE

SEQ ID NO: 123322 - protein, 71 aa, Glycine max
  Coding DNA Sequence Number=SeqID_6544
MGILAGHATTKGKTKQQCDTGHDHEFAEPKKRKRESEGELESIFSDMFVFENCNCNIGTSNASMHQGEVQN

SEQ ID NO: 123323 - protein, 561 aa, Glycine max
  Coding DNA Sequence Number=SeqID_6545
  Gene Ontology: Mol. function=hydrolase activity, hydrolyzing O -glycosyl compounds; Cellular component=anchored to membrane; Biological process=carbohydrate metabolic process
  Homolog annotation: Hit_ID=O23562; Match level="QueryCoverage=81%, HitCoverage=91%, E-value=0.0, Identity=70%"; Hit description =Glucanase like protein
  Pfam annotation: Domain name=Glyco_hydro_17; Domain location=104-423; Score=267.2; E_value=3.4e-77; Accession=PF00332.9; Description =Glycosyl hydrolases family 17
  Pfam annotation: Domain name=X8; Domain location=442-524; Score =132.7; E_value=1e-36; Accession=PF07983.3; Description=X8 domain
  Pfam module annotation: Pfam domain module=Glyco_hydro_17::X8; Domain location=104-423::442-524
  Subcellular localization annotation: CTP_CleavageSite=76; ConfidenceScore=5.66e-01
MVSVNNKNFVPHCPEALRNAKLKKSSSRSCSGALLLAVNTVTSRAGASSAFRVYYSPQTAAKSLLFNERLKCVCLSGRMLEATRWLLGAGILMWMLAWLGESAIGVNWGTVSFHKLKPSTVVGLLKDNKIPKVKVFEAEADVLKALMGSGIQVMLGIPNEMLPLLSTSPAAADSWLRQNVSAYLGKGGADIRYIAVGNEPFLTSYNGQYQNLVMPAILNLQQSLVKANLAGYIKLVVPCNADAYESSLPSQGAFRPELTQIMTQLVQFLNSNGTPFIVNIYPFLSLYDNNDFPQDYAFFEGTTHPVTDGNNVYTNAFDGNYDTLVAALSKLGYDQMPIVIGEIGWPSDGAIGANITAAKVFNQGLISHVLSNKGTPLRPDAPPMDIYLFSLLDEGAKSILPGGFERHWGIFSFDGQAKYPLNLGLGNKELKNAKNVQYLPSRWCVASPSTDAQNVANHMRIACSVADCTTLDYGGSCNGIGEKGNISYAFNSYYQLQMQDSRSCNFDGLGVITFRDPSVGDCRFLVGVTDKGSDSSASQIRCQWWILLAFLVIQTISSFSL

SEQ ID NO: 123324 - protein, 117 aa, Glycine max
  Coding DNA Sequence Number=SeqID_6546
MAWRGDVKKEEGCSSEALGVFDFPWLKDGVTTKPEDYLMDLEDNLSSLLEQEDSSFKAATACIDFSSEAKLEDLAWQPFESDVLELEADDVDYIWSSLLKQPLRPHPAATIFSINIV

SEQ ID NO: 123325 - protein, 74 aa, Glycine max
  Coding DNA Sequence Number=SeqID_6547
MESSVNGGFTHLQSCGDSSEEELSVLPRHTKVVVTGNNRTKSVLVGLQGVVKKAVGLGGWHWLIFTCGFLRGVG

SEQ ID NO: 123326 - protein, 505 aa, Glycine max
  Coding DNA Sequence Number=SeqID_6548
  Gene Ontology: Mol. function=6-phosphofructokinase activity; Cellular component=6-phosphofructokinase complex; Biological process=glycolysis
  Homolog annotation: Hit_ID=Q9FIK0; Match level="QueryCoverage=84%, HitCoverage=95%, E-value=0.0, Identity=74%"; Hit description =Pyrophosphate-fructose-6-phosphate 1-phosphotransferase-like protein
  Pfam annotation: Domain name=PFK; Domain location=96-355; Score= -18.4; E_value=7.4e-12; Accession=PF00365.10; Description =Phosphofructokinase
MASEEAECISNLFKPIYLKEVAELRQYVPNLQSRPNPLDHNPYFDTRQLQQQQGFYLTESDVLLRQIGNDLSPSPRFAYHRAGPRKNIYFDPSIVRVAIVTCGGLCPGLNTVIRELVVGLWQLYGVRHIFGITAGYRGFYSSVPLPLNPKLVHHWHNVGGTLLQTSRGGFDLHNIVDAIQTHAFNQVYIIGGDGTMRGAVKIFDEIKHRKLEVAVVGIPKTVDNDVGIIDRSFGFQTAVEMAQEAISAAHVEAESAVNGIGLVKLMGRSTGHIALHATLSSRDVDCCLIPEIDFFLEGKGGLLEFLGQRLKENGHAVLVVAEGAGQDIIPRTDSQKDERDESGNPVFLDVGVWLKSELNKWWKREHPNELFTVKYIDPTYMIRAVHANATDNLYCTLLAHSAIHGVMAGYTGFVAGPINGNYAYIPLEDVARANNPVDTQDHKWSWVRSVTNQPDFVRSLFLLSKFALVYRWAYKGVFGVTENVESLEFISSNVFVREKMWATHF

SEQ ID NO: 123327 - protein, 271 aa, Glycine max
  Coding DNA Sequence Number=SeqID_6549
  Homolog annotation: Hit_ID=Q008R6; Match level="QueryCoverage=22%, HitCoverage=26%, E-value=5e-26, Identity=96%"; Hit description =Calcineurin B-like protein 3
  Pfam annotation: Domain name=efhand; Domain location=21-49; Score =27.1; E_value=6.3e-05; Accession=PF00036.22; Description=EF hand
MVVATLAESGMNLSDDVIESIIDKTFEEADTKHDGKIDKEEWRNLVLQHPSLLKNMTLQYLNAESANGHSLFPLLPHSSSDSGSALLSQPLLQDQNLFTEIEQEVQVLHWEKPSALEKEIRGLKSSFSRLETVVQTSVSKLQSGPTSEANEAAITSLKEKVDNLKTSLNGEIIGREADKRIYSAKEINELKTIVDEMMSTMLDLAAAIADLKHESLQPKESNESAQVRITDLAMITVSKEEHYIVIIFLIAVLIGLNLQPNCVLTSGTMLL

SEQ ID NO: 123328 - protein, 739 aa, Glycine max
  Coding DNA Sequence Number=SeqID_6550
  Gene Ontology: Mol. function=identical protein binding; Cellular component=cytoplasm; Biological process=negative regulation of enzyme activity
  Homolog annotation: Hit_ID=Q9FJF3; Match level="QueryCoverage=99%, HitCoverage=95%, E-value=0.0, Identity=60%"; Hit description=Serine protease-like protein
  Pfam annotation: Domain name=PA; Domain location=344-447; Score=80.3; E_value=6.1e-21; Accession=PF02225.12; Description=PA domain
  Pfam annotation: Domain name=Peptidase_S8; Domain location=98-586; Score=1.1; E_value=7.7e-07; Accession=PF00082.12; Description =Subtilase family
  Pfam annotation: Domain name=Subtilisin_N; Domain location=2-81; Score=55.1; E_value=2.4e-13; Accession=PF05922.7; Description =Subtilisin N-terminal Region
  Pfam module annotation: Pfam domain module=PA::Peptidase _S8::Subtilisin_N; Domain location=344-447::98-586::2-81
MGSHEHGEGVTDADFDLVTQIHHEFVKSYVGSSEKAKEAIIYSYTRHINGFAAMLEEKEAADIAKHPDVVSVFLNKGRKLHTTHSWEFMDLEGNDGVIPSDSLFRKAKYGEDTIIANFDTGVWPESPSFRDEGMGPIPSRWKGTCQHDHTGFRCNRKLIGARYFNKGYMAHAGADAKFNRSLNTARDYEGHGSHTLSTIGGTFVPGANVFGLGNGTAEGGSPRARVATYKVCWPPIDGNECFDADIMAAFDMAIHDGVDVLSLSLGGNATDYFDDGLSIGAFHANMKGIPVICSAGNYGPTPATVFNVAPWILTVGASTLDRQFDSVVELHNGQRFMGASLSKAMPEDKLYPLINAADAKAANKPVENATLCMRGTIDPEKARGKILVCLRGVTARVEKSLVALEAGAAGMILCNDELSGNELIADPHLLPASQINYKDGLAVYAFMNSTKNPLGYIYPPKTKLQIKPAPAMAAFSSRGPNTVTPEILKPDVIAPGVNIIAAYSEGVSPTNLGFDKRRVPFITMSGTSMSCPHVAGVVGLLKTLHPDWSPAVIKSALMTTARTRDNTGKPMLDGGNDAKATPFAYGSGHIRPNRAMDPGLVYDLTNNDYLNFLCFSIYNQSQIEMFNGARYRCPDIINILDFNYPTITIPKLYGSVSVTRRVKNVGPPGTYTARLKVPARLSISVEPNVLKFDNIGEEKSFKLTVEVTRPGETTAFGGITWSDGKRQVRSPIVVGGVRG

SEQ ID NO: 123329 - protein, 481 aa, Glycine max
  Coding DNA Sequence Number=SeqID_6551
  Gene Ontology: Mol. function=metal ion binding
  Homolog annotation: Hit_ID=Q69VQ6; Match level="QueryCoverage=86%, HitCoverage=79%, E-value=1e-106, Identity=50%"; Hit description=Zinc finger (C3HC4-type RING finger)-like protein
  Pfam annotation: Domain name=VWA; Domain location=165-311; Score=7.3; E_value=0.001; Accession=PF00092.18; Description=von Willebrand factor type A domain
  Pfam annotation: Domain name=zf-C3HC4; Domain location=2-40; Score =23.1; E_value=0.00065; Accession=PF00097.15; Description=Zinc finger, C3HC4 type (RING finger)
  Pfam module annotation: Pfam domain module=VWA::zf-C3HC4; Domain location=165-311::2-40
  Subcellular localization annotation: CTP_CleavageSite=31; ConfidenceScore=5.48e-01
PLSHKSKGSKAIFTAQCSHAFHFACISSNVRHGNVTCPICRAQWTQLPRNLNSGSTISTNRSDPILQILDDSIATFRVHRRTLLRSTRYDDDDPVESDDAPEIHKLCFSLAPIPPKAPTSHLSPHPLSCGSSSLLQSPPQPMHIMFPSSNRSYLSLKLAQERATDLVLVASSNGQHLRLLKQAMALVVYSLRHTDRLAIVTHSSAAARVFPLRRMSSYGKRTALQVIERLFYMGQADPVEGLKKGIKILQDRTHKNSKSCILHLSDNPTRPYHAVNMELPSTPIHRFHVGFSFGTSNGFFIQEFERFLNKILGGIVRDIQLRICGTGEEVGGCRVVRIGDMRGGEERRVVLDLGDCTDVYVEYSYTEGDIDECVRRTGETVVGIGDHKGRVTEVAEETMNIIGRSCSVESWDFHDPYMARRWAKHLQELEIRGGTEYEGVKVIFKHRPAYIDDCIIGGQCTNSGLKLHAAIQGLAICAQWL

SEQ ID NO: 123330 - protein, 236 aa, Glycine max
  Coding DNA Sequence Number=SeqID_6552
  Gene Ontology: Mol. function=Rho GDP-dissociation inhibitor activity; Cellular component=cytoplasm; Biological process=actin cytoskeleton organization and biogenesis
  Homolog annotation: Hit_ID=Q705X3; Match level="QueryCoverage=99%, HitCoverage=99%, E-value=9e-94, Identity=74%"; Hit description=Rho GDP dissociation inhibitor 2
  Pfam annotation: Domain name=Rho_GDI; Domain location=24-235; Score =47.2; E_value=3.7e-12; Accession=PF02115.7; Description=RHO protein GDP dissociation inhibitor
MGFDDDKGKDVPETQHAAGKTVHAHDDESGDERGTSLSRHMSEGSIAVTEDEDEDVERRIDLGPQCTLKEQLEKDKDDESLRRWKEQLLGSVDMTSVGESLEPEVKILSLAIKAAGREDIVLPIPESGNPSGLWFTLKEGSRYSLMFTFQVSHNIVSGLKYTNTVWKTGLKVDSTKEMIGTFSPQAEPYTHEMPEETTPSGLFARGQYSARSKFVDDDNKLYLEINYTFDIRKDWL

SEQ ID NO: 123331 - protein, 141 aa, Glycine max
  Coding DNA Sequence Number=SeqID_6553
  Subcellular localization annotation: CTP_CleavageSite=25; ConfidenceScore=5.03e-01
PDYVIRPGEFSSSCSSKSQKKVHPCVSKVQVPGSLIAEAKDSLCLDRPMNMNRNEEAEELLSSTSIGKSQKKVSFKLSHNVIFYSPDEPCSPEPYYYNSSESEGSFYSSICREYSFDPSADETLIKLAVDVLPHVSVSSKI

SEQ ID NO: 123332 - protein, 65 aa, Glycine max
  Coding DNA Sequence Number=SeqID_6554
MVSVLVQTILGIHPICLTSISHNHALLPPSRLLRAHTLRIKKLLQRSLRESPRYTRQVVEPVMLY

SEQ ID NO: 123333 - protein, 125 aa, Glycine max
  Coding DNA Sequence Number=SeqID_6555
MERSIPEAAECDLSIPIPRGGPIYVPNMVGPSTRVPHFQTCLLSELRNLEAELSEDFSHLDISVDDLKIFTEDDLMDMALKEVFQGRENDENHPPLLDQPNARSVFFLFIIVVVAAVVARVAKFD

SEQ ID NO: 123334 - protein, 166 aa, Glycine max
  Coding DNA Sequence Number=SeqID_6556
MIKSLLYEILSSLRSASTEAASSSSVLPTISSTKSVSELLSEVAPESFFGEDTDGNDGHTDVQDKKLNGEGEDCCSYTSSNRESWGRCSSLGGSDEDLRADDTLTQVFATPMRSTKEKEKEDDKKHKKKKKKKKPKSERFEKLEALSRRLRLCLLKGSTHRRHKST

SEQ ID NO: 123335 - protein, 193 aa, Glycine max
  Coding DNA Sequence Number=SeqID_6557
  Gene Ontology: Mol. function=hydrolase activity; Biological process =aromatic compound metabolic process
  Homolog annotation: Hit_ID=UPI00005DC23F; Match level="QueryCoverage =81%, HitCoverage=31%, E-value=5e-64, Identity=72%"; Hit description =catalytic
MALLRQSITLISTCGKRNSPLQVEHTKGRIWRQLKNTRGYTLKCSHYLPSPFPEDTSLPCVIYCHGNSGCRADANEAAVILLPSNITVFTLDFSGSGLSDGDYVSLGWHEKDDLKMVVSYLRSNKQISCIGLWGRSMGAVTSLLYGAEDPSIAGMVLDSAFSNLYDLMMELVDVYKIRLPKFTVISLSLTFSL

SEQ ID NO: 123336 - protein, 103 aa, Glycine max
  Coding DNA Sequence Number=SeqID_6558
MVKVRKGKMWGKLRGTNSKSDEIPHPNCDIKAYGCSSPLTLFLNEAAKNGGKVNNFTGWKSGYELLPPKSKCLSEEEEEEEEEGDNDGNELKRSWFLFVVLRK

SEQ ID NO: 123337 - protein, 329 aa, Glycine max
  Coding DNA Sequence Number=SeqID_6559
  Gene Ontology: Mol. function=transporter activity; Cellular component= integral to membrane; Biological process=iron ion transport
  Homolog annotation: Hit_ID=Q9SAH8; Match level="QueryCoverage=98%, HitCoverage=49%, E-value=1e-109, Identity=65%"; Hit description =Metal transporter Nramp1
  Pfam annotation: Domain name=Nramp; Domain location=104-329; Score =109.4; E_value=1.1e-29; Accession=PF01566.9; Description=Natural resistance-associated macrophage protein
MTVTGSSSGQPQFIASTGGSRSFSNAPLIENSDTDQIVVPDVEIIVWDLDENCFMFEIKVYNFRVGCFILSLYANAKRTSWKNLFAYIGPGFLVSIAYIDPGNFETDLQSGAQYKYELLWIILVASCAALLIQTMAANLGVVTGMHLAEHCRAEYSRVPNFILWVIAEIAVVACDIPEVIGTAFALNMLFNIPVWIGVLLTGSSTLILLALQQYGVVFYILYSPLPHGYLTSFYDLNLNKSMIRKLEFFIAFLVFTIAGCFMAELGYAKPVAKEVVTGLFVPKLQGHGATGLAISLLGAMVMPHNLFLHSALVLSRKIPRSVRGIKVNT

SEQ ID NO: 123338 - protein, 366 aa, Glycine max
  Coding DNA Sequence Number=SeqID_6560
  Gene Ontology: Mol. function=sodium:hydrogen antiporter activity; Cellular component=integral to membrane; Biological process=sodium ion transport
  Homolog annotation: Hit_ID=Q8RWU6; Match level="QueryCoverage=92%, HitCoverage=92%, E-value=3e-72, Identity=62%"; Hit description =Sodium/hydrogen exchanger 6 (Na(+)/H(+) exchanger 6)
  Pfam annotation: Domain name=Na_H_Exchanger; Domain location=22-273; Score=-73.5; E_value=0.037; Accession=PF00999.11; Description =Sodiumhydrogen exchanger family
MEEDGTSKEQQQAAGVGILLQIMMLVLSFVLGHVLRRKKIYVLPEASASLLIGLLVGTLANISHTQTSISPAFSLASFWSFQKPFFANFGAIVTFAIFGTFLASIVTGVLVYLGGLMYLMYRLPFVECLMFGALISATDPVTVLSIFQELGTDVNLYALVFGESVLNDAVSFYCYKNNNNNPGEMAISLYRTMSVVKSHPSGQNFFMVIVRFLETFVGSMSSGLRGAMAFALALQSIHDLPEGHGQTILTATTAIVVLTVLLIGGSTGTMLEALEVVGSDSPVESPLASNFEGNNVYISPDDEEPSSGNKIKMKLQEFQRSAASFTAIDKNYLTPFFTSQNGDEEDEAVPLTLKNVGLDDHDHYSS

SEQ ID NO: 123339 - protein, 104 aa, Glycine max
  Coding DNA Sequence Number=SeqID_6561
MVAKVEAGLKCFNMNTNLVILLLLPPPSTLAFPQILSLFIALCGDSNALPPLLRCQILHDVNLGLKVTRLALRHEIRRQSLQVVGEVEPHDGGDIVLHLSRYIL

SEQ ID NO: 123340 - protein, 141 aa, Glycine max
  Coding DNA Sequence Number=SeqID_6562
  Gene Ontology: Mol. function=serine esterase activity; Biological process=metabolic process
  Homolog annotation: Hit_ID=Q010S2; Match level="QueryCoverage=90%, HitCoverage=48%, E-value=3e-17, Identity=30%"; Hit description=[R] KOG1516 Carboxylesterase and related proteins
MILSSSILHVAFSPSTWEVAYYYFFTSKVKRSIVYGDQPRNRLDLYLPANIGEPKPVLIFVTGGAWIIGYKAWGSLLGLQLAERGIIVACIDYRIYLMGQSADAHISSCALLEQAARESEKVESVPWSISQLKAYLGLSGG

SEQ ID NO: 123341 - protein, 89 aa, Glycine max
  Coding DNA Sequence Number=SeqID_6563
MQFRYGEESTSVDVHDNTMMVMRSCMCGASKVEVAHRMFRIRALCNTDDGGCGGAGHGGDGMRLWRSVKVVDGDNGCLTVVKGREELWF

SEQ ID NO: 123342 - protein, 233 aa, Glycine max
  Coding DNA Sequence Number=SeqID_6564
  Gene Ontology: Mol. function=nucleic acid binding
  Homolog annotation: Hit_ID=Q651K8; Match level="QueryCoverage=70%, HitCoverage=21%, E-value=1e-22, Identity=41%"; Hit description =Proline-rich spliceosome-associated protein-like
  Pfam annotation: Domain name=PSP; Domain location=1-36; Score=27.5; E_ value=4.6e-05; Accession=PF04046.7; Description=PSP
MQELDPPTWLNRMRELGYPPGYLDVDNEDQPSGITIFTDSEIADQEDGEIMEADASKPKRKKTVKFPGINAPIPEKADERLWGTRAGPSSSDISRNLSLPQHRSNYSTDYGSQGYHREHRLGDLRDDGPPGDPGHSSSMFSFHPRFGGHDSALRSPSMARSQSDRGRSPMHDEESSMPFSFHFLHYSSSERYFWPLDQDSGRLGSWTSESQTMVTTAVGGEDGTNRINHIGRF

SEQ ID NO: 123343 - protein, 50 aa, Glycine max
  Coding DNA Sequence Number=SeqID_6565
MGCDSFSVKFAYDGILNSQLEGTMEELFTQLWKVDAPPKTLHIVRRLFLP

SEQ ID NO: 123344 - protein, 99 aa, Glycine max
  Coding DNA Sequence Number=SeqID_6566
  Pfam annotation: Domain name=zf-BED; Domain location=2-33; Score=8.4; E_value=0.06; Accession=PF02892.5; Description=BED zinc finger
  Subcellular localization annotation: CTP_CleavageSite=31; ConfidenceScore=5.11e-01
PNPVSQAKCRHCGALVKYSNGTTVMRTHLDRCKKRSDIMSKRQKSDSSSTTITPSSSSMIDQEAWRARLKDASSKKGKYIGVATNVYSRKTLEKTKKTK

SEQ ID NO: 123345 - protein, 760 aa, Glycine max
  Coding DNA Sequence Number=SeqID_6567
  Subcellular localization annotation: CTP_CleavageSite=5; ConfidenceScore=5.11e-01
MFRISKMHAKGSNLGNSCKQTPGSSSSFVPNHPLQRDFDLRHQDYIMNQARFFFDWRKDPEISQCRNLIKNDISTILHSRHPNDQGQASVLANFLENRLFVEAASKDEYINRQTIMQRLDTQLKKLYAPKCSQVNSSIACTSQMVPSFGLLQARSNGSVPEPAFHNVAGPITNATNYCAVPVDNKNSFPNGGLSYSSFVPQPVFLPDNHPSIATCTDLDVLPNSFVSGGRSNLKACSKSISSYFPQRQADDWKTLLVKYGDCSRTTTGKSVQSESSNLMTPQDALREFSKVFDLPPVPRSLGDIRQHQHRKRDFQRNLKPFMQPYGLPGKTNMAQPNAFSNQGERCSQMLGHKTLKQPQLFKRSLNGDQQFTSGSSVDLFGLDDSDNMNSCGSSKVSVEQRIMLEYLYLKNFNNISRGNVMKYLHSTVCLKGTCNCGWYIKLLLHFDDCKDDGCRTCYSWKLHGTDILGGHLKFPDIMGSVERKNDAPSGNTEAMLPPEKRRKMEPAFGVPLINNASLDQSTQKMVHPRSSEALSELPLSQKADQEMEMSPNPTANSVHMEDNQGKIRLNQDEINATKEAIKPKVDEEKERKSPNPTLNTAYMEDIKGRIELDQDEINATKEIIEPKVDQEMERMSQNPTVTVDMEGIQAITGFNQDGINATKEVIEPKFDEEKERKSPNSIVNTADKEDTQGRTKFIQHGINVDLEMERKSSKTTVNTVSLIDFFTSNQIKEHITSLRKQFNQVSIPSSTVFHYLDMFQ

SEQ ID NO: 123346 - protein, 218 aa, Glycine max
  Coding DNA Sequence Number=SeqID_6568
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=95%, HitCoverage=12%, E-value=2e-53, Identity=50%"; Hit description=Zinc finger, TAZ-type; Zinc finger, ZZ-type; Transcriptional coactivation; Zinc finger, FYVE/PHD-type
  Pfam annotation: Domain name=DUF902; Domain location=1-55; Score =43.7; E_value=6.2e-10; Accession=PF06001.3; Description=Domain of Unknown Function (DUF902)
MVEESGSDVYTCQLCGMGTLSFAPVPIYCFCCGIRIKRNACYYYRREEDDTQHCFCSVCFRTSRGGNIKFNGTSVSKTDLDKKTNNREFEESHQICALYNDKRDLDYRAEYTCPICRLKEIGNGMHAPLPKTAAMFSANDLPRTMLSDHIESRLFKRLWQEDEDWAKAGYKNLDEVFEAESLSVRVVLSVDKQLKVKKQFLDIFGEENYPSEFPYTLK

SEQ ID NO: 123347 - protein, 402 aa, Glycine max
  Coding DNA Sequence Number=SeqID_6569
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=98%, HitCoverage=23%, E-value=1e-103, Identity=45%"; Hit description=Zinc finger, TAZ-type; Zinc finger, ZZ-type; Transcriptional coactivation; Zinc finger, FYVE/PHD-type
  Pfam annotation: Domain name=ZZ; Domain location=230-274; Score=3.6; E_value=0.083; Accession=PF00569.8; Description=Zinc finger, ZZ type
  Pfam annotation: Domain name=zf-RanBP; Domain location=245-269; Score= 9.6; E_value=0.072; Accession=PF00641.9; Description=Zn-finger in Ran binding protein and others
  Pfam annotation: Domain name=zf-TAZ; Domain location=289-373; Score =63.0; E_value=9.6e-16; Accession=PF02135.6; Description=TAZ zinc finger
  Pfam module annotation: Pfam domain module=ZZ::zf-RanBP::zf-TAZ; Domain location=230-274::245-269::289-373
YHSMLRKAAEENIVVGLTNLHDHFFVTTGSCDSKVTAARLPYFDGDFWSGAAMDKARHIEQECGGDYKMIFDKVVSKRCLKSMGHVNPPSEGTAKDILVMHKLGQTILPFKEDFLVVQFQYVCMHCHEVIANGKRWFCTECKKFQECERCHTVHSHISAKGERHRLHQVLMDDVLGDTKENDIILDNGLFDSRHNFLSFCQRNRFQFDSLRRAKYSSMMILYLVKNPTLLIVGTTCRVCSKNNVSQRYWKCENCPEFTVCSACYNERGASCHAHTLSEAYSPAQSPSGNQELQQNSAMLQQLLDVIEHASLCHSIKTQPCTYPHCSQIKKLFAHASRCEVRLSGGCQFCKKVWQGLTLHSRNCKDSACRIPRCMDLKKQIEWIATQAESRLRAAVLQSEDSR

SEQ ID NO: 123348 - protein, 78 aa, Glycine max
  Coding DNA Sequence Number=SeqID_6570
MAMRLWCRSKVDGSVMDSGERADISGVIGIREITDGRVLDPYCSSLTPKMVEAFIWTQYWLKGDPCQYLQMRNLRKVK

SEQ ID NO: 123349 - protein, 184 aa, Glycine max
  Coding DNA Sequence Number=SeqID_6571
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=65%, HitCoverage=30%, E-value=6e-50, Identity=74%"; Hit description =Ser/Thr protein kinase
  Pfam annotation: Domain name=Pkinase; Domain location=1-182; Score= -45.0; E_value=7e-06; Accession=PF00069.15; Description=Protein kinase domain
MKKVLASRTKIYIILKFTGGELFDIIILHGRLSEADSRRYFQQLIDGVDYCHRNIKISDYGLSAFPEQGASILRTTCGTTCGSPNYVAPKVLSHKGYNGAVADVWSCGVILFVLLTGYLPFDELYGIFPLKVETFTKVGQLEKASDAEQSIQVDGSNRGTGLSSPIPLPARPQRISTGRELFYQ

SEQ ID NO: 123350 - protein, 691 aa, Glycine max
  Coding DNA Sequence Number=SeqID_6572
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q2HSS5; Match level="QueryCoverage=87%, HitCoverage=97%, E-value=0.0, Identity=77%"; Hit description =Glycoside transferase, six-hairpin, subgroup
  Pfam annotation: Domain name=Glyco_hydro_9; Domain location=180-658; Score=775.1; E_value=4.2e-230; Accession=PF00759.9; Description =Glycosyl hydrolase family 9
MELNYIPKCFRDSLPVPNYWFNKCTASGWFSGRASWNAGISLYVSCNLARIGNSLCLDNNEERLEESFECGKMSMYGRDPWGGPLEIHATDSATDDERSRNLQELDRGALDETQQSWLLGAGEQKKNKKTYVDLGCIIVSRKLFIWTLGTLAVFAFLSAFITLIVKTVPRHHHKPPPPDNYTIALHKALLFFNAQKSGKLPRHNNVSWRGNSCLHDGKDDGVPPVIKDLVGGYYDAGDAIKFNFPMSFSLTMLSWSVIEYSGKYQAAGELGHVKDIIKWGTDYLLKNFNSTADTITQLGMQVGSGDTSQGSATPNDHYCWMRPEDIDYDRPTQTCTTCSDLAAEMAAALAAASIVFKDNRAYSQKLVHGATTLFKFSRDQRGRYSPNGKEASVFYNSTSYWDEFVWGGAWMYFATGNSSYLKLATTPRLAKHAGAFWGGPDYGVLSWDNKLTGAQVLLSRLRLFLSPGFPYEDILTTFHNQTGIVMCSYLPMFTSFNRTRGGLIQLNHGRPQPLQYVVNAAFLAALYSDYLDAADTPGWYCGPNFFSTDVLRDFAKTQIDYILGKNPRKMSYVVGFGNHYPKHVHHRGASIPKNKVKYNCKGGWKWRDSSKPNPHTIVGAMVAGPDKHDHFHDVRTNYNYTEPTLAGNAGLVAALVALSGDKTTGIDKNTLFSAVPPMFPTPPPPPAPWKP

SEQ ID NO: 123351 - protein, 220 aa, Glycine max
  Coding DNA Sequence Number=SeqID_6573
  Gene Ontology: Mol. function=protein binding
  Homolog annotation: Hit_ID=Q9ZVQ5; Match level="QueryCoverage=93%, HitCoverage=70%, E-value=3e-67, Identity=59%"; Hit description =Expressed protein
  Pfam annotation: Domain name=SNARE_assoc; Domain location=34-140; Score=81.9; E_value=2e-21; Accession=PF09335.1; Description=SNARE associated Golgi protein
VLYPIMEWEATAFGRPVLALVLVASLALFPVFLIPSGPSMWLAGMIFGYGLGFVIIMVGTTIGMQWLKRWPQNAALIRLAGEGNWSRQFQVVALFRVSPFPYTIFNYAVVVTNMRFWPYLCGSVAGMVPEAFIYIYSGRLIKTLADAQYGKHHLTTVEIVYNIISFIIAIVTTIAFTVYAKRTLNELKMAELNDEVTSVSVEMEKLPLERPKQLSLPKIS

SEQ ID NO: 123352 - protein, 684 aa, Glycine max
  Coding DNA Sequence Number=SeqID_6574
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=99%, HitCoverage=76%, E-value=0.0, Identity=57%"; Hit description=Protein kinase
  Pfam annotation: Domain name=LRR_1; Domain location=125-147; Score =6.8; E_value=15; Accession=PF00560.23; Description=Leucine Rich Repeat
  Pfam annotation: Domain name=LRR_1; Domain location=150-169; Score =6.0; E_value=22; Accession=PF00560.23; Description=Leucine Rich Repeat
  Pfam annotation: Domain name=LRR_1; Domain location=174-196; Score =14.1; E_value=0.49; Accession=PF00560.23; Description=Leucine Rich Repeat
  Pfam annotation: Domain name=LRR_1; Domain location=198-219; Score =14.9; E_value=0.3; Accession=PF00560.23; Description=Leucine Rich Repeat
  Pfam annotation: Domain name=LRR_1; Domain location=22-45; Score=4.1; E_value=49; Accession=PF00560.23; Description=Leucine Rich Repeat
  Pfam annotation: Domain name=LRR_1; Domain location=221-244; Score =10.4; E_value=3.3; Accession=PF00560.23; Description=Leucine Rich Repeat
  Pfam annotation: Domain name=LRR_1; Domain location=246-268; Score =8.3; E_value=7.9; Accession=PF00560.23; Description=Leucine Rich Repeat
  Pfam annotation: Domain name=LRR_1; Domain location=47-69; Score=9.4; E_value=5; Accession=PF00560.23; Description=Leucine Rich Repeat
  Pfam annotation: Domain name=LRR_1; Domain location=71-93; Score =12.8; E_value=1.1; Accession=PF00560.23; Description=Leucine Rich Repeat
  Pfam annotation: Domain name=LRR_1; Domain location=95-117; Score =10.3; E_value=3.4; Accession=PF00560.23; Description=Leucine Rich Repeat
  Pfam annotation: Domain name=Pkinase; Domain location=519-684; Score =5.3; E_value=7.1e-09; Accession=PF00069.15; Description=Protein kinase domain
  Pfam annotation: Domain name=Pkinase_Tyr; Domain location=519-684; Score=9.7; E_value=4.6e-13; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=125-147::150-169::174-196::198-219::22-45::221 -244::246-268::47-69::...
  Pfam module annotation: Domain location=71-93::95-117::519-684::519 -684
MQKGMFGRNSCDIAQTSDDKHFVWTMDLSYNKDLTGPLPESIGELKKLATLILVGCSFKGPIPDSIGNMQELLFLSLNSNSFSGPIPHSIGNLSKLYWLDLADNQLQGNIPVSSGDISGLDKLHHAKHFHLGKNNLSGSIPPQLFSSEMALIHVLLESNQLTDKIPPTLGLVQSLEVVRLDGNSLNGPVPPNINNLTHVQDLYLSNNKLSGSLPNLTGMNALSYLDMSNNSFKPLDFPGWFSTLKSLTTLKMERTQLQGQVPTSLFTLINLQIVNQLRLVDFETNSIDSFEQKDEVPNVKIKIILKDNPICQENGELESYCSSSQPNVSYSTPLNNCQPGTCSSEQILSPNCICAYPYSGTLTFRSPPFLDFDNKTYYSMLEEGLMNSFKSHFLPVDSVLLSHPSKDSTQYLELSLQVFPSGQNHFNRTGAFSIGFLLSNQTFKPPKVFGPFYFVGDKYEHFENSEGLTESSKSSNIGIIIGAAVGGRWDTASSKSEVPQLTEARMFSFEELKKYTKNFSQVNGIGSGGFGKVYKGNLPNGQVIAIKRAQKESMQGKLEFKAEIELLSRVHHKNLVSLVGFCFEHEEQMLVYEYVQNGSLKDALSGKSGIRLDWIRRLKIALGTARGLAYLHELVNPPIIHRDIKSNNILLDDRLNAKVSDFGLSKSMVDSEKDHVTTQVKGTM

SEQ ID NO: 123353 - protein, 75 aa, Glycine max
  Coding DNA Sequence Number=SeqID_6575
  Gene Ontology: Mol. function=catalytic activity; Biological process =cellular metabolic process
  Homolog annotation: Hit_ID=Q7Y0H8; Match level="QueryCoverage=94%, HitCoverage=29%, E-value=2e-19, Identity=53%"; Hit description =Cinnamoyl CoA reductase
MPTDTSSVSGGEIVCVTGAGDDPKNGHLKELEGGKERLTLHKVDLFDIDSIKEALNGCHGVFHTASPVTDNPFRV

SEQ ID NO: 123354 - protein, 136 aa, Glycine max
  Coding DNA Sequence Number=SeqID_6576
MLSFNDWGRNGGQRLKLCLKLQWRMKKKKATNFQDVTGFGCYRTPTKEDCAAVWCAVNYIDGLYVRLSQPGDPLRHPPVVHDDTYVEPDIPQYPMAMTAIEEAPADAPSHVEQPRHAVVDTVVEPKDSNRRYKSVQ

SEQ ID NO: 123355 - protein, 629 aa, Glycine max
  Coding DNA Sequence Number=SeqID_6577
  Homolog annotation: Hit_ID=Q6KAC4; Match level="QueryCoverage=96%, HitCoverage=97%, E-value=1e-137, Identity=43%"; Hit description =Putative X1
  Pfam annotation: Domain name=XH; Domain location=494-628; Score =241.9; E_value=1.4e-69; Accession=PF03469.5; Description=XH domain
  Pfam annotation: Domain name=XS; Domain location=114-222; Score =130.1; E_value=6.3e-36; Accession=PF03468.5; Description=XS domain
  Pfam annotation: Domain name=zf-XS; Domain location=43-85; Score =96.9; E_value=6.1e-26; Accession=PF03470.5; Description=XS zinc finger domain
  Pfam module annotation: Pfam domain module=XH::XS::zf-XS; Domain location=494-628::114-222::43-85
MDYSSEEDSDISESEIEEYAEKPYEQLRAGKYKVKNLNGTLRCPYCAGKKKQEFKYKDLLQHASGVGKGSANRSAQQKANHLALAKYLETDLASEAESIQRPAPPQAVNQPLLQEDLYVWPWTGIIVNIKGKSIDSGYWLKEFAKFRPIDFRIFLKDDDLIAEAVVDFNNDWNGFMNASEFEKSFEAARHGKKDWNSRKLEAGSNIYGWVAREDDYNCGGPIGEYLRNKGRLRTVSDIVQEASVSRNNIVTNLTNEIEITNENLDKMQYKFNEKTMSLSRMLEEKDKLHNAFEEESRNMQRRARNEVRRILDEQEKLSSELEEKKRKLDSWSRDLNKREALTDQEKKKLDEDKKKKDLRNESLQLASKEQKIADENVLRLVEEQKREKEEAYNKILQLEKQLDAKQKLEMEIEELKGKLQVMKHLGDEDDAAVQNKIKEMNDELQEKVDNLENMEAMNQTLIVKERQSNDELQEARKELINGLDDMLNGPRTNIGLKRMGELDQKIFVNNCKKRFPLEEAGTKGVELCSLWQENVKNSAWHPFKVVTVDDKPENIINEEDEKLRSLKQEWGDEIYSAVVTALKEINEYNASGGYTVKELWNFKEKRKATLKEVINYIMDHIKPLKRKRA

SEQ ID NO: 123356 - protein, 294 aa, Glycine max
  Coding DNA Sequence Number=SeqID_6578
  Gene Ontology: Mol. function=3'-5' exonuclease activity; Cellular component=intracellular; Biological process=translation
  Homolog annotation: Hit_ID=Q75LE1; Match level="QueryCoverage=87%, HitCoverage=86%, E-value=3e-79, Identity=58%"; Hit description =Expressed protein
  Pfam annotation: Domain name=DUF901; Domain location=109-288; Score =251.8; E_value=1.5e-72; Accession=PF05991.2; Description=Protein of unknown function (DUF901)
  Subcellular localization annotation: CTP_CleavageSite=69; ConfidenceScore=5.39e-01
MKLKAVPWWHNWLVVKAGSSHSSLMVRKKQTQDSESTPPRITSNVKQNLRFLKLWKSFQNRNSSTPRPSTSYRKKKVEKEDDVVDTDLYRDPTTSLYYTNQQGILDNAVPVLLVDGYNVCGYWMKLKKHFVKGRLDIARQKLIDELLTFSMLREVKIVVVFDAMMSGLPTHKEDFAGLDIIFSGETCADTWIEKEVAALKEDGCPKVWVVTSDHCHQQAAHGAFYTAADFQGAFIWSCKALVTEIKASQKEVERMLQEQRSTSFQGRLLKHNLDAEVVDALKDLRQKLSENELK

SEQ ID NO: 123357 - protein, 169 aa, Glycine max
  Coding DNA Sequence Number=SeqID_6579
  Gene Ontology: Mol. function=zinc ion binding; Cellular component =intracellular; Biological process=regulation of transcription, DNA -dependent
  Homolog annotation: Hit_ID=Q9ZTK7; Match level="QueryCoverage=88%, HitCoverage=49%, E-value=2e-37, Identity=54%"; Hit description =CONSTANS-like protein 2
  Pfam annotation: Domain name=zf-B_box; Domain location=32-79; Score =45.3; E_value=2e-10; Accession=PF00643.14; Description=B-box zinc finger
MAQPIQSMRVMRVTLGPYSKVHAANKLELRHPRVAFCEVCEQASAHVTCKADAAALCLACDRDIHSANPLASCHERIPVTSFFESVHSVKASSPINFHHPFFSDVDADVSTEEAEAASWLLANPKTYLNSSQYLFSKTESVPYVDLDYTAMDSKTEQKSSATADGVIPV

SEQ ID NO: 123358 - protein, 69 aa, Glycine max
  Coding DNA Sequence Number=SeqID_6580
  Gene Ontology: Mol. function=nucleic acid binding
  Homolog annotation: Hit_ID=Q1SU57; Match level="QueryCoverage=82%, HitCoverage=28%, E-value=2e-11, Identity=53%"; Hit description=Zinc finger, CCHC-type
  Pfam annotation: Domain name=zf-CCHC; Domain location=32-49; Score =20.4; E_value=0.00042; Accession=PF00098.13; Description=Zinc knuckle
MVWVEVDLRKPVVVKVIVHMHWYHFEYESLHLPCTSCGHYGHRSKDCPKKPPQMSTKVNPSINLKVTID

SEQ ID NO: 123359 - protein, 434 aa, Glycine max
  Coding DNA Sequence Number=SeqID_6581
MASTFPIGKVTKMLIAGQSTRTNGGERTNGDASSKDGAKTQNPNSNERDINQQRIKEGKIFTGIGLMEKGERQKWTRPKVNGNASKVPEVPKMTMTCNLPTHGLATYGKDTKLLYPNSHANEVCGHPRRSKLMKFESRDGRGGEHGRGNPIGGFANKKSFQHMRKLISKYHLDIRLIKVVTLTRHYESFSLKEKGFMDDMFGRLQVLLTGLKALGYTYTKAQINLKVLNSFSKVWEPKTITILKAKDLKDSSRMNFWIDKSTKEEKKNSFKSLKVQMIEFNVSNNNSGGSTDNEVMPYDVLLQNCHMISLQCKKYKERNKTSIFENTKLKKSDEDLEKKINALEESLSQASLSGLGLEEETSSSESQSDPDKYDFCGKSGHSKFICIHKKKQMSKDNGCSRHMTEERSMFLNLKPVEGGVGSFGGMGKGKITDI

SEQ ID NO: 123360 - protein, 109 aa, Glycine max
  Coding DNA Sequence Number=SeqID_6582
  Gene Ontology: Mol. function=tetrahydrofolylpolyglutamate synthase activity; Biological process=folic acid and derivative biosynthetic process
  Homolog annotation: Hit_ID=Q8W040; Match level="QueryCoverage=72%, HitCoverage=14%, E-value=9e-20, Identity=58%"; Hit description =Dihydrofolate synthetase /folylpolyglutamate synthetase
MECTEGWSFCCSTKQGDLSACMKQHTLPKKFIKGLTTTSLQGRAQIVPDQFINDEIPNELVFFLDGAHSPESMEACTKWFSLAIKDEDQILFHQKPDNSNFSSSEDAQL

SEQ ID NO: 123361 - protein, 674 aa, Glycine max
  Coding DNA Sequence Number=SeqID_6583
  Gene Ontology: Mol. function=alpha-glucan, water dikinase activity; Cellular component=chloroplast; Biological process=carbohydrate metabolic process
  Homolog annotation: Hit_ID=Q8LPT9; Match level="QueryCoverage=96%, HitCoverage=42%, E-value=0.0, Identity=62%"; Hit description=Alpha -glucan water dikinase, chloroplast precursor
MEQLSGKFNLDGNIELQIAVSSSEPGAARQVDFKVSYNSESLLLHWGVVRDQPGKWVLPSRHPDGTKNYKSRALRTPFVKSDSGSFLKIEIDDPAAQAIEFLILDEAKNKWFKNNGENFHIKLPVKSKLSQEVSVPEDLVQIQAYLRWERKGKQMYTPEQEKEEYEAARNELLEEVARGTSVQDLHARLTKKTKAAEVKEPSVSETKTIPDELVQIQAFIRWEKAGKPNYSREQQLMEFEEARKELLEELEKGASLDAIRKKIVKGEIQTKVAKQLKTKKYFRAERIQRKKRDLMQLINRNVAQNIVEQVIDAPKALTVIEHYANAREEYESGPVLNKTIYKLGDNYLLVLVTKDAGKIKVHLATDSKKPFTLHWALSRTSEEWLVPPETALPPGSVTMNEAAETPFKAGSSSHPSYEVQSLDIEVDDDTFKGIPFVILSDGEWIKNNGSNFYIEFGGKKQKQKDFGNGKGTAKFLLNKIAEMESEAQKSFMHRVCTDSYSLKRQTELPVPPATNALFYVCVTCIFNIASDLIDEAKNAGQLGLAGILVWMRFMATRQLIWNKNYNVKPREISKAQDRLTDLLQDVYANYPQYREIVRMILSTVGRGGEGDVGQRIRDEILVIQRNNDCKGGMMEEWHQKLHNNTSPDDVVICQASFSSITDLCLKLVIESSQC

SEQ ID NO: 123362 - protein, 337 aa, Glycine max
  Coding DNA Sequence Number=SeqID_6584
  Gene Ontology: Mol. function=nucleic acid binding; Biological process= DNA integration
  Homolog annotation: Hit_ID=Q1S7C5; Match level="QueryCoverage=93%, HitCoverage=25%, E-value=4e-26, Identity=31%"; Hit description =Integrase, catalytic region
  Pfam annotation: Domain name=zf-CCHC; Domain location=186-203; Score =10.1; E_value=0.022; Accession=PF00098.13; Description=Zinc knuckle
MQFLSVSDLDAGIENPLYRTWELQYQLRNSKKGDKSVFEFLLLIKVIVDALYSIRHPVSEHEQLDVILEGLPSEYELLVLLMTTKPDLFSFSKIGSLLVAQEARIERNKQTEIVSLNLTQATASKQPDASSSSVVQYTQSKLNSANSCHNQSYNNYQCGDYGFCGCGGGQRGGCRHRGAHGGNSNVQCQVCSKFGHIAAYCHYRFDSSCMPQQNIYQPNQFATGHQQFPNSPATYTAPPGFHLQRNYTQFGPPQSQAHQITYIAPTLSTVAAPSMTQYSVASMTYQTSFPLEYLAHDRPKTGLWTRMLLTMSPLMVKISRILLQSKGMKIFSLQMVK

SEQ ID NO: 123363 - protein, 580 aa, Glycine max
  Coding DNA Sequence Number=SeqID_6585
  Gene Ontology: Mol. function=alpha-glucan, water dikinase activity; Cellular component=chloroplast; Biological process=carbohydrate metabolic process
  Homolog annotation: Hit_ID=Q9SAC6; Match level="QueryCoverage=62%, HitCoverage=25%, E-value=1e-172, Identity=83%"; Hit description =Alpha-glucan water dikinase 1, chloroplast precursor
  Subcellular localization annotation: CTP_CleavageSite=88; ConfidenceScore=5.41e-01
MLLLNLFRLNRFPLLSLSSESNQSNSASELSSPVPKSCHVTVPEQTQSVSEQLSSSVHPMQTSSKSGIVKPKLHPTLLFTTAEPSTVKQALISPPWRQAMQADFDALMENKTLTLTSLPSGKAAIDSLTNHWPLQQVDINNAFLHGLLTEEVYMVQLPGFETIDSTLVCKLQKAIYGLKQATRACDFDIGVYWKALNDNGITKERLLSYDRAIHSEPNFRRDQKEGLLRDLGNYMRTLKAVHSGADLESAISNCMGYKSEGQGFMVGVKINPVPGLPTGFPELLEFVMEHVEEKNVEPLLEGLLEARQELQPSLSKSQSRLKDLIFLDVALDSTVRTAVERSYEELNNAGPEKIMYFISLVLENLALSSDDNEDLIYCLKGWDVALSMCKIKDTHWALYAKSVLDRTRLALTNKAHLYQEILQPSAEYLGSLLGVDKWAVEIFTEEIIRAGSAASLSTLLNRLDPVLRKTAHLGSWQVISPVETVGYVEVVDELLTVQNKSYERPTILIANSVKGEEEIPDGTVAVLTPDMPDVLSHVSVRARNSKLIQNFIIIEVSIQSVKFCEFVRVDNVNKRVFGEI

SEQ ID NO: 123364 - protein, 390 aa, Glycine max
  Coding DNA Sequence Number=SeqID_6586
  Gene Ontology: Mol. function=translation initiation factor activity; Cellular component=eukaryotic translation initiation factor 2B complex; Biological process=cellular metabolic process
  Homolog annotation: Hit_ID=Q9FFV8; Match level="QueryCoverage=91%, HitCoverage=54%, E-value=1e-147, Identity=81%"; Hit description =Similarity to guanine nucleotide exchange factor
  Pfam annotation: Domain name=IF-2B; Domain location=129-377; Score =187.4; E_value=3.4e-53; Accession=PF01008.8; Description=Initiation factor 2 subunit family
MSLGEGSKASGTVATMNAKPAKAVKPAQKVDNAAVAASEKKGGEIPPEKDRKKDAPQPRMQYDDKSRVEKAKRRAVVKQTEARNRVELFRHLPQYEHGSQLPDLEAKFFHLSPVHPSVYKVGLQYLTGDIAGGNARCIAMLQAFQEAIKDYKVPHEKTLVRDLTAKISSYVSFLIECRPLSISMGNAIRFLKSHIAKLPLTLSESEAKASLQSDIERFISEKIILANKVIVKHAVTKIRDGDVLLTYGSSSAVEMILLHAHELGKQFRVVVVDSRPKLRGQLLLRRLVEKGLSCTYTHINAVSYIMHEVTRVFLGASAVLSNGTVYSRVGTACVAMVAHAFRVPVILYKMRILFTLPGRFLHCVSKKVDVSMMFLQAIQMSFQMYWVERM

SEQ ID NO: 123365 - protein, 96 aa, Glycine max
  Coding DNA Sequence Number=SeqID_6587
MVHLLWISSSGGYIHLVVQREQGRVHPLWIFACKGFYKVEKKSQGPQVSWGLDTTTRHPRLPNTGMLLVKRYLRERCIHLMRKAIPRETRVTLLNI

SEQ ID NO: 123366 - protein, 182 aa, Glycine max
  Coding DNA Sequence Number=SeqID_6588
MDPSRRAPRAVIDPIPKIRQVGFFAPPERSQSGPPDPTHSSPPISSSLSPVMIPPPRHLSDNLLLHAPRPASSPLSAAAAAGGSGNSFDYGAVFFPAPLSPAIPSSSYSSRIIATTGEGGFFKGNGAGGGKVAASSFPRGGFDLTAMKKAAAASVVVPASELTTVSVVNDSLGIPGEVLING

SEQ ID NO: 123367 - protein, 79 aa, Glycine max
  Coding DNA Sequence Number=SeqID_6589
MELEIYPKPHENPRVFSCIFGLIFLESSIQCTWGFLPKTYETKCWKKGNETNGLKLWMVPRQCEIMDDLVQEERLRERG

SEQ ID NO: 123368 - protein, 87 aa, Glycine max
  Coding DNA Sequence Number=SeqID_6590
MAQPPPRERTLREMAAPDFTYESLCIQYPDEDVPYVRKTRLIHLLPKFHGLAEGVAKDWLYYLAPRSITSWDDLKRDHDHQKGYFRH

SEQ ID NO: 123369 - protein, 400 aa, Glycine max
  Coding DNA Sequence Number=SeqID_6591
  Gene Ontology: Mol. function=DNA binding; Cellular component=nucleus; Biological process=regulation of transcription
  Homolog annotation: Hit_ID=Q9ZVP8; Match level="QueryCoverage=96%, HitCoverage=91%, E-value=5e-92, Identity=48%"; Hit description=NAM (No apical meristem)-like protein
  Pfam annotation: Domain name=NAM; Domain location=42-169; Score =293.2; E_value=5.1e-85; Accession=PF02365.6; Description=No apical meristem (NAM) protein
MAIAAANSSPTMSLSHSQSQEDATTNDNKPVVVDDDHEHDMVMPGFRFHPTEEELVEFYLRRKVEGKRFNVELITFLDLYRYDPWELPALAAIGEKEWYFYVPRDRKYRNGDRPNRVTTSGYWKATGADRMIRTENFRSIGLKKTLVFYSGKAPKGIRTSWIMNEYRLPQHETERYQKAEISLCRVYKRAGVEDHPSLPRCLPTRPSSSSRASSDHINNNKSTKHNEMVQHHNINMGFMGQSKPPTTEHIVDKINESEASSDVNTTLGLSKYNAYRAATMALPVVPMDEEALMMMQQSKQAAAAAAHVPTIFSAGPSSSNNSGVVNMDDLNRLMSYQHQYYNVQSQSHPNQFSTLLMQPSPIVSLSSLPNPLPPTFSDRLWDWNPIPESPSQEYSNISFK

SEQ ID NO: 123370 - protein, 324 aa, Glycine max
  Coding DNA Sequence Number=SeqID_6592
  Gene Ontology: Mol. function=GTP binding; Cellular component =intracellular; Biological process=small GTPase mediated signal transduction
  Homolog annotation: Hit_ID=Q9FLE0; Match level="QueryCoverage=90%, HitCoverage=61%, E-value=1e-108, Identity=66%"; Hit description=GTP -binding protein-like
  Pfam annotation: Domain name=ATP_bind_1; Domain location=47-228; Score=-55.8; E_value=0.0051; Accession=PF03029.7; Description =Conserved hypothetical ATP binding prot
  Pfam annotation: Domain name=Dynamin_N; Domain location=45-170; Score= -44.8; E_value=0.073; Accession=PF00350.13; Description=Dynamin family
  Pfam annotation: Domain name=GTP_EFTU; Domain location=40-229; Score=- 59.6; E_value=0.0063; Accession=PF00009.17; Description=Elongation factor Tu GTP binding domain
  Pfam annotation: Domain name=MMR_HSR1; Domain location=43-170; Score =122.3; E_value=1.4e-33; Accession=PF01926.13; Description=GTPase of unknown function
  Pfam annotation: Domain name=Miro; Domain location=44-170; Score= -8.8; E_value=0.039; Accession=PF08477.3; Description=Miro-like protein
  Pfam module annotation: Pfam domain module=ATP_bind_1::Dynamin_N::GTP_ EFTU::MMR_HSR1::Miro; Domain location=47-228::45-170::40-229::43 -170::44-170
MSLKPLLEDYMLRVFTEEGARENSHNEVEDSSDLDVDKSKLPLQLAIVGRPNVGKSTLLNALLQEDRVLVGPEAGLTRDSIRTQFEFQGRTIYLVDTAGWLQRTKQEKGAASLSIMQSRKSLLRAHIIALVLDAEEIINARRSMKHAEVVIARRAVEEGRGLVVIVNKMDLLRGKHKSSSYEKVMEVVPQEIQTIIPQVTGIPVVFISALEGRGRTTVLNQVMSRHSWKDQAAQPKVKYFTQVKARPPTFVAFVRGKTQLSDTDIRFLTKSLKEDFDLGGIPIRIMQRSVTKKDASGSGNSKNSHSVCRVVERTVSDKRSIVDE

SEQ ID NO: 123371 - protein, 115 aa, Glycine max
  Coding DNA Sequence Number=SeqID_6593
MPLKGVGHNVPTNLGRVKGDPGASSLTQSNPKIGSNNGNEMTKEKYKPYLKHIVNGSSFTNGIVVVNVGPPKIRSNKVFVKTNYMEIEKVFVPTSNRELLAHMIASKEIDSGPKI

SEQ ID NO: 123372 - protein, 210 aa, Glycine max
  Coding DNA Sequence Number=SeqID_6594
MAPIRPRPYVQPPPTAPINLNVNVRLFPGFRGHIVLEWQTCNKVWKEKGEVGSHILHPKMSQFSYVVTSNTQFAIAVDKLVLYQKAKCDKCKELLIEEDEDAPSTRYVNARPRRLFKHEFEALKMKTKHTSLVWFTMRRFYRLKAYCPVVEPNGKPSTYGVHHQIGSCYQTLNHLCFTKDTPFNMIYSWTREFNIVFDYNFTFGLGSYVM

SEQ ID NO: 123373 - protein, 350 aa, Glycine max
  Coding DNA Sequence Number=SeqID_6595
  Gene Ontology: Mol. function=zinc ion binding; Cellular component =integral to membrane
  Homolog annotation: Hit_ID=Q06A75; Match level="QueryCoverage=100%, HitCoverage=98%, E-value=2e-61, Identity=70%"; Hit description=PHD5
  Pfam annotation: Domain name=C1_3; Domain location=298-328; Score =8.2; E_value=0.055; Accession=PF07649.3; Description=C1-like domain
  Pfam annotation: Domain name=PHD; Domain location=299-349; Score =56.1; E_value=1.1e-13; Accession=PF00628.19; Description=PHD-finger
  Pfam module annotation: Pfam domain module=C1_3::PHD; Domain location= 298-328::299-349
MEGVPHPIPRTVEEVFTDFKGRRAGLIKALTTDVEKFYQQCDPEKENLCLYGFPNETWEVNLPVEEVPPELPEPALGINFARDGMQEKDWLSLVAVHSDSWLLAVAFYFGARFGFGKNERKGIWERLEENIDLSLEIWEFMLISTMAEHRLAVGAWACWWYTWTVETIMCKVGLQLSQIGFLVVTEKEEVEDFNKSAMVRVQSGFGFWLWRSDYCHDESGRKRLFQMINDLPTIFELVTGSAKQLKDQPAAHNNGSKCKSSGKVSHQSESQAKGMKMSAPPKEEDESGEEEEDDEQGATCGACGDNYGTDEFWICCDMCERWFHGKCVKITPAKAEHIKQYKCPSCSNKR

SEQ ID NO: 123374 - protein, 162 aa, Glycine max
  Coding DNA Sequence Number=SeqID_6596
MLVLTITLIPTPKTKVGETTQICLGRSKKIKGKVRVKAKMCTSLLTCKRPRKEEKRHTMQDMMMEHMTKSDERELKVLCPPKLSPTLRRIRRWFIVYPKGIEDVLVKVNKFIFLDDFVVFDIEVDEDVPIILGHPFLNTYDIVIEVKQGRLTLRMVDEQVVH

SEQ ID NO: 123375 - protein, 78 aa, Glycine max
  Coding DNA Sequence Number=SeqID_6597
MGRLGEEREKLVAVNACDSGWQRPTGSSSSSQATGITNQIGNVPCLLVAMLLSFGGLGTRTMTYIVTMPKKKFINNFE

SEQ ID NO: 123376 - protein, 64 aa, Glycine max
  Coding DNA Sequence Number=SeqID_6598
  Subcellular localization annotation: CTP_CleavageSite=48; ConfidenceScore=5.17e-01
MYINNSNTVNKTHKTSSSTSSSAYLDQTAEIKRNYKRTSSHCKSNGKRLTHLKDSFVLPDPYSL

SEQ ID NO: 123377 - protein, 1234 aa, Glycine max
  Coding DNA Sequence Number=SeqID_6599
  Gene Ontology: Mol. function=DNA-directed DNA polymerase activity; Cellular component=DNA polymerase III complex; Biological process =DNA replication
  Homolog annotation: Hit_ID=Q2QW40; Match level="QueryCoverage=77%, HitCoverage=81%, E-value=0.0, Identity=46%"; Hit description=ATPase, AAA family protein, expressed
  Pfam annotation: Domain name=AAA; Domain location=486-678; Score =21.6; E_value=4.9e-06; Accession=PF00004.19; Description=ATPase family associated with various cellular activities (AAA)
  Pfam annotation: Domain name=DNA_pol3_delta; Domain location=529-798; Score=-70.6; E_value=0.0061; Accession=PF06144.3; Description=DNA polymerase III, delta subunit
  Pfam module annotation: Pfam domain module=AAA::DNA_pol3_delta; Domain location=486-678::529-798
MSEMRVSELHLKKELTQIRKAARVLRDPGTTSSWKSPLSSSRSVAAWNKDTASRRFTTPNDKDKDKDKRVFLYNWKNYKSSSEKYNDEEEEEDDDDDGSSSLLGDRDRDSLSDARNGCDSKSDTYLAAADGGGGARSSIFRCGDANLVSRRAVPVKKKSKKNNPHFDFLAKYQHHRPGKKFVSSSKALLEGHPSPFFNRDDSVEHSDDDTEDYTNSEGVRPISGTSPLLLKLRQKNWSRSSSKFLRRSRKEDSSYSYSTPALSTSSYNRYGHRYPSTLGSWDGTTTSVNDGDGDDEIDDHLDLPGRQGCGIPCYWSKRTPKHRGMCGSCYSPSLSDTLRRKGSSMLCGSQTIYPRHRRSASASHKRRLSLRSARGVIPLLTNSGDVREGSSVGTGRSDDELSTNFGELDLEGLSRLDGRRWSSSCRSQEGLEIVALNGEGEYDGTPENNRSFSQKYRPMFFGELIGQNVVVQSLISAVSRGRIAPVYLFQGPRGTGKTSTARIFAAALNCASPNESKPCGYCRECVDFISGKSSDLLEVDGTNKRGIDKARYLLKRLSTGSSSASPQYTIFVIDECHLLPSKTWLGFLKFLEEPPQRVVFIFITSDLDNVPRTIQSRCQKYLFNKIKDGDIVTRLRKISTQENLDVEADALDLIAMNADGSLRDAETMLEQLSLLGKRITTSLVNELVGVVSDEKLLELLELAMSSDTVETVKRARELMDSGVDPMVLMSQLAGLIMDIIAGSYAVIDTKPDDSFFGGRSLNQSELERLKNALKLLSEAEKQLRTSSERSTWFTATLLQLGSTPSPDLTQSSSSRRQSCKTTEDDPSSVSRDVTSCMHKSDPQYVPRKSAYTASQQKAVNESSHHQKDISSKIEGLKSKPSNGPVIDDGSTVVSSDDLMVENRMFRCIDSGKLCDIWVHCIERCHSKTLRQLLHNHGKLVSVCEVEGVLVAYVAFGDADIKVRVERFLRSITNSMEMVLRRNVEVRIIHLPDGEGENQVNLLGLKQAESTVAGEKEERKGHMNRTESYSSFPPLLDGNLQSTNASSDILAEGNGVKERRQDNPMQRIESIIREQRLETAWLQAVEKGSPGSLSRLRPEENQVLLQNAVDPMESMDSTRFPSHQHWEDELNNEVKVLSLKNGRVPQKDQIGRKADRYPMSPSLLHDNSLATISGKDNLGYESGSGAGGCGFLCWNKSKPRRVVKVKGGTPVRARRAATFTLFGDCTKPKKRERRR

SEQ ID NO: 123378 - protein, 561 aa, Glycine max
  Coding DNA Sequence Number=SeqID_6600
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98204; Match level="QueryCoverage=99%, HitCoverage=46%, E-value=0.0, Identity=65%"; Hit description =Phospholipid-transporting ATPase 1
MTVILGYSNNSVKLFVKGADTSMFSVIDKSLNSDILQATETHLHSYSSVGLRTLVIGMRDLNASEFEQWHSAFEAASTALIGRASMLRKVAINVENNLCILGATAIEDKLQQGVPESIESLRTAGIKVWVLTGDKQQTAISIGCSSKLLTSNMTQIIINTNNRESCRRCLQDALVMSRKHMTVPGVTHNSEGRSDAVSTPLALIIDGTSLVYILDSELEEELFQLANRCSVVLCCRVAPLQKAGIVALVKNRTDDMTLAIGDGANDVSMIQMAHVGVGISGQEGRQAVMASDFAIGQFRLLVPLLLIHGHWNYQRLGYMIIYNFYRNAIFVLVLFWYVLFTAFSLTTAINEWSSVLYSIIYSAVPTIVVGVLDKDLSKRTLLKHPQLYGAGLRQEAYNKKLFWLSMADTLWQSIAVFFTPLIAYWGTTEDVASIGDLWTLSVVILVNLHLAMDVIRWNWITHAAIWGSIVATFICIIIIDAIPAFPGFWAIFHAAGTGLFWLCLLGTVIAALLPRLVVKYMNQYYFPSDIQISREAEKFGNPRDNGVGQIEMLPVSDGSPR

SEQ ID NO: 123379 - protein, 239 aa, Glycine max
  Coding DNA Sequence Number=SeqID_6601
  Gene Ontology: Mol. function=protein phosphatase type 2A regulator activity; Cellular component=protein phosphatase type 2A complex; Biological process=signal transduction
  Homolog annotation: Hit_ID=Q1SHY8; Match level="QueryCoverage=75%, HitCoverage=27%, E-value=2e-60, Identity=63%"; Hit description=WD40 -like
LLLLTGLPKSGCQMSSSFTSSGKHIISVGEDSHVYIWNFDDMGNASSKQTKSERSCEYFFSKGVTVAIPRSGMKADKRDSSGNYSHHSSEMPTQQLEVASEARDHKRFSLGNWFAIDGTCRGSMTWPEEKLPSWDLPITEDEYGHQQLCYKDNCHGRNVSETWGLSIVAAGCDGTIKTFHNFGLPALPGKGGNLQRCVMALESNVSGSKCGKTEFEAFASAYMMIIAKSMLSLKALEMF

SEQ ID NO: 123380 - protein, 283 aa, Glycine max
  Coding DNA Sequence Number=SeqID_6602
  Gene Ontology: Mol. function=DNA binding; Cellular component=nucleus; Biological process=regulation of transcription
  Homolog annotation: Hit_ID=Q4F944; Match level="QueryCoverage=73%, HitCoverage=61%, E-value=2e-49, Identity=49%"; Hit description=Zinc finger homeodomain protein 1
  Pfam annotation: Domain name=ZF-HD_dimer; Domain location=64-123; Score=137.3; E_value=4.3e-38; Accession=PF04770.3; Description=ZF-HD protein dimerisation region
MELSSQEGEIPIPINSSTTYGHGNGHGHGLMIHHDHNHIISSTAPSNGIPTMQQEEDHGLGSYKKVVRYRECLKNHAAAMGGNATDGCGEFMPSGEEGTIEALNCSACHCHRNFHRKEVEGEPSCDYHHLNINRRRHILGPHKNLLPPEALGYPTAARSVPPHQMIMPYNIGGIGHHLPSESDEQEDGGGGGGMVQLSSRPISSQQQLVKKRFRTKFSQEQKDKMLNFAEKVGWKIQKQEESVVQQFCQEIGVKRRVLKVWMHNNKHNLAKKNPPTTAAPPPP

SEQ ID NO: 123381 - protein, 47 aa, Glycine max
  Coding DNA Sequence Number=SeqID_6603
MDYGMFEPKRIVSQAISTTIRQKFLHPWPTWVVMKDHERMPSSNALR

SEQ ID NO: 123382 - protein, 193 aa, Glycine max
  Coding DNA Sequence Number=SeqID_6604
SEFLIGGYVGARASLLSTIPAFVAMTQELVARGDTLRLSAPRHSVTPSVIDEKRPKTKFGHSAPMIRGDTLWLFAPFCHPEAAGPMTSRDQVWSFCTHDTRRFLMVIRTLLSSRGGGPDDKQRPKTKFGHSAPMIRGDTLWLFAPFCHPEAAGPMTSRDQVWSFCTHDTRRYLMVIRTLLSSRGGGPDDKQRP

SEQ ID NO: 123383 - protein, 90 aa, Glycine max
  Coding DNA Sequence Number=SeqID_6605
MVVQLGNPLAPFLYTIVAECLSVLTTEAVNFYKSKIGVFGMEESVMKRYVELLNCRMMNEAFLYLGFLLEQIQDANILRRDSYQSFKKDG

SEQ ID NO: 123384 - protein, 124 aa, Glycine max
  Coding DNA Sequence Number=SeqID_6606
  Subcellular localization annotation: CTP_CleavageSite=79; ConfidenceScore=5.27e-01
MLVRMIRTRLFAAAQVKSCPGMHSSCVIASLSGCARTVGPPPISGGGPRTVWIWSPLNVRTRSPLKARACSPLKFRTCRLSKARECSPMMARTCNPLKVRACSPTKVKAHDPLTARTCSPLKLK

SEQ ID NO: 123385 - protein, 90 aa, Glycine max
  Coding DNA Sequence Number=SeqID_6607
MGIAPTRHPVDPEKSNRAWGFQLWLRPLSVYRVPVPPPARSRHHSSTEYLSPPARASGPLLIELSSRSTAPPGRRRAKHHSSIGMAGSGQ

SEQ ID NO: 123386 - protein, 134 aa, Glycine max
  Coding DNA Sequence Number=SeqID_6608
MTATTVGGGGGDNDGNDGHDDKGGVDNSDHGGTYSGGMIFCGDAVKDKYGMFRFGFACFLGNCSILQAELATIFRGLQVAIIRGYDKIIVESNSKDAFKMLQKWVSVRSPLGPPNWFYLEFGFLFNAIPMAANL

SEQ ID NO: 123387 - protein, 130 aa, Glycine max
  Coding DNA Sequence Number=SeqID_6609
MCGGRDQFYSWQDLALTTTQFSFLLAQKGSDIGEWKSYIGSDICKEVVRHSLCPGRDIQSNVVRTSSNLMDWESATFGSLKQKVKEEYFSSLFTSSNPSGVQEVANVVGRRVSDEMLGLFSMKLLWKMKW

SEQ ID NO: 123388 - protein, 64 aa, Glycine max
  Coding DNA Sequence Number=SeqID_6610
MKQAQEVALVCIKNKLKRLLKRLALTDPLKLLQEHNKGKGNFTKEKKHRVVTMLELNMRYPSHV

SEQ ID NO: 123389 - protein, 61 aa, Glycine max
  Coding DNA Sequence Number=SeqID_6611
MASWNMGLASCQKTMSFEVSCSRKRDRDRERGSILPYKVVEITPPPKSLGVRCLPPVSAIR

SEQ ID NO: 123390 - protein, 225 aa, Glycine max
  Coding DNA Sequence Number=SeqID_6612
  Homolog annotation: Hit_ID=Q0GPH0; Match level="QueryCoverage=99%, HitCoverage=55%, E-value=8e-42, Identity=41%"; Hit description=BZIP transcription factor bZIP80
  Pfam annotation: Domain name=DUF632; Domain location=1-130; Score= -123.1; E_value=0.0038; Accession=PF04782.3; Description=Protein of unknown function (DUF632)
MYECHQVQKHIVQQLEYLNTIPSKNPTSEIHKQSTLQLELEVQQWHQSFCNLFKAHHDYIQSLTGWLRLTLFQFSKTPINRTPEESKIYTLCEEWHLAVDRIPDKVASEGIKILLTVIHAIALQQAKEQKQKKKSDSTFKELEKKVVQLRSLECKYGPYSMPESSGSLRTRDPITEKRTKVDALKAKADEEKSKYNKSVSVTRAMTLNNLQMGCPHVFQGIVGFS

SEQ ID NO: 123391 - protein, 325 aa, Glycine max
  Coding DNA Sequence Number=SeqID_6613
  Gene Ontology: Mol. function=RNA-directed DNA polymerase activity; Biological process=RNA-dependent DNA replication
  Homolog annotation: Hit_ID=Q1RXD8; Match level="QueryCoverage=60%, HitCoverage=30%, E-value=9e-33, Identity=39%"; Hit description=RNA -directed DNA polymerase
MELHDIPLVGKSIPWFKTNGHTKSKFVNFVEQAWETIEINGRVDFVLKEKLKALKGELRRWNKGMFWKLTRMWVEDPKEVKAEVRRFFNERFLETNEDRPKLDGVSFKRLKERDNDILGETFDDAGGGFSTYDGGIPHKWEATKRNNCLIHSSRSKDGKPSRARNMLGGVLIANEMVEKAKRCKKSCVIFKGSMDWIGWIKGCLQPTLVSILVNGSPTTKFNTQKGLRQDNPLAPFLFLMVVESLIGLIRQAMVANKFYGVKVGKDLMVSMLQFEDDTLMFGDVTLENMLCVKSALRCFELVSRLKVKFQKSKLGGICVDELIVK

SEQ ID NO: 123392 - protein, 99 aa, Glycine max
  Coding DNA Sequence Number=SeqID_6614
  Subcellular localization annotation: CTP_CleavageSite=18; ConfidenceScore=5.13e-01
MGMGFGKQGCGQGTTYPSSSRPATMSSPEDSKVQIQLMQALWLIGLRRSTSMHRTFLGGETWSHERIILDDLKVELEGPMKLHCDKKSTINIAHDPIQH

SEQ ID NO: 123393 - protein, 112 aa, Glycine max
  Coding DNA Sequence Number=SeqID_6615
RLRLVAKELIWWKDFLKVREWINGRWIWKLDWKRQWFNWEQPIFDGFLKMLNSKRLYPQEKDKLVWKGCVSSSFLISNMYRLLRSYQGEEDTQSIFKDLWSIAIPSNVTFFG

SEQ ID NO: 123394 - protein, 39 aa, Glycine max
  Coding DNA Sequence Number=SeqID_6616
MQEKIAKIKSQGNATVEISLNDSLGQEYKVVLKNLKFMS

SEQ ID NO: 123395 - protein, 94 aa, Glycine max
  Coding DNA Sequence Number=SeqID_6617
  Gene Ontology: Mol. function=glucose-1-phosphate adenylyltransferase activity; Cellular component=chloroplast; Biological process =glycogen biosynthetic process
  Homolog annotation: Hit_ID=P55230; Match level="QueryCoverage=98%, HitCoverage=18%, E-value=3e-32, Identity=71%"; Hit description =Glucose-1-phosphate adenylyltransferase large subunit 2, chloroplast precursor
MGGGAGTRLFPLTSTRPKQAVPIAGCYRLIDIPMSNCINSGIRKVYVLTQFNSFYLNGHLSRTYNFGNGVNFGGGFAEVLAATKTPGEAGNKWF

SEQ ID NO: 123396 - protein, 305 aa, Glycine max
  Coding DNA Sequence Number=SeqID_6618
  Gene Ontology: Mol. function=RNA-directed DNA polymerase activity; Biological process=RNA-dependent DNA replication
  Homolog annotation: Hit_ID=Q8S6H9; Match level="QueryCoverage=52%, HitCoverage=10%, E-value=1e-09, Identity=25%"; Hit description =Putative retroelement
GVLDVNVVVHSPKMVHVSIQNKSGGCRWFMTTVDGDPVRTSFNQQFWFDLTNIGLSMQDPWMLVGDFNAYLHPNEKKGMSDPNISSINQFEKFLDDYCLMDLNFQGPCYTWEARGEAMVYHLPFFKSNLREILIRLNHIVHPHHGQREFCFLTNWLVDRSFEEVVKGASENGQEIFEVGDIKWIVEGFFIDLLKDETPYQEWPLIGAFLQLANDEIDAIQVPPVDFEVKATVHSMGPLKAPPFILSRSLGGGEGVMVNGDKTQEFRPEKGLSQWDPLSPYIFVLCVERLLHLIQEGAGSLSGGVG

SEQ ID NO: 123397 - protein, 300 aa, Glycine max
  Coding DNA Sequence Number=SeqID_6619
  Homolog annotation: Hit_ID=Q8TGM6; Match level="QueryCoverage=40%, HitCoverage=97%, E-value=1e-09, Identity=43%"; Hit description =Protein TAR1
GPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGLVGSVRARKGSSMGPELTGSHVIGLERGSSTILSRRSRPEPRFNQPRGGRALGLMASGATCVQRLDGSRDSAIHTKYRISLRSSSMQEPRYPLPRVIDEEAGRTGRRGHPLPPDGR

SEQ ID NO: 123398 - protein, 199 aa, Glycine max
  Coding DNA Sequence Number=SeqID_6620
  Gene Ontology: Mol. function=inositol or phosphatidylinositol phosphatase activity; Cellular component=cytoplasm; Biological process=phosphatidylinositol biosynthetic process
  Homolog annotation: Hit_ID=Q5U788; Match level="QueryCoverage=79%, HitCoverage=58%, E-value=3e-70, Identity=81%"; Hit description=L -galactose-1-phosphate phosphatase
  Pfam annotation: Domain name=Inositol_P; Domain location=6-188; Score= 161.0; E_value=3e-45; Accession=PF00459.15; Description=Inositol monophosphatase family
MGDNDSLSEFLASAVDAACKAGEIIRKGFYQTKNVQHKGLVDLVTETDQACEDLIFTHLKQLYSTHKFIGEETTAAGGNAELTDEPTWIVDPLDGTTNFVHGFPFVCVSIGLTIGKVPTVGVVYNPIINELFTGIRGKGAFLNGNPIKVSSQTELMSALLVTEVCPLLLLCISEALSCENKLLQSINDKYQCNGEVATL

SEQ ID NO: 123399 - protein, 318 aa, Glycine max
  Coding DNA Sequence Number=SeqID_6621
  Gene Ontology: Mol. function=transporter activity; Cellular component= membrane; Biological process=sodium ion transport
  Homolog annotation: Hit_ID=A0FKR1; Match level="QueryCoverage=90%, HitCoverage=63%, E-value=4e-68, Identity=45%"; Hit description =Vacuolar citrate/H+ symporter
  Pfam annotation: Domain name=Na_sulph_symp; Domain location=1-297; Score=-300.1; E_value=0.0092; Accession=PF00939.9; Description =Sodium:sulfate symporter transmembrane region
  Subcellular localization annotation: CTP_CleavageSite=38; ConfidenceScore=5.32e-01
MLAVIAWVYSWWVTAAVPLPVTSMCPKFNRAVVLTVVYATPIGGISTSQFALIQFLESDVTWVFLNMVLLRFSCCHSLPLLFWCIVCFLYVPKDSSRALSSLSFDIPGWGACFHGLVGDGSVSVMVAVLLFIIPNKKQEGEKLMDWNERKKLPWNLILLLGAGFALADGVQSSGLADVLSRALDFLEDTPYWAIAPAVSLMSSIITEFITSNDATATATLLIPLLYNIAKTMHVHPLLLMVPGAVATAFLLPTSTPSNVVGFATGHIEILDMLKIGVPLKVAGIAVLSIFMPTLGAIVFGTDDYIQWMPNINSPWLRN

SEQ ID NO: 123400 - protein, 245 aa, Glycine max
  Coding DNA Sequence Number=SeqID_6622
  Gene Ontology: Mol. function=isomerase activity; Biological process =proteolysis
  Homolog annotation: Hit_ID=Q1S064; Match level="QueryCoverage=83%, HitCoverage=57%, E-value=3e-31, Identity=37%"; Hit description =Cyclin-like F-box; F-box protein interaction domain
MECLAREVKGDDEIGFVGLEFSGDEPVEGAGDEDAHGAGAAEGVGHAGEVLPGVGFEGVELDLGIEGAFLEIHEVGNAQELVVVGGGVVAEAVDAGGEEGGLGAVEAVGGENTVLAEERVPEGDVVSNVGDAEEAVGGAEDLDAVAVAHQGVAQFHGILFRRFEVQGVEVGAVAENEAGVGFVEVEEDEVPAVDDGPPPLAGFASGEIQIVSITNCNSPFDKLVLNKVKNYLQYAVKDITYVHFK

SEQ ID NO: 123401 - protein, 95 aa, Glycine max
  Coding DNA Sequence Number=SeqID_6623
MKLECILLVFVLFGFAIDQGEVKMNDPHVIEIANFAVTEFNKEAGEGLNCSSCKSFLMNITLNCWNLPTILQGAKLSRLLDDAKMEKSGLLRLSS

SEQ ID NO: 123402 - protein, 138 aa, Glycine max
  Coding DNA Sequence Number=SeqID_6624
  Gene Ontology: Mol. function=ferredoxin hydrogenase activity; Cellular component=periplasmic space; Biological process=electron transport
  Homolog annotation: Hit_ID=O23488; Match level="QueryCoverage=84%, HitCoverage=19%, E-value=5e-26, Identity=50%"; Hit description=LET1 like protein
  Pfam annotation: Domain name=DUF588; Domain location=25-137; Score =72.2; E_value=1.7e-18; Accession=PF04535.3; Description=Domain of unknown function (DUF588)
MSYLGLGVSPGTVPVYHGTKLKVLDRRVRITELVLRCVSLGLGAVAIVLVVTDSQVKEFFSFQKKAKFTDMKALVFLVVANGLTVGYSLIQGLRCVVSMIRGNVLFNKPFAWLIFSGDQANPPKEGVIDFPFKHLILS

SEQ ID NO: 123403 - protein, 103 aa, Glycine max
  Coding DNA Sequence Number=SeqID_6625
MRKKKELLKMLTTSEPKPFNSNPTMRQFFHPELIIPSRSSPPHVSLSLGPTSQPMQEYTKSTIDAPVANNMLSIDSTHNQVSCKNIYDWDSGTDSIVDTSLHL

SEQ ID NO: 123404 - protein, 90 aa, Glycine max
  Coding DNA Sequence Number=SeqID_6626
MEMRKRNGMLDRCCTSLRKEDLEVLLKSSLSDEEANSPSERRTLENVKSKSSALSVQLTRPGKPLLLLALSASTSAKRSVTNSHSAKHAR

SEQ ID NO: 123405 - protein, 63 aa, Glycine max
  Coding DNA Sequence Number=SeqID_6627
  Gene Ontology: Mol. function=inositol or phosphatidylinositol phosphatase activity
  Homolog annotation: Hit_ID=Q5U789; Match level="QueryCoverage=94%, HitCoverage=34%, E-value=5e-14, Identity=73%"; Hit description=L -galactose-1-phosphate phosphatase
MPVQIGSIACFSRDVAGGAVIVREAGGVIFDPSGADFDITSQRVAASNPFLKDALVDVLHQIV

SEQ ID NO: 123406 - protein, 577 aa, Glycine max
  Coding DNA Sequence Number=SeqID_6628
  Gene Ontology: Mol. function=transcription factor activity; Cellular component=nucleus; Biological process=regulation of transcription, DNA-dependent
  Homolog annotation: Hit_ID=Q00LP7; Match level="QueryCoverage=92%, HitCoverage=98%, E-value=0.0, Identity=61%"; Hit description=GRAS1
  Pfam annotation: Domain name=GRAS; Domain location=181-487; Score =440.1; E_value=3e-129; Accession=PF03514.5; Description=GRAS family transcription factor
MDERERLVAGIGKQSGFSLLSALHPTTQTEQSQTQMQTSQKHPSSAGVHFYHQPVQGIYQMLQSNLCHDSSSQGTSVSFETCKEQYFTLESCPAPTTCFVDCDDSPSYASVSSKRTPFSPQGSQSCYSDHQQSSDNTYGSPISGLSSVDDGHELKHKLRELEISLLGPEQSDSCGCCVVKGGLQGSSQLAKHNWDQIAENVAQFDLKGVLRVCAQAVSDDDVPTARGWMDNVLGKMVSVSGDPIQRLGAYLLEGLRARLESSGNLIYKSLNCEQPTSKELMSYMHILYQICPYWKFAYISANAVIEEAMANESRIHIIDFQIAQGTQWHLLIQALAHRPGGPPSLRVTGVDDSQSIHARGGGLQIVGERLSDFARSCGVPFEFRSAAISGCEVVRGNIEVLPGEALAVSFPYVLHHMPDESVSTENHRDRLLRLVKRLSPKVVTIVEQESNTNTSPFFHRFVETLDYYTAMFESIDVACPRDDKKRISAEQHCVARDIVNMIACEGVERVERHELLGKWRSRLSMAGFKQCQLSSSVMVAIQNLLKEFSQNYRLEHRDGALYLGWMNRHMATSSAWR

SEQ ID NO: 123407 - protein, 378 aa, Glycine max
  Coding DNA Sequence Number=SeqID_6629
  Gene Ontology: Mol. function=ATP binding; Cellular component =chromosome; Biological process=DNA metabolic process
  Homolog annotation: Hit_ID=Q3BM83; Match level="QueryCoverage=62%, HitCoverage=19%, E-value=1e-98, Identity=74%"; Hit description =Putative ATP-binding protein
MHFLQVVVVGARRQQGFHLAARGDHRLVRAIKLGEVADQALGGVEGLRRVEHEVAQEDIEVAQVLRRLRLVQQAQRHLVVDAEQVAEALGVTGEGVEVVQVGQLLLELAQVQVETTKILGDVERALGDHVVLAHIASRGAVAGDPQQAHQADHAAIAGAVLGGDFAGAAVLLVGPRATHVGHQVAVAATAFGFTRGGVEVDDGRRRQQRGHGIEQGRLARAGTADEQEAALGDRHFGQAVEVCLEIAMRWSGLSGLGGRGFAQLAVDRRELGHVFGGEQQLQRRRDFVAVFLAAEAGQDVVVLHLLHRRSDTAVEAGAVGGQVLFVDGQRFGHLGIGDHRAVAARIGLGQLLAKVQQQHRVDEGQRRGAQQHRRIDVF

SEQ ID NO: 123408 - protein, 298 aa, Glycine max
  Coding DNA Sequence Number=SeqID_6630
  Gene Ontology: Mol. function=ATP binding; Cellular component =chromosome; Biological process=DNA metabolic process
  Homolog annotation: Hit_ID=Q3BM83; Match level="QueryCoverage=98%, HitCoverage=21%, E-value=7e-83, Identity=53%"; Hit description =Putative ATP-binding protein
MDVRDRGLLGEEAQRRAALDNHTERLAELELQRRQQGGERIEELEREQGRAEAERDRRQAKREQARQAAQQLQAELPDDAHGFAELVERAQNELQDRQRASSALDDAISDRLGGKRDDERRFGEVRAELEAMQRTPSNIPAPMQKLRARLAEETGIAEAALPFVGELIQVRSEEQGWQGAIERVLGGFALSLLVDDKHYNDVAEWVNRTHLGMRFTYYRVRRNDDAFAREPSAKSLLHNLELREHVFESWLRRELGKRFDYKCVDAKQLRNVDRGITREGQVKHPGDRFQKGRPHCGG

SEQ ID NO: 123409 - protein, 524 aa, Glycine max
  Coding DNA Sequence Number=SeqID_6631
  Gene Ontology: Mol. function=oxidoreductase activity; Cellular component=membrane; Biological process=electron transport
  Homolog annotation: Hit_ID=O81974; Match level="QueryCoverage=91%, HitCoverage=94%, E-value=1e-170, Identity=61%"; Hit description =Cytochrome P450 71D8
  Pfam annotation: Domain name=p450; Domain location=38-497; Score =373.8; E_value=2.7e-109; Accession=PF00067.12; Description =Cytochrome P450
MELRPSFLVLTSFLLLLLWLARIYKQKIKVRSVVHKLPPGPWKLPLIGNLHQLAGAGTLPHHTLQNLSRKYGPLMHLQLGEISAVVVSSSDMAKEIMKTHDLNFVQRPELLCPKIMAYDSTDIAFAPYGDYWRQMRKICTLELLSAKRVQSFSFIREEEVAKLIQSIQLCACAGSPVNVSKSVFFLLSTLISRAAFGKKSEYEDKLLALLKKAVELTGGFDLADLFPSMKPIHLITRMKAKLEDMQKELDKILENIINQHQSNHGKGEAEENLVDVLLRVQKSGSLEIQVTINNIKAVIWDIFGAGTDTSATVLEWAMSELMKNPRVMKKAQAEIREAFRGKKTIRESDVYELSYLKSVIKETMRLHPPVPLLLPRECREPCKIGGYEIPIKTKVIVNAWALGRDPKHWYDAEKFIPERFDGTSNDFKGSNFEYIPFGAGRRMCPGILLGIANVELPLVALLYHFDWELPNGMKPEDLDMTEGFGAAVGRKNNLQFVELITHNVENGDPKGSATFVLNELMDLA

SEQ ID NO: 123410 - protein, 523 aa, Glycine max
  Coding DNA Sequence Number=SeqID_6632
  Gene Ontology: Mol. function=ferredoxin hydrogenase activity; Cellular component=periplasmic space; Biological process=electron transport
  Homolog annotation: Hit_ID=Q93YF9; Match level="QueryCoverage=99%, HitCoverage=100%, E-value=0.0, Identity=79%"; Hit description=Narf -like protein
  Pfam annotation: Domain name=Fe_hyd_lg_C; Domain location=78-451; Score=195.4; E_value=1.4e-55; Accession=PF02906.5; Description=Iron only hydrogenase large subunit, C-terminal domain
MSEKFSAALRIGDLNDYIAPSQACIVSLKGLKKNDKPEVSIANKQVNFEPVKISLKDCLACSGCVTSAETVMLEKQSLDEFLNNINSGKAVIVSLSPQSRASIAVHFGISPIQKQCLCICKGKAAYSDLPSYLCIARSFLAFKKLTRFFKSLGVKAVFDTSCSRDLTLVESCVEFITRYRQNQLVDDERSKSSLPMIASACPGWICYAEKQLGSFVLPYISSVKSPQQTVGAIIKNYVCQELGLRPEEVYHVTVMPCYDKKLEAARDDFVFQFESHVEGLESEINMISEVDSVLTTGEVLELIQSKEVDFKSLEETPLDKILTNINEEGYLYGVHGSSGGYAETIFRYAAKTLFGRQIDDPLTFRNIRNSDFQEVTLEASSFELYNIIIMLVKKVVIRKVVEGKTVLKFALCYGFRNLQNIVRKLKNGKCDYHFLEIMACPSGCLNGGGQIKPNSGQSPKELSQLLESVYMENVLVASPFDNPIIKGLYDKWLEQPGSVKARRYMHTQYHPVEKSITSQLHNW

SEQ ID NO: 123411 - protein, 286 aa, Glycine max
  Coding DNA Sequence Number=SeqID_6633
  Pfam annotation: Domain name=DUF751; Domain location=122-184; Score =91.7; E_value=2.2e-24; Accession=PF05421.2; Description=Protein of unknown function (DUF751)
MKIYRVVLVSHRIDLVECGKMRSVSLRPELHIPICSSNPPSCVKPIKLVVASSYGKNLKNPPSKFAITLREHRTTLEHAARLPLLKHDSGIVVMGAVCVVGILAVVLSEEKALALGPEGPLVEEFWDNVRRYGLYALTVSTGALYTIFRPIAELLKNPISAIFILALFGGSIFIVSQVLSAMKIRRVEFGFFPRCSKSDQESLSNPPIYIEALKRISQFSLSLTNTTPPLLRSHSPRPQARTLSHLPGQHYRTSTTNNNNLLVLFTPPMNIVSLDLTFFSRFTLIA

SEQ ID NO: 123412 - protein, 246 aa, Glycine max
  Coding DNA Sequence Number=SeqID_6634
  Gene Ontology: Mol. function=monooxygenase activity; Cellular component=membrane; Biological process=electron transport
  Homolog annotation: Hit_ID=Q1SDS7; Match level="QueryCoverage=83%, HitCoverage=67%, E-value=1e-19, Identity=35%"; Hit description=E -class P450, group I
MEAQFFLAVIKFFLSLLVLLLAKNYKQKGLHKLPPGPWKLPIIGNLLQVEAASSLPHRAFRELAQKYGPLMHLQLEVFGNITTENCEGFLSIVKETIEVADGFDLADMFPSFKPMHFITGLKAKLDKMHNKVDKILDKIIKENQANKGMGEEKNENLVESTSGTDTSAKVIEWAMSEMMRNPGGREKAQAEIRQTQIALPLETPPQGMKPEELDMEEAFGAEAGRKNNLHLIPIPYNPSIHHDNCK

SEQ ID NO: 123413 - protein, 149 aa, Glycine max
  Coding DNA Sequence Number=SeqID_6635
  Homolog annotation: Hit_ID=Q9LUE7; Match level="QueryCoverage=45%, HitCoverage=41%, E-value=1e-19, Identity=64%"; Hit description =Similarity to ATFP3
  Pfam annotation: Domain name=HMA; Domain location=31-94; Score=47.6; E_value=4.1e-11; Accession=PF00403.16; Description=Heavy-metal -associated domain
MGEEKKDEGNKEEAKEEKKEEEKKEEPPPEIVLKVDMHCEACARKVAKALKGFQGVEEVSADSRTSKVVVKGKAADPIKVCERLQKKSGKKVELISPLPKPPEEKKEETKEEPPKEEKKDEGESAEMKVTKQSDVPPKGTRNEGNGGDK

SEQ ID NO: 123414 - protein, 685 aa, Glycine max
  Coding DNA Sequence Number=SeqID_6636
  Gene Ontology: Mol. function=binding; Cellular component=plastid chromosome; Biological process=transport
  Homolog annotation: Hit_ID=Q9FSB6; Match level="QueryCoverage=88%, HitCoverage=86%, E-value=0.0, Identity=69%"; Hit description=67kD chloroplastic RNA-binding protein, P67.1
  Pfam annotation: Domain name=PPR; Domain location=163-197; Score =31.9; E_value=2.2e-06; Accession=PF01535.11; Description=PPR repeat
  Pfam annotation: Domain name=PPR; Domain location=198-232; Score =31.1; E_value=3.8e-06; Accession=PF01535.11; Description=PPR repeat
  Pfam annotation: Domain name=PPR; Domain location=233-267; Score =36.9; E_value=7.2e-08; Accession=PF01535.11; Description=PPR repeat
  Pfam annotation: Domain name=PPR; Domain location=268-302; Score =40.1; E_value=7.5e-09; Accession=PF01535.11; Description=PPR repeat
  Pfam annotation: Domain name=PPR; Domain location=303-337; Score =35.1; E_value=2.5e-07; Accession=PF01535.11; Description=PPR repeat
  Pfam annotation: Domain name=PPR; Domain location=338-372; Score =37.5; E_value=4.8e-08; Accession=PF01535.11; Description=PPR repeat
  Pfam annotation: Domain name=PPR; Domain location=373-407; Score =20.7; E_value=0.0053; Accession=PF01535.11; Description=PPR repeat
  Pfam annotation: Domain name=PPR; Domain location=409-443; Score =36.7; E_value=7.8e-08; Accession=PF01535.11; Description=PPR repeat
  Pfam annotation: Domain name=PPR; Domain location=444-478; Score =30.0; E_value=8.4e-06; Accession=PF01535.11; Description=PPR repeat
  Pfam annotation: Domain name=PPR; Domain location=546-580; Score=9.5; E_value=0.56; Accession=PF01535.11; Description=PPR repeat
  Pfam module annotation: Pfam domain module=PPR::PPR::PPR::PPR::PPR::PP R::PPR::PPR::PPR::PPR; Domain location=163-197::198-232::233-267::268- 302::303-337::338-372::373-407::409-443::444-478::546-580
  Subcellular localization annotation: CTP_CleavageSite=67; ConfidenceScore=5.56e-01
MAYNLCSSPSSLFHDLPSISSSSSSRKFKLRNLSSSSLTPHSKTLLHVSLHEHEPIPEHLPPDAKSSSSSKSNYIWVNPRSPRAKQLESRSYDARYTSLVNLAHSLDSCNPSQEDVSLVLKDLGDRVIEQDAVIVINNMSNSRVVPFVLNYFQRRIRPTREVILYNVTLKVFRKSKDLDAMEKLFDEMLQRGVRPDNVTFSTIISCARICSLPNKAVEWFEKMSSFGCEPDDVTYSAMIDAYGRAGNIDMALRLYDRARTEKWRLDTVTFSTLIKMYGLAGNYDGCLNVYQEMKVLGVKPNMVIYNTLLDAMGRAKRPWQAKSIYTEMTNNGFSPNWVTYASLLRAYGRGRYSEDALFVYKEMKEKGMEMNTHLYNTLLAMCADLGLANEAFEIFEDMKTSATCLCDSWTFSSLITIYSCTGNVSEAERMLNEMIESGSQPTIFVLTSLVQCYGKVGRTDDVVKTFNQLLDLGISPDDRFCGCLLNVMTQTPKEELGKLNDCVKKANPKLGSVVRYLVEGLEEGGGEFKKEASELFNSIADEVKKPFCNSLIDLCVNLNLLDKACELLDLGLTLEIYTDVQSKSQTQWSLHLKSLSLGASLTALHAWINDLSKTLESGEDLPPLLGINTGHGKHRYSDKGLASVVESHLNELNAPFHEAPDKAGWFLTTQVAAKSWLESRELVTA

SEQ ID NO: 123415 - protein, 60 aa, Glycine max
  Coding DNA Sequence Number=SeqID_6637
MKSETSTGIQKEKGEGDWFGSVENRIMPNATEQNNAKGRLGAMHILMGFTLCSDLKHSLT

SEQ ID NO: 123416 - protein, 205 aa, Glycine max
  Coding DNA Sequence Number=SeqID_6638
  Gene Ontology: Mol. function=metal ion binding; Biological process =metal ion transport
  Homolog annotation: Hit_ID=Q8S6Y3; Match level="QueryCoverage=50%, HitCoverage=42%, E-value=3e-11, Identity=36%"; Hit description =Putative ATFP3
MDEIHKPPPVVTVVLKVRMHCEPCAQVIQKRIRKIKVFYLDAETLYLTGMVSAAYCILKCPCSLYASYFALYFNFGTFLRVDGLYGLLGCHVNSTLLVRGVESVETDLANDQVIVKGVVDPAKLVDHVYKRTKKQASIVKDEEKKEEEKKEEEKREEKEEEKKEGEEDNKTEIKRSEYWPSKNYIDYAYDPEIFSDENPNACSVM

SEQ ID NO: 123417 - protein, 89 aa, Glycine max
  Coding DNA Sequence Number=SeqID_6639
MAKKVNIMRLKVDLGCHKCYKKVTVLSKALKFVEPPKLKPRLKPKPPPPPPVSVPIGLCCVPCFDGYGALPPVMTLIMIVTAVGAGLVT

SEQ ID NO: 123418 - protein, 518 aa, Glycine max
  Coding DNA Sequence Number=SeqID_6640
  Gene Ontology: Mol. function=microtubule binding; Cellular component =cortical microtubule, transverse to long axis; Biological process =cytoskeleton organization and biogenesis
  Homolog annotation: Hit_ID=O23565; Match level="QueryCoverage=84%, HitCoverage=72%, E-value=2e-91, Identity=46%"; Hit description =Myosin II heavy chain like protein
  Pfam annotation: Domain name=Myosin_HC-like; Domain location=103-476; Score=424.9; E_value=1.1e-124; Accession=PF07058.2; Description =Myosin II heavy chain-like
MESVNWTKDLELQRIILNKRCTVLNLEIKKLTDEKKNALASQYAAEATLRRVHANQKDEDFVPIERAIAPLEAEIKMYKNEITALQEDKKALERLTKLKESALLEAERILRSALDRALVVEEEENKLLEKNHRQKILEVEKLSQTIQELEEVILASGATANAVRDYQQQISELQEEKRTLERELARVKVSTNRIANAVANEWKDENHKVMPVRQWLEERRIMQAEIQRLKDKQAISERTAKAESQLKDKLKLRLKTLEEGLKHFSNNPITSNVSYASQKAEKSNILGFLTTSAGLRKRSTSQPRACTVGSSLFQTPNIKNNRGDIVAGNLKLGSPTKKYGSTENMLTKGIWASRSKVADNGEKENEMQVNRDMTLNRCNDESEATEIKTIVDVEEDPPESKKPKGSSRDDVVSGFLYDKLQKEVINLRKSCEIKDSSLQAKDEEIKMLIKKVGVLTKAMEVEWKKMKREAAAREKEASSTKSDDNRKNRSANSSKRFFSFTFCSAANNCQLSSFFSPF

SEQ ID NO: 123419 - protein, 50 aa, Glycine max
  Coding DNA Sequence Number=SeqID_6641
MVCAMNGHFFASTTRLKAVQVGHLMAKDVGHSSPQTQLVFTFRKLRATNE

SEQ ID NO: 123420 - protein, 241 aa, Glycine max
  Coding DNA Sequence Number=SeqID_6642
  Gene Ontology: Mol. function=nucleoside-triphosphatase activity; Cellular component=chloroplast
  Homolog annotation: Hit_ID=Q2PMM5; Match level="QueryCoverage=100%, HitCoverage=17%, E-value=1e-49, Identity=82%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPRTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQK

SEQ ID NO: 123421 - protein, 140 aa, Glycine max
  Coding DNA Sequence Number=SeqID_6643
MEAMKEQMTTMMEAMMSMKKIMEVNAVAIAATSAVTKVNPMPPENVNNSTPILIESRQPQTDHAHVSQTVGETHEIPHHNLADFEPCLGYATEGQAVGEMGKLDHLEERLRAIEGGKDYAFANLEDLFLVPNIITPPKFK

SEQ ID NO: 123422 - protein, 499 aa, Glycine max
  Coding DNA Sequence Number=SeqID_6644
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q8H046; Match level="QueryCoverage=66%, HitCoverage=16%, E-value=3e-44, Identity=33%"; Hit description =Putative callose synthase
  Pfam annotation: Domain name=PPR; Domain location=293-327; Score =31.0; E_value=4e-06; Accession=PF01535.11; Description=PPR repeat
  Pfam annotation: Domain name=PPR; Domain location=328-362; Score =33.7; E_value=6.5e-07; Accession=PF01535.11; Description=PPR repeat
  Pfam annotation: Domain name=PPR; Domain location=363-397; Score =30.1; E_value=8e-06; Accession=PF01535.11; Description=PPR repeat
  Pfam annotation: Domain name=PPR; Domain location=433-467; Score =16.9; E_value=0.073; Accession=PF01535.11; Description=PPR repeat
  Pfam module annotation: Pfam domain module=PPR::PPR::PPR::PPR; Domain location=293-327::328-362::363-397::433-467
MDFVAQFMTFEARSSVVVVEDGVGVGVAGGGGVQGWGNTRWWDLVLSKREISQGLVVPIALLIVRIGISYDNWKVYIRRRAFKSWAEVIESSSPIPIRSAGVSLLSWPVPPPPYRNLNFNNTNTLSYGNPKHQQQQSQDVDELGSKLNSMNVSLSDASVVDIFQILASEKVSALQFFDFLKGSDPELCCDPDIGSLFINNCGLLGNYEAMVPVLSGFSHRRVFLGMKAFGFLLDLGLDKASSMECVRKVMAVFNKVGGMYQSCGVQLLIEMFGLSGSFEIAEFVIRTAGRKVKHYHVLMRILCKSGDCKRVSDLVKEMKRSGCDMDVSTYNLLLSCLCKNGKIDEAWQLLEAMEKNYGLTNAHSFDILINFLCKRRQFDSVLKLLDKMFLKGIEPSILTHAAIIKSYFESGKYEEAHEYVIGSANRLSYSSNANYGLLATLQLKNGNVLLACKVLSEMMDKGLKPNFSVYKKIRKHLEKKDEKDLSLELLRRYSSLVEK

SEQ ID NO: 123423 - protein, 170 aa, Glycine max
  Coding DNA Sequence Number=SeqID_6645
ASQDSFVAHGRQDVLIAAIGRLEHPGRVRAAGAGVTIKQYFRPTPRTSCTSFSMAPEDLEQLTQMQSHFQSQMQSQGLTLPPKPKVGPLDAHVSTKESCVDPSGNDPDTVKVGVEEVGDADAPIHVPTREDDTVFGVFNEDLPLYIKHEDLSEIAHGGQCLNISVIQLWI

SEQ ID NO: 123424 - protein, 172 aa, Glycine max
  Coding DNA Sequence Number=SeqID_6646
LRLPAIKQQLILQFKAAFHCDKDVIEIPGFYQRQWLPNYPEIVEFKYDGETYEIQDRQHKGKLYFADGLTRLRTELQIYESVTINFLACDHPSKFDLHFTPPLDQFGPPLQWNVVVLDKGIGDKYITLPWYKFLQEGDFSHGDELSFYYRRAEKIWKVVIRRAIDWDDSDID

SEQ ID NO: 123425 - protein, 69 aa, Glycine max
  Coding DNA Sequence Number=SeqID_6647
MAGGRLLGIVEEVDDGRERGIEVELEVSTDEEDYGGNNLDRPRRHEGEPSNFMVVNALTNVPTRDLSVV

SEQ ID NO: 123426 - protein, 123 aa, Glycine max
  Coding DNA Sequence Number=SeqID_6648
  Gene Ontology: Mol. function=RNA binding
  Homolog annotation: Hit_ID=Q5SMR4; Match level="QueryCoverage=48%, HitCoverage=9%, E-value=4e-08, Identity=69%"; Hit description=ALM beta-like
MLHLQIGTLIYVQVVKANPGMNPELSCTDDLTLPFILFSQWNSSRIWWPKRWLYVPMYNGSLKDVCMLLNSPTCPVLDGLGQVWVNATSPHTTILVANEIMNSETLSGTQQRIMGEKLLQRIQ

SEQ ID NO: 123427 - protein, 63 aa, Glycine max
  Coding DNA Sequence Number=SeqID_6649
MRGGVKETGSNIGLPPHTYTHVGDVDFEGFSQGDVDMVLPPNNFGGLINESSLGFGVLPRDDF

SEQ ID NO: 123428 - protein, 104 aa, Glycine max
  Coding DNA Sequence Number=SeqID_6650
MGDARSLEAHGSTVHINEKVSEDLSSLFQQILEKYGLFFSVLSPSYQSDAGHCDNILGSNSNTLHQKNKFIPSQLTHYQVPLDPQTSSPETTFRSSRPDQLLQD

SEQ ID NO: 123429 - protein, 83 aa, Glycine max
  Coding DNA Sequence Number=SeqID_6651
METLYSLSSTFLVGARSKTRDSSQIAELVLHGLLLTSEWPNFISLETRSRLLRNVHLREITRSEIERKREIIKYEIENNKNHY

SEQ ID NO: 123430 - protein, 568 aa, Glycine max
  Coding DNA Sequence Number=SeqID_6652
  Gene Ontology: Mol. function=protein-tyrosine kinase activity; Cellular component=integral to membrane; Biological process=protein amino acid phosphorylation
  Homolog annotation: Hit_ID=Q7EYF8; Match level="QueryCoverage=96%, HitCoverage=54%, E-value=1e-159, Identity=52%"; Hit description =Putative phytosulfokine receptor
  Pfam annotation: Domain name=LRRNT_2; Domain location=21-67; Score =46.8; E_value=7.2e-11; Accession=PF08263.3; Description=Leucine rich repeat N-terminal domain
  Pfam annotation: Domain name=LRR_1; Domain location=119-141; Score =13.8; E_value=0.65; Accession=PF00560.23; Description=Leucine Rich Repeat
  Pfam annotation: Domain name=LRR_1; Domain location=143-165; Score =15.8; E_value=0.15; Accession=PF00560.23; Description=Leucine Rich Repeat
  Pfam annotation: Domain name=LRR_1; Domain location=167-186; Score =12.4; E_value=1.4; Accession=PF00560.23; Description=Leucine Rich Repeat
  Pfam annotation: Domain name=LRR_1; Domain location=191-213; Score =15.6; E_value=0.18; Accession=PF00560.23; Description=Leucine Rich Repeat
  Pfam annotation: Domain name=LRR_1; Domain location=215-237; Score =11.7; E_value=1.9; Accession=PF00560.23; Description=Leucine Rich Repeat
  Pfam annotation: Domain name=LRR_1; Domain location=266-289; Score =13.4; E_value=0.84; Accession=PF00560.23; Description=Leucine Rich Repeat
  Pfam annotation: Domain name=LRR_1; Domain location=292-313; Score =13.3; E_value=0.87; Accession=PF00560.23; Description=Leucine Rich Repeat
  Pfam annotation: Domain name=LRR_1; Domain location=315-334; Score =14.8; E_value=0.31; Accession=PF00560.23; Description=Leucine Rich Repeat
  Pfam annotation: Domain name=LRR_1; Domain location=341-362; Score =7.1; E_value=14; Accession=PF00560.23; Description=Leucine Rich Repeat
  Pfam annotation: Domain name=LRR_1; Domain location=363-382; Score =8.5; E_value=7.4; Accession=PF00560.23; Description=Leucine Rich Repeat
  Pfam annotation: Domain name=LRR_1; Domain location=384-403; Score =5.2; E_value=31; Accession=PF00560.23; Description=Leucine Rich Repeat
  Pfam annotation: Domain name=LRR_1; Domain location=407-430; Score =18.6; E_value=0.023; Accession=PF00560.23; Description=Leucine Rich Repeat
  Pfam annotation: Domain name=LRR_1; Domain location=431-450; Score =12.8; E_value=1.1; Accession=PF00560.23; Description=Leucine Rich Repeat
  Pfam annotation: Domain name=LRR_1; Domain location=455-477; Score =9.3; E_value=5.2; Accession=PF00560.23; Description=Leucine Rich Repeat
  Pfam annotation: Domain name=LRR_1; Domain location=479-502; Score =7.0; E_value=14; Accession=PF00560.23; Description=Leucine Rich Repeat
  Pfam annotation: Domain name=LRR_1; Domain location=504-526; Score =17.1; E_value=0.063; Accession=PF00560.23; Description=Leucine Rich Repeat
  Pfam annotation: Domain name=LRR_1; Domain location=528-550; Score =12.8; E_value=1.2; Accession=PF00560.23; Description=Leucine Rich Repeat
  Pfam annotation: Domain name=LRR_1; Domain location=552-566; Score =0.9; E_value=2e+02; Accession=PF00560.23; Description=Leucine Rich Repeat
  Pfam annotation: Domain name=LRR_1; Domain location=95-117; Score =14.4; E_value=0.42; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1; Domain location=21 -67::119-141::...
  Pfam module annotation: Domain location=143-165::167-186::191 -213::215-237::266-289::292-313::315-334::341-362::363-382::384 -403::407-430::431-450::455-477::479-502::504-526::528-550::552 -566::95-117
MKPFSLLVLSLYFFSVVGQLPSQDILALLEFKKGIKHDPTGYVLNSWNEESIDFDGCPSSWNGVLCNAGNVAGVVLDNLGLSADPDLSVFSNLTKLVKLSMSNNSISGTLPDNIADFKSLEFLDISNNLFSSSLPLGIGELRSLQNLSLAGNNFSGPIPDSISEMASIKSLDLSRNSFSGMLPVTLTKTTSLVSLNLSHNGFTGKVPKGFELIPALEKLDLHGNMLEGNLDVVFMLLSSASYVDLSENMLSSSDSKKKFLPRISESIKHLNLSHNKLTGSLASGAAEPVFENLKVLDLSYNQLDGELPGFDFVYDLEVLRLSNNRFSGFIPNGLLKGDSLVLTELDLSANNLSGPLSIITSTTLHSLNLSSNEFTGDLPLLTGSCAVLDLSNNKLEGNLTRMLKWGNIEFLDLSGNHLTGTIPEETPQFLRLSYLNLSHNSLSSSLPKVLTQYPKLRVLDISFNQLDGLLLANLLTLSTLQELHLENNMISGGIKFSSSADQSDLQILDLSHNQLNGYFPDEFGSLTGLKVLNIAGNNFSGSLPTTIADMSSLDSLDISENHFAGPLP

SEQ ID NO: 123431 - protein, 49 aa, Glycine max
  Coding DNA Sequence Number=SeqID_6653
  Gene Ontology: Mol. function=GTP binding; Cellular component =intracellular
  Homolog annotation: Hit_ID=Q9M7P3; Match level="QueryCoverage=76%, HitCoverage=9%, E-value=4e-12, Identity=84%"; Hit description=GTP -binding protein
MDFNSYCRVQEHGGETIIPFSCALERNLADMPPDEAAKYCEENKTQRSV

SEQ ID NO: 123432 - protein, 149 aa, Glycine max
  Coding DNA Sequence Number=SeqID_6654
MRKPSSRSFLYTGLGTVHGEEVDEALEHICGIGDGRSERSHNRNIRVAMGSHHVVPRRRRSHQAGVKNGKNARSELGRGEEWWWRRWFLGLGISSIFTLMLWECLKRRRRKLPPAAMNGCWDRGEIIRRFILALALNYFGFEIFPNFEI

SEQ ID NO: 123433 - protein, 51 aa, Glycine max
  Coding DNA Sequence Number=SeqID_6655
MVKNVFNKFNDYEIFWRVRHYQLKTEESVSVQNILPKCEDFRIRLPHLADF

SEQ ID NO: 123434 - protein, 126 aa, Glycine max
  Coding DNA Sequence Number=SeqID_6656
MDLKMRENHTRPLLGNMVIAPKIRGLMLRGLLVVVVGNPLLSQPRSFVSVVKGHIQRDFQYPKKERNDRGLDDQPKRSKAMGRVFTLNSVEASKSKHLIQEKHKLFFSSLNNDLVVETPTSGCLNF

SEQ ID NO: 123435 - protein, 203 aa, Glycine max
  Coding DNA Sequence Number=SeqID_6657
  Homolog annotation: Hit_ID=Q47522; Match level="QueryCoverage=27%, HitCoverage=76%, E-value=4e-17, Identity=70%"; Hit description=LacZ protein
VPPVQLLTGWCVTAKAPPDISAGKCSGHAARRVPFAIQAAQLLGRAIGAGLFAITPAGERGMCCKAIKLGNARRIRLFHYVIPPKKIVSVADHVNTEYEAWEVQDYTPCLAPIYSFKIGSVTRGARYQLLFPLVRVNFELGVIMVIAVSFGKPVVPAALMNRPTRGERRFAYWALAECILAYYVGTDEGVSEVLHVAEKKAAP

SEQ ID NO: 123436 - protein, 204 aa, Glycine max
  Coding DNA Sequence Number=SeqID_6658
MEELNINEVHDLMNNMHRDELINDNEDYEDNNIEYVDEPSQSPIDPPLTSNPPQSTKSPANLPLLDTLLHSQGATSRNGPSTNDGHSQPTIEHSSVDSHVEVDRSFGLYLEDISNLKRFDPDVTRDIVSKLLMRMPMPAENQKKYCPRINESLFNNFMNVADYEGHGSRGMRTEIWDGLVVDIWNTLEWKNKSIKAKMNTAIKA

SEQ ID NO: 123437 - protein, 223 aa, Glycine max
  Coding DNA Sequence Number=SeqID_6659
  Homolog annotation: Hit_ID=Q2HRX8; Match level="QueryCoverage=57%, HitCoverage=19%, E-value=9e-14, Identity=35%"; Hit description=IMP dehydrogenase/GMP reductase
MCIIQLYCLIKSLTHCWIYEHFPTVHTCVVHDAYDEGSPRARRWLTGKAHMTGIKGAPNRRCMDACTMTDVCWMPYAEHRGVRGFDLISSYTSQLRWGQIVVYVRLERVLWQFGYIQTIPPPPHLFVTWTEETAEPRHLPPPHNEEFVEPPIPEVSVVSDLPTHSVGMTKDLRAIAKDLEQVINLRMVTEGTDLYEIMTRCLRRARGDAADGSLRPRQRHHIG

SEQ ID NO: 123438 - protein, 95 aa, Glycine max
  Coding DNA Sequence Number=SeqID_6660
MCDSDSSCDDHDGDTDEDTDDDEDRWKPEPRPCKPPHYHKGGVPPNLSQKNDDLGLVHRWIIVKFEYHVHNPISNILTVGNFKIISELREKPFAL

SEQ ID NO: 123439 - protein, 164 aa, Glycine max
  Coding DNA Sequence Number=SeqID_6661
  Gene Ontology: Mol. function=transferase activity, transferring glycosyl groups; Cellular component=cytoplasm; Biological process =metabolic process
  Homolog annotation: Hit_ID=Q8S999; Match level="QueryCoverage=99%, HitCoverage=40%, E-value=5e-64, Identity=73%"; Hit description =Glucosyltransferase-10
MGSSETINMPHAVCIPYPAQGHINPMLKLAKLLHFKGFHITFVNTEYNHKRILKARGPYSLNGLPSFRFETIPDGLPEPVVEATQDIPSLCDSTRRTCLPHFRNLLAKINNSDVPPVTCIVSDGGMSFTLDAAEELGVPQTQVMLRMGIWRLPSIGYQASKKLD

SEQ ID NO: 123440 - protein, 555 aa, Glycine max
  Coding DNA Sequence Number=SeqID_6662
  Gene Ontology: Mol. function=ATPase activity, coupled to transmembrane movement of substances; Cellular component=integral to membrane; Biological process=transport
  Homolog annotation: Hit_ID=Q1RSS5; Match level="QueryCoverage=96%, HitCoverage=56%, E-value=1e-117, Identity=59%"; Hit description=ABC transporter, transmembrane region, type 1
  Pfam annotation: Domain name=ABC_membrane; Domain location=220-504; Score=3.4; E_value=0.00089; Accession=PF00664.13; Description=ABC transporter transmembrane region
  Pfam annotation: Domain name=ABC_tran; Domain location=52-245; Score =109.9; E_value=7.2e-30; Accession=PF00005.17; Description=ABC transporter
  Pfam annotation: Domain name=SMC_N; Domain location=42-224; Score= -134.9; E_value=0.098; Accession=PF02463.9; Description=RecFRecNSMC N terminal domain
  Pfam module annotation: Pfam domain module=ABC_membrane::ABC _tran::SMC_N; Domain location=220-504::52-245::42-224
VILSREVLGESGEREEGCGGQTAVEIIDGTLSWDDDNMQQDLKNVNLEIKKGELTAIVGTVGSGKSSLLASILGEMRKISGKVRVCGNVAYVAQTSWIQNGTIEENILFGLPMDRRRYNEVIRVCCLEKDLEMMDYGDQTEIGERGINLSGGQKQRIQLARAVYQDCDIYLLDDVFSAVDAHTGSEIFKVNCYIKWVELTALSRLECFWDDECVRGALKGKTIILVTHQVDFLHNVDQILVTRDGMIVQSGKYDELLDSGMDFKALVVAHETSMALVEQGQGVVMPGENLNKPMKSPEARNSGESNSLDRPVSSKKSSKLIKEEERETGKASTDQTNVDVLLPLFTGIVIAMYITVLSILIITCQNSWPTSFLIIPLIWLNIWYRGYYLATSRELTRLDSITKAPVIHHFSESIAGVMTIRSFRKQKNFCEENLKRVNDNLRMDFHNYSSNVWLGVRLELLGSFVFCISAMFMIILPSSIIKPENVGLSLSYGLSLNASLFWAVFMSCFIENKMVSVERIKQFTNIPSEPAWNIKDRMPPSNWPSQGNVDIKDLQ

SEQ ID NO: 123441 - protein, 209 aa, Glycine max
  Coding DNA Sequence Number=SeqID_6663
  Gene Ontology: Mol. function=transition metal ion binding
MQNSGVTLRAKSQHFTSVHDDNPYVASIPYFGFIEEIWELNYVKFTICVFKWFTLVDLKKLAYQNDSFIMAEQAKQVFYVQDPCDERQMTTPPSSPPPLTDATSHSPSTLKQTKKVTRLRSLAIMPVGAERPLVHMDHATGKADGLHRKKLKTYLGIVARDKVDVTYKNWKQVPATQKNLIWEDIHVDVRYENWKQVPAAQKDLIWEDI

SEQ ID NO: 123442 - protein, 405 aa, Glycine max
  Coding DNA Sequence Number=SeqID_6664
  Gene Ontology: Mol. function=ATPase activity, coupled to transmembrane movement of substances; Cellular component=integral to membrane; Biological process=transport
  Homolog annotation: Hit_ID=Q1RSS5; Match level="QueryCoverage=90%, HitCoverage=32%, E-value=6e-67, Identity=54%"; Hit description=ABC transporter, transmembrane region, type 1
MQFKLTLIAEVVFTILYIVAYVLLFSSSSEVSWKQVDEGSNGIVLSEESQETQQHLVDDKMTESEVTDFASASLLSKAFWIWINPLLRKGYKSKHPVNITLLQCFWKELAFTAFLAIIRLCIMFVGSVLIQSFVDFTSGKRSYAYEGYYLVLILLVSKFIEVLTTHHFNFQAQKVGMLIRCTLIPSLYKKRLKLSFSARQDHGVGTIVNYMVVDTQQLSDMMLQLHAAWEEHFSQRIMGFREMEYGWFSKLMYSICGTIVVMWSTPMLVSTLTFGTTILLGVQLDATTVFTITIVFKLLQKPIRTFPQPMISLSQAMISLERMDRFMLSRELSNDSDEREEGFGGQTTTEIIDGTFSWDHDNNMQQDLKNINLEIKKGELTTIVGSVGSRKSSLIASILGEMHKR

SEQ ID NO: 123443 - protein, 440 aa, Glycine max
  Coding DNA Sequence Number=SeqID_6665
  Gene Ontology: Mol. function=ATPase activity, coupled to transmembrane movement of substances; Cellular component=integral to membrane; Biological process=transport
  Homolog annotation: Hit_ID=Q1RSS5; Match level="QueryCoverage=77%, HitCoverage=49%, E-value=1e-70, Identity=73%"; Hit description=ABC transporter, transmembrane region, type 1
  Pfam annotation: Domain name=ABC_tran; Domain location=172-309; Score= 14.2; E_value=9.5e-09; Accession=PF00005.17; Description=ABC transporter
MDCGDQTEIGERGINLSGGQMQRIQLVRAVYQASTDQTNVDVLLPLFMGVAIAIYITVLSIFIITCQTSWPTVFLIIPLVWLNIWYRGYFLASSRELTRLDSITKAPVIHYFSESIAGVMTIRAFRKQKKFCEENLKRFYLVVGISHRIVWKLCLLHFCHVHDHLTQQYHKARQVEPSGGKIIIDDIDVSNLGLHDLRSRFGIIPQEPVLFEGTVRSNIDPIGQYTDEEIWKSLERCQLKEAVAAKPEKLDTLGRVILKQSRLLLMDEATASVDSQTDGVIQKIIREDFAACTIISIVDCDKVLVVDAGRAKEYNKPSNLLQSQSLFRALVQEYANRSTGYKKSRISNVPLDMSALVIHILMKKSKCLNKESQAICLILDIQLHKLAWLGRLRAKSRTDFGGEGEGKCGRGEDGVVEGEGWLQSSVQRQSLTSSSKNKRI

SEQ ID NO: 123444 - protein, 38 aa, Glycine max
  Coding DNA Sequence Number=SeqID_6666
MKLTLVTEVYTVSTTKPDLQGGAAQTKGCYQERPGGWG

SEQ ID NO: 123445 - protein, 74 aa, Glycine max
  Coding DNA Sequence Number=SeqID_6667
  Gene Ontology: Cellular component=mitochondrial membrane; Biological process=photorespiration
  Homolog annotation: Hit_ID=Q4TZT1; Match level="QueryCoverage=66%, HitCoverage=60%, E-value=8e-24, Identity=92%"; Hit description=Fb14
MASGWGITGNKGRCYDFWMDFSECMSRCREPKDCAFLREDYLECLHHSKEETSVEVFKLELNLQIPSSAYIHIK

SEQ ID NO: 123446 - protein, 209 aa, Glycine max
  Coding DNA Sequence Number=SeqID_6668
  Gene Ontology: Mol. function=transferase activity, transferring glycosyl groups; Cellular component=cytoplasm; Biological process =metabolic process
  Homolog annotation: Hit_ID=Q8L5C7; Match level="QueryCoverage=96%, HitCoverage=40%, E-value=9e-57, Identity=69%"; Hit description=UDP -glucuronosyltransferase
PDLVAGENVVLSLEFVKETENRGMLSSWCPQEQVLTHPAIGVFLTHSGWNSTLESVCGGVPMICWPFFAEQQINCRFCCKEWGIGLEKMVRELMDGENGKKMKDKVLQWKELAKNATSGPNGSSFLNLDNMQETNCMFYCKKWEIGLEIEDVKKDTIESLVRELMDGEKGKETRDKGLQWKELAKSVASGPDGSSFLNLENMFVKFFWA

SEQ ID NO: 123447 - protein, 262 aa, Glycine max
  Coding DNA Sequence Number=SeqID_6669
  Gene Ontology: Mol. function=catalytic activity; Cellular component =integral to membrane; Biological process=cellular metabolic process
  Homolog annotation: Hit_ID=Q1RUS0; Match level="QueryCoverage=90%, HitCoverage=57%, E-value=8e-90, Identity=70%"; Hit description=NAD -binding site; Nucleotide sugar epimerase
  Pfam annotation: Domain name=Epimerase; Domain location=105-256; Score=-9.7; E_value=1.5e-05; Accession=PF01370.11; Description=NAD dependent epimerasedehydratase family
  Pfam annotation: Domain name=NAD_binding_4; Domain location=107-261; Score=-96.2; E_value=0.021; Accession=PF07993.2; Description=Male sterility protein
  Pfam module annotation: Pfam domain module=Epimerase::NAD_binding_4; Domain location=105-256::107-261
MSSSTGLIFRGHEAQPMDDAYYPKPQKPWLSFRYLLREQRLHFLLLGIVLATLFFFLLPSGLHDPFPTPYLEPTRWPTNSPSYDVVSVHSVGKIPLGIKRKGLRIVVTGGAGFVGSHLVDRLIARGDSVIVVDNFFTGRKENVMHHFGNPNFELIRHDVVEPLLLEVDQIYHLACPASPVHYKFNPLVLIHKTNVVGTLNMLGLAKRVGARFLLTSTSEVYGDPLEHPQKETYWGNVNPIGELRKGESNQPRFLACETRGTS

SEQ ID NO: 123448 - protein, 491 aa, Glycine max
  Coding DNA Sequence Number=SeqID_6670
  Gene Ontology: Mol. function=transferase activity, transferring glycosyl groups; Cellular component=cytoplasm; Biological process =metabolic process
  Homolog annotation: Hit_ID=Q8S999; Match level="QueryCoverage=95%, HitCoverage=97%, E-value=0.0, Identity=72%"; Hit description =Glucosyltransferase-10
  Pfam annotation: Domain name=UDPGT; Domain location=33-491; Score= -37.5; E_value=9.9e-09; Accession=PF00201.9; Description=UDP -glucoronosyl and UDP-glucosyl transferase
QALASHILSLGKMQSKEETRNMSSLGTILKPHAVCVPHPTQGHINPMLKLAKLLHFKGFHITFVNTEYTHKRLLKSRGPDSIKGLPSFRFETIPDGLPEPLVDATQHIPSLCDSTRRTCLPHFRNLLTKINDSDAPPVSCIVSDGVMSFTLDAAEELGVPQLLFWTPSACGFMCYVQFGQLVEKGLVPLKDSSCITNGYLETTIDWIPGIKEIRLRDIPSFIRTTDVDDFMLEFLQWECGRARGASAIILNTFDAIEHDVLDAFSSILPPVYSIGPLNLLVKDIDDQDLNAIQSNLWKEELECVEWLDTKESNSVVYVNFGSITVLTNEQLIEFAWGLADSNKSFLWVIRPDVVGGENVVLPPKFVEQTKNRGLLSSWCPQEQVLAHPAIGGFLTHSGWNSTLESVCGGVPMICWPFFAEQQTNCRFCCKEWGIGLEIEDVKRDKIESLVRELMDGEKGKEMKKKGLQWKELAKSAASGPNGSSFLNLENL

SEQ ID NO: 123449 - protein, 92 aa, Glycine max
  Coding DNA Sequence Number=SeqID_6671
  Gene Ontology: Mol. function=hydrolase activity; Biological process =aromatic compound metabolic process
  Homolog annotation: Hit_ID=O22248; Match level="QueryCoverage=61%, HitCoverage=16%, E-value=9e-15, Identity=57%"; Hit description =Putative phospholipase
MGVECGVRLACDEYALFGIDYEEHGRSEGARCYIKKIDNIVNNCYNFFKSVSELQEYKDREPHGPVHGPRSVYPGQAQVENSIRNVENQHEP

SEQ ID NO: 123450 - protein, 277 aa, Glycine max
  Coding DNA Sequence Number=SeqID_6672
  Homolog annotation: Hit_ID=Q27DV3; Match level="QueryCoverage=61%, HitCoverage=62%, E-value=1e-07, Identity=22%"; Hit description =Hypothetical protein precursor
  Pfam annotation: Domain name=Omt_N; Domain location=15-88; Score= -10.0; E_value=0.0032; Accession=PF02409.9; Description=O -methyltransferase N-terminus
MSAVEFSCFKVQTYISIQNCSRNEPLFLDPYAGCFVPHNSPKDVIQDLHPYCLATKFIDDKLLHTVSLIDGLKQLILLTDGMDTRPYRLQLPSSILIFDISPESVFRIAAEKLKGVGAKMPKGCIFYHIPLESSDIEQAMQFKGYNGSRPSIWALQGFPVMTLANFEEVLSMISSLAMKGSLFVGELPACVAETDIEIKSNTRQWVDKLFMSKGFRVEIINYKGFAERSGKDFVSGHYNNILFVAEQLLHSDDQMESWRREFQRIENEGDEEGFEEL

SEQ ID NO: 123451 - protein, 219 aa, Glycine max
  Coding DNA Sequence Number=SeqID_6673
  Gene Ontology: Mol. function=structural constituent of ribosome; Cellular component=intracellular; Biological process=translation
  Homolog annotation: Hit_ID=Q1STF7; Match level="QueryCoverage=79%, HitCoverage=93%, E-value=4e-84, Identity=90%"; Hit description =Ribosomal protein L18e
  Pfam annotation: Domain name=L15; Domain location=122-149; Score =13.7; E_value=0.067; Accession=PF00256.13; Description=Ribosomal protein L15
  Pfam annotation: Domain name=Ribosomal_L18e; Domain location=44-218; Score=446.3; E_value=4e-131; Accession=PF00828.9; Description =Eukaryotic ribosomal protein L18
  Pfam module annotation: Pfam domain module=L15::Ribosomal_L18e; Domain location=122-149::44-218
MVVGNVYLARKCKLMSQLGGVMQQWRQATPSAMGIDLKAGGKSKKTKRTAPKSDDIYLKLLVKLYRFLVRRTGSNFNAVVLKRLFMSKVNKPPLSLSRLIRYTKGKEDKIAVVVGAVTDDIRVYEVPALKVTALRFTETARARIEKAGGECLTFDQLALRAPLGQNTVLLRGPKNAREAVKHFGPAPGVPHSHTKPYVRAKGRKFERARGRRNSRGFRV

SEQ ID NO: 123452 - protein, 117 aa, Glycine max
  Coding DNA Sequence Number=SeqID_6674
MEEEFSLQEKNITMKIIHMVIDYMLKIQIQNLFQQLFLNPVFCKCLSFEAALLDSSLTSSKSSLAQAIGNPNRGEAGRAVEYQGLDRFQRNNPPSFNGGYNLDGAQNWIRKLRNFFE

SEQ ID NO: 123453 - protein, 165 aa, Glycine max
  Coding DNA Sequence Number=SeqID_6675
  Gene Ontology: Mol. function=nucleic acid binding; Cellular component= viral capsid
  Homolog annotation: Hit_ID=Q2QNL3; Match level="QueryCoverage=88%, HitCoverage=18%, E-value=1e-10, Identity=29%"; Hit description=Zinc knuckle family protein
  Pfam annotation: Domain name=zf-CCHC; Domain location=75-92; Score =32.6; E_value=1.4e-06; Accession=PF00098.13; Description=Zinc knuckle
MVDSEICKQIYTPQQYHKEIRKKRPQYRPPNKQPSRKKNPTSRYSIRASNSRKPTLNKERHVRKLRDNKTYTKQLECYACHQPGHYSRDCPNKTNLFIREAELIKRCRMNLIPIDETVSTDSKIYSIVSWSDYTSKKEEVNKDYKILNEFTRNEYTNHYPVTILL

SEQ ID NO: 123454 - protein, 41 aa, Glycine max
  Coding DNA Sequence Number=SeqID_6676
MTNANYLQESLHSVSNGNLSWVIRKVPRHSGSQKEALLRNP

SEQ ID NO: 123455 - protein, 140 aa, Glycine max
  Coding DNA Sequence Number=SeqID_6677
MLLSELSHAATIVEAMPCHSAMALGKNSAMQDAQKTELRKNKVVEKYLGTVARCHDGDKVAKRDKVAKTKLRRRRREREQNRARVLIFLNKYNPNEKGQYVKGRMPRVSYQTNKISPVTAIMEVKPNGLHYLHDKTFSTN

SEQ ID NO: 123456 - protein, 125 aa, Glycine max
  Coding DNA Sequence Number=SeqID_6678
  Gene Ontology: Mol. function=phosphoenolpyruvate carboxylase activity; Biological process=carbon utilization by fixation of carbon dioxide
  Homolog annotation: Hit_ID=Q8S569; Match level="QueryCoverage=99%, HitCoverage=41%, E-value=3e-49, Identity=70%"; Hit description=PEP carboxylase
MLFAKGDPGIAALYDKLLVSEELWPFGKRLMSMFEETKSLLLQVAGHKNLLEGDPYLKQILRLHDSHITTLNVLQAYTLKRFRDPDYHPAVELVKFKPTSDYAPGMEDTRILTMKGIVVGMQNTG

SEQ ID NO: 123457 - protein, 416 aa, Glycine max
  Coding DNA Sequence Number=SeqID_6679
HHLSVALGSASAFARNALSLPLCFGFYWFPDGNYPYYPQLGPSPSLSRPPLTSPSHRVSTWDFLNFFDNFDNGYPSYPPRFGSSVSNPDSKEVREREGILEFEDEAEHKMMKKKNKEFVLLKKEKKNMGEDKGFGVGVRDFGEGPSNTKTVSLQQVNSSEGSSKAVRFHDGNDNGSVKKEINSIPNTVASEEHGAKKGVSFKIDEAIVMTMDNDSSVLSSITTLSVHGTKDLPSNFGKEVALLLEVYKPPYRSRVPALRGDVDSSKMEVGGTRKKKKYKKMVQGNMESSSSDFAKPSFPAKKRVQVSQNLLSETPMKNLKIGDSLSEINKEKEGTEKVLVKESERPLQSEKDNPVLSPFFWSREENNGKMLSQQTDEDQIIDDSTPNPPSFSDLKDSDDEIHSNVDLMVSVGLTNK

SEQ ID NO: 123458 - protein, 68 aa, Glycine max
  Coding DNA Sequence Number=SeqID_6680
  Homolog annotation: Hit_ID=Q9LS23; Match level="QueryCoverage=51%, HitCoverage=6%, E-value=7e-09, Identity=80%"; Hit description =Arabidopsis thaliana genomic DNA, chromosome 5, BAC clone:F10E10
LPFAAFASLLVETVVKLDSVIEEVEELGRLACFKEYITDDKIIVSCETPQVDVLKDHDKPSRDGYDYE

SEQ ID NO: 123459 - protein, 41 aa, Glycine max
  Coding DNA Sequence Number=SeqID_6681
MEERRKSHRRWRRGSQARKFKKEGYARSPVVIQWQTPQIFG

SEQ ID NO: 123460 - protein, 342 aa, Glycine max
  Coding DNA Sequence Number=SeqID_6682
  Gene Ontology: Mol. function=DNA binding; Cellular component=nucleus; Biological process=regulation of transcription
  Homolog annotation: Hit_ID=Q8LRL4; Match level="QueryCoverage=98%, HitCoverage=99%, E-value=1e-118, Identity=62%"; Hit description=Nam -like protein 11
  Pfam annotation: Domain name=NAM; Domain location=6-136; Score=312.8; E_value=6.1e-91; Accession=PF02365.6; Description=No apical meristem (NAM) protein
MGGATLPPGFRFHPTDEELVGYYLKRKVEGIEIELEVIPVIDLYKFDPWELPEKSFLPKRDLEWFFFCPRDRKYPNGSRTNRATKAGYWKATGKDRKVVCQSNPSTVGYRKTLVFYLGRAPLGDRTDWVMHEYRLCDDLGQATPCFQGGFALCRVIKKNEKASASQGEHKGKRAGSSSINGSDTSVKFSSEPFSNSGDASSQASHLNNESRYSSPITSPYNVAPMGEFNQASVETTNPSNFWISPDMILDSSKDYSQLQNAMAECFPRYDLPSVMAPWQSLEHPETSSSLSYSNFNGEVEFADNLSQIGCTRQWNSMDLYGNGDVPYDGYDQVNSISYPEPF

SEQ ID NO: 123461 - protein, 216 aa, Glycine max
  Coding DNA Sequence Number=SeqID_6683
  Gene Ontology: Mol. function=electron carrier activity; Biological process=electron transport
  Homolog annotation: Hit_ID=Q9LS22; Match level="QueryCoverage=79%, HitCoverage=32%, E-value=3e-64, Identity=68%"; Hit description =Arabidopsis thaliana genomic DNA, chromosome 5, BAC clone:F10E10
  Pfam annotation: Domain name=UPF0005; Domain location=1-191; Score =70.4; E_value=5.9e-18; Accession=PF01027.11; Description =Uncharacterised protein family UPF0005
MCASSSYMRFFPCIKKNYDYGVNIFLLTYNLVAVSGYRIDNVFKMAHERFSNIAIGVAICLLMSLLVFPNWSGEALHNSTASKLEGLAKSLEACVNEYFYGEMETSGDKKSSEDIYEGYKAVLDSKSTDETQALHASWEPRHLCRKFPWQQYVKVGTVIRQFGYTVVSLHGCLKTEIQCSKGNLIHVSKLATDAEYVRIDQCSTLTEYTLGRNDEL

SEQ ID NO: 123462 - protein, 412 aa, Glycine max
  Coding DNA Sequence Number=SeqID_6684
  Homolog annotation: Hit_ID=Q01FV7; Match level="QueryCoverage=46%, HitCoverage=93%, E-value=2e-43, Identity=48%"; Hit description =Homology to unknown gene
  Subcellular localization annotation: CTP_CleavageSite=52; ConfidenceScore=5.45e-01
MVEGAADLPVPVSVNSFSPGSPVHSSNGMPYTHSVSSPSPVAAKFTDAAICSLSEKKEYSFVGLRGLDPVHVLEETLLEGIDDVNLVLVAKELHRPDATRHCLGKEGGVADLILQGRGEEELDVEGGGRERGRTSTVSCTKLLNFFSFTLLSAAVSLKELMAATLTLLKLPILPNKPLLPRPSTSKLVPFPSIYSKLNIPKDSNPQNLPFLDQNIDALKPDALAVGGEFGILEGRSFALIHPIVMGSFFLYTLWAGYLGWQWRRVRTIQNDINELKKQVKPNPVTPDGKPVEEAAPSPVELQIQQLTEERKELIKGSYKDRHFNAGSILLGFGVLESVGGGVNTWFRTGKLFPGPHLFAGAAITALWALAAALVPSMQKGNETARNLHIALNAVNVLLFVWQIPTGIDIVFK

SEQ ID NO: 123463 - protein, 275 aa, Glycine max
  Coding DNA Sequence Number=SeqID_6685
  Gene Ontology: Mol. function=hydrolase activity; Cellular component =soluble fraction; Biological process=aromatic compound metabolic process
  Homolog annotation: Hit_ID=Q76E11; Match level="QueryCoverage=85%, HitCoverage=74%, E-value=3e-99, Identity=71%"; Hit description =Soluble epoxide hydrolase
  Pfam annotation: Domain name=Abhydrolase_1; Domain location=92-275; Score=2.7; E_value=0.0049; Accession=PF00561.10; Description =alphabeta hydrolase fold
  Pfam annotation: Domain name=DLH; Domain location=54-251; Score= -80.6; E_value=0.097; Accession=PF01738.9; Description=Dienelactone hydrolase family
  Pfam module annotation: Pfam domain module=Abhydrolase_1::DLH; Domain location=92-275::54-251
MGVAKESGAGEGGGMCGLRWGEGFGSEEKEGERQKVEKKKMEKIEHKTVRTNGINMHVASIGSGPVVLFLHGFPELWYTWRHQLLSLSAVGYRAIAPDLRGYGDTDAPPDASSYSALHIVADLVGLLDALGIERVFLVGHDWGASIAWHFCLLRPDRVKALVNMSVVFRPRNPNRKPIQSLRAIMGDDYYICRFQKPGEVEEEFARAGAARIIKTFIASRDPRPPCVPKEIGFGGSPDLRIDLPSWLTEEDVNYYASKFEQKGFTGGLNYYRAMD

SEQ ID NO: 123464 - protein, 103 aa, Glycine max
  Coding DNA Sequence Number=SeqID_6686
  Subcellular localization annotation: CTP_CleavageSite=27; ConfidenceScore=5.16e-01
MAFSLGTVQTVKEIGMRRRMMSTKALPADTSSQRAVRERSSIIASAFPFLPFRSFQDASCGFLYRTKLTYFNVPDEKNLYVFYINQTLSFIRLFEVNLFLYCC

SEQ ID NO: 123465 - protein, 94 aa, Glycine max
  Coding DNA Sequence Number=SeqID_6687
  Homolog annotation: Hit_ID=Q9LS22; Match level="QueryCoverage=86%, HitCoverage=14%, E-value=1e-13, Identity=47%"; Hit description =Arabidopsis thaliana genomic DNA, chromosome 5, BAC clone:F10E10
MAMASNESRRMVTGNLMKRVLALGDKLRVFLSLAWESVWKMGRDDPRRVIYAFKVGFSLTLVSLLYLLEPFFKGLGENVIWAVMTVVVVFQFTA

SEQ ID NO: 123466 - protein, 231 aa, Glycine max
  Coding DNA Sequence Number=SeqID_6688
  Gene Ontology: Mol. function=RNA-directed DNA polymerase activity; Biological process=RNA-dependent DNA replication
  Homolog annotation: Hit_ID=Q1T0R3; Match level="QueryCoverage=34%, HitCoverage=40%, E-value=2e-20, Identity=54%"; Hit description =Hypothetical mitochondrial protein atmg00310
EQSVERPTIREVVEMLAQAKKPNAFQKQLPRKVADNLIGMQRSFLWGGGSEQRKIAWVKWETICLPKQKGGLGIKDIRTFNKVLLEKWRWDLFHQSKELWARILASKYGGEQYGGWAVGIKFISGRINGLELDGNGTFLGEGPYLTMRSAYILLQGNSEEGNMDDIFKDLWKLKIPAKASIFAGRRKLHLIFSLTAAKPNILVGIPIMDRHLGGLSYKSKAPFSAAQQWDE

SEQ ID NO: 123467 - protein, 47 aa, Glycine max
  Coding DNA Sequence Number=SeqID_6689
MASNPKTLTFEEVAKHNNKKDCWIIINGKGCDAVQKPHVNLQYSVLS

SEQ ID NO: 123468 - protein, 254 aa, Glycine max
  Coding DNA Sequence Number=SeqID_6690
  Homolog annotation: Hit_ID=Q1SHI0; Match level="QueryCoverage=95%, HitCoverage=74%, E-value=7e-69, Identity=54%"; Hit description =Probable extensin [imported]-Arabidopsis thaliana, putative
  Subcellular localization annotation: CTP_CleavageSite=59; ConfidenceScore=5.78e-01
FSSSSSSSLPTSLVHNATLSTSPPEKHTRVPVSSPTHSPKIIKQSDPSPMHSPNNNRTTASPPSPLTLPPSQLMAEPNIPQQPDPKTVLVQKTIDRPKPWLTGATGSHKNHGKHVTVKESESKEKGIHRKLSQSEESGMRVITIAGENRGAYMELIQSPKKHDPKYLHKKGNSNINVDGVESAEEGNVNKNQKGRTSSSFPMAAYMNSNVQCVNNSLLYHTSCSHHNPGVRLSLSKKPFGEGFHLKEHADGHNT

SEQ ID NO: 123469 - protein, 85 aa, Glycine max
  Coding DNA Sequence Number=SeqID_6691
MARTRGLGRAIGRVVGRDRTADEDVGDVPERRRPTASARRLRVHQMTTEGRDMAEDVADMTDDVPEQPTEAPEMRADAQGADSGE

SEQ ID NO: 123470 - protein, 253 aa, Glycine max
  Coding DNA Sequence Number=SeqID_6692
  Gene Ontology: Mol. function=transcription factor activity; Biological process=regulation of transcription, DNA-dependent
  Homolog annotation: Hit_ID=Q75G59; Match level="QueryCoverage=56%, HitCoverage=27%, E-value=2e-18, Identity=35%"; Hit description =Expressed protein
  Pfam annotation: Domain name=CDT1; Domain location=52-167; Score =48.2; E_value=2.8e-11; Accession=PF08839.1; Description=DNA replication factor CDT1 like
MEQNACKELSKIASNFKCEKVLETVDESIVCPTPQKNEEPLTVKSKEGQTNLPEKYSTLADLFGHMSCSLRLLYLCKKAPIFKMFAARKFSHAHLAQMKYILPKSVYIDRVLVHDKKSLCVVPDMKITLKFEVVKDCFGESADLALRRYFKSKLIDFFDMHPEDMPTQKSTSSYKPAKRVLDFSLMEDNDGLGIEMDKLESIRALHESSRGCSEDCNSFGSVSAPQEEGTHACILEKSGINEMFMTTGKIMMK

SEQ ID NO: 123471 - protein, 481 aa, Glycine max
  Coding DNA Sequence Number=SeqID_6693
  Gene Ontology: Mol. function=enzyme inhibitor activity; Cellular component=cell wall; Biological process=cell wall modification
  Homolog annotation: Hit_ID=Q7XAF8; Match level="QueryCoverage=98%, HitCoverage=98%, E-value=1e-126, Identity=45%"; Hit description =Papillar cell-specific pectin methylesterase-like protein
  Pfam annotation: Domain name=PMEI; Domain location=27-183; Score =65.5; E_value=1.7e-16; Accession=PF04043.6; Description=Plant invertasepectin methylesterase inhibitor
  Pfam annotation: Domain name=Pectinesterase; Domain location=243-467; Score=405.0; E_value=1.1e-118; Accession=PF01095.10; Description =Pectinesterase
  Pfam module annotation: Pfam domain module=PMEI::Pectinesterase; Domain location=27-183::243-467
MAFNSLYFRILCVSLVLSFLTSISIADNNHEAVPPETICYSTLDPSYCKSVLANQNGSIYDYCRISVRKSLSQSRKFLNNMYSYLQHPSSYSQPTIRALEDCQFLAELNFEYLSTTRGTVDKASDVLPTSQASDVHTLLSAVLTNQQTCLDGLQTSASDSRVKNDLSSQLSENAKLDSVSLYLFTKAWDSENKTSTSWQHQNERLPLKMPNKVRAIYDSARGQGKKLLQTMDDNESVLVSDIVVVSKDGSGNFITINDAIAAAPNNTAATDGYFIIFIAEAVVAQGFVAMNITFRNTAGPSKHQAVAVRNGADMSTFYSCSFEGYQDTLYTHSLRQFYRECDIYGTVDFIFGNAAVVLQNCNMYPRLPMSGQFNAITAQGRTDPNQNTGISIQNATIKAAQDLAPVVAPAGWHEWNGNFSLSTLYYAEYDNTGPGSNTANRVNWPGYHVIDATDAANFTVSNFLVGNDWVPQTSVPYQTSL

SEQ ID NO: 123472 - protein, 606 aa, Glycine max
  Coding DNA Sequence Number=SeqID_6694
  Gene Ontology: Mol. function=enzyme inhibitor activity; Cellular component=cell wall; Biological process=cell wall modification
  Homolog annotation: Hit_ID=Q7XAF8; Match level="QueryCoverage=89%, HitCoverage=97%, E-value=0.0, Identity=59%"; Hit description =Papillar cell-specific pectin methylesterase-like protein
  Pfam annotation: Domain name=PMEI; Domain location=26-184; Score =75.7; E_value=1.5e-19; Accession=PF04043.6; Description=Plant invertasepectin methylesterase inhibitor
  Pfam annotation: Domain name=Pectinesterase; Domain location=249-547; Score=705.9; E_value=2.8e-209; Accession=PF01095.10; Description =Pectinesterase
  Pfam module annotation: Pfam domain module=PMEI::Pectinesterase; Domain location=26-184::249-547
  Subcellular localization annotation: CTP_CleavageSite=68; ConfidenceScore=5.18e-01
MAFKNLSALTLCVSLVLPFLTPISIAANNRAVVPPETICNSTVNPSFCKTVLVNQNGSIVDYGRISVRKSLSQSRKFLNSVNSFLQGKSTLSLPTIRALEDCQFLAELNFEYLSNALDAVDKVSNVLPTNQAEDQQTLLSAVLTNEETCLEGLQQTTTSDQRVKSDLISSLSNDKKLHSVSLGLFTKGWVPEKKISTSWKTNGRHLGFRNGRLPLKMSNRVRAIYDSARGHGRKLLQDNSQSVLVRDIVVVSQDGSGNFTTINDAIAAAPNNTVASDGYFLIFVTQGVYQEYISIAKNKKNLMMVGDGINQTIITGDHNVVDNFTTFNSATFAVVAQGFVAVNITFRNTAGPSKHQAVAVRNGADMSTFYSCSFEGYQDTLYTHSLRQFYRECDIYGTVDFIFGNAAVVLQTCNLYPRLPMSGQFNAITAQGRTDPNQNTGTSIHNATIKPAADLAPSVGIVKTYLGRPWKEYSRTVYMQSFMDSFINPSGWREWSGDFALSTLYYAEYNNTGPGSNTTNRVTWPGYHVINATDAANFTVSNFLDGDNWLPQTGVPYIRRTIACRRSEEVKSGIPAGSDLRYGLTRRRSADDVVFSSVCPSSSRQS

SEQ ID NO: 123473 - protein, 361 aa, Glycine max
  Coding DNA Sequence Number=SeqID_6695
  Gene Ontology: Mol. function=histone-lysine N-methyltransferase activity; Cellular component=nucleus; Biological process=chromatin modification
  Homolog annotation: Hit_ID=Q0WU37; Match level="QueryCoverage=44%, HitCoverage=16%, E-value=3e-42, Identity=51%"; Hit description =Trithorax 3
  Pfam annotation: Domain name=PWWP; Domain location=186-263; Score =1.3; E_value=0.013; Accession=PF00855.8; Description=PWWP domain
MIIKRSLKTGLQKRKQYKPENCDNLAIQKEPKPENCDNSAVQKKQRVNEVSSAEGGASGSCEVQSNSNSVDSNGTIQGLVPQSEEVQPPRPSRGRAKKLPRRFSDSVFYERFGLVDENKNTLQYIADKRNQRDSPCSPNSIESGDFEFSVKTVKKTVNGGRKLLVKEKSNDAAGHSSNSEGVDGNVWAKCGKKHPAWPAVVIDPLLQAPKSVLSCCVPGALCVMFFGYSKIGKQRDYAWVKQGMIFPFLEFMDRFPGQTQLYRGKASDFHAAMDEAYLVENGIFEVQLGAEQNMDGVDSCVNQECADQDQDTISCAGCGLMSPCKTMKKIKDSSCATQHFCKPCAKVLPRLILDFFNFLTG

SEQ ID NO: 123474 - protein, 555 aa, Glycine max
  Coding DNA Sequence Number=SeqID_6696
  Gene Ontology: Mol. function=enzyme inhibitor activity; Cellular component=cell wall; Biological process=cell wall modification
  Homolog annotation: Hit_ID=Q7XAF8; Match level="QueryCoverage=94%, HitCoverage=93%, E-value=0.0, Identity=64%"; Hit description =Papillar cell-specific pectin methylesterase-like protein
  Pfam annotation: Domain name=PMEI; Domain location=24-180; Score =104.9; E_value=2.4e-28; Accession=PF04043.6; Description=Plant invertasepectin methylesterase inhibitor
  Pfam annotation: Domain name=Pectinesterase; Domain location=243-540; Score=708.1; E_value=6.1e-210; Accession=PF01095.10; Description =Pectinesterase
  Pfam module annotation: Pfam domain module=PMEI::Pectinesterase; Domain location=24-180::243-540
  Subcellular localization annotation: CTP_CleavageSite=65; ConfidenceScore=5.38e-01
MASKFCFFLFLILLPLFASSDTVPNPTTPVSPGTACKSTPDPSFCKSVLPPQNGNVYDYGRFSVKKSLSQARKFLNLVDKYLQRSSSLSATAIRALQDCRTLGELNFDFLSSSFQTVNKTTRFLPSFQADDIQTLLSAILTNQQTCLDGLKDTASAWSVRNGLTVPLSNDTKLYSVSLALFTKGWVPRTKAKAMHPTKKQLGFKNGRLPLKMSSRTRAIYESVSRRKLLQATVGDEVVVRDIVTVSQDGSGNFTTINDAIAAAPNKSVSTDGYFLIYVTAGVYEENVSVDKKKTYLMMVGDGINKTIITGNRSVVDGWTTFSSATLAVVGQGFVGVNMTIRNTAGAVKHQAVALRSGADLSTFYSCSFEGYQDTLYVHSLRQFYSECDIYGTVDFIFGNAKVVFQNCKMYPRLPMSGQFNAITAQGRTDPNQDTGISIHNCTIRAADDLAASNGVATYLGRPWKEYSRTVYMQTVMDSVIHAKGWREWDGDFALSTLYYAEYSNSGPGSGTDNRVTWPGYHVINATDAANFTVSNFLLGDDWLPQTGVSYTNNLI

SEQ ID NO: 123475 - protein, 175 aa, Glycine max
  Coding DNA Sequence Number=SeqID_6697
MVWQSPNQKSIFSKLEFDSLVTIYIKAFKIVETDASDIGYGGILKQRVHGQDHNTSRAPQIHYLTTLPVNSYRKVVMSPKASGISLRGGRSTGKGARLALPEPTIKKSSTSSGSPTQAGSSTQKTNLEGSSTQIASIKPEPSTQESPKPATAKQTSADYAWPIETLQALQDMDGT

SEQ ID NO: 123476 - protein, 278 aa, Glycine max
  Coding DNA Sequence Number=SeqID_6698
  Homolog annotation: Hit_ID=Q1SFJ9; Match level="QueryCoverage=38%, HitCoverage=49%, E-value=7e-18, Identity=47%"; Hit description =Leucine zipper, homeobox-associated; Homeodomain-related
MVSIFKQLQELDDRIQKPLEQAQSCTTGYKAANSTESETTTMKSEQEVKQSNTSIERSQHIVGVLWECDRSIKAEQYFEMEDEPAQLNFVEHVDGSLTSSEDWAVIINGGTSGPKTVKRRLSLYHIKIKEWVSLLVGSKSFIAIVLKRDMLGAPSNIAAFFLLLLFFLCIPLPRAFSFIASPGAASFGWTPFPFEFRKNVFRKVSGRSVLPEVTKRLPEEHFFRKTSGKRLPGTFRKKWFIRKNSGRRALPEEVSKFRKTFRKNPSSGVFRKNHFFRK

SEQ ID NO: 123477 - protein, 121 aa, Glycine max
  Coding DNA Sequence Number=SeqID_6699
  Homolog annotation: Hit_ID=Q6KA75; Match level="QueryCoverage=70%, HitCoverage=7%, E-value=2e-11, Identity=44%"; Hit description =Peroxisomal membrane protein-like
MGGWNDKRNDDIDALLGADEKLEDFDDDQENKENKEGVVVEEEMDEAFNFRLNGIGSNVATGWWFVNEGEAVLLAHHDGSCTYYDITNSEARNNARILISGSFSNRYERITRCAKGWESNQ

SEQ ID NO: 123478 - protein, 497 aa, Glycine max
  Coding DNA Sequence Number=SeqID_6700
  Gene Ontology: Cellular component=intracellular; Biological process =signal transduction
  Homolog annotation: Hit_ID=O82459; Match level="QueryCoverage=86%, HitCoverage=100%, E-value=0.0, Identity=79%"; Hit description=Rac GTPase activating protein 2
  Pfam annotation: Domain name=PBD; Domain location=116-162; Score =48.1; E_value=2.9e-11; Accession=PF00786.18; Description=P21-Rho -binding domain
  Pfam annotation: Domain name=RhoGAP; Domain location=179-316; Score =101.5; E_value=2.5e-27; Accession=PF00620.17; Description=RhoGAP domain
  Pfam module annotation: Pfam domain module=PBD::RhoGAP; Domain location=116-162::179-316
MTRLFRSKSCGLVEFNAAPPSPLFHDVKSEDEDNEEDEDEDEEEEEEEELDSDDDVSSNPVSTALMNPGSKVENKGWRGGHGCQSNQFAMLDILLAALKKSLVTCSVEREDISSLDISWPTEVRHVSHVTFDRFNGFLGLPSELELEVPKRVPSASAKVFGVSAKSMQCSYDERGNSVPTILLMMQKRLYSEGGLKAEGIFRINADNSQEEFVRDQLNRGLVPLGIDVHCLSGLIKAWFRELPTGVLDSLTPEQVMHCNTEEDCTNLMKLLPSTEAALLDWAINLMADVVEREQFNKMNARNVAMVFAPNMTQMADPLTALIHAVQVMNFLKTLILKTLRERDESIAKARQLSSLLDSPSCKGDSHPLEVNNKEESCEEETEETCSTKPPVKSKFSRTSTLGRIEWCIEEKLWRSEEKGNGVGELESVSDSSSPSRYENGPLENRYRGIYDSEHWVKLRNGVRRLCRHPVFQLSKPTKKRASLGIVNTREGGGEAWA

SEQ ID NO: 123479 - protein, 856 aa, Glycine max
  Coding DNA Sequence Number=SeqID_6701
  Gene Ontology: Mol. function=catalytic activity; Biological process =guanosine tetraphosphate metabolic process
  Homolog annotation: Hit_ID=Q84LE7; Match level="QueryCoverage=99%, HitCoverage=100%, E-value=0.0, Identity=67%"; Hit description=RelA -SpoT like protein RSH1
  Pfam annotation: Domain name=HD; Domain location=169-276; Score=64.3; E_value=3.8e-16; Accession=PF01966.12; Description=HD domain
  Pfam annotation: Domain name=RelA_SpoT; Domain location=361-483; Score=141.4; E_value=2.4e-39; Accession=PF04607.7; Description =Region found in RelA  SpoT proteins
  Pfam annotation: Domain name=TGS; Domain location=548-607; Score =93.2; E_value=7.9e-25; Accession=PF02824.11; Description=TGS domain
  Pfam module annotation: Pfam domain module=HD::RelA_SpoT::TGS; Domain location=169-276::361-483::548-607
MASASSLSVSLECVNACKPWRGDGNVRFDCSLLSCAWKAPRALTGFLASTAHPHQCSNLSNGRNGRRNRYNFGCEAFSVGGSCHDEPLDIILFEGYSRSISCQNAPRRWQLCCSLASNTVTEFSAESLWEDLKPAISYLSPKELELVYNAFMLAFKAHDGQKRRSGEPFIIHPVEVARILGELELDWESIAAGLLHDTVEDTNVVTFERIEEEFGATVRHIVEGETKVSKLGKLKYKNENDSVQDVKAEDLRQMFLAMTEEVRVIIVKLADRLHNMRTLSHMPPHKQTSIAMETLQSELENLSFMYTNAEDYAKVKRRVAELYKEHEKELLEANKMLMKKIQDDQFLDLLTVKTKVRAVCKEPYSIYKAVLKSKSSISEINQIAQLRIIIKPKQCIGVGPLCNPQQICYHVLGLIHGIWTPIPRSVKDYIATPKPNGYQSLQTTVIPFLYESMFRLEVQIRTEEMDLIAERGIAAHYSGREFVTGLVGSATPSSKSSRGKTVCLNNANIALRIGWLNAIREWQEEFVGNMSSREFVDTITRDLLGSRVFVFTPRGEIKNLPQGATVIDYAYMIHTEIGNKMVAAKVNGNLVSPAHVLANAEVVEIITYNALSSKSAFQRHKQWLQHAKTRSARHKIMKFLREQAARSAADITTEAVNDFVTDSDGDSESEELSKGSSGSKYTWGKMFVNGAEISTLGRSETVLQSNNGSAWIPKVNGKHNKHVQHESFNGKGEMLLQGNLVAKIIQVNIPRYKEVLPGLESWQAQKIASWHNMEGHSIQWLSVVCIDRKGMMAEVTAAMATAGIAICSCVAEIDGGRGMAVMVSACSKVDLILGVLGWSTGCSWPSLMEDRGVLEC

SEQ ID NO: 123480 - protein, 74 aa, Glycine max
  Coding DNA Sequence Number=SeqID_6702
LGRIDGDPVLRETRIWATWEYVSSDGGGQQGMSGTWRYVAGVRRPWGRQASSWQSTDKRNKDHKARRLVVAGQL

SEQ ID NO: 123481 - protein, 252 aa, Glycine max
  Coding DNA Sequence Number=SeqID_6703
  Gene Ontology: Mol. function=transcription factor activity; Cellular component=nucleus; Biological process=regulation of transcription, DNA-dependent
  Homolog annotation: Hit_ID=Q75UJ4; Match level="QueryCoverage=74%, HitCoverage=95%, E-value=6e-55, Identity=50%"; Hit description=ERF -like protein
  Pfam annotation: Domain name=AP2; Domain location=103-167; Score =146.7; E_value=6.4e-41; Accession=PF00847.10; Description=AP2 domain
MTRLSICHNYLTSNWKRRVVGTRMWLGCHVSMPPLFCSYKRALPLWFFSLTKKTKEASMCGGAIIADFIPRQRPRTLTASELWPKRSEPQPQPPPPPVKRQRKNLYRGIRQRPWGKWAAEIRDPRKGVRVWLGTFNTAEEAARAYDKEARKIRGKKAKVNFPNEDDPLPQYGSCKSLNLEFGYDLNQTGLFPSSNADENCGSHVAYSVTEANNKVEKLSEELMAYENLMRFYQIPENVVGDLWAFPDTSPPL

SEQ ID NO: 123482 - protein, 696 aa, Glycine max
  Coding DNA Sequence Number=SeqID_6704
  Homolog annotation: Hit_ID=Q1RSU0; Match level="QueryCoverage=87%, HitCoverage=67%, E-value=1e-155, Identity=50%"; Hit description=Tudor
MGSTDKELEEQLLDAGNKLLLDPPSSAEELLPLLDVMTPFLPFSSSLQIKLRVGVVPSANSDASDGCWAWFQWCCCGYDRGYTSFTVQVECCLSRVEQSPIDSMQNALSPSLKALIADKLLSHSDDDVKVAVASCISEITRITAPEAPYDDAQMKDVFQLIVSSFENLHDKLSQSYAKRTSILETVAKVRSCVVMLDLECDTLILEMFQHFFKNIREHHPENVFSSMETIMTLVLEESEDISLDLLSPLLTSIKKDNKEVFPIAQKLGERVIESCATKLKPYLVQAVKSLGISVDDYSSVLASICQDTSDDLEKNDTCVTSEHVEDKSDSAKQSLEESTHVVNKDSSEVTPSQPENTDVKISPKLVMSNGVVEDNVLADSKSIKKQEDADCSSHSEGLNLSGHEVHNDLDTEKVDTSKQKPEQATKRQRKKSSSSTKSAKPSKGQVAANEKETEKMLDFESNSKKVPSSSHEDHSAEAAGPPENDNGIDAKISSPKACNDESEVVASPPSESFSDENHSKKIGRTKKKDGDAEGVSKVSEGASDSEAKPVRRSVKRALGQKSDAKKTNVVDSVKKGSGTANDADAKKHPAKKLDENKKDRDGSSSRQMEDKKKGRWGKANSEANVVKSSAMDVDKEMVSSLRSGTKSTKNENSEETPKTNVKRKRSSGKENESNAKEYGQNLVGLRVKVWWPDDRE

SEQ ID NO: 123483 - protein, 247 aa, Glycine max
  Coding DNA Sequence Number=SeqID_6705
  Homolog annotation: Hit_ID=Q1SXB1; Match level="QueryCoverage=99%, HitCoverage=29%, E-value=1e-40, Identity=42%"; Hit description=Tudor
VLYDDGDEETLNLVKEKWKVIEADSDADEEERSDCADLDVSTDMPLKKKGKTSAGESTKQGKMDVSSKSGAAASNRSKGASTKSSQKSKDGNKSKDSKANSKSEDGVNRKSKDSTPKNGSSKSIVAAKKMSNKSKNTDTSKTSESKDDGSIKQKPSAKFKHETPKSGKSKQETPKAAISKGKPVKSGGKTDVNGTSKARSGLLKRKDSENENSDVSAGEREDAKGKSANSSKAKGSELKSGKKRRKT

SEQ ID NO: 123484 - protein, 883 aa, Glycine max
  Coding DNA Sequence Number=SeqID_6706
  Gene Ontology: Cellular component=mitochondrion
  Homolog annotation: Hit_ID=Q1RSU0; Match level="QueryCoverage=99%, HitCoverage=100%, E-value=0.0, Identity=48%"; Hit description=Tudor
MAMASTDTELEEQLLEAGNKLLLDPLSSVEDLLPLLDQVESCLSRVEQSPNDSMRNALSPSLKALITDKLLRHSDDDVKIAVASCVSEITRITAPEAPYDDDQMKVVFQLIVSSFENLHDKLSQSYAKRTSILETVAKVRSCVVMLDLECDALILEMFQHFFKAIREHHPENVFSSMETIMTLVLEESEDISLDLLSPLLASIKKDNEEVFPIVQKLGERVIECCATKLKPYLVQAVKSLAISVDDYSAVLASICQDTSDDLEKNDTCVTSELVEDKSDSAKQSPEESTHVVEKDSREVAPSQPENTGVSISPKLVMSNGVACVGEDNALADSKSIKKQEDADFSNHSEGLNISGEEVHNNLDTEKVDNSKQKPKQATKRRRKKSSSSTKSAKPSKGHVAANERETEKMLDHESNNKKVPSPPHEDHSVEAAGPPENDNEIDAKISSPKACNGESEVVASPPRESLYDENLSRKHGRTKKKDGPIKEGAAEDASKVSGGASDSDAKPVRQSVKKALGLKSDVKKASVVDSVKKGSGAVNDADAKKHSAKKLDENKKGSGGSSSRQMEDKKKGRRGKANSETDVAKSSAMELDKEMVSSPRSGTKSTKNENSEDTPKTNESSTKEYGQNLVGLQVKVWWPDDHEFYKGVIVSFDSAKKKHKVLYDDGDEETLNLVKEKWKVIEADSDADKEERSDHTDLDASTDMPPKKKGKRSAGESTKQGKMDASSRSGGAATSSRSKGASTKSSQKSEDGNKSIDSKTISKPEDEVGRKSKASAPKSGSNKSIVTDKKMSNKSKNIDTSKTSESKDDDTSTPKPSAKSKQETPKSGKSKQETLKTLISKRKPFKSGGKTDVNGEVENAKGKTSKFIKGTSELKSGKKRWRS

SEQ ID NO: 123485 - protein, 70 aa, Glycine max
  Coding DNA Sequence Number=SeqID_6707
MAGQLATTSGVFCATWLCPANSSLGVTVCYIIHAKYVKKSPHDLYFFNHTFLSMPTLSRSEEIYTVSVVS

SEQ ID NO: 123486 - protein, 262 aa, Glycine max
  Coding DNA Sequence Number=SeqID_6708
  Gene Ontology: Mol. function=DNA binding; Cellular component=nucleus; Biological process=regulation of transcription, DNA-dependent
  Homolog annotation: Hit_ID=Q84WP6; Match level="QueryCoverage=75%, HitCoverage=58%, E-value=2e-77, Identity=67%"; Hit description=NAC domain-containing protein 43
  Pfam annotation: Domain name=NAM; Domain location=13-142; Score =280.1; E_value=4.3e-81; Accession=PF02365.6; Description=No apical meristem (NAM) protein
MKMSICVNGESQVPPGFRFHPTEEELLQYYLRKKVSNEKIDLDVIRDVDLNRLEPWDIQEMCKIGSSPQNDWYLFSHKDKKYPTGSRTNRAIIVGFWKATGRDKVIYSNGKIIGMRKTLVFYKGRAPNGQKSDWIMHEYRLDDINNTNEMEHGWVVCRVFKKKNVPLKTLDSPKSMTMNMFTESDYCGGFTNWESLDQLVASQLNGQTETYCSDLQFPAFLSSSYIATTTHIAPTIQDYPSYDIDLWNHCASRVSNTPNVTL

SEQ ID NO: 123487 - protein, 98 aa, Glycine max
  Coding DNA Sequence Number=SeqID_6709
GRSLPPSSPRRARLLPPEATALWRNLLEGPSGPAFEEVTETHGLRKNTSFRLPPHYGISRIAQACFLLISETSRDFIYCATKDAKYLKAANQRLHVIK

SEQ ID NO: 123488 - protein, 60 aa, Glycine max
  Coding DNA Sequence Number=SeqID_6710
KKKEGVETRVVITKRAGRTKSVSYLCFPLISDESPETSQKSKGSRLARSVKFRNVAEVEK

SEQ ID NO: 123489 - protein, 40 aa, Glycine max
  Coding DNA Sequence Number=SeqID_6711
MEENTSPIDKGQWQPHSPNHPIVEGKIPRIATGNSCCIKT

SEQ ID NO: 123490 - protein, 166 aa, Glycine max
  Coding DNA Sequence Number=SeqID_6712
  Homolog annotation: Hit_ID=Q6Z1V9; Match level="QueryCoverage=31%, HitCoverage=40%, E-value=2e-09, Identity=85%"; Hit description =Chloroplast ORF133; ORF within trnI intron
MSPHGGDMDGGEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLKKDLRVSRVVPGGSLNAFLFLLIGVISQRLAMVKKKGEQAHLESAVQRIVVCCVREG

SEQ ID NO: 123491 - protein, 89 aa, Glycine max
  Coding DNA Sequence Number=SeqID_6713
  Subcellular localization annotation: CTP_CleavageSite=41; ConfidenceScore=5.18e-01
MNCVFVHVSSTFEFGAMRSDCLVQFSILTLFRSPMNCDFVHVSSTFEFGAMRSDCLVPFSILNHFGAPLIAFSFMCPPPSSLELCVVIA

SEQ ID NO: 123492 - protein, 98 aa, Glycine max
  Coding DNA Sequence Number=SeqID_6714
  Gene Ontology: Mol. function=transition metal ion binding
MGERLEDMICDLGQESFQQAHAPMYEGLQSDSKKPLYTGCKNSLTLLLAVLSLVNVKAIYGWSDKSFSSLLQVVHDLLPEENMLPKSYYQAKKILCSM

SEQ ID NO: 123493 - protein, 103 aa, Glycine max
  Coding DNA Sequence Number=SeqID_6715
MRKWTLGKEKGTVKVVTVTVYTITFEKLDEGSVNGRKQVFSIVKVKTLVEDAEVDTSFLIVRPMGQKEAKRKSKGKGVGTSINPVDLKGVEEAMREKNFSMPN

SEQ ID NO: 123494 - protein, 555 aa, Glycine max
  Coding DNA Sequence Number=SeqID_6716
  Gene Ontology: Mol. function=malate transporter activity; Biological process=response to aluminum ion
  Homolog annotation: Hit_ID=Q9LS22; Match level="QueryCoverage=94%, HitCoverage=95%, E-value=1e-147, Identity=53%"; Hit description =Arabidopsis thaliana genomic DNA, chromosome 5, BAC clone:F10E10
  Pfam annotation: Domain name=UPF0005; Domain location=47-519; Score =513.6; E_value=2.2e-151; Accession=PF01027.11; Description =Uncharacterised protein family UPF0005
MVTKVHAGVEMAMAGHESGSTGNWRKKVVFIGDQLRRFPSLAWKNVWKMGRDDPRRVIHAFKVGFSLTLVSLLYLLDPSFQGIGENVMWAVMTVVVVFEFTAETPSIMASISNILLVAGATLCKGLNRGLGTVIAGALAFSVKYVANGFDNGSDRVFHALFIGTTVCIIGAATSYMRFFPYIKKNYDYGVLIFLLTFNLITVSSYRTENLFKMIYQRFYTIAIGCAICLLMSLLVFPNWSGEALHNSTAFKLEGLAKSIEACVNEYFNGEMEASNDKISSEDIYKGYKAVLDSKTTDETLALHASWEPRHSCHKFPWQQYVKVGTVLRQFGYTVVALHGCLKTEIQTPPSVRVLFKNPCTRLASEVSKVLIELANSIRNHRRCYQEILSNGLQEALQDLNTAIKSQPRLFVGTSSDSQDSDMLAIAAAHAAGLTNQGNGSLSSAKIDSPTLQECKAQCIEQQQQPKEVAERKVLRHQLSIIAITSLEFSEALPFAAFASLLVETVAKLDLVIEEVEELGRLARFKEYRLDDKIIVTCETPRVDILEDHIPTRGAE

SEQ ID NO: 123495 - protein, 57 aa, Glycine max
  Coding DNA Sequence Number=SeqID_6717
MELATKYMTIRKLKQEKKLVGGGAPVDDLEVPPIVDDDDEGRGNAIKEDEDHLEDDR

SEQ ID NO: 123496 - protein, 103 aa, Glycine max
  Coding DNA Sequence Number=SeqID_6718
MELHQVVINSYGLWQSQDISSFSARISTTAMVDITTVIMSLIKDTIFRSLIRVIIVATYPSVEGRRVTRGCVFQERNTRGVATNVYLRKTSEKPEKTWSTNFK

SEQ ID NO: 123497 - protein, 68 aa, Glycine max
  Coding DNA Sequence Number=SeqID_6719
MSRNFTDYATIPSSASGRLRNFTDYAIMFPFDSRHVVKLHGLLNDGCQVPRSGQAKVACHQTMIPGQI

SEQ ID NO: 123498 - protein, 168 aa, Glycine max
  Coding DNA Sequence Number=SeqID_6720
  Gene Ontology: Mol. function=helicase activity
  Homolog annotation: Hit_ID=Q1SRJ5; Match level="QueryCoverage=89%, HitCoverage=18%, E-value=2e-35, Identity=46%"; Hit description =Probable helicase [imported]-Arabidopsis thaliana-related
MDSNKIYHHGRDLTYAEYVSKFIYVAHKRCWQPRKQGNTIGRLIWVPPSTRELFYMRMMLSSVKGSQSYKDIRTIDNVVYHTFREACFAKGFLVSDQEFVGALGEANTWGTPHFLRKLFVKLLFMNTMDRPEYVWEQTWQWMADDIVFNHRRQGIQLTNKETMHLCLT

SEQ ID NO: 123499 - protein, 185 aa, Glycine max
  Coding DNA Sequence Number=SeqID_6721
MAKFDPEVVLEFYANSWPTEEGVRDMYALSQFLGDPLVLEEGQQCEFSQRRNRADGFDEEAIAQLLCTPGQDFARTAVGRRVRIMRTSMTTLTQTWMTLLLNNVLPSDHNYDLPLPKCQLVYAILTRMSVHVAQVIADAIYLFVGMPPTRHPLDPDKSNRALGFPALITGLCQSFGILVTPTKVI

SEQ ID NO: 123500 - protein, 133 aa, Glycine max
  Coding DNA Sequence Number=SeqID_6722
MSRWHAKRSCALSVPYDFQFLKIKGRGTLGVTFAPKPLHLPNLQHLCILCFLCTVSLHLHCIISRTIQVKVISFRVSQCRILGVKTPVVLSGNRDERAKRACALSLFIAAVKILDFQMNALSGPCRAMHIHPC

SEQ ID NO: 123501 - protein, 78 aa, Glycine max
  Coding DNA Sequence Number=SeqID_6723
MDAVTKCAWLRKARLSVRLSTKNMIKLHGLSDSASLSHRHLSKRMSVHPPKMKSLSVVGAHSEFFRERLYSMSTDELA

SEQ ID NO: 123502 - protein, 147 aa, Glycine max
  Coding DNA Sequence Number=SeqID_6724
MGVPNNCSFDTLKRRMHNTLQLTNDQLLDEIYYQQPFIDAELLCTIIRTPDAILNLLQSTITPTHDAIMYYNGKWNIPRQGEFLGYSFAGTNLIIRFGIPPGCGMKKLKDLIKQVAPIGVSPNGIHGSQLVRRLFFRQSVILSIPKI

SEQ ID NO: 123503 - protein, 109 aa, Glycine max
  Coding DNA Sequence Number=SeqID_6725
MMLSRGWCRNLPFGGRATQDSPVRLPRKENTWNRHQRLFEENIRKNQKWPMNFENKRFGSHLRARKGRQERGSCSYVPSIAMRNSDLRSSLKSEKVMRSVDFRLLNDSF

SEQ ID NO: 123504 - protein, 45 aa, Glycine max
  Coding DNA Sequence Number=SeqID_6726
MLRGTRIRATQECVSSVERVVPGDMSRGSGDLGDVRWGAVAQNHA

SEQ ID NO: 123505 - protein, 145 aa, Glycine max
  Coding DNA Sequence Number=SeqID_6727
  Subcellular localization annotation: CTP_CleavageSite=88; ConfidenceScore=5.32e-01
MGKNKGRQSHSAAKQIMVKGTTSGSGKSQISATSGLAGCLDVVQANQNAYTASQDNLVGKVLVKKAGTSSAKTDDVAHQVFDNLSECSAESESSPEVSCTLGDNDSTTNNDSSHSCGSKSSPQLDDNKAPTPWVNLFKDNRSPSK

SEQ ID NO: 123506 - protein, 252 aa, Glycine max
  Coding DNA Sequence Number=SeqID_6728
  Gene Ontology: Mol. function=methyltransferase activity; Biological process=DNA methylation
  Homolog annotation: Hit_ID=Q21TW6; Match level="QueryCoverage=56%, HitCoverage=26%, E-value=3e-48, Identity=66%"; Hit description=DNA -cytosine methyltransferase
HEARGHMASDLARYLFSASFAHLSGYCPTLDVFPPKLLPDHINAHVDRESEVIPFKDRFRVQCRNEPSTTVVAHIAKDGHYYIHYDPSQCRSLTVREAARLQTFPDNYLFAGNRTEQYTQVGNAVPPLLAHKLAKTVRSLLNEMNKRRRRQTGYILKKMPAGNILAAMQPFLNHLRSLLARVLQGTLPYDRHTPAERMNHLRMARVASDISLEFLQPEIFIGTGSGCIAAPFMSVPEAPMDEYHCFVLREHQ

SEQ ID NO: 123507 - protein, 418 aa, Glycine max
  Coding DNA Sequence Number=SeqID_6729
  Gene Ontology: Mol. function=endonuclease activity
  Homolog annotation: Hit_ID=Q07LJ9; Match level="QueryCoverage=99%, HitCoverage=46%, E-value=1e-180, Identity=74%"; Hit description =Endonuclease
  Pfam annotation: Domain name=ResIII; Domain location=79-303; Score= -28.9; E_value=0.012; Accession=PF04851.6; Description=Type III restriction enzyme, res subunit
MAETPTREQVEEKAIEIATIFGYTGDLRNIVTEAMISVDTRMGAGVSLVDVTAKHDDQWVHKRDDVAWTYAESYGNFLLKEGWPPQMVQSLSDVTTRILGHLQDPLSEGTTWNRRGLVIGHVQSGKTANYTGLIARAADAGYKFIIVVAGIHNNLRKQTQQRIDEAFIGRSSDPEDRRNIGVGLAPGYPHPATLTNINEDFNKNTAEKSGWKINDFSKPIILVIKKNVTTLTALHKWLKELNAEGDGRISDVPMLLIDDEADNASINTNKEDLDPTRTNAMIRRILGLFAKSCYVGYTATPFANIFINPDAYGDDVREELFPRDFIYCLDAPTTYFGAEKVFLDEATSQSIVRPIDDCENLIPYAHKRDDPVPELPPSLYRALDEFIVARAIRNLRGQTGKHCSMMVNVSRFVPVQKA

SEQ ID NO: 123508 - protein, 72 aa, Glycine max
  Coding DNA Sequence Number=SeqID_6730
MEMLEKALQLMRVTYRHGNGAGTGIVSPFHDPDSPTYTRTHLRYSSGMGRLVTSPSPIPTPVKMLDNPRTRI

SEQ ID NO: 123509 - protein, 278 aa, Glycine max
  Coding DNA Sequence Number=SeqID_6731
  Gene Ontology: Mol. function=GPI anchor binding; Cellular component =membrane; Biological process=cell adhesion
  Homolog annotation: Hit_ID=Q1SN67; Match level="QueryCoverage=83%, HitCoverage=82%, E-value=8e-72, Identity=62%"; Hit description=Beta -Ig-H3/fasciclin
  Pfam annotation: Domain name=Fasciclin; Domain location=73-207; Score= 83.8; E_value=5.2e-22; Accession=PF02469.12; Description=Fasciclin domain
  Subcellular localization annotation: CTP_CleavageSite=26; ConfidenceScore=5.40e-01
MKQATLFSFSLFLLLSSTTMAISPAPAAAPKTPPTPKATAPSPKPLVPTLPQSPDSPDSVPDDITRILKKAKMFSVLIRLLKTTEIMNNINSQLITAKSGGITILAPDDSAFSNLKAGFLNSLNEGQKIELVQFHILPEFVSSSNFDSLSNPVQTVAGKDPARLPLNVNALGNSVNISTGVVNATILGVVYSDNKLGIYHVDKVLLPLDFFLTNKAPALAPTTLAKAPKAAKENSSDDDQEETDQNHNKSGAVSLVSLGGAMLMSIGIALVTVATMWS

SEQ ID NO: 123510 - protein, 567 aa, Glycine max
  Coding DNA Sequence Number=SeqID_6732
  Homolog annotation: Hit_ID=O22111; Match level="QueryCoverage=38%, HitCoverage=44%, E-value=5e-74, Identity=66%"; Hit description=6 -phosphogluconate dehydrogenase
  Pfam annotation: Domain name=6PGD; Domain location=162-369; Score =107.7; E_value=3.3e-29; Accession=PF00393.9; Description=6 -phosphogluconate dehydrogenase, C-terminal domain
MADLSCSISTMDRIEAAIAKLTVAQDATVAKLDEILQKLALLENRYKKVQSFMEESLNSFSSQGRVRENQTMEAEVPGEDGSKYTLGSDEKPMFGRGYEFSIHDHTVSHRHRSFELDHSDSEDANAVSFEVMRKNPFWVYDREALQLFSKFNKGRLQLEHILLGNVDVLMAAHLGAVFMPQGLRHFLGIDTFDPEGYLKDAGKWTVQQAAELSIVAPTIEASLDARFLSGIGVIVTDQPVDKQKLIDDVRKALHAAKICSYAQEMNLIRAKSIEKGWDLKLGELARIWKRGCVIRAIFLDRIKQAYEENPNLANLLVDSEFAKEIIDHQSAWRRVVCLAINSGISTPGMSVSLAYFDTILLASNYDDAICYVETMNLDGETNLKLKQAPEATSKLQEDSNFQNFRAIIKCEDPNAGVAYGRGVTEVERALPRRHESHPGQELKKISGSKSSIKEPNANVIQNFLRLLVVCHTAMPKVDEEIGKVSYEVESPDEAAFVIVARELGFEFYERTHTTISLRELDIISDQKINKSYKLLNILEFTSARKRMSVIVKDVEGNYYYLAKGLTV

SEQ ID NO: 123511 - protein, 301 aa, Glycine max
  Coding DNA Sequence Number=SeqID_6733
  Gene Ontology: Mol. function=GPI anchor binding; Cellular component =membrane; Biological process=cell adhesion
  Homolog annotation: Hit_ID=Q1SN67; Match level="QueryCoverage=74%, HitCoverage=81%, E-value=2e-77, Identity=68%"; Hit description=Beta -Ig-H3/fasciclin
  Pfam annotation: Domain name=Fasciclin; Domain location=98-232; Score= 84.0; E_value=4.6e-22; Accession=PF02469.12; Description=Fasciclin domain
MAPSLFLIHIIKLHLIDNSCIAAAFGVLCSLSTFSFPLSNYILQRCLKQHLQQHQKTPPTPKATAPSPKPLVPTIPQSPDSPDSVPDDITRILKKAKMFSVLIRLLKTTEIMNNINSQLITAKSGGITILAPDDSAFSNLKAGFLNSLNEGQKIELVQFHILPEFVSSSNFDSLSNPVQTVAGKDPARLPLNVNALGNSVNISTGVVNATVLGVVYSDNKLGIYHVDKVLLPLDFFITNKAPASAPSTLAKSPKAAKDNSSEDDQEETNQHQNKSGAVSVVSIGGATLMSLAIALVATMLS

SEQ ID NO: 123512 - protein, 103 aa, Glycine max
  Coding DNA Sequence Number=SeqID_6734
MEMLEKALQLMRVTYRHGNGAGTGIVSPVPDPDSSTYTRIRLRYSSGMGRLVTSPSPLPTPVKKLNNPRTRIRSTRIFPVKIRTGLGGYPRVRISLSCLVTQC

SEQ ID NO: 123513 - protein, 813 aa, Glycine max
  Coding DNA Sequence Number=SeqID_6735
  Homolog annotation: Hit_ID=Q1SN78; Match level="QueryCoverage=33%, HitCoverage=30%, E-value=3e-95, Identity=66%"; Hit description =Rhodopsin-like GPCR superfamily; D-galactoside/L-rhamnose binding SUEL lectin; Galactose-binding like
  Pfam annotation: Domain name=Fasciclin; Domain location=299-433; Score=97.8; E_value=3.2e-26; Accession=PF02469.12; Description =Fasciclin domain
  Pfam annotation: Domain name=Glyco_hydro_35; Domain location=349-641; Score=-145.8; E_value=8.2e-06; Accession=PF01301.10; Description =Glycosyl hydrolases family 35
  Pfam module annotation: Pfam domain module=Fasciclin::Glyco_hydro_35; Domain location=299-433::349-641
MAKRIEDDQKFKNKKSKKRKNLEASNQLENDRKKSKKEMISKTREEVEADYKAASLAPDVMEKKQMQTETLSAVFETYFRILKKTMQSIGARPEANAGALSAAVEPLPLLAPCLKGLAKFSHLIDLDFMGDLMNHLRVLASGSSNSGNTSDKCSKCLTVSERLQCCIVAFKVMRNNLDALNVDLQDFFLHLYNLVLEYRPGRDQGEVLAEALKIMLCDDKQHDMQKTAAFIKRLATLSLCVGSADSMAAPLKPPQPAPTIPAAAPQQPLVPSLPQSPSDSTPESTPALDIVGILRKAKSFNILIRLMKTTQLINQLNAQLLTTKSGGITILAPDDSAFSELKAGFLNSLSDGQKLELLQFHVLSDYVSSSNFDTLTNPVRTLAGAKPGKVELNVISYGGSVNISTGEVNTTITGIIYTDKHLAIYKVGKVLLPTDFFAVTKAPAKSPSLAPEPSSDTAKAPKADKDESSSSDSSQVNPTEQNSGTEKIAVYGMWMSLGLGALLMTKAPKADKENSLCPDSSESSQINSTNENSGTVKIYAHGKFVSFGDVVPHRPVEDLAFAVARFYQRGFNFKLLKIGNEMMPQLFWLVAWKQYHGGTNFGRTTGGPFISTSYDFDTPIDEYGIIRQPKWDHLKNVHKAIKLCEKALLATGPTITYLGPNIEAAVYNIGAVSAAFLANIAKTDAKVSFNGNSYHLPAWYVSTLPDCKSVVLNTAKINSASMISSFTTESLKEEVGSLDDSGSGWSWISEPIGISKAHSFSKFWLLEQINTTADRSDYLWYSSSIDLDAATETVLHIESLGHALHAFVNGKLA

SEQ ID NO: 123514 - protein, 363 aa, Glycine max
  Coding DNA Sequence Number=SeqID_6736
  Gene Ontology: Mol. function=protein kinase activity; Cellular component=nucleus; Biological process=protein amino acid phosphorylation
  Homolog annotation: Hit_ID=Q656B0; Match level="QueryCoverage=96%, HitCoverage=40%, E-value=5e-73, Identity=43%"; Hit description =Putative Noc3p
  Pfam annotation: Domain name=NOC3p; Domain location=205-298; Score =142.6; E_value=1.1e-39; Accession=PF07540.2; Description=Nucleolar complex-associated protein
MGKKKDRIVLPPELPPEIPDEEVEVSDDDLQFVKENRAYASLLSTLDTRSITKYNVSPCPIYVLDFSRVSVHVTRVADAKDDALEKLYEKRMQKNALKKEKEETGLQVDRVDALPIKTLDGKIHYQTATKTVLENDPSEERTGENVKKDKGMVKLTKAEKRAKLKKMRKDAKQQGKEVAKAEVEETPQAAVLAEVKEDLTAEEAFESKKHKLAELGNALLTDPESNIKFLKEMVQISKDNDDTIVKLGLLSLLAVFKDIVPGYRIRLPTEKELDMKVSKTVRKMRYYESTLLSAYKAYLQRLVALEKKPLFQHVAVRCICSLLDANPHFNFRESLLDATVRNISSPNDAIRLCCMFAVDHTSL

SEQ ID NO: 123515 - protein, 119 aa, Glycine max
  Coding DNA Sequence Number=SeqID_6737
  Gene Ontology: Biological process=cell adhesion
  Homolog annotation: Hit_ID=Q1SGD7; Match level="QueryCoverage=84%, HitCoverage=39%, E-value=3e-23, Identity=58%"; Hit description=Beta -Ig-H3/fasciclin
MVMPPDLVVRNCALNWWINWVVFMRRIRMLNDFAFLRIPTMSSAGVLSGVESLGAAAGMVGAGWAGLRGAEAGDNWAKVVVEYINEISITSEKDKTDCFFNMVFVLLKEGLDDIGNDCK

SEQ ID NO: 123516 - protein, 377 aa, Glycine max
  Coding DNA Sequence Number=SeqID_6738
  Gene Ontology: Mol. function=zinc ion binding; Cellular component =cytoplasm; Biological process=apoptosis
  Homolog annotation: Hit_ID=O04261; Match level="QueryCoverage=85%, HitCoverage=71%, E-value=1e-100, Identity=53%"; Hit description =Putative zinc finger protein
  Pfam annotation: Domain name=zf-MYND; Domain location=201-239; Score =53.2; E_value=9e-13; Accession=PF01753.9; Description=MYND finger
MTYVNAVHVFSTFYSSPKHMDTDAIGDLVDKLKAIQNDNVEDQDQDDDFDDDDDDDEEHEPITLGFVDKPKNNWSLRRQYFPSKAGGVPAWLDPLNIPSGGSFVCDNCGDPLQFLLQVYAPTEKETTFHRMLFVFMCPSMKCLLRDQHEQWKRHPEKPSKRFSVVNYLALIHFTHLNALSIIKATNLLAVENLCLLSAALCDWCGTWKGDKLCSGCRQARYCSEKHQVMSWRTGHKIACQQMKVSSPVSGPNKSGTASLDSHKVGSKNLWPEFEITIEDESDYKRDMSEENTLANSLISRNRTDDTMNSLLDNFQGDDDKKSWASFQQCIAKAPEQVLRYYRNTNAKPIWPVSSDLPSNADIPSCSYCTGPMCCEFQ

SEQ ID NO: 123517 - protein, 136 aa, Glycine max
  Coding DNA Sequence Number=SeqID_6739
MNSVITVLYFNGRVYEDNDGVIFEGSKKAIQIKRGISFNALKKKIGDKDVAGGSMFHSANSLTSCGNYLSNDETQPATNMSNLHIDEDDDDDDDYLVSNSYVEESVDEDDSVDGISETDDEVTDIPQPVRIVHPAE

SEQ ID NO: 123518 - protein, 117 aa, Glycine max
  Coding DNA Sequence Number=SeqID_6740
PFGSGSWELHFGAIGDGDELGGDIGERFSVTMRGAVFYVATVKLFMQIASMNSATLRHATRGCVASATGDSTDVATCNGVLAMQGGVAGQTSASPRVSGTAFAGEPAFAVQLKTPGP

SEQ ID NO: 123519 - protein, 60 aa, Glycine max
  Coding DNA Sequence Number=SeqID_6741
MTASKGKTHFEVVLPLELPFKVAPDWRCPTPHKQRGKDRNTQLPLQKHYPRENPIDPDRA

SEQ ID NO: 123520 - protein, 138 aa, Glycine max
  Coding DNA Sequence Number=SeqID_6742
MEAMMSMRKMIEVNAVAVATIIVATEGGEVLGSSSGPHFVQIHSKHSFPPYGLPPNYTPPNVAHTPNENVNNSTLVLIESQQPQSGQAQVPQPMGETHEVPRDHTLADSEPCPGYAIEGKAVGGVPLPNTLGGPQFRP

SEQ ID NO: 123521 - protein, 254 aa, Glycine max
  Coding DNA Sequence Number=SeqID_6743
  Gene Ontology: Mol. function=protein binding; Cellular component =integral to membrane; Biological process=xylan catabolic process
  Homolog annotation: Hit_ID=Q949G7; Match level="QueryCoverage=97%, HitCoverage=80%, E-value=6e-63, Identity=32%"; Hit description =HcrVf3 protein
  Pfam annotation: Domain name=LRR_1; Domain location=11-34; Score =12.3; E_value=1.4; Accession=PF00560.23; Description=Leucine Rich Repeat
  Pfam annotation: Domain name=LRR_1; Domain location=132-154; Score =7.6; E_value=11; Accession=PF00560.23; Description=Leucine Rich Repeat
  Pfam annotation: Domain name=LRR_1; Domain location=156-178; Score =13.6; E_value=0.72; Accession=PF00560.23; Description=Leucine Rich Repeat
  Pfam annotation: Domain name=LRR_1; Domain location=180-202; Score =16.6; E_value=0.091; Accession=PF00560.23; Description=Leucine Rich Repeat
  Pfam annotation: Domain name=LRR_1; Domain location=204-225; Score =9.3; E_value=5.1; Accession=PF00560.23; Description=Leucine Rich Repeat
  Pfam annotation: Domain name=LRR_1; Domain location=36-58; Score=6.1; E_value=21; Accession=PF00560.23; Description=Leucine Rich Repeat
  Pfam annotation: Domain name=LRR_1; Domain location=60-82; Score =10.6; E_value=2.9; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=11-34::132-154::156-178::180- 202::204-225::36-58::60-82
IFPTSLKKNNQLISLDLGENNLSGTIPTWVGEKLLNVKILRLRSNRFGGHITNEICQMSLLQVLDLAQNNLYGNIPSCFSNLSAMTLKNQITDPRIYSEAHYGTSYSSMESIVSVLLWLKGREDEYRNILGLVTSIDLSSNKLLGEIPREITSLNGLNFLNLSHNQVIGHIPQGIGNMGSLQSIDFSRNQLSGEIPPTIANLSFLSMLDLSYNHLKGKIPAGTQLQTFDASSFISNNLCGPPLSINCSSNVKTR

SEQ ID NO: 123522 - protein, 49 aa, Glycine max
  Coding DNA Sequence Number=SeqID_6744
MAIEGFTMRRGERKKGSALSATPPRSARVDRALSAHVAGLARASVRSRA

SEQ ID NO: 123523 - protein, 270 aa, Glycine max
  Coding DNA Sequence Number=SeqID_6745
  Homolog annotation: Hit_ID=Q8H348; Match level="QueryCoverage=42%, HitCoverage=34%, E-value=2e-18, Identity=43%"; Hit description =Putative fiber protein
  Pfam annotation: Domain name=DUF761; Domain location=23-264; Score =64.0; E_value=5e-16; Accession=PF05553.2; Description=Cotton fibre expressed protein
MDLFQNPSSLKSNKFETSVWIAKLVLMSVGVISTLVLLKVAIVPYTFHLLLSTLPQFCVSVRSWLTLPFLYIIVNFIIITIAASSNFPLFCNNHPKTFSDREGTTTTISDTVSHPTESENQTNEPKEEEKEVQQQQQEVVEEEEPEEEVVEESDGDDTLEATWRAIMEGQGKTMKPQLKKSDTWGARIAKAEPFHRNGEGGDDDPVAWAQKELKKSDTFNDRASLRRDKSMSPEELNRRAEAFIKKINNQMKLQRLESYQRFREMVNRGV

SEQ ID NO: 123524 - protein, 401 aa, Glycine max
  Coding DNA Sequence Number=SeqID_6746
  Gene Ontology: Mol. function=kinase activity
  Homolog annotation: Hit_ID=Q60D21; Match level="QueryCoverage=71%, HitCoverage=75%, E-value=1e-65, Identity=46%"; Hit description =Putative kinase interacting protein, identical
  Pfam annotation: Domain name=KIP1; Domain location=64-139; Score =31.9; E_value=2.3e-06; Accession=PF07765.3; Description=KIP1-like protein
  Subcellular localization annotation: CTP_CleavageSite=60; ConfidenceScore=5.13e-01
MERDPNMGKEKVVSNSTLLPSSTKGFKDKGIPNNSMPSWLLTNISVTTSYVETVPTFFKQSSMEWKEGRKKCEMKEKNSPIQTDLEERMKVLAMSTTEDEEMGDTFADRAETYYQKRPQLLSLLQDLYNGYITLSDRYIQTLAKHKHHSRHSSQVSTVDEGFSDQEEEASGVSHSDSDIESSISYQHPQHMMMPIGLPKSSMLDVDAIVAELLIRNIEYDMLMHEVGVMERRYCESSRKSELQKSLLEVLESERIVLLNENASLGYRVNTLVEENKELASESVFIKRKAGELAKCVLKMREDHRVYLLHRKIEDLQAQIHALEKRNKEYYDKLLRRDGHEDGKKGVALEVCVQMDKQKRFKWKDGNTSGMKKFHGKKSPPSLWKKLKNMDLLLCGTNPTCA

SEQ ID NO: 123525 - protein, 65 aa, Glycine max
  Coding DNA Sequence Number=SeqID_6747
  Homolog annotation: Hit_ID=Q9LUM8; Match level="QueryCoverage=87%, HitCoverage=44%, E-value=4e-07, Identity=43%"; Hit description=Blue copper-binding protein-like
MGLQAYQCSCLIMFYLCLTNPFIFLYAKGETYIVGDSYGWDDVLDFSNWRDGKEFHVGDVLGKLM

SEQ ID NO: 123526 - protein, 131 aa, Glycine max
  Coding DNA Sequence Number=SeqID_6748
MQTKNIFEIHNTQQEKIRITKGRKFTNLDRRTRRGSEEETTKKSNQPWRGRRRGENEADFGRKRSGGKIRRSLLEGGSIGNGEGHFHPFIDIAGCPNKNVVCSKQLSKLNPNNIIIVLLITNYSFASSDTI

SEQ ID NO: 123527 - protein, 441 aa, Glycine max
  Coding DNA Sequence Number=SeqID_6749
  Gene Ontology: Mol. function=oxidoreductase activity; Cellular component=endoplasmic reticulum; Biological process=metabolic process
  Homolog annotation: Hit_ID=Q8W2K0; Match level="QueryCoverage=96%, HitCoverage=94%, E-value=1e-151, Identity=63%"; Hit description =Forever young oxidoreductase
  Pfam annotation: Domain name=KR; Domain location=64-207; Score=-93.1; E_value=0.058; Accession=PF08659.1; Description=KR domain
  Pfam annotation: Domain name=adh_short; Domain location=61-218; Score= 26.9; E_value=9.4e-08; Accession=PF00106.15; Description=short chain dehydrogenase
  Pfam module annotation: Pfam domain module=KR::adh_short; Domain location=64-207::61-218
MATTTSSSSEEAPNTKKNKKERLGWIEWLRGWFYLVYEMLFQRIMASHLHNPMPLPPVNDLTCIVTGSTSGIGLEIARQLAQSGAHVVMAVRNTKAAQELIQKWQVDSEGLSIPLNVEVMQVDLLSLDSVTRFAEAWNARSAPLHVLINNAGIFSIGEPQKFSKDGYEQHLQVNHLAPALLSILLLPSLIRGSPSRIVNVNSIVKLVWKTFSFFCLGAFLVIPSPGRLVFPHCLLMHHVGFVDTEDMNVTSGKRKFSSLVGYSSSKLAEIMFSSILNKRLPAESGISVLCVSPGIVQTNVKQPLCICKSKAVHNDLPPYLRIASSFMVPRYARDLPKLVQAAYHLIPYFIFSAQEGARSALFAATDPQVPEYCDMLKADEWPVCAFISQDCRPANPSEEAHNVQTSYEVWEKTLEMIGLPSDAVERLLDGEEVKSHYRQEQ

SEQ ID NO: 123528 - protein, 150 aa, Glycine max
  Coding DNA Sequence Number=SeqID_6750
MKCFLPLVQERGAKIPAPVWELVAPAPPPPPCVSMVLHRMFHCESRYSAPKVLLSDTSYFLTCIPIIQTLAPQIPAKLLATPALLSTTNTQKSKNKNMYLRETLPRSSDVLQSLHEEDAHSQKVNPDGFQGCSSIYLALVSEPMTKSFMC

SEQ ID NO: 123529 - protein, 60 aa, Glycine max
  Coding DNA Sequence Number=SeqID_6751
MESLGFENLPVEERRTDEERKLGEKLATQLAQASRVASSRSNNLLVGASGPGCYLHPHFY

SEQ ID NO: 123530 - protein, 69 aa, Glycine max
  Coding DNA Sequence Number=SeqID_6752
  Gene Ontology: Mol. function=diaminohydroxyphosphoribosylaminopyrimidi ne deaminase activity; Biological process=riboflavin biosynthetic process
  Homolog annotation: Hit_ID=Q1S453; Match level="QueryCoverage=97%, HitCoverage=5%, E-value=9e-15, Identity=56%"; Hit description =CMP/dCMP deaminase, zinc-binding; Bacterial bifunctional deaminase- reductase, C-terminal
MEQSRGHRVVIIAAVGLHVEVRGGATTEFVNDVDDLDLHSIGALGIEVAFADDFVKGGEDDITEVGMGE

SEQ ID NO: 123531 - protein, 35 aa, Glycine max
  Coding DNA Sequence Number=SeqID_6753
MVTPGPQVYSSNLPNNWYQSRCMGINGHPRPAKQD

SEQ ID NO: 123532 - protein, 90 aa, Glycine max
  Coding DNA Sequence Number=SeqID_6754
IAPAGHPVDPKKSNRVPGLPPLITGLCQFYVVPVTLNNVIRPPTTRAFIKKYCAPRQAEGETPQQPGDGQQQATNAPPPPLEPLSSSTKR

SEQ ID NO: 123533 - protein, 59 aa, Glycine max
  Coding DNA Sequence Number=SeqID_6755
MGAKYLKVVKRGSHPNNGWSSDEIRGAKFVSAHLSLIERADNRMPSSPPALDDKRRRRR

SEQ ID NO: 123534 - protein, 246 aa, Glycine max
  Coding DNA Sequence Number=SeqID_6756
  Gene Ontology: Mol. function=RNA-directed DNA polymerase activity; Biological process=RNA-dependent DNA replication
MKADMEALKDQMTSMMEAMLSMKRLIESNVAAAVATNATAEADLTHPFAINQVNQPILDMLGQGGEVLGSTGGPHIGHNRNAYPYRLPPNYTLPTMHIPNENSNHVVPVTFEGQQPQLIGGTREEPREHAQAVEGKEKLDLIEERLRVVEGFGDYPFADMEELCLVPDVVMPPKFKVPNFDKYKGTTCPKNHLKMYCQKMGAYSRDEKLLMHFFQESLAGATVIWYTNLEASRIHTWKDLITAFIR

SEQ ID NO: 123535 - protein, 127 aa, Glycine max
  Coding DNA Sequence Number=SeqID_6757
MDLDRHFQRMNLRFYLLDGLNDPSLKNTYVASLLEEIQPELNKMVATAQIDFSTMSTGQIHQFTLEVVDKLCRQHQYFSDIMNRKAKYSRACKKPYLEIKCKEKTCHCSPKKKKALQTHTKEKRRPL

SEQ ID NO: 123536 - protein, 81 aa, Glycine max
  Coding DNA Sequence Number=SeqID_6758
  Homolog annotation: Hit_ID=P93042; Match level="QueryCoverage=97%, HitCoverage=9%, E-value=1e-15, Identity=48%"; Hit description=Root hair defective 3
YDAEANYFDEGVRSAKQKQLQEKLFQLVQPTFQIVLGYMRSGILDKFKEAFDKALNGGEGFSSAANKCIEIYMAQFDEGCA

SEQ ID NO: 123537 - protein, 174 aa, Glycine max
  Coding DNA Sequence Number=SeqID_6759
MNPKRIKVILEWPAPPTPLIELVRNYVPSWEDAQEMSFQTLPYFNILNTANTYGEGMMQSYPARALDRKLQVDWARDAREGPRVLMSLKVDFGSMEGEVSICLLHPIATSYSHTLCMLSQRALHGRARARLTSALSKGGKMRGVATNVYLWKTSEKPKEIGQNENPKFGSCIYA

SEQ ID NO: 123538 - protein, 86 aa, Glycine max
  Coding DNA Sequence Number=SeqID_6760
MEDTWTALSNSFMWLRKRAIMKHSSKLENGGHMNAQRNSFMGLRKRVRMEDCLEGPLLGNHETQLQLENGGHMNDNAIHSWGSEKG

SEQ ID NO: 123539 - protein, 84 aa, Glycine max
  Coding DNA Sequence Number=SeqID_6761
  Gene Ontology: Mol. function=oxidoreductase activity; Cellular component=glycerol-3-phosphate dehydrogenase complex; Biological process=electron transport
  Homolog annotation: Hit_ID=Q7N4S7; Match level="QueryCoverage=82%, HitCoverage=18%, E-value=9e-20, Identity=65%"; Hit description =Similar to probable D-amino acid oxidase
  Subcellular localization annotation: CTP_CleavageSite=53; ConfidenceScore=5.41e-01
MPQKGARGSSSAANARAAKYGESSISGVCRPICAAISAALPRAVVTPNPSCPSASHSQEYRGCAPNSGSPSAEAARSPVQQRMM

SEQ ID NO: 123540 - protein, 238 aa, Glycine max
  Coding DNA Sequence Number=SeqID_6762
  Gene Ontology: Mol. function=oxidoreductase activity; Cellular component=integral to membrane; Biological process=electron transport
  Homolog annotation: Hit_ID=Q9I478; Match level="QueryCoverage=97%, HitCoverage=55%, E-value=6e-58, Identity=52%"; Hit description =Probable oxidoreductase
  Pfam annotation: Domain name=DAO; Domain location=8-233; Score=-61.5; E_value=0.074; Accession=PF01266.14; Description=FAD dependent oxidoreductase
  Pfam annotation: Domain name=Pyr_redox; Domain location=8-109; Score=- 8.2; E_value=0.069; Accession=PF00070.17; Description=Pyridine nucleotide-disulphide oxidor
  Pfam annotation: Domain name=Pyr_redox_2; Domain location=8-238; Score=-12.4; E_value=0.0016; Accession=PF07992.4; Description =Pyridine nucleotide-disulphide oxidor
  Pfam annotation: Domain name=Thi4; Domain location=1-184; Score= -127.1; E_value=0.01; Accession=PF01946.7; Description=Thi4 family
  Pfam module annotation: Pfam domain module=DAO::Pyr_redox::Pyr_redox _2::Thi4; Domain location=8-233::8-109::8-238::1-184
MMSNLDCEVLIVGAGPAGMAAALAAAESGGQVRMIDDNPHPGGQIWRDGPQVVLPETANRYRQAVATKENIALQPGCKLVAQCGANRLAYEDADGCGVIRYQKLILCNGARELLLPFPGWTLPGVTGAGGLQAQIKQGLAIRGERVVIAGSGPLLLAVANSVKQAGGEVVLVAEQAPLWRLAAFAGDLWRWPGKLRQAFSLMPHRYRAGSRVQAALGQERLTAVRVNNGGRERTIACD

SEQ ID NO: 123541 - protein, 402 aa, Glycine max
  Coding DNA Sequence Number=SeqID_6763
MEMLTKGGPWVLRALRQGCVCPRFWRGSQRVDLVFDNPVELHRDSPRVDLGLHEPLEKVDLGFCESLKKRDSPRTDLRFDKPLEKQDSPRADLGFNEPLEKRDSLRVDLGFDEPVRLTKDATKSISVLDFFQGSLRADLGFDKPLEIQSGPKNNFVGCLCLTIGLRMFDKGYKEAIPAYEVFLGGLRHLVDSTSKYLVAPGALGNGLSMFIPHIVKGQGELKLWSLLGGCLLDDSLEVPGLFGAGQLGEQVCSSIALLRYVVYLKTFEVVNEIFGNVVVLEQRCFLGLVFVDNFPLHKLRGFEVELESLFQTNYARKYAMNCVFVGLSQNLFDGEVHLDYYFVTLEVWPKMSGRALLNVIEYVASEVDEKLVLPFHLYEGQKGLFAGDGGNGLLEGQKGLFA

SEQ ID NO: 123542 - protein, 401 aa, Glycine max
  Coding DNA Sequence Number=SeqID_6764
  Subcellular localization annotation: CTP_CleavageSite=46; ConfidenceScore=5.31e-01
MTKDAIHGHNFAAQHHFLSPFSLLASSFLSSCMPRGADQLAQASCLLNAKGCRVDTWFGLPFEFARFASDSIGHRGSTPAIVVAIAPTLPPSLVVPMQEVAHIAVEVSAPATSASPVVASLSTIVAALLSVGVTTTSAPMMSPPPFSAPPIPPSAVLALALTSTSFHPHVSLDHIYTSSNADSLRGIGYKPKQKTLGLACYGFYQSLSPTKFGDPGREWAKAPRGLSKVVSLEAEVAKWGATARIVWRVERPKVANSIVAFYDVVKSNQQLSFKVGNVLAKLLWTKLDGDELFEHCKYLHKEKKKPWPRACQGGCKPRGLTERVKVQAGGFRTEAVVQHEKGFHKAIRQAEFFAKDLDLGLFDPFKDVKDGVLLDDEDIAAKEKDAGEEQSAKEQNDDANV

SEQ ID NO: 123543 - protein, 215 aa, Glycine max
  Coding DNA Sequence Number=SeqID_6765
MADQESAHEETPYGPRYTPTYSPRAITLSPSTAHALSATPNESIEAPKAEETTDNLKGTTETGTIFKEELPSPKTCGLRAIKKVGMMLSSQGVDLMQSYLARALDKRLQEDWARDARDARESPRVLMSLRNIAPLELEGLGSSSSVDSFASWKMNGNGRRRKRERRRHFKEKMSLEEAHHHRRPWIRAWRKKEMNEGRGREEHKILCSKRALKSE

SEQ ID NO: 123544 - protein, 111 aa, Glycine max
  Coding DNA Sequence Number=SeqID_6766
MPSTICRDRAHKTPSGPEEVQQGPGVLVLITGLYQFYGVPVAPNRVIRLLLTGLLSRSTAPPGRRRARHHNSRQQTHRHHLQSSPQLIHKKDGSLPTTHGRPAGDQVQSQR

SEQ ID NO: 123545 - protein, 178 aa, Glycine max
  Coding DNA Sequence Number=SeqID_6767
MAPTRHPLDPDKSNRALGFPALITGLCQSFGVPIAPSKVIRPPITRAFIEKYCTQGQAQGDAPQAADAPPPHQAGPVGSFDTELYLRHLVHQQAANHRAHVQTHDCLYQLSLSLQSQGFTSFPCPTPDPFRAEVTWPGDWPEARAGEAPAEAPDEADEAREDEEMTDLLDFLGGSGAT

SEQ ID NO: 123546 - protein, 90 aa, Glycine max
  Coding DNA Sequence Number=SeqID_6768
MGVNLSDTGGALRKLHPEHSRRGDELINYGLCISAILGEKTCFREEKLSRSAFVTLPRHFREQICEDFSPFFTVLRSSTALTDRLSRYLT

SEQ ID NO: 123547 - protein, 60 aa, Glycine max
  Coding DNA Sequence Number=SeqID_6769
MANSHNSSTYPKGCYNGGSNAGGDGDVSGNDGGSDGGVVVAIGGDCGGSDGSDDDGGNKL

SEQ ID NO: 123548 - protein, 212 aa, Glycine max
  Coding DNA Sequence Number=SeqID_6770
  Gene Ontology: Mol. function=RNA-directed DNA polymerase activity; Cellular component=intracellular; Biological process=RNA-dependent DNA replication
MGEERHKEIKEEVDKLLKANFIREVKKVNDKWQICTDYTNLNKECHKDAYPMPSIDRLGDKASEFQVLSFLDAYSGYNQIRMHTPNEEKTTFIIEDANFCYRIRQNVEIYIDDMVIKSHSIAQHVNPNRATGGRTLESTRSATIANGERLSDYIKVILMMPKNQESRKIQRFKNQVSRIKTQESSFKNQDSRIIKIKIQDSRFKKQGKTQSR

SEQ ID NO: 123549 - protein, 121 aa, Glycine max
  Coding DNA Sequence Number=SeqID_6771
MTLISACYQAFHFTDSKKVYTDNHSGISARQRDSKVSKTDLVSAEDDVNLRVSTGLSAAIDEGCRRRHSTKVYMDNHSSISARQRDSKLNMTDLVSAEDDVNLRVSTGLSAAIDERRRRRR

SEQ ID NO: 123550 - protein, 184 aa, Glycine max
  Coding DNA Sequence Number=SeqID_6772
  Homolog annotation: Hit_ID=Q5CEG7; Match level="QueryCoverage=56%, HitCoverage=99%, E-value=1e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWDLVNPFMRVTN

SEQ ID NO: 123551 - protein, 276 aa, Glycine max
  Coding DNA Sequence Number=SeqID_6773
MTTLAQTWSVLSFSNLIPTSHTSDVTLDKAKLIYGIIMKMDMNMGYLISHQISLIAQHDTSKLGFPALITALCKARGPRKARDKRSEAPSTLAPETPAPSSSTAPLPPTKILVIPLTPTQIPLPAPFSVGPSDFTFTPQMLHSLLQSIHKGKSIIMQSLQGLGLPSIMSMEEFDAQVAYPGDQPSSSRGDGASVAHEPMTEEPRAFAKRDTQWLSARKNPEEDELSGSLSAPLQVIKRTTSAHPLSERSALRQNSLMRAKRFRFALSARAQTNPPI

SEQ ID NO: 123552 - protein, 39 aa, Glycine max
  Coding DNA Sequence Number=SeqID_6774
MILPLCMSNNGHFFMLKFTRNADNEYLTILYNQGDDVSS

SEQ ID NO: 123553 - protein, 95 aa, Glycine max
  Coding DNA Sequence Number=SeqID_6775
MTGEGISPYIRVVLLKCQPPCVNQALYLVLEGHALLNIMPRNTPMIGASCIGIVPSRERRLVDLPEVHHSHLVANQEWKFLLRLVLVLGLVFPAG

SEQ ID NO: 123554 - protein, 110 aa, Glycine max
  Coding DNA Sequence Number=SeqID_6776
MPQPNATGASQHRPLQPLHFSVGRLPPTMEERVKLDLIKERLRAIKGISDYPFLDMEELCLVPNVIIPPKFKVPDFDKYKGTTCSKNHLKMYRQKMGAYSRDEKLLMNFS

SEQ ID NO: 123555 - protein, 199 aa, Glycine max
  Coding DNA Sequence Number=SeqID_6777
  Gene Ontology: Mol. function=DNA binding
  Homolog annotation: Hit_ID=Q1S0F5; Match level="QueryCoverage=95%, HitCoverage=39%, E-value=1e-21, Identity=32%"; Hit description=IMP dehydrogenase/GMP reductase
MDQVRRQAFRKTYGKIWDLAMIEVSVEAIASLTQYYNQSQRCFTFGDLQLVPTVEKFEGILECPLGEKKPYMFSGLYPSMERIEKMVKISAQELDRAKQNRNGVVRIPRKCLEEKAKALVDQGEWTLFIDVLALLVFGIVLFPNVDGLVDLAVIDDFLAYLHSKESPVIAILVDAYDTFDRRCKKSSARIVCCTPTLYV

SEQ ID NO: 123556 - protein, 147 aa, Glycine max
  Coding DNA Sequence Number=SeqID_6778
MRITIRYLYMLLDPRVAIAEVRLFCGLGRKTLTSPGRVQMTTLVSVCQQACLPLIDERYLRMLPDPRVAIAEVRLFRGLGQKTLTSPGRLTKDVDNHKVSPHATGPSSRDSRSENFLRSRPEDVDISGKGVDDHIGLGLSIRLGVSK

SEQ ID NO: 123557 - protein, 215 aa, Glycine max
  Coding DNA Sequence Number=SeqID_6779
  Homolog annotation: Hit_ID=Q9FJ17; Match level="QueryCoverage=77%, HitCoverage=59%, E-value=2e-15, Identity=36%"; Hit description =Drought-induced protein Di19-like protein
  Pfam annotation: Domain name=Di19; Domain location=2-198; Score=62.4; E_value=1.5e-15; Accession=PF05605.3; Description=Drought induced 19 protein (Di19)
MGTQDSNETQNFWPTKRQVCPICGKKVGVDLVGHFTTQHGNFLRISFLQVVILVISALLTITYVQRKRRVRKGGSASTISILRKELQEGALQSLLGGSSYLASSNSEPDPLLSSFMFNPVVADESVSATPPSTEDALVKESSKDDFLKRFENFLSDNGMMYGYRKPQQLQLSEEDQVEKARSSYANVERAGAVLSSRFYSMIQIHKKGETAGVSI

SEQ ID NO: 123558 - protein, 88 aa, Glycine max
  Coding DNA Sequence Number=SeqID_6780
MLSPELLNPDVSCMFSLILIKHRLQIPLVGLNLTRTALRHTYQKLVPGMLAQPGGSSGALSQLILAEHIMKTHLLPGSSTCLAMNCCT

SEQ ID NO: 123559 - protein, 135 aa, Glycine max
  Coding DNA Sequence Number=SeqID_6781
MDNHSWCYPACIQCHRKTDIQTGPFTCGCGKDNDQPVLRYRVEVMVSQNNDSSKFLLCDRECAELIGEIVEVNRVKIEDGDVDLNASPQALDRLLGYVLAFKVRIQSKFRNVVVLRYSNELDLINVVLDMLANTE

SEQ ID NO: 123560 - protein, 230 aa, Glycine max
  Coding DNA Sequence Number=SeqID_6782
  Gene Ontology: Cellular component=mitochondrion
MTKAPFFDIKNPIINLTEKANNYMMSIGFRFMPGQGEFLIKDLRAPDTLVGLRKLKDSLGLSLTKGSLNSNPLLKLKGISDSVSNSMESLASRVLVEVITFNEGYYGRFLILVQMGIGCTVWYGFVPGDGINMPIEGLNTLFSPIENYDTIFTNPDAHVIPGFNKMTLIEGVNNPAASLSQAFAQDRPFMDMDIEIPDSNKSIIIGVSLGLAVAILFTFGINPCCGEVIV

SEQ ID NO: 123561 - protein, 171 aa, Glycine max
  Coding DNA Sequence Number=SeqID_6783
  Gene Ontology: Mol. function=cytochrome-c oxidase activity; Cellular component=mitochondrial respiratory chain; Biological process =electron transport
  Homolog annotation: Hit_ID=Q02226; Match level="QueryCoverage=62%, HitCoverage=26%, E-value=1e-41, Identity=80%"; Hit description =Cytochrome c oxidase subunit 2, mitochondrial precursor
  Pfam annotation: Domain name=COX2_TM; Domain location=9-85; Score =23.0; E_value=2.4e-06; Accession=PF02790.6; Description=Cytochrome C oxidase subunit II, transmembrane domain
MAIRISRCSNTYSARNNRLTSRYHFLRHSDCSFCSMDLAARALWHFRSKINPIPQRIVHGTTIEILWTVFPSVILMFIAIPSFALLYSMDDVVVDPAITIKAIGHQWMKELIPILLEFIKSYLKLLSEEKPLLHYHPFYRITIGPTTTLSLPSRTLAYMLSIAPLRIGPNR

SEQ ID NO: 123562 - protein, 164 aa, Glycine max
  Coding DNA Sequence Number=SeqID_6784
  Gene Ontology: Mol. function=pyridoxal phosphate binding; Biological process=metabolic process
  Homolog annotation: Hit_ID=Q6L417; Match level="QueryCoverage=66%, HitCoverage=16%, E-value=8e-23, Identity=45%"; Hit description =Putative isopenicillin N epimerase, identical
MVVQFESEWGLIYGSTLVETAAIRSSHEDDVAFLELSFAEVPGGVLEDDGGDNGGVANDGDLIDGSRLEDVGLEIIEVGVVGLAKVLELPVALPSEDRGRATTKVVVVDARDDNFVVAEFEFDFRRSYEGGREFGFFRYVRVVVVVVFVDGGGRHWDLGLRNEE

SEQ ID NO: 123563 - protein, 103 aa, Glycine max
  Coding DNA Sequence Number=SeqID_6785
  Gene Ontology: Mol. function=3'-5'-exoribonuclease activity; Biological process=RNA processing
  Homolog annotation: Hit_ID=Q69UI6; Match level="QueryCoverage=71%, HitCoverage=40%, E-value=7e-12, Identity=41%"; Hit description =Putative ribonuclease PH
MPKQWSINDYVLKAVSWHLAKSTLSFYPEIFKIDAVNATSGSAYAEVGNTKIWAKREQGSDHKEYSSMLHKALEEAIILETFPKTTLDIHALVLESIGNTLIL

SEQ ID NO: 123564 - protein, 159 aa, Glycine max
  Coding DNA Sequence Number=SeqID_6786
MAMEGSQWLSDLLCMCELFENESGWFQNGIGRVVGDGSNTSFWEAKWLEGERLSSRLMDMATVVEKTKVSMGATYGATFGKDRLFGFGTKDTGNKWFLFNDSDDGPLGCGSGGKKGKRESATGTNALELGAENVEQHDGGSHVEEEAVRVDGEAEVVVA

SEQ ID NO: 123565 - protein, 103 aa, Glycine max
  Coding DNA Sequence Number=SeqID_6787
MALVMDSLLKRIASYDPTLDTQHDVSFIGACRPRIFFINGLFCFLEYEWQRNGEKKRERRRHFKDKMILEEVHHHRRPWIRAWRKKEMNEGKGREEHEILCSK

SEQ ID NO: 123566 - protein, 650 aa, Glycine max
  Coding DNA Sequence Number=SeqID_6788
  Gene Ontology: Mol. function=two-component response regulator activity; Cellular component=nucleus; Biological process=two -component signal transduction system (phosphorelay)
  Homolog annotation: Hit_ID=Q71BZ1; Match level="QueryCoverage=99%, HitCoverage=99%, E-value=0.0, Identity=59%"; Hit description=Type-B response regulator
  Pfam annotation: Domain name=Myb_DNA-binding; Domain location=209 -259; Score=44.0; E_value=5e-10; Accession=PF00249.21; Description =Myb-like DNA-binding domain
  Pfam annotation: Domain name=Response_reg; Domain location=29-142; Score=88.9; E_value=1.5e-23; Accession=PF00072.14; Description =Response regulator receiver domain
  Pfam module annotation: Pfam domain module=Myb_DNA-binding::Response _reg; Domain location=209-259::29-142
MNLSNGKGSTSSSPLKAGDSVSDQFPAGLRVLVVDDDPTCLMILERMLRACLYEVTKCQRAEVALSLLRENKNGFDIVLSDVHMPDMDGFKLLEHIGLEMDLPVIMMSADDGKHVVMKGVTHGACDYLIKPVRIEALKNIWQHVIRKRKNGLRDVEQSGSVEEGDQPPKVSDDGDYSSSVNEARSSKKRRDEDEEGDEKDDSSTLKKPRVVWSVELHQQFMAAVNQLGIDKAVPKKILELMNVPGLTRENVASHLQLFEGVNSFAVWFLVQKYRLYLRRLSGVSQQQGNLNNSFMSSQEATFGGTSINGIDLQTLSAAGQFPSQSLAKLQATGLGRTTAKAGVPMPLSDQKNLFSFENPRLRFGEGSLQHLSNSKPINLLHGIPTNMEPKQLANLHQSTQPLGSLNMRVNAPVTQNNPLLMQMAQSQPRGQMLGENAGSHVTRFPSSLVQPTVSNGISNGVLGNGIAGTSNITTYNPVQQNSSLLSFPMNQTNEISVSNFPLRSSPGITSITNKGMFHEEGTSGIKGPGGFVQGYDMFNELHHQKSHDWDLTNTGMTYDAAHHANPLQGEGMHQSNLQNVGQHHNNLLLDNSVRVKAERIPDPSCQINNLFADQYGQEDLVSAFLKQQESIGTSENEFDFDGYSLDNIPV

SEQ ID NO: 123567 - protein, 614 aa, Glycine max
  Coding DNA Sequence Number=SeqID_6789
  Gene Ontology: Biological process=regulation of GTPase activity
  Homolog annotation: Hit_ID=Q9FVH3; Match level="QueryCoverage=98%, HitCoverage=84%, E-value=4e-69, Identity=33%"; Hit description=ARF GAP-like zinc finger-containing protein ZiGA4
MAKFTSQEVDALQNGGNQRAREIYLKNWDFQRQRLPDNSPGIHEDEIRRASSYHSYSQSPPYDYQYEDRRYGKQAAALTRKPGSDKARYEGKMSSIIYSPGRFSDHAYDDRFANEGSGPRISDFSVSSGGEQFKSDVQSPNFHKDIKIRSPSYQQRSGSGSSSSEDVWYQARNASLETNANAKRDADGIRPPQRTVSAQSRDNKFPSLRSYNSGSLVDFFSEPVQASEPLQNKAFGIPRPPGPTRSVSMDLSKAPLESASSVDLFQLPAAPSQAPTLDLFQSSLSSADPSFNENQLSQTSHLASIDFFSDFSPQPSTVTSDGKALELSVPKNEGWATFDMPQRTSSTAQVEIPTTVPSNAKSLEEKFDPFSTSNANMQWPSFDMPQSTSSTAQVEIPATAPSSAKSLHETFDPFSSSNANRQWPSFEISSVSVPSSVTSNLWHDGVWNGEEQVSAMAANTQPWNAFEDSGGHHPVDSLSQGLQLHNFPSADNHILGLRESEGSNEDGVKGFAPVGGFDNHDIPSHVSCSAYPPPMLPPMGDIQPNQMKSKSTNPFDYPYESDVDHNNMFLDMSSLQAALPDALFPATFHGGIAESWLPQNTVTPYISSAGEGIA

SEQ ID NO: 123568 - protein, 53 aa, Glycine max
  Coding DNA Sequence Number=SeqID_6790
MNSWGGDGQVINTFKEMKRWDSDSNSATEHHIGHIAEATNRPRRVSKKPTYLL

SEQ ID NO: 123569 - protein, 154 aa, Glycine max
  Coding DNA Sequence Number=SeqID_6791
MGISVRSTYKLIMEKFVDQPSLCREGDWNLIWKLHIPPRVNEGCWEKLNHKQRVDDFVLEVDSPIFKLLQGLRDQQRRRVAMLLWSIWRRRNEKLWNNQAELDVAAIQRGDDTTTKWSSCCEYVREPVPVTCVASPRSVAAVTRHGLRSLGHRT

SEQ ID NO: 123570 - protein, 138 aa, Glycine max
  Coding DNA Sequence Number=SeqID_6792
  Gene Ontology: Mol. function=DNA binding; Biological process=DNA integration
  Homolog annotation: Hit_ID=Q1SIP9; Match level="QueryCoverage=83%, HitCoverage=27%, E-value=4e-12, Identity=63%"; Hit description =Integrase, catalytic region
GTKDNIPFLRSASNSSVMAFLHEWVVGCYEQVFGFEDVVLRSVWSGLCVGVRGIVICKGIDSHIGTLHILQICMADILVEVCWMHRDAIMGNISNQRSKVSGSAEGKCPELGGVEKTPNIGVDKLKRLLAFDTGCRKR

SEQ ID NO: 123571 - protein, 183 aa, Glycine max
  Coding DNA Sequence Number=SeqID_6793
MGTRVWCCFVMFLSLNALAIALEDHNLKTTSKDDIKCTPCGQIPSPPPPSPPPPAPTTTYCPPPPSPPSSGGGGAYYYSPPPPSQYTYSSPPPPASTSGGGGGGAYYYPPPRGYYPTPPPPNPIVPYFPFYYHTPPLSSTAAPPPVKGSLEIEGVGMWLIMILMMDTVTVGRVTQKNLLTILS

SEQ ID NO: 123572 - protein, 751 aa, Glycine max
  Coding DNA Sequence Number=SeqID_6794
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=70%, HitCoverage=36%, E-value=1e-101, Identity=42%"; Hit description =Putative retroelement
  Pfam module annotation: Pfam domain module=RVT_1::Retrotrans_gag; Domain location=424-606::109-209
MADGTRLSKIENELSRIEAQNSSFQERMEAQMTQLMSLLQKKKSDDENLDAESTHSISQSPPRYSTTLISTKDCKIDLPKFDETDVDDWIFRLEEYFDVAQTPLEQCIKVASFHMIGPSYAWYKWMIHNNYTQDWTIFVDALYKRFGSNLYTNPQKTLKELKQGTVKEYQTQFEAFSTRVNGLREQWLAKCHILLAPDDLVDVCHGLLDADASNNAAIEGTGVPDISFNALSGEYSPRTLRLKGTYQGHTFNILVDNGSSFNFIKPAVARRLRVHVTNIEPFKVFVGSDDFIWCNTCSYDVPILVQGISFPVDLHHLEISGADMVFSLSWLQSLGQVLTDYNRLTMEFDYHGTPIILHVEHLLSPNPIKNRRINHMLLHDDISSLCTMRVCQPDKPTATFPLVVQELLKEYAAVFQEPKGLPPTRDISHRIPLHSNSKSVQIKPYKYLHFQKIEIERLTIVAPTPLLSVTCFRCLQSRRLWMNCRVSSFSPNWIYAQVITKFVWRKETYIRQLFILIMVTEFLVMPFGLTNAPTTFQATMNRIFPPFLRNFVSVFLDDILIYSKTWEDHLHHLRLVLETLQTRSFFAKLTKCDFCKDSVHYLGHVISAKGVEVDNSKIDIILSWPLPYTIKQLRGFLGLTGYYRRFVKGYATIAFPLTKMLKHDSFYWTPESETTFKLLNQALTSTPILALPNFLLSFEVETDASTTGIGAVLTQQGRPLAFFIKKLSHCMSNASTYVHELYAITQAVARW

SEQ ID NO: 123573 - protein, 543 aa, Glycine max
  Coding DNA Sequence Number=SeqID_6795
  Gene Ontology: Mol. function=protein transporter activity; Cellular component=nuclear pore; Biological process=intracellular protein transport
  Homolog annotation: Hit_ID=Q94KA9; Match level="QueryCoverage=99%, HitCoverage=99%, E-value=0.0, Identity=87%"; Hit description =Importin alpha 2
  Pfam annotation: Domain name=Arm; Domain location=106-147; Score =48.6; E_value=2.1e-11; Accession=PF00514.13; Description =Armadillobeta-catenin-like repeat
  Pfam annotation: Domain name=Arm; Domain location=149-189; Score =59.4; E_value=1.2e-14; Accession=PF00514.13; Description =Armadillobeta-catenin-like repeat
  Pfam annotation: Domain name=Arm; Domain location=191-232; Score =38.2; E_value=2.7e-08; Accession=PF00514.13; Description =Armadillobeta-catenin-like repeat
  Pfam annotation: Domain name=Arm; Domain location=234-273; Score =35.2; E_value=2.2e-07; Accession=PF00514.13; Description =Armadillobeta-catenin-like repeat
  Pfam annotation: Domain name=Arm; Domain location=275-315; Score =48.7; E_value=1.9e-11; Accession=PF00514.13; Description =Armadillobeta-catenin-like repeat
  Pfam annotation: Domain name=Arm; Domain location=317-358; Score =51.8; E_value=2.3e-12; Accession=PF00514.13; Description =Armadillobeta-catenin-like repeat
  Pfam annotation: Domain name=Arm; Domain location=372-412; Score =36.7; E_value=8e-08; Accession=PF00514.13; Description=Armadillobeta- catenin-like repeat
  Pfam annotation: Domain name=Arm; Domain location=415-455; Score =35.2; E_value=2.2e-07; Accession=PF00514.13; Description =Armadillobeta-catenin-like repeat
  Pfam annotation: Domain name=DUF634; Domain location=98-292; Score= -159.1; E_value=0.072; Accession=PF04826.4; Description=Protein of unknown function (DUF634)
  Pfam annotation: Domain name=HEAT; Domain location=112-149; Score =3.0; E_value=19; Accession=PF02985.12; Description=HEAT repeat
  Pfam annotation: Domain name=HEAT; Domain location=155-191; Score =28.3; E_value=2.7e-05; Accession=PF02985.12; Description=HEAT repeat
  Pfam annotation: Domain name=HEAT; Domain location=240-275; Score =10.5; E_value=2.3; Accession=PF02985.12; Description=HEAT repeat
  Pfam annotation: Domain name=HEAT; Domain location=281-317; Score =10.4; E_value=2.3; Accession=PF02985.12; Description=HEAT repeat
  Pfam annotation: Domain name=HEAT; Domain location=323-360; Score =8.9; E_value=3.5; Accession=PF02985.12; Description=HEAT repeat
  Pfam annotation: Domain name=HEAT; Domain location=378-414; Score =6.3; E_value=7.2; Accession=PF02985.12; Description=HEAT repeat
  Pfam annotation: Domain name=HEAT; Domain location=421-457; Score =0.6; E_value=36; Accession=PF02985.12; Description=HEAT repeat
  Pfam annotation: Domain name=HEAT_PBS; Domain location=134-171; Score= 5.7; E_value=16; Accession=PF03130.6; Description=PBS lyase HEAT-like repeat
  Pfam annotation: Domain name=HEAT_PBS; Domain location=176-210; Score= 7.4; E_value=9.5; Accession=PF03130.6; Description=PBS lyase HEAT -like repeat
  Pfam annotation: Domain name=HEAT_PBS; Domain location=219-255; Score= 1.7; E_value=59; Accession=PF03130.6; Description=PBS lyase HEAT-like repeat
  Pfam annotation: Domain name=HEAT_PBS; Domain location=399-437; Score= 2.5; E_value=45; Accession=PF03130.6; Description=PBS lyase HEAT-like repeat
  Pfam annotation: Domain name=IBB; Domain location=4-97; Score=148.4; E_value=1.9e-41; Accession=PF01749.10; Description=Importin beta binding domain
  Pfam module annotation: Pfam domain module=Arm::Arm::Arm::Arm::Arm::Ar m::Arm::Arm::DUF634::HEAT::HEAT::HEAT::HEAT::HEAT::HEAT::HEAT::HEAT _PBS::HEAT_PBS::HEAT_PBS::HEAT_PBS::IBB; Domain location=106-147::149- 189::191-232:...
  Pfam module annotation: Domain location=:234-273::275-315::317 -358::372-412::415-455::98-292::112-149::155-191::240-275::281 -317::323-360::378-414::421-457::134-171::176-210::219-255::399 -437::4-97
MSLRPNARTEVRRNRYKVAVDADEGRRRREDNMVEIRKSKREESLQKKRREGLQAQQQFPTPLQASSIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQEVTCSVTWRCGVAVIEAGLIAPLVNLLQNAEFDIKKEAAWAISNATSGGTHEQIKYLVSQGCIKPLCDLLVCPDPRIVTVCLEGLENILKVGEAEKSLGNTGDVNLYAQMIDEAEGLEKIENLQSHDNNEIYEKAVKILETYWLEDDDETLPAGDGAQPGFNFGNNDLPVPSGGFNFS

SEQ ID NO: 123574 - protein, 77 aa, Glycine max
  Coding DNA Sequence Number=SeqID_6796
LNFKLSKRYFGAFRILECIGKAYSGPTPPMSITCDDHPKHQLPTPQAIISEHSVPTPEGNQYQVLVECANESREEAT

SEQ ID NO: 123575 - protein, 175 aa, Glycine max
  Coding DNA Sequence Number=SeqID_6797
MVWRYVNNGGYNVKSAYNLIMEKFVDQASLCKEGDWSLIRKIDIPPRVEDTSLIFKLLQVLNEQQRKRVAMMLWRNEQIGGTHLVMERLNASVTDMRVCIMDEYGRVVALRTDQRRLCMAVQEGEALALVAAMEFVISSGYNAVTFETDCKCVVHKIRVLSFIRVKLQTPQETVS

SEQ ID NO: 123576 - protein, 206 aa, Glycine max
  Coding DNA Sequence Number=SeqID_6798
  Pfam annotation: Domain name=DUF1218; Domain location=14-139; Score =8.6; E_value=0.0011; Accession=PF06749.3; Description=Protein of unknown function (DUF1218)
MDTGGKENGAKSECVYSGSGKVPLLCAASAFVGLAFAMVMEHAYMLIAVSKSSPSLLTWDPDSPSAKSLTWQAGFFFITTWICFGVAEILLLAALNVESGHLKNWTRQRTGCHSIREGLFSAAGVYALATVFLAAGLYLTALRAQRMSEELVNVRRELLEASALYASPPRSPQPQYMSTVARENPTTRETQNELLLSMFPTPFIKS

SEQ ID NO: 123577 - protein, 78 aa, Glycine max
  Coding DNA Sequence Number=SeqID_6799
MMILKLVVETSVGTVTKGKCPMEGSINAGVFLKKFVQFGGHGVLSSDEVELIGGEFHNGFFDAIHIGLGTSRLNQGAR

SEQ ID NO: 123578 - protein, 151 aa, Glycine max
  Coding DNA Sequence Number=SeqID_6800
MVKEKCKEVSVSSKRLAKKESHFAIKTNIKETSLLRQPPHLLLCKRTLVSTAISLELEIIPQVKELLDKGLVRKSLNHCALLVPKIGIMRHQIPMIGEAFQLCGVHLSGPLAMLSYPAKALDRRLQIDWVRDPREGPRVLMSLREDFEPMG

SEQ ID NO: 123579 - protein, 137 aa, Glycine max
  Coding DNA Sequence Number=SeqID_6801
MGVQIATRPTWALQKIPPEGCCFWRKQPCSPGRAGFRPFVDVLHSFFIVLRSSTGRVDPDRDKIDIEYFFNILELEKKGLRLNKNLELYGIRAYFDDPQKGLRFILLNPLPWALDRRLQENWARDVGEDPRVLMSLG

SEQ ID NO: 123580 - protein, 53 aa, Glycine max
  Coding DNA Sequence Number=SeqID_6802
LSSSVGLSAIEESDRASTSRPRAKREINALSATVVFNEAQRMTGAKLKSTYSR

SEQ ID NO: 123581 - protein, 111 aa, Glycine max
  Coding DNA Sequence Number=SeqID_6803
  Gene Ontology: Mol. function=protein binding; Cellular component =cytoplasm; Biological process=regulation of GTPase activity
  Homolog annotation: Hit_ID=Q5W7F2; Match level="QueryCoverage=38%, HitCoverage=5%, E-value=4e-11, Identity=72%"; Hit description=ARF-GAP
VQTVKQGYLLKRSSSSRGDWKRRFFVLDNQGNLYYYRVKGVKPMAENEADRMDWVNKITGAITSLFNSQFLQQPQFGRVHSQNRNSATGASLASQSEDSQKSLRDDVYSKE

SEQ ID NO: 123582 - protein, 60 aa, Glycine max
  Coding DNA Sequence Number=SeqID_6804
MLNGTPQGFSVTSTHYVRVVSSKKWRLRKPSRGYGYHCIIEWIWEQVVFVIGSAVGRLCG

SEQ ID NO: 123583 - protein, 194 aa, Glycine max
  Coding DNA Sequence Number=SeqID_6805
  Gene Ontology: Mol. function=transferase activity; Cellular component= cytoplasm; Biological process=aromatic amino acid family metabolic process
  Homolog annotation: Hit_ID=UPI00005F9C35; Match level="QueryCoverage =98%, HitCoverage=100%, E-value=3e-62, Identity=61%"; Hit description= COG0625: Glutathione S-transferase
  Pfam annotation: Domain name=GST_N; Domain location=1-62; Score=15.9; E_value=0.026; Accession=PF02798.10; Description=Glutathione S -transferase, N-terminal domain
MSVYVALTEKGIPFTVRRVDLSRNAQLDEEYRGLSLTCRVPTLQIDDVSLNESSAIAEYLEERFPAPEFERLYPRDREKRAHAREVQAWLRSDLLALRTERPTEVLFAAERFAPLTPAGEQAASKLIAAVQRLLPDGQQNLFGEWSIADTDLAVMINRLALHGDPLPVKLQHYAEFQWQRASVQLWLAESGKAR

SEQ ID NO: 123584 - protein, 73 aa, Glycine max
  Coding DNA Sequence Number=SeqID_6806
MHLRDQGSHNHSQTHLKLSERFPLQSLVSADLHTAKSLKTLWNWDLSLSRITRHAKLQLSAQTPFTKSDFRLK

SEQ ID NO: 123585 - protein, 155 aa, Glycine max
  Coding DNA Sequence Number=SeqID_6807
MGNCAFKGISTSEGVSNDKMVKVLTPNGGIMELYTPITAECITNEFSGHGIFRSRRDLFSEPLHHYEELHAGELYYLLPLDPSCSVSKGGSVEGEAGDKPGAAVGDFVAGVADGGLRRELEDGGKVRQWGAVGGEFRSLQWWIPPVGRALWLRIK

SEQ ID NO: 123586 - protein, 243 aa, Glycine max
  Coding DNA Sequence Number=SeqID_6808
  Homolog annotation: Hit_ID=Q1SXA5; Match level="QueryCoverage=41%, HitCoverage=45%, E-value=2e-51, Identity=94%"; Hit description=MIR
  Subcellular localization annotation: CTP_CleavageSite=59; ConfidenceScore=5.00e-01
MHKKVVYVKIWAKESNPREKGPFSECALSISSDLATNPNPLRTVASSASQNLSRRKSSSSSSFSQQTSGSTRIVYREPRIPSESNFPIWQQNWFIALLFLMALGFFALALFLFITFDSDIAPSSTASAASSEGVEVQVTYGTVLKLMHEKTKFRLHSHDVPYGSGSGQQSVTGFPSVDDSNSYWIVRPEPGTSAKQGDPIKSGTIIRLQHMRTRKWLHSHLHASPISGNLEYSFRLFYVLIDA

SEQ ID NO: 123587 - protein, 1268 aa, Glycine max
  Coding DNA Sequence Number=SeqID_6809
  Gene Ontology: Mol. function=nucleic acid binding; Cellular component= intracellular; Biological process=DNA integration
  Homolog annotation: Hit_ID=Q1RXN8; Match level="QueryCoverage=98%, HitCoverage=98%, E-value=0.0, Identity=50%"; Hit description =Peptidase S8 and S53, subtilisin, kexin, sedolisin; Integrase, catalytic region; Zinc finger, CCHC-type
  Pfam annotation: Domain name=RnaseH; Domain location=1116-1256; Score= -34.8; E_value=0.1; Accession=PF00075.14; Description=RNase H
  Pfam annotation: Domain name=rve; Domain location=443-606; Score =188.2; E_value=2e-53; Accession=PF00665.16; Description=Integrase core domain
  Pfam annotation: Domain name=zf-CCHC; Domain location=203-220; Score =30.7; E_value=5.1e-06; Accession=PF00098.13; Description=Zinc knuckle
  Pfam module annotation: Pfam domain module=RVT_2::RnaseH::rve::zf -CCHC; Domain location=768-1029::1116-1256::443-606::203-220
DLAMGTRFDVEKFTGENDFNLWRIKMQALLVHQGLDDALQGASKLPSTLSDKEKKDLLSKAHSIIILSLGDEVLQEVAEEKSAAGIWLKLESLYMTKSLTNKLYLKKRLHQLKMEEGSSIKEHVSLFTKAVLDLKSVDVRIDKEDQAVMLLCSLPSSFENLVDTMLFGRDTLTLEEALMARGRSEKRDSKSKNKRRSKSKNKKACYYCKKEGHFRKECPERKKKNNGKYNDESDIAVVADGYESVEVLSISTEKHSEEWILDSSCSFHMTPNLEWFSSYKEIDGGKVLMGNNMACNVIGIGTIKLKMQDGSVKLLPDVRHVPELKRNLLSLGMLDQSGCSFKGEGGTLKVFKGSLQIMKGTRQNGLYKLQGNTILNSAGLVSISEPNASKLWHYRLGHVSEKGLEELHKQGLIGNGNYQKLSFCEHCVYGKQKRVSFHNATHATQGILDYVHSDVWGPARVPSLGGAKYFITFIDDWSRKVWTYLLKHKNQAFKCFKQWKMLVENQTGRHVKLLRTDNGLEYLSEEFNEFCKNNGIRRHKTVRLTPQQNGLAERMNRTILERVRCMLSNAKLAKSFWGEAVNTTCYLINRCPSSAIEFKTPEERWTGKAPSYENLRIFGCIVYVHSNEGKLEPRAKKGIFLGYPEGVKGYKVWLLDPAGPKSIISRDVLFREEDMIVDYQQKSDLVQKGVQAEQNRHPDQGIRLEVEKLAQTSSPVEDRNETSRDEPMISSIPEPVDTSYNLVRDRQKRQIKAPVRLGYADLIAYALTMQDEFDSLMKNDTWKLVEKPAKQKVVGCKWIFKRKPEETGMDSYRYKARLVARGFTQREGIDYNEIFSPVVKHTSIKIILALVAVHNLELEQMNVKTTFLHGNLEETIYMSQPEGYEVKGKEEMMVCLLKKSLYGLKQSPRQWYKRFDSFVVSNGFSRSSYDSCVYFKRLKPDCFIYLLLYVDDMLIASADMEAIKELKNLLQSEFEMKDLGAARRILGMDIIRKRNEGLLYLSQSSYVQKLLRRFNMLDSKPVSTPIAGHFKLSITHSPQTEDEIKDMSRIPYSNATGSLMYAMVCTRPDLAYSASIVSRFMANPGKQHWSAVKWILRYLKGSKSVGLVYGRNSEGINGLSGYVDADYAGDIDKRRSLTGYLFTLYGSVISWKANLQSVVALSTTEAEYIALTEAIKEAIWLKGLVHELEGKTGPVEVWCDSQSAIDLSKNQVFHERTKHIDIRMHYIRDIIAQGEVEVRKVAGANNPGDILCKRLEERELAGPNIEDP

SEQ ID NO: 123588 - protein, 262 aa, Glycine max
  Coding DNA Sequence Number=SeqID_6810
  Gene Ontology: Mol. function=DNA binding; Cellular component=nucleus; Biological process=regulation of transcription, DNA-dependent
  Homolog annotation: Hit_ID=Q84WP6; Match level="QueryCoverage=65%, HitCoverage=50%, E-value=1e-76, Identity=74%"; Hit description=NAC domain-containing protein 43
  Pfam annotation: Domain name=NAM; Domain location=13-142; Score =281.3; E_value=1.9e-81; Accession=PF02365.6; Description=No apical meristem (NAM) protein
MEMSICVNGESQVPPGFRFHPTEEELLQYYLRKKMSNEKIDLDVIRDVDLNRLEPWDIQEMCKIGSRPQNDWYLFSHKYKKYPTGSRTNRATSVGFWKATGRDKVIYSNGKIIGMRKTLVFYKGRAPNGQKSDWIMHEYRLDDINNTNEMEHGWVVCRVFKKKNVPLKTLDSPKSMTMNMVTESDYCGGFTSWESLDQLVASQLNGQTETYCSDLQFPAFLSSSYIATTTTTTTHIAPTIQDYPSYDIDLWNHCASCPTLQM

SEQ ID NO: 123589 - protein, 134 aa, Glycine max
  Coding DNA Sequence Number=SeqID_6811
  Gene Ontology: Mol. function=heat shock protein binding; Cellular component=integral to membrane; Biological process=protein folding
  Homolog annotation: Hit_ID=Q8H2B1; Match level="QueryCoverage=92%, HitCoverage=75%, E-value=7e-23, Identity=48%"; Hit description=DnaJ -like protein
  Pfam annotation: Domain name=DnaJ; Domain location=4-59; Score=31.4; E_value=3.2e-06; Accession=PF00226.21; Description=DnaJ domain
MFGTVEHDEIRRAYRKMDLWYPDRWIKDPKLALEAKKRFQRVQEAYSVLSNKGKRRIYDAGLFGLIGEDDDEGFVDFMQEMASTMQKVRPKDEKGMLEDLQGLLMVMMADNEGMGKSGLSWNSSPCPTKRTRIL

SEQ ID NO: 123590 - protein, 159 aa, Glycine max
  Coding DNA Sequence Number=SeqID_6812
  Gene Ontology: Mol. function=microtubule motor activity; Cellular component=microtubule associated complex; Biological process =microtubule-based movement
  Homolog annotation: Hit_ID=Q1RV39; Match level="QueryCoverage=91%, HitCoverage=14%, E-value=2e-52, Identity=71%"; Hit description =Calponin-like actin-binding; Kinesin, motor region
LVESVLNKVVEEFEQRIASQGEQTKVTSRDPVSQSNGSAMADKKGEKKIHVVTKKEDCINKNEVATMVTQRQLMKQQMLFDQQQREIQELRHSLHSTKDGMQFMQMKFHEDFSNLGTHIHGLANAASGYHRVLEENRKLYNQVQDLKEKEEINNLIDAL

SEQ ID NO: 123591 - protein, 494 aa, Glycine max
  Coding DNA Sequence Number=SeqID_6813
  Gene Ontology: Mol. function=microtubule motor activity; Cellular component=microtubule associated complex; Biological process =microtubule-based movement
  Homolog annotation: Hit_ID=Q1RV39; Match level="QueryCoverage=93%, HitCoverage=45%, E-value=0.0, Identity=76%"; Hit description =Calponin-like actin-binding; Kinesin, motor region
  Pfam annotation: Domain name=Kinesin; Domain location=2-206; Score =162.5; E_value=1.1e-45; Accession=PF00225.13; Description=Kinesin motor domain
MKTSFNQDALSTIYTYYRTHIALIVLPLTIDTLEIRSSSQKGLSVPDASLVPVSSTIDVIELMNLGQRNRAVGATALNDRSSRSHSCLTVHVQGRDLASGAILRGCMHLVDLAGSERVDKSEATGDRLKEAQHINKSLSALGDVIASLAQKNSHVPYRNSKLTQLLQDSLGGQAKTLMFVHISPESDAIGETISTLKFAERVATVELGAARVNKDSADVKELKEQIASLKAALARKEGESEHSFLGSSEKHRTKASELSPYHINQRGPDAVDQLGCRQPMVEVGNIELRSNTTVRLKTQSFDFDEISANSPSWPPVNNSLAQNYGEDDKESGGSGEWVDKVMVNKQDVNKTENLLGCWQAASNGNLSEAFYQKYLKDSPKMYSEQSDNMFMGANQFNIAGSDDMDELDAATSDSSEPDLLWQFNHSKLSSVTNGIGSKTMRSKAAKNSPELSKSAVHSSPLGPSPSLKNSNGVPHRTGRHTAPVDVKRRTGSRK

SEQ ID NO: 123592 - protein, 104 aa, Glycine max
  Coding DNA Sequence Number=SeqID_6814
MTSSSSNLTALFASCPKVTCLSMVRCCYSILDRQVFGSFRKHSYSGPFNQQHHHNDGMRHHSIRLVSKEQSIAIDACEKLQGVYSLGLVTGRSNNFVVFAFETI

SEQ ID NO: 123593 - protein, 98 aa, Glycine max
  Coding DNA Sequence Number=SeqID_6815
  Gene Ontology: Mol. function=oxidoreductase activity, acting on the aldehyde or oxo group of donors, disulfide as acceptor; Biological process=metabolic process
MVELVQSEKAHYAGRDPISALKKYMIENKLASEQELKTIDKKIEEVVEDAVEFADESPHPPRSQLLENVFADPKGFGIGPDGKYRCEDPKFTEGTAHV

SEQ ID NO: 123594 - protein, 87 aa, Glycine max
  Coding DNA Sequence Number=SeqID_6816
MESEWQKVFFSYLELFGLVQQRHWGGESMFVSLNAGHLEQQSKASSRKCYAFLKPKMWLVSIKNRISDKRFFLEIRMGPQLMIEMIK

SEQ ID NO: 123595 - protein, 425 aa, Glycine max
  Coding DNA Sequence Number=SeqID_6817
  Gene Ontology: Mol. function=DNA photolyase activity; Cellular component=mitochondrion; Biological process=DNA repair
  Homolog annotation: Hit_ID=Q2HTC1; Match level="QueryCoverage=87%, HitCoverage=86%, E-value=1e-161, Identity=74%"; Hit description =Peptidase S8 and S53, subtilisin, kexin, sedolisin; Tetratricopeptide - like helical
  Pfam annotation: Domain name=PPR; Domain location=139-173; Score =24.3; E_value=0.00044; Accession=PF01535.11; Description=PPR repeat
  Pfam annotation: Domain name=PPR; Domain location=174-207; Score =19.2; E_value=0.015; Accession=PF01535.11; Description=PPR repeat
  Pfam annotation: Domain name=PPR; Domain location=208-242; Score =31.6; E_value=2.7e-06; Accession=PF01535.11; Description=PPR repeat
  Pfam annotation: Domain name=PPR; Domain location=261-295; Score =36.4; E_value=1e-07; Accession=PF01535.11; Description=PPR repeat
  Pfam annotation: Domain name=PPR; Domain location=296-330; Score =12.1; E_value=0.27; Accession=PF01535.11; Description=PPR repeat
  Pfam annotation: Domain name=PPR; Domain location=68-102; Score=1.8; E_value=4.6; Accession=PF01535.11; Description=PPR repeat
  Pfam module annotation: Pfam domain module=PPR::PPR::PPR::PPR::PPR::PP R; Domain location=139-173::174-207::208-242::261-295::296-330::68-102
MDENTLEIGRAYLSKKKLPNQTLFWPKKSWTYSSYLILLLKLGRSKHFTFLDGLLRPLKSDSHPITPTLFTYLFKVYPEADLPDKALKTFYTILHFNCKPLPKHLNRILEVLVSHRNYLRPAFDLFKDSRSYGVEPDTKSCNILMRPFCLNGDISIAYSLFNIMFKRDVVPDIESYRILMQALCRKSRVNGAVDLLEDMLNGFVPDSLTYTTLLNSLCRKKKFREAYKLLCRMKVKGDGRTHDACKVISDMRANGSLPNLVSYRTLVSGLCNMGMLDEASKYMEEMLSKDFSPHFAVVHALVKGFCNVGRTEDACGVLTKALEHGEAPHVDTWMIIMPVICEVDDEGKSSGALEEVLKIEIKGHTRIVDAGIGLENYLIGKIRSRRFEAVKTNWIGLVVNANALVWYVCRVWRRTMASRARLEVV

SEQ ID NO: 123596 - protein, 245 aa, Glycine max
  Coding DNA Sequence Number=SeqID_6818
  Gene Ontology: Mol. function=microtubule motor activity; Cellular component=microtubule associated complex; Biological process =microtubule-based movement
  Homolog annotation: Hit_ID=Q1RV39; Match level="QueryCoverage=98%, HitCoverage=23%, E-value=1e-92, Identity=77%"; Hit description =Calponin-like actin-binding; Kinesin, motor region
  Pfam annotation: Domain name=CH; Domain location=41-168; Score=42.3; E_value=1.7e-09; Accession=PF00307.21; Description=Calponin homology (CH) domain
MAAEAALFFSVASVVEDVLQQHGPRLKDLDLESRKAEEAASRRYEAAGWLRKMVGVVAAKDLPAEPSEEEFRLGLRSGIILCNVINKVQSGAVPKCILLFKVVESPVDSALIPDGAPLTAYQYFENVRNFLVAVQEIGIPTFEASDLEQGGKSSRIVNCVLALKSYSEWKMSGSNGVWKFGGNLKPTVTSKSFVRKNSDPFTNSLSRTSSLNDKSIAAFNSDVESIKMVVWFPLFEYACSGNFIG

SEQ ID NO: 123597 - protein, 170 aa, Glycine max
  Coding DNA Sequence Number=SeqID_6819
  Homolog annotation: Hit_ID=Q8L949; Match level="QueryCoverage=23%, HitCoverage=18%, E-value=4e-10, Identity=68%"; Hit description =Plastid protein
MVSLFKGCDYHHWLVVIHESAGKGCTKPQMIDCYIQTLAKVLGSSSSPPLVLPNSRFVLRFLLFPFLSSFCFHGFGGRRIGKECVDVAVGSYMVLSKESTGCCELGHDAGVIYLVIKSASGSLITRWEGLEYYDQRWVEVNLQGASNVYGGCYDWEGVFNKKNPTICSDL

SEQ ID NO: 123598 - protein, 85 aa, Glycine max
  Coding DNA Sequence Number=SeqID_6820
MASTSSLRHGRRGTGRQQRGQWRENNGRKNRTKRATRATATDHHHQPFAHKSNSREATCRKREHMLDEPLGVTNEGVTRVVQPTT

SEQ ID NO: 123599 - protein, 697 aa, Glycine max
  Coding DNA Sequence Number=SeqID_6821
  Gene Ontology: Mol. function=DNA binding; Cellular component=nucleus; Biological process=regulation of transcription, DNA-dependent
  Homolog annotation: Hit_ID=Q8L5P7; Match level="QueryCoverage=86%, HitCoverage=80%, E-value=0.0, Identity=74%"; Hit description=LHY protein
MELPHQFLLLAIAADSTTLVQHEKTKCSEKQNPYFYWKVPIASINIGGVTKNDNHHHWESDDWRGPSTGTLSFNHRREKMLEKEAFVKGVPIGQALDIDIPPPRPKRKPNNPYPRKTRIGTTSLHSGAKDGKLNLVESSHVNQALDLKKEPLPEKHDLDEGLTTVKENKDENHAKVFTLLQEVPCSSVSSANESSITMSVPLGNPCAFKEITPSVKEVIARDEKTESFVTVEPENGKLEINDGKQTNGTSKDSRLEDSDALHMKLVQNEKPDGLDCELTIDGMQGNQNYPRHVTVHVVDGNLGTNTQNPSQDMLFRDSMFQPIGGVNGQRNVFTNTAPSNTSESQNNTARSSVHQSFLPYPPFTQHNQDDYQSFLHMSSTFSNLIVSTLMQNPAAHAAASFAATFWPYANPETSANSPRCSQGGFTNRQIGSPPSVAAIAAATVAAATAWWAAHGLLPLCAPLHTSFACPASVTTVPSMNTGEAPALKAEQEKTTLQNPPLQDQMLDPEYSEAQQAQHSASKSPAAILSDSESGDAKLNTSSKVTDHETNKTISEHLDSNKTKGRKPVDRSSCGSNTASSSDVETDALEKGEKGKEEPEIPDANQLAIEFSNRRRSVSNLTDSWKEVSEEGRLAFQALFSREVLPQSFSPPHALKNTDHQMDNANDNKQNIDDKDEDLDGSKKCSSNYEAMQKNLLL

SEQ ID NO: 123600 - protein, 132 aa, Glycine max
  Coding DNA Sequence Number=SeqID_6822
MRGSDFNYKEQKQAQPTVQQLLSVQGIVTSGINLVVNALFLNPLILFFGAFSPQLKSHPQTPTPLFSVRKSAASCHTWGPQVARQRLRPITPPHGASLFTVRYLLCVPWLNLDLFLDDNNLSTRHTIVTLFV

SEQ ID NO: 123601 - protein, 230 aa, Glycine max
  Coding DNA Sequence Number=SeqID_6823
  Gene Ontology: Mol. function=oxidoreductase activity
  Homolog annotation: Hit_ID=Q9ZSA8; Match level="QueryCoverage=95%, HitCoverage=76%, E-value=3e-13, Identity=62%"; Hit description =F3H7.16 protein (Putative Fe(II)/ascorbate oxidase)
MVPEGVIEKMMKVSREFFGLPESERLKSYSNDPFKASRGLLETSLSPYRRLHKGMALQPSIFQMISNDKYKSVLHRALVNCKKERVSIPSYDTTRMSGTGDFPNKLASISSRPNTAIRPGFHCEASGHSSISKAFMAPVTLTSSKTLAKLAKVMDFFRYVNLMTYYTMMNREDVAEYSMKMRELALKLVEAISESLGEKAVGKHGQHMAMNYYPPCPEPELRRHHHTPSR

SEQ ID NO: 123602 - protein, 54 aa, Glycine max
  Coding DNA Sequence Number=SeqID_6824
MVITTFNGTGVGFGTLVWVSRFLHIRNLDSLSHAKFSFSGFGVGCGFGIGWGFG

SEQ ID NO: 123603 - protein, 53 aa, Glycine max
  Coding DNA Sequence Number=SeqID_6825
MKHVRINRNFIKSDIENGMPLNLLGLGAVFNGYDYDILYEVCCLPPHTKNPTS

SEQ ID NO: 123604 - protein, 121 aa, Glycine max
  Coding DNA Sequence Number=SeqID_6826
  Gene Ontology: Mol. function=nucleic acid binding; Cellular component= intracellular
  Homolog annotation: Hit_ID=Q8GT87; Match level="QueryCoverage=60%, HitCoverage=33%, E-value=1e-15, Identity=48%"; Hit description=Fiber protein Fb2
  Pfam annotation: Domain name=Di19; Domain location=10-120; Score= -34.0; E_value=3.1e-06; Accession=PF05605.3; Description=Drought induced 19 protein (Di19)
MEDETLSLGLSTASRSYQSRLKSHFAELFIDFDEVNGDEELRTAYPCPFCTEDFDLLELCCHIDLDHPVEAKSGTKTHQLDYFREISSNHHELLNPSIMQPPPHPQTMKSKPDPSNSSWLS

SEQ ID NO: 123605 - protein, 306 aa, Glycine max
  Coding DNA Sequence Number=SeqID_6827
  Gene Ontology: Mol. function=protein transporter activity; Cellular component=integral to membrane; Biological process=intracellular protein transport
  Homolog annotation: Hit_ID=O65359; Match level="QueryCoverage=87%, HitCoverage=89%, E-value=2e-87, Identity=61%"; Hit description =Syntaxin-41
  Pfam annotation: Domain name=SNARE; Domain location=214-273; Score =55.6; E_value=1.7e-13; Accession=PF05739.9; Description=SNARE domain
  Pfam annotation: Domain name=Syntaxin; Domain location=80-177; Score =74.4; E_value=3.5e-19; Accession=PF00804.15; Description=Syntaxin
  Pfam module annotation: Pfam domain module=SNARE::Syntaxin; Domain location=214-273::80-177
  Subcellular localization annotation: CTP_CleavageSite=65; ConfidenceScore=5.43e-01
MATRNRTIEFRKHRDAVKSVRAPLSSSASASTGPVIEMVTTSLLPPNRSSSYALLSTQEPAPSTSSDYLGDIRDAFTVGLPPSWVDDSEEIATNIQRARVKISELTKAHAKALMPSFGDGKEDQRHIETLTQEITSLLRKSEVRLRRLSAAAGSSEDSNVRKNVQRSLATDLQNLSMDLRRKQSAYLKRLQQQQEGYDGIDLEMSFTGSKFGSQNDEFSDVVVKSVHELAQIMKDLSVLVIDQGTIVDRIDYNIQSVSTSVEEGLKQLQKVWGFAFEVPLAKMIGSLLRGKLGMALYSIPSCKHWY

SEQ ID NO: 123606 - protein, 858 aa, Glycine max
  Coding DNA Sequence Number=SeqID_6828
  Gene Ontology: Mol. function=cellulose synthase (UDP-forming) activity; Cellular component=membrane; Biological process=cellulose biosynthetic process
  Homolog annotation: Hit_ID=Q09HT7; Match level="QueryCoverage=91%, HitCoverage=69%, E-value=0.0, Identity=60%"; Hit description =Cellulose synthase-like D4
  Pfam annotation: Domain name=Cellulose_synt; Domain location=278-858; Score=893.2; E_value=1.2e-265; Accession=PF03552.5; Description =Cellulose synthase
  Subcellular localization annotation: CTP_CleavageSite=38; ConfidenceScore=5.81e-01
MVKTASPSSSSPVTITVSSGGRRRSMGLTSPIPRASVSANNPASPLRASGCGGRRISGGGASKDGGIEESNTEFVSYTVHIPPTPDRRPLTASEDGKSGTSFISGTIFTGGYNSVTRGHVMECSMESDAQAKTSSSVCGMKGCDEEAIKGRLCGGPCECGFKICRDCYLECGGKNGGGKCPGCKEPYKYVSDDDEDDEEEDEDQPLPLPSMAEFKLDKRLSVVKSFKAQNHPPDFDHTRWLFETKGTYGYGNAVWPKDGYGPNGFDPPPEFGEKARRPLTRKVGVSAAIISPYRLLILLRLAALGLFLTWRVRHPNHEAIWLWAMSITCELWFAFSWILDQLPKLCPVNRVTDLSILKGRFESPNLRNPKGRSDLPGIDVFVSTADPEKEPPLVTANTILSILAIDYPVEKVACYLSDDGGALLTFEALAETASFARIWVPFCRKHHIEPRNPEAYFGQKRDFLKNKVRLDFVRERRRVKREYDEFKVRINSLPESIRRRSDAYNAHEELRAKKKQMEAGSNVSEPIKVPKATWMSDGSHWPGTWASAEQDHSRGDHAGIIQAMLAPPNAELEFGTETDGENLIGTTDVDIRLPMLVYVSREKRPGYDHNKKAGAMNALVRTSAIMSNGPFILNLDCDHYIYNSLAMREGMCFMLDRGGDRICYVQFPQRFEGIDPSDRYANHNTVFFDVSMRALDGLQGPMYVGTGCIFRRTALYGFSPPRATEHHGWLGRRKIKLFLRKPKVSKKEVDEVCLPINGDHNDDDADIESLLLPRRFGNSTSLAASIPVAEYQGRLLQDLQEKGTQGRSAGSLVVPREPLDAATVAEAISVISCFYEDKTEWGKRVGWIYGSVTEDVVT

SEQ ID NO: 123607 - protein, 60 aa, Glycine max
  Coding DNA Sequence Number=SeqID_6829
  Subcellular localization annotation: CTP_CleavageSite=36; ConfidenceScore=5.43e-01
MNNPSGLPIPHSGTRKSLLSFIQRSTTKRNITSCPSAGPKTEQNKETQLLMDTTTFACNR

SEQ ID NO: 123608 - protein, 222 aa, Glycine max
  Coding DNA Sequence Number=SeqID_6830
  Gene Ontology: Mol. function=identical protein binding; Cellular component=cytoplasm; Biological process=negative regulation of enzyme activity
  Homolog annotation: Hit_ID=Q2HRK7; Match level="QueryCoverage=99%, HitCoverage=29%, E-value=2e-91, Identity=70%"; Hit description =Protease-associated PA; Proteinase inhibitor I9, subtilisin propeptide
MSCPHVTGLAALLKGIHPEWSPAAIRSALMTTAYRTYKNGQTIKDVATGLPATPFDYGAGHVDPVAAFDPGLVYDTTVDDYLSFFCALNYSPYQIKLVARRDFTCSKRKKYRVEDLNYPSFAVPFNTAYGVKGGSSKPATVQYTRTLTNVGAAGTYKVSVSQSPVKIVVQPQTLSFRGLNEKKNYTVTFMSSSKPSGTTSFAYLEWSDGKHKVTSPIAFSWT

SEQ ID NO: 123609 - protein, 73 aa, Glycine max
  Coding DNA Sequence Number=SeqID_6831
MVPSTSRCLSAQCSLQRKRTKYNIHQVHPLKVTKDLGDHLDMSFEGMKEYQELLRQLEPMFEEESDNSFKDTS

SEQ ID NO: 123610 - protein, 755 aa, Glycine max
  Coding DNA Sequence Number=SeqID_6832
  Gene Ontology: Cellular component=mitochondrion
  Homolog annotation: Hit_ID=Q10G00; Match level="QueryCoverage=97%, HitCoverage=94%, E-value=0.0, Identity=51%"; Hit description =Expressed protein
MVVKMMRWRPWPPLLSKKFQVRLHVRRLQGCDLLQNAALQGSRLVLEIRWKGPKLILGSLRWNSVARNFTKEADFELDGGGAAVVHWDEEFQTMCNLNGYRDNVFHPWEIAFTLFNGLNQRPKNKVPAIGTALLNIAEFASSTDQKDFDLNIPLTLTGGSGEPSPLLCISISLMELSVAQESLEPVQRSIVPVPSPSAKSGETALAEKDELSAIKAGLRKVMILTEFVSPKKAKKGCREEEGSEGRCSRSEDGEYNYPLDSESLDDSEEGETDGGKEDSSVRKSFSYGTLASANAGGFFHSNARVNCNDEDWVYYSHRKSDVGCSQREDSTASSSQPYLVQSSKRSILPWRKRKLSFRSPKAYKGEPLLKKVYAEEGGDDIDFDRRQLSSDESLSLTWYKIEDDTSAHRSSISDFGDDSFAVGSWEQKEVTSRDGHMKLQTQVFFASIDQRSERAAGESACTALVAVIADWFQNNCDLMPIKSQLDSLIREGSSEWRNLCENDAYRERFPDKHFDLETVIQAKIRPLTVAPGKSFIGFFHPEGMDEGRFDFLHGAMSFDNIWDEISRAGQECPSNGEPHIYIVSWNDHFFILKVEYDCYYIIDTLGERLYEGCNQAYILKFDSNTMMYKTPNVAHSSDDKTSNDQQTVAEILDPNNSQTQQVNSKEVDSVAGEKEQLRTEQEEQVICRGKEACKEYIKSFLAAIPIRELEADAKKGLISSASLYHRLLQIEFHYTQLLGETSPMAELRDLSSCNN

SEQ ID NO: 123611 - protein, 303 aa, Glycine max
  Coding DNA Sequence Number=SeqID_6833
  Gene Ontology: Mol. function=nucleic acid binding; Biological process= DNA integration
  Homolog annotation: Hit_ID=Q1SAJ1; Match level="QueryCoverage=71%, HitCoverage=85%, E-value=8e-40, Identity=41%"; Hit description=Zinc finger, CCHC-type
  Pfam annotation: Domain name=zf-CCHC; Domain location=277-294; Score =19.2; E_value=0.00067; Accession=PF00098.13; Description=Zinc knuckle
MGQTIPALCNLNWAHDSGGFDTKCYLGCPWTTVICLLNAKETKCAGHHDSIHSAKSRVVLRFNATIGIKSQVLEGILRWGQGLMWRSSQGKMISACGGSRCKLFLFIKGLMMHYKEPPSFHLHCQDLLSKAHSTIILSLGDEVLREVAEEKSAAEIWLKLESLYMTKSLTNKLYLKKRLHQLKMEEDVRIDEEDQAVMLLYSLPSSFENLVDTMLFGRDTLTLEEVKATLNSRELKKKITENKGEGGDPEALMARGRSEKRDSKSKNKRRSKSRNKKAGYYCKKEGHFRKECPERKKKNMVNP

SEQ ID NO: 123612 - protein, 254 aa, Glycine max
  Coding DNA Sequence Number=SeqID_6834
  Gene Ontology: Mol. function=protein disulfide oxidoreductase activity; Biological process=cell redox homeostasis
  Homolog annotation: Hit_ID=Q8H558; Match level="QueryCoverage=81%, HitCoverage=82%, E-value=3e-34, Identity=38%"; Hit description =Peptide transporter-like
  Pfam annotation: Domain name=Glutaredoxin; Domain location=106-171; Score=53.7; E_value=6.1e-13; Accession=PF00462.14; Description =Glutaredoxin
  Pfam annotation: Domain name=SH3BGR; Domain location=103-193; Score= -16.6; E_value=0.031; Accession=PF04908.5; Description=SH3-binding, glutamic acid-rich protein
  Pfam module annotation: Pfam domain module=Glutaredoxin::SH3BGR; Domain location=106-171::103-193
MVRGRFVRKLKLVPTITNLKKQDLVLQKKFPTSYDDYKGNNLPELAVKDDNHFEEEEATVGSKKITELAEEKLVITKMPSCNNNEYPSLSDFKELRPQGGNSHSIILYTTSLRGIRKTFQDCNTIRFLLRSFKIMYHERDVSLHLEFREELWKILGGKVIPPKLFIKGRYIGGADEVVGLHEMGWLGKFLEGTPTHSSDSPCTGCANMRFTICSNCCGSCKVFTDNSDNKNNDECFVRCSLCNENGLVKCPVCC

SEQ ID NO: 123613 - protein, 681 aa, Glycine max
  Coding DNA Sequence Number=SeqID_6835
  Gene Ontology: Mol. function=ubiquitin thiolesterase activity; Cellular component=transcription factor TFIID complex; Biological process=ubiquitin-dependent protein catabolic process
  Homolog annotation: Hit_ID=Q9C585; Match level="QueryCoverage=97%, HitCoverage=72%, E-value=0.0, Identity=55%"; Hit description =Ubiquitin-specific protease-like protein
  Pfam annotation: Domain name=UCH; Domain location=81-678; Score =366.5; E_value=4.4e-107; Accession=PF00443.19; Description=Ubiquitin carboxyl-terminal hydrolase
MAKEEAFWCSMSIQVVLELQVHGLPDSVGGNGGNEMILDRSQTECSHSGSVIMNGSTDNVIPCISATNHFRGSSCRAIQSLGLTGLQNLGNTCFMNSAIQCLAHTPKLVDFFLGDYCKEINYENPLGMNGELALAFGDLLRKLWVPGAAPIAPRTFKMKLANFAPQFSGYSQHDSQELLAFLLDGLHEDLNRVKRKPYHEVKDADGRPDEEVAEEYWRNHLARNDSIVVDLCQGQFRSTLVCPICKKVSITFDPFMYLSLPLPSTTIRTMTLTVISTDGITSPSTITVTVPESGTLKDLIGALSTSCSLRDDETLLVAEIYRNKIFRVFEDPSDLLVEIRDQDKLVAYRMQKCNEPSPLVVFLHERLAENFGKERFENRLFGIPLVTRWSSISCGYDDVQKEFLKLINPFLMRTEDVLHEYDKNDGVNKRVSEDDELGDATNSAAIGNDADSNSGTEDGIHSSTAFEFYLQGIERAKIIVKKPLPQVTTLPGKLPVVVVLWSDKMLKMYDTYLLDSLPEVFKPQLFAKRMQESVSIYKCLEAFLKEEPLGPEDMWYCPHCKEPQQAYKKLDLWRLPEILVVHLKRFSYSRYFKNKLETFVDFPINDLDLSTYVAHGNSQSSNRYVLYAISCHYGGLGGGHYTAFVRYGYDKWYDFDDSRVESVSEDMIKTPAAYVLFYRKI

SEQ ID NO: 123614 - protein, 148 aa, Glycine max
  Coding DNA Sequence Number=SeqID_6836
MWVALFYILVRPSNQSSTYCLNTLRQELRTREMCVSVVESGNRNRQAGKKTLHFCATLCLIAPFPFQHCQRATQISRSSERHRRGNKTWFQQQQKQSKIRKRQGAHVSTEPRGFLSPNSLRPHGIPTLIHTQNASQKTPFRNPNGGGG

SEQ ID NO: 123615 - protein, 45 aa, Glycine max
  Coding DNA Sequence Number=SeqID_6837
WKMIPSPSASQPKKTNTLPKLSISVELPPHIRRTTVSLSPPIATH

SEQ ID NO: 123616 - protein, 236 aa, Glycine max
  Coding DNA Sequence Number=SeqID_6838
MQSRLAEATRRTSCALSSTTRFTLKRQLCSGTRIRTADPEIHSGELEAGPKVHRGQPQGISTQDKAKEARYSETERNASKAHEMLKSPKSPCEPSRKLKSAGVNQRLDPSIQQKREKGSKVGIEEVSCAGLDGTPWPEDTNKGKEKEDNREYFKRHKASPLSEIEFLDSRKPITRASDKTADSGRGVGVIGWLPEQMETAEETLMRAAEMWRERAMRGDPDAPHSRVLRALRGEDF

SEQ ID NO: 123617 - protein, 107 aa, Glycine max
  Coding DNA Sequence Number=SeqID_6839
  Homolog annotation: Hit_ID=Q9C9V9; Match level="QueryCoverage=72%, HitCoverage=9%, E-value=3e-14, Identity=52%"; Hit description =Putative golgi transport complex protein; 67058-70172
MSNASKVILIVEAEDLKMELGGHGKINFFGVGDGHEVVKLIGEAEGVNGVLEELVGAMEVGELGGFGDNKVVRVEELGAEATDCNMENMDLREEGLCFLSFFNKIIY

SEQ ID NO: 123618 - protein, 50 aa, Glycine max
  Coding DNA Sequence Number=SeqID_6840
MGEGSHAITKVVVSRLQWLGWMAMAALHWWWQRGAYEVVGVRVEGWEWSM

SEQ ID NO: 123619 - protein, 46 aa, Glycine max
  Coding DNA Sequence Number=SeqID_6841
MSLRGEDGGAVAPSGLNLLESTQLKIGKRPNRKKAQRFSQRVVRAL

SEQ ID NO: 123620 - protein, 413 aa, Glycine max
  Coding DNA Sequence Number=SeqID_6842
  Gene Ontology: Mol. function=DNA binding; Biological process =regulation of transcription, DNA-dependent
  Homolog annotation: Hit_ID=O82799; Match level="QueryCoverage=78%, HitCoverage=91%, E-value=5e-53, Identity=42%"; Hit description =Putative RAV-like B3 domain DNA binding protein
  Pfam annotation: Domain name=B3; Domain location=89-197; Score=121.2; E_value=3e-33; Accession=PF02362.12; Description=B3 DNA binding domain
MELMQQVKGNYSDSREEEEAAAEIITITREPESSRLHQQDAASNFGKKLDLMDLSLGSSKEEEEGKLQQGGGGGGVVHHAHEIVEKENMFEKVVTPSDVGKLNRLVIPKQHAEKYFPLDSSSNEKGLLLNFEDRNGKVWRFRYSYWNSSQSYVMTKGWSRFVKEKKLDAGDIVSFQRGLGDLYRHRLYIDWRKRSAHPHAHHHAPDPLFLPSIRWYSLPPTMPPRYHHDHHFHHHLNYNNLFTFQQHQYQLGAATAAATAAHHGDQNSGSGSLYYLRSSMSMGGGDQNLQGRGNNIVPMIIDSVPVSVGHHNNRHGNGGITSGGATSSGKRLRLFGVNMECASSAEDSKGLSSGSAAHVTTAASSSLHQRLRLPLPHEDPLSSSSARFGDHKGGSTGTSLLFDLDPSLQYHRQ

SEQ ID NO: 123621 - protein, 219 aa, Glycine max
  Coding DNA Sequence Number=SeqID_6843
  Homolog annotation: Hit_ID=Q1SDA3; Match level="QueryCoverage=88%, HitCoverage=98%, E-value=1e-24, Identity=33%"; Hit description=IMP dehydrogenase/GMP reductase
METQPECAVINIPNIKTEQHVSVSPKKKNGGGMRFLRVALFKMRGRSAKPTALQVDNNEDGERSKSTWGKFVGSMRPLHLQSTQSPRSSPDSPSEYKSDCGGYVSDFGAEEEPYSPSPPSSRYASAVGLNELVQNDEENEKQEVIVEDYEQHVDGDGDEMIDAKAEDFIAQFYQEMKLQRLDSVDRRYVERSQRRQDRYYFCLMRNRNMKMAWAKVILK

SEQ ID NO: 123622 - protein, 84 aa, Glycine max
  Coding DNA Sequence Number=SeqID_6844
MVARRQATLRGHRWSWVVEKKVLRFGWAFGEEESEKSGEIGECDPEIKKACHMNNVEARRRKMVIDGEQERTLQDHRTPRVGLL

SEQ ID NO: 123623 - protein, 499 aa, Glycine max
  Coding DNA Sequence Number=SeqID_6845
MNLNHHDAPPYEHMLKESINRFFAEHRRGATDFADFTSIFSRMLHSTPEPPLPLLWFYAALEFRATREPSRRARDLFHLLASCSGARGSTKRIAALAPLLFVLHRSVLLRGEELLLKSEVEGLVEGVVSYCSICCGNEICREDDVAVLEFGDLVKVWTVDDDEDYNEGGVLGLGFFPFVSEEFRKGMIERGCEVGVLAGVVMWEALLLKLCLAFEKGIGRAEQEKRVMASAVQTITGFRSFRFLEALRYAKVWGRDVVRSLTLAYAKLDIGPILVLSGVTSLQFSCLFFLNADWSTFRYPFQDDVGTSFASDLSTGQYHGSENEVLLKEVLYNSVMMIDYSFINPQAEFSLYANSLKDFAITWLFVAELAVQSARYEKKTVYCVAVIDEGWLLVAEEQGIAVFAGETAKQINIMLKANFFTSRTECLLPVIKHFFNNLNKNLYLNSMNGEAGADKLDGDVEMLDTVDTVSLPAADSLNRVIEGTRKRKEGIEDDTITQL

SEQ ID NO: 123624 - protein, 611 aa, Glycine max
  Coding DNA Sequence Number=SeqID_6846
  Gene Ontology: Mol. function=RNA binding; Cellular component=nucleus; Biological process=regulation of translation
  Homolog annotation: Hit_ID=Q9T0G5; Match level="QueryCoverage=78%, HitCoverage=54%, E-value=1e-42, Identity=32%"; Hit description =Putative DNA-directed RNA polymerase
  Pfam annotation: Domain name=KH_1; Domain location=125-190; Score =73.3; E_value=7.9e-19; Accession=PF00013.19; Description=KH domain
  Pfam annotation: Domain name=KH_1; Domain location=217-283; Score =83.6; E_value=6.2e-22; Accession=PF00013.19; Description=KH domain
  Pfam annotation: Domain name=KH_2; Domain location=125-171; Score =6.1; E_value=0.022; Accession=PF07650.7; Description=KH domain
  Pfam annotation: Domain name=KH_2; Domain location=217-269; Score =6.0; E_value=0.023; Accession=PF07650.7; Description=KH domain
  Pfam module annotation: Pfam domain module=KH_1::KH_1::KH_2::KH_2; Domain location=125-190::217-283::125-171::217-269
MADESQYSANPDSTPTPPSLKRKYNDDHRPTGFSDGPDPAAPPPPSYNNVPPPSSAASDFELAKQRAQEVAARLLSGAAPLDPTKRPKHDNNGSSFDSIDVKGPYSVPSISPSAVSYSYQGGGASKKIDIPNGRVGVIIGKGGETIKYLQLQSGAKIQVTRDMDADPNSATRTVELMGSPDAIATAEKLINEVLAEAETGGSGIVARRVAGQAGSDEYVSKIPNNKVGLVIGKGGETIKNMQASTGARIQVIPLHLPPGDTSTERTLKIEGTPEQIESAKQMVNQVISGEVLGDIKVTLMPYSCVEVATHWDYSPFNHGLVCIGPLVTPTWNPFVGVLSACNGRVCFCWSNSVISRTSTNRQRNPSMSGGYSQQGYQARPPTSWGPPAAPMQQSGYGYVQPGAYSGPPQYNVPQQPYAGYPPQSSGGYSAANWDQSTAPQQQSAHAGYDYYSQQQQQQNPAPPSDGTAYNYSQPPSSGYSQPGQGYAQDGYGGYHAPPQSGYGQPPSYDQQQGYSSAASYGSNPAPEGHTANYGSQGDSTQAPPAQPPSQGYGTGQQPSPNAANYAPQAQPGYGVPPTSQPATYGSQPPAQSGYGSGDGPPQTQKPSGTPP

SEQ ID NO: 123625 - protein, 71 aa, Glycine max
  Coding DNA Sequence Number=SeqID_6847
MNVQTYTWSRGHILTDVFVGATTFLGTPRNSEEEWVLSEKVPWVTRIILRSYEIEIGLYFDLRMENEKGEL

SEQ ID NO: 123626 - protein, 101 aa, Glycine max
  Coding DNA Sequence Number=SeqID_6848
  Gene Ontology: Mol. function=DNA binding; Cellular component=nucleus; Biological process=regulation of transcription
  Homolog annotation: Hit_ID=Q1SDA6; Match level="QueryCoverage=85%, HitCoverage=24%, E-value=3e-40, Identity=87%"; Hit description=Myb -like DNA-binding domain, putative
  Pfam annotation: Domain name=Myb_DNA-binding; Domain location=14-61; Score=40.7; E_value=5.2e-09; Accession=PF00249.21; Description=Myb -like DNA-binding domain
MVRAPCCEKVGLKKGRWTTEEDEILTKYIMANGEGSWRSLPKNAGLLRCGKSCRLRWINYLRADLKRGNFSVEEESTILKLHASFGSSKNKTRDNPGHKTS

SEQ ID NO: 123627 - protein, 68 aa, Glycine max
  Coding DNA Sequence Number=SeqID_6849
MKQNLNLNVGVEGVWEEAGSVRRRDWECGKRLRRVGGVAPDPWTLPKALASGALPAVPRVMCTVEVSV

SEQ ID NO: 123628 - protein, 383 aa, Glycine max
  Coding DNA Sequence Number=SeqID_6850
  Gene Ontology: Mol. function=heat shock protein binding; Cellular component=endoplasmic reticulum; Biological process=protein folding
  Homolog annotation: Hit_ID=Q1SDA8; Match level="QueryCoverage=86%, HitCoverage=94%, E-value=1e-168, Identity=86%"; Hit description=Heat shock protein DnaJ, N-terminal
  Pfam annotation: Domain name=DnaJ; Domain location=56-118; Score =136.5; E_value=7.2e-38; Accession=PF00226.21; Description=DnaJ domain
  Pfam annotation: Domain name=DnaJ_C; Domain location=251-382; Score =66.9; E_value=6.5e-17; Accession=PF01556.9; Description=DnaJ C terminal region
  Pfam module annotation: Pfam domain module=DnaJ::DnaJ_C; Domain location=56-118::251-382
MANPTWRGMIGWNNQMVAVIGQFRNEHVAKPKPKPKRIPYFRLRSQVLAESLSLKSYYDILQLSKGASDEQIKRAYRKLALKYHPDKNPGNEEANKKFAEISNAYEVLSDSEKRNIYDRYGEEGLKQHAASGGRGGGMNFQDIFGSFFGGGQMEEEEKIVKGDDVVVDLDATLEDLYMGGTLKVWREKNVLKPASGKRRCNCRNEVYHKQIGPGMFQQMTEQVCEQCPNVKYVREGYFITVDIEKGMQDGQEVLFYEDGEPIIDGESGDLRFRIRTAPHDVFRREGNDLHTTVTITLVQALVGFEKTIKHLDEHLVDISTKLTDLYFLTRQEITKPKQVRKFKGEGMPLHMSNKKGDLYVTFEVLFPTSLTEEQKTKIKAILG

SEQ ID NO: 123629 - protein, 1378 aa, Glycine max
  Coding DNA Sequence Number=SeqID_6851
  Gene Ontology: Mol. function=RNA-directed DNA polymerase activity; Cellular component=chromatin; Biological process=chromatin assembly or disassembly
  Pfam annotation: Domain name=Chromo; Domain location=1275-1320; Score= 30.9; E_value=4.4e-06; Accession=PF00385.14; Description='chromo' (CHRromatin Organisation MOdifier
  Pfam annotation: Domain name=RVP_2; Domain location=298-430; Score= -41.3; E_value=0.0017; Accession=PF08284.2; Description=Retroviral aspartyl protease
  Pfam annotation: Domain name=rve; Domain location=1007-1163; Score =102.8; E_value=1e-27; Accession=PF00665.16; Description=Integrase core domain
  Pfam annotation: Domain name=zf-H2C2; Domain location=952-989; Score =21.7; E_value=0.00047; Accession=PF09337.1; Description=His(2) -Cys(2) zinc finger
  Pfam module annotation: Pfam domain module=Chromo::RVP_2::RVT _1::Retrotrans_gag::rve::zf-H2C2; Domain location=1275-1320::298 -430::523-850::76-166::1007-1163::952-989
  Subcellular localization annotation: CTP_CleavageSite=34; ConfidenceScore=5.37e-01
MTHKLDTLITTLSTSKSLDSLPTSFPHNPSPSPSASQPPRVKLDVPRFDGTDPLGWIFKITQFFEYHHTPEHERLTIASFYMDGRALAWYQWMVGNGQLSTWAGFLHALQTRFTSSQFDDPTGTLFKLTQRTTVAAYLSEFEDTANRVVGLPPHFLLSCFVSGLNPDIRREVQALQPLTLVQAAGLARLQEEKLVENRRSFRNRSPSFSMVPPTPISVPPSPRTISVQSLSPMPLKRLTPDELASRRERGLCFKCDERYHRGHRCQARVNLLIVDEEERSPKEAVPLGLSPEPHHPHDPNEAQLNLHSLTGPLAPETLRFSGLVASKQVLILVDGGSTHNFIQDAMLPELGLFPSDTTPLTVMVGNGQYLHCNQICTEVSIVIQGIHFIIDLHVLPLCGANVVLGVQWLWSLGPILTDYTTLSMKFMHEGRTIELKGDDTSALQPLSVPQARHLVQTYDPSACYLLSVTSLETPSNTSTYPPDIQSLLTKFASLFQPPQTLPPSRPTDHHIHLVPNSEPVNVRPYRYPHYQKAEIETQRFCVDYRELNALTIKDHFPIPAIDELLDELGGAAWFSKLDLLQGYHQILMSEGDISKTAFRTHHGHFEFTVMPFGLCNAPSSFQATMNTIFRPFLHQFIIEHFVLKFSKCTFAQPQVEYLGHVVSSRGVAPVLAKVQAIQQWSEPRSACALRNFLGLVGFYRRFIRGYASIDAPLTKLLTFEVFHWTPEAAAAFTTLKQMLTSSPVLRLPDFNLPFTVETDASGTGMGAVLSQQGHPVAYFSKMFPPKLLQASTYIRELFAITVAVKRWRQYLLGWSFTILTDHRSLKELLTQVIQTLEQQKYLARLMGYDYNIQYRSGSSNVVADVLSRVSEPIPELFLLLSVPCFTFLQELKAQLEQCPDYIQLRQTIIAQPDQNPDFSITKDFVLHKGRIWLPSTMPIVNTLLQEYHCTPTRGHMGVTKTLARLTENFYWQGIRKDVERFVASCLDCQQTKYETRKPTGLLCPLPVPCRPWEDLSLDFITGLPTFRGNTSILVIVDRFSKGIHLGMLPTHHTAYTVAILFMDLVGKLHGMPRSLVFDRDPLFLSKFWQELFRLSGTKLRLSSAYHPQSDGQTEVLNRVIEQYLRAFVHKRPSSWGKLLGWVEWSYNTSWNSSSGLSPYEITFGKKPFNFLQYLVGDSNVDVVDTMLKDHKKRREVEYQVGDMVLVKLRPHRQVSILGQTERIGSTAYKLQLPEEARIHPVFHCSLLKSYHSTEMDTSPHPSTLPILSNDDHLLIQPLTFLNTRRNKDSALEVLVQWQGLSPDDTTWENWDQLRADYHLEDKVLPEAVEAIQACGGQKTVDGRRFRTGGGVLWSIIKVREPNAYKEIMNKAKEFEECD

SEQ ID NO: 123630 - protein, 82 aa, Glycine max
  Coding DNA Sequence Number=SeqID_6852
  Gene Ontology: Mol. function=cysteine-type endopeptidase activity; Biological process=proteolysis
  Homolog annotation: Hit_ID=Q5QL07; Match level="QueryCoverage=54%, HitCoverage=9%, E-value=2e-16, Identity=86%"; Hit description =Vacuolar processing enzyme 2
MDLMSVIPVAIGTGEEDGPAGALDVVIVIGFGGQSEKVSGEVRAGGDEGGEGYEKEERGKKKSGHMESDHLAFFADVFDSTS

SEQ ID NO: 123631 - protein, 230 aa, Glycine max
  Coding DNA Sequence Number=SeqID_6853
  Gene Ontology: Mol. function=hydrolase activity; Biological process =traversing start control point of mitotic cell cycle
  Homolog annotation: Hit_ID=Q9M3Z3; Match level="QueryCoverage=66%, HitCoverage=38%, E-value=3e-72, Identity=84%"; Hit description =Putative PTS protein
MWNKVRTSPTDLPGYSIRRELLFYHNKLWLLSDCSFISGIQLLQYSHSVMEAYMNGPVSQKEPAPGLAYFHIPLPEYASFDSSNFTGVKQEGISSASVNSGFFTTLVEAGDVKAVFTGHDHVNDFCGKLTGIHLCYAGGFGYHAYGKAGWSRRARVVLVSLEKTDNGRWEDVKSIKTWKRLDDQNLTGIDGQVLWSKSFGSKISLDSGILGVLYFLISNLCYRLIDEIYL

SEQ ID NO: 123632 - protein, 369 aa, Glycine max
  Coding DNA Sequence Number=SeqID_6854
  Gene Ontology: Mol. function=triacylglycerol lipase activity; Biological process=lipid metabolic process
  Homolog annotation: Hit_ID=Q1SDA9; Match level="QueryCoverage=69%, HitCoverage=32%, E-value=8e-37, Identity=38%"; Hit description =Lipase, class 3
MLFIYTLYDVALPWNQAFCYNITTPSSICGIAPSISITASARANDYASHSQVKAVGSFSLFSRFSFRFPLKSFWPRPPTGNASGYHGLAVDDDAVLAENATAETERGEGEGQNGNWVLKIFHIRSVWRGEQRSDEGEAMANGQTDKECDDCRVEEEENEEVSFDRDSFSRMLRRVSLSEARLYARISHLGNLAYSIPKINPGKLFKHYGLRFVTSSIEKKKLAVAAEKNQTTFAATQKEETNEENGGETKEEKNNGGYMISASAAYEIAASAASYLHAQTRSILPFKSSDAVEGEGSHEASNERFNGEKMANTEEANLKATTDSVTAVVAANEQVKQVFADDLNSTSSSPCEWFVCDDDQTSTRYFVIQ

SEQ ID NO: 123633 - protein, 77 aa, Glycine max
  Coding DNA Sequence Number=SeqID_6855
QLGPLGPSRFFLQKVVASGGSNLAHLGELGGKLLPYFAIHRGRSEEEKGSAFLALRIHLKLLRIIVSVKKIQAEALP

SEQ ID NO: 123634 - protein, 104 aa, Glycine max
  Coding DNA Sequence Number=SeqID_6856
  Gene Ontology: Mol. function=dihydroneopterin aldolase activity; Biological process=folic acid and derivative metabolic process
  Homolog annotation: Hit_ID=Q6TFM2; Match level="QueryCoverage=92%, HitCoverage=73%, E-value=2e-28, Identity=64%"; Hit description =Dihydroneopterin aldolase
  Pfam annotation: Domain name=FolB; Domain location=12-104; Score =59.0; E_value=1.5e-14; Accession=PF02152.8; Description =Dihydroneopterin aldolase
MESDALTWGDKLMLWGLSFHGFHGAKPEERTLGQKFFIDIDAWMDLKAAGKSDHLSDTVCYTEEIYDIAKEVLEGSPHNLLESLAQKIAITITNHKEISAVRVK

SEQ ID NO: 123635 - protein, 269 aa, Glycine max
  Coding DNA Sequence Number=SeqID_6857
  Gene Ontology: Mol. function=nucleotide binding; Cellular component =membrane; Biological process=small GTPase mediated signal transduction
  Homolog annotation: Hit_ID=Q40192; Match level="QueryCoverage=87%, HitCoverage=98%, E-value=1e-105, Identity=83%"; Hit description =RAB11B
  Pfam annotation: Domain name=Arf; Domain location=44-218; Score= -47.1; E_value=3.8e-06; Accession=PF00025.11; Description=ADP -ribosylation factor family
  Pfam annotation: Domain name=Miro; Domain location=59-173; Score =65.7; E_value=1.5e-16; Accession=PF08477.3; Description=Miro-like protein
  Pfam annotation: Domain name=Ras; Domain location=59-220; Score =300.7; E_value=2.7e-87; Accession=PF00071.12; Description=Ras family
  Pfam module annotation: Pfam domain module=Arf::Miro::Ras; Domain location=44-218::59-173::59-220
MANKELNIALMYLHRDTVVSQLQKVLLIDLGKKMNQEMNGVEAERVKVNVHDKIDYVFKVVVIGDSAVGKTQILSRFAKNEFCFNSKSTIGVEFQTRSVTINGKVIKAQIWDTAGQERYRAVTSAYYRGALGAMLVYDITKRQSFDHVARWVDELRAHADSSIVIMLIGNKGDLVDQRVVHAEDAVEFAEDQGLFFSETSALSGENVESSFFKLLEEIHRVISKRSLECDNGKANADNNVATLKGSKIDVISGAELEIAEMKKLSSCSC

SEQ ID NO: 123636 - protein, 177 aa, Glycine max
  Coding DNA Sequence Number=SeqID_6858
  Homolog annotation: Hit_ID=Q2R2E6; Match level="QueryCoverage=99%, HitCoverage=45%, E-value=1e-30, Identity=44%"; Hit description =Expressed protein
MVKKGNIVQYRERLDNTLALPDLTNEQILKTLVKSQLQRSSEVEIEGCNEKEVETKTTELCNLLDMLRSASGDNGGGSSSTSHADWKLYAFHGRPPSTRNERMKVPWPLSTREAIVHYYLFEYFQDDLVVILLNTVSESKTDNLNKDAIPEAKDVVRIDLVGGYAMQKVTSERSYFR

SEQ ID NO: 123637 - protein, 97 aa, Glycine max
  Coding DNA Sequence Number=SeqID_6859
MGLKFDVSFGKGIYANGRSEIGTFFPKTFQKNLLPEAFRKNLLPEEQFVFYRKNLLPESFRKKVLSVEQFVHPEEGSSGKLPEEGSSGKFSEKRFFR

SEQ ID NO: 123638 - protein, 351 aa, Glycine max
  Coding DNA Sequence Number=SeqID_6860
MGNDKDKDFSKALEDTLYVRIHEALLSTRESKAMAGEELKQDASIVPTEELVQSEDEAKDVTCEDSSNQCSNNYIGETLDAGSEEVVEADCKEILQIEEDVNKVLSIPIEEGNSLSVLMGKENGEIVETDSEEIVEIEMDVNKMHDLPVEEDGTKSVLKDRMNAYIRSDVRNALETIERVISVVRECGFHSLGSTLNSAGEEFHCMENGGTVDSDSAKVIEVCLKNEVSVKVSSSNMLEENLEEPGTIQSFRHTGTNANKEVNYKKVVPASPEQNLSRPMEANQADSYSLKNGTTLDQTIYDNKQLNSDAVQDMSSDDLKKSTREINIQGVIFNPPFTNSMIPMDVLKSRS

SEQ ID NO: 123639 - protein, 112 aa, Glycine max
  Coding DNA Sequence Number=SeqID_6861
MSKKSVVSSRAIYGRMTVLIFDGQAALVIRTFVPHLGFDSEEEIRRPAECCNQTKSILKRISQMRYLKEESSSVPSVRRGIPIEEYRRPETYPKSNENESGDTDFVAMAKDV

SEQ ID NO: 123640 - protein, 475 aa, Glycine max
  Coding DNA Sequence Number=SeqID_6862
  Gene Ontology: Mol. function=protein serine/threonine kinase activity; Cellular component=flagellin-based flagellum; Biological process=protein amino acid phosphorylation
  Homolog annotation: Hit_ID=P93838; Match level="QueryCoverage=100%, HitCoverage=79%, E-value=1e-161, Identity=62%"; Hit description =Calcium-dependent calmodulin-independent protein kinase CDPK
  Pfam annotation: Domain name=Pkinase; Domain location=127-385; Score =372.4; E_value=7.1e-109; Accession=PF00069.15; Description=Protein kinase domain
  Pfam annotation: Domain name=Pkinase_Tyr; Domain location=127-383; Score=-33.9; E_value=2.2e-10; Accession=PF07714.7; Description =Protein tyrosine kinase
  Pfam annotation: Domain name=efhand; Domain location=432-460; Score =33.3; E_value=8.5e-07; Accession=PF00036.22; Description=EF hand
  Pfam module annotation: Pfam domain module=Pkinase::Pkinase _Tyr::efhand; Domain location=127-385::127-383::432-460
MGNNCLGSKTSNDALFPYVLPSSFWWLHQTSVKEISDAPSIVSRIQDTHFLENVQEKPPLVVKINNEEMKLKPVPLPTNKHQKETNMSSGEQIRQIQKMPHKVKRLPIGLQAESILKRKNGNFKEYYNLGQELGKGQYGTTFLCTEKATGKKYACKSIPKVKLAMDDDVEDVRREIEIMHHLEGCPNVISIKGSYEDGVAVYVVMELCGGGELFDRIVEKGHYTERKAAKLARTIVSVIEGCHSLGVIHRDLKPENFLFVDGNEESTLKAIDFGLSVFFKPGDIFKDVVGSPYYIAPEVLRRHYGPEVDVWSAGVIIYILLCGTPPFWGESEQEIFEEVLHGDLDFSSDPWLNISESAKDLVRKMLVRDPRKRMTAHEVLRHPWIQVDGVAPDKPLDSAVLSRLKQYSVMSKLKKMALRVIAENLSEEEIFELKVMFKMIDTDNSGHITLEKLKAGLKMLGANLSEPEILDLMQA

SEQ ID NO: 123641 - protein, 118 aa, Glycine max
  Coding DNA Sequence Number=SeqID_6863
  Gene Ontology: Mol. function=protein serine/threonine kinase activity; Cellular component=cytoplasm; Biological process=protein amino acid phosphorylation
  Homolog annotation: Hit_ID=Q5XLG2; Match level="QueryCoverage=98%, HitCoverage=31%, E-value=7e-43, Identity=75%"; Hit description =Calcium-dependent protein kinase 2
  Pfam annotation: Domain name=efhand; Domain location=30-58; Score =28.7; E_value=2.1e-05; Accession=PF00036.22; Description=EF hand
  Pfam annotation: Domain name=efhand; Domain location=64-92; Score =38.8; E_value=1.9e-08; Accession=PF00036.22; Description=EF hand
  Pfam module annotation: Pfam domain module=efhand::efhand; Domain location=30-58::64-92
MADVDNSGTIDYREFIAATLHLNKVEREDHLVAAFSFFDRSGSGYISQDELLKACKEFGMENVCLEEMIQEADQNNDGRIDYNEFVAMMQRGNADFSQNGLKGDTDFSIGFREALLVC

SEQ ID NO: 123642 - protein, 456 aa, Glycine max
  Coding DNA Sequence Number=SeqID_6864
  Gene Ontology: Mol. function=nucleic acid binding; Cellular component= chromatin; Biological process=DNA integration
  Homolog annotation: Hit_ID=Q1T010; Match level="QueryCoverage=99%, HitCoverage=31%, E-value=1e-129, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
METVRIITAISSKKGWHMHHMDVKSAFLNGPLEEEVYVSQPPEFEIKGSEEKAPRAWNRRIDGFLMRLGFLKCTTKHGVYIKGSNSTILTVVCLYVDDLLVTGNNETEIANFKGEMMREFEMTNLDLIYYFLGIEFKRTDEGVIMHQGRYARDVLKKFRMVDCNSVDTPTATGVNLVKDPNEEEVDVTLYRKMVGSLRCLCCTIPDLLYAVGLISRYMENPKLSHFRATKRIMRYVKGTLDYGILFPSAAKKCNVLGYSDSDWCGDKSDRKSTTGYVFFYGDAPISWSSKKEQVVALSSCEAEYIAAAMTACQAQWLDNIFGELKMKEKGTITLMVDNKSAINLAKQPVAHGRSKHIETRFHFLREQVTKGKLSVKYCPTIVDNKSAINLAKHPVAYGRSKHIETRFHFLREQVTKGKLSVKYCPTIVQVADIFTKPLKIYQFKELRSRLGVIEVQ

SEQ ID NO: 123643 - protein, 441 aa, Glycine max
  Coding DNA Sequence Number=SeqID_6865
  Homolog annotation: Hit_ID=Q9SJ62; Match level="QueryCoverage=83%, HitCoverage=88%, E-value=2e-47, Identity=36%"; Hit description =Expressed protein
  Pfam annotation: Domain name=TPX2; Domain location=247-303; Score =93.9; E_value=5e-25; Accession=PF06886.2; Description=Targeting protein for Xklp2 (TPX2)
MESENGVAVEEEKRVIGVTTKVENVKKEVENDCNGAEIMTKNEVSKPTVVAKRPISAGDKVAVEASKTYANKNSKGATTKETVGRASVASKNNKYAKDKPILKGPSSISQKQRPSLSQSLSFPAKSAGEDAMQKSIDGYLVKPKVRNNQGNGIRGEAPIRHLNKSTNSEVNSLAKTNTGMPGLKRSAFGRSTTVAAFTKSQTSEASLPVDQVSNTAKTAKADKENDDSHSTTSATPCLRSSGSGFSFRLEERAEKRKEFFSKLEEKILAKEAEKTNLQAKSKENQEAEIRLLRKSMAFKATPMPSFYKEPPPKVELKKIPTTRAKSPKLGRHKESAMNNNSGEDKTCSIPRGKQQQNDSNKVKGHKDMVSKKPIRKTQAKVKSQENVTPENKEQCQDTHVNNSECKNDMELQSETGHAPNSTLLLNSTTPELLSYEVTVGV

SEQ ID NO: 123644 - protein, 336 aa, Glycine max
  Coding DNA Sequence Number=SeqID_6866
MVLAEGESLPAYSRYYRMPTDIREIEAALCIPSRGFVLYAEGHLGKILRKDLTTLAQLDMNVGALISGQITSMAQSNSYRLGFPTLITALCRSRGVASDSLVFERLSPVINFAYIRKNCWNPNDLTVTIRGAKRARARPVEAPSTSAAPPLARSSVAPSTPPSVDFQRLEAMLRSIHQGQIVLLHSLQLVAPPDFIPYVEQFNEWVAWPGTQPPLHREDEGPTAQVPQQMEDESSETSTPEPLIKRKKVVETQEAAATSEKSLEATSKKSLEASPEPPAPVADTTSPQQAIEPSTVEDQTTPVMSSNASPIATHVVRFTDEEDVQTQDTQDQSQDF

SEQ ID NO: 123645 - protein, 199 aa, Glycine max
  Coding DNA Sequence Number=SeqID_6867
  Subcellular localization annotation: CTP_CleavageSite=80; ConfidenceScore=5.70e-01
MGESDQTISTSVSHPNTLTVLQSPSPAAPATTSQTGAVSVNSSEATTPASSPSNSSPLPQGTSELPNTPPAIVSSNVEITAAEVSLSSPVTDSVPPVTPNTPPATVSSNVEVTAAEVPLSSPVTDSVPPVTASQNALVRPDNVLMCTRAKAGVVEPRLHPTLLAHSEPKSTKTALSNPTCLAAMKAEYGFDEEWHMNCY

SEQ ID NO: 123646 - protein, 63 aa, Glycine max
  Coding DNA Sequence Number=SeqID_6868
MIQREWRKELAFPVTRNAVDSDSKCPFASSKVQPFEGAGRRCNRLHKYGNRLPESNIARNNCL

SEQ ID NO: 123647 - protein, 470 aa, Glycine max
  Coding DNA Sequence Number=SeqID_6869
  Gene Ontology: Mol. function=DNA binding; Cellular component=nucleus; Biological process=protein modification process
  Homolog annotation: Hit_ID=Q10PJ6; Match level="QueryCoverage=96%, HitCoverage=97%, E-value=2e-37, Identity=28%"; Hit description=Helix- loop-helix DNA-binding domain containing protein, expressed
  Pfam annotation: Domain name=F-box; Domain location=332-379; Score =38.9; E_value=1.8e-08; Accession=PF00646.23; Description=F-box domain
DIGSNTMKLRLRSLESKETLKIEVPDSCCSLQQLKDTVSHTISSSSSSSSSVHLSLNRKDEIHAPSPDEPLQSLGVAAGDLIFYSLNPTAFSLETLPHKPETAPLDGPTIQDSPETLAGDAPSVPTAEKPPTLDSAEPEPAEMIDGSDGTVVVSTNSEPFFVRRVLKEALGNNVTDFKLLVFAVHGVVLESGFVRIDKDSRMAVSCSDLLDDSPSAFSSVISLRYTLPEILANGASHSVNLKFQTLGHFVNVCGSLSDDVRSMLHFVCLDTRKYVRPLESMLANSETKGSLNDGEDIVFGNEVFEMWKMGKDRLALPLLIDLCEKAGVDLPPCFMRLPMELKLLILERLPGVDLAKVACTCSELRYLSTSNELWKKKYEEEFGKEGDRKGWLFKDLFALSWETKKRRQAVPFRRQGISRNIIFSPNHFGMPPVWGGEYGVQPVFGVPFPRYQPRRNIIPPCTLTLGDFNI

SEQ ID NO: 123648 - protein, 36 aa, Glycine max
  Coding DNA Sequence Number=SeqID_6870
MSTVQVRLKVTRRRITNTRQSSMGKIPLGYIKIVTG

SEQ ID NO: 123649 - protein, 171 aa, Glycine max
  Coding DNA Sequence Number=SeqID_6871
  Subcellular localization annotation: CTP_CleavageSite=25; ConfidenceScore=5.63e-01
MALTVTVNKYASSNLQAVPRTQGKVATKKTTPTLSTNVEMGRRGLVLSTVIATTQVPEPDSRTQLLKKYQKKSEENKEKNDKERLESYYKRNYKDYFELMEGTLKAKDGKLSDTEKVGGAQMTLNLLLYTVALPMELYIRDVHRYLVDCDSRVLEILRVQLFQVIELMNLI

SEQ ID NO: 123650 - protein, 806 aa, Glycine max
  Coding DNA Sequence Number=SeqID_6872
  Gene Ontology: Mol. function=protein binding; Cellular component =nucleus; Biological process=mRNA processing
  Homolog annotation: Hit_ID=UPI00005DC1C7; Match level="QueryCoverage =92%, HitCoverage=80%, E-value=1e-119, Identity=36%"; Hit description= protein binding
  Pfam annotation: Domain name=FF; Domain location=467-524; Score=24.5; E_value=0.00038; Accession=PF01846.10; Description=FF domain
  Pfam annotation: Domain name=FF; Domain location=538-582; Score=20.5; E_value=0.006; Accession=PF01846.10; Description=FF domain
  Pfam annotation: Domain name=FF; Domain location=600-649; Score=24.2; E_value=0.00048; Accession=PF01846.10; Description=FF domain
  Pfam annotation: Domain name=FF; Domain location=674-730; Score=32.4; E_value=1.6e-06; Accession=PF01846.10; Description=FF domain
  Pfam annotation: Domain name=FF; Domain location=760-806; Score=2.7; E_value=1.2; Accession=PF01846.10; Description=FF domain
  Pfam annotation: Domain name=WW; Domain location=256-285; Score=35.3; E_value=2.2e-07; Accession=PF00397.16; Description=WW domain
  Pfam module annotation: Pfam domain module=FF::FF::FF::FF::FF::WW; Domain location=467-524::538-582::600-649::674-730::760-806::256-285
ILIALLFLIALACGGLSAEMANNPQYPGLQPLRPPIAGSLDPPRNFVPPMPVQFRPVVPTQQSQQFISMPSQHYQHQPVGPGGVPLIGVGMPPQNQRSQFSQPIQQLPPRPSPQLPPPSQAIPMPVARPNMHIPSESMMHQPDSQVHSQAPNGYTPGLGGPAMPLSASYTFAPSAYGQVQTNFSSTGQFQPVPQIHALTGSSSQSITTGATLQSNGGQPSVTTVMPSATIAQPQLAKNGPTDWIEHTSATGRTVDATTNWKEYTSPDGRKYYYNKITNESKWSVPEELKLARELVEKAIVSGARPEALLNSHPQPSPTPSAIEATPNADNSSLPSQGEPSSPVSVSPVVTTSISNLQSEMPSGSSPSPADAITGTKVDELEAPLNTVTPSDTSVGSDKAIVTDINTAVTPMNDVDNDSAQATLGSADGVSAEDKEDGKNDSIGEKSNDEAAETKAVEPEPPVYANKMAKDAFKALLESVNVGSDWTWDRVGNISMLQSMRLIINDKRYGALKTLGERKQAFNEIIVFVKPAVVAVVATILKQESTDLTSSARWSKAVSIFENDERFKAVERDRDRRDMFESFLEELLNKERAKVQEERKRNIMEYKKFLESCDFIKASTQWRKVQDRLEADERCSRLEKIDRLEIFQDYLHDLEKEEEEQKKIQKEELRKTERKNREEFRKLMEEHIASGILTAKTHWRDYYTKVKDLHAYVAVASNTSGSTPKDLFEDVAEELEKQLVFDELLERAKEKEEKEAKKRKRLSDDFFHLLHSTKDITVSLKWEDCRPHVEDSQEFRAIRLYHSALET

SEQ ID NO: 123651 - protein, 129 aa, Glycine max
  Coding DNA Sequence Number=SeqID_6873
  Pfam annotation: Domain name=DUF558; Domain location=28-129; Score= -70.0; E_value=0.0021; Accession=PF04452.4; Description=Protein of unknown function (DUF558)
MSQTLGLGGVIPRFVNRSWLRNLTGSVIRVQCDEFWHMTKVLRVQLFNGKGSLVEGCIQNIDRTGLDFVALNDLISIPPPNTQLHVFAGFGTLKGGRADWLLEKCTELGANSVTPLLTERSPSISCKWE

SEQ ID NO: 123652 - protein, 540 aa, Glycine max
  Coding DNA Sequence Number=SeqID_6874
  Gene Ontology: Mol. function=transferase activity; Biological process= cell adhesion
  Homolog annotation: Hit_ID=Q8RWC5; Match level="QueryCoverage=66%, HitCoverage=81%, E-value=1e-140, Identity=71%"; Hit description =Fasciclin-like arabinogalactan protein 16 precursor
  Pfam annotation: Domain name=Fasciclin; Domain location=276-409; Score=29.6; E_value=1.1e-05; Accession=PF02469.12; Description =Fasciclin domain
  Pfam annotation: Domain name=Fasciclin; Domain location=54-183; Score= 87.0; E_value=5.9e-23; Accession=PF02469.12; Description=Fasciclin domain
  Pfam module annotation: Pfam domain module=Fasciclin::Fasciclin; Domain location=276-409::54-183
  Subcellular localization annotation: CTP_CleavageSite=51; ConfidenceScore=5.11e-01
MDSSSIYGVSHRHFLTLFLLFLLPLHSHSAFSHNSSSSSQINSNSILVALLDSHYTELAELVEKALLLQKLEEAVGNHNITIFAPRNQALERDLDPEFKRFLLEPRNLRSLQTLLMSHILPTRIASHHWPSDDLRHRTLSDHRLHLASKPSGHRTVDSAEILRADDVLRPDGVIHGIERLIVPRSVQEDFNRRRNLAAISAVLPEGAPEVDPRTHRLKKPAPVPAGAPPVLPIYDAMAPGPSLAPAPAPGPGGPKHHFNGERQVKDFIHTLLHYGGYNEMADILVNLTSLATEMGRLVSEGYVLTVLAPNDEAMAKLTTDQLSEPGAPEQIMYYHIIPEYQTEESMYNTVRRFGKVSYDTLRLPHKVLAQESDGSVKFGHGDSSAYLFDPDIYTDGRISVQGIDGVLIPPEEEEERTRRTTPLVKVAAPKPRRVFGWSELREKLFGLSTFDFMFYIDGIELSGKDWCRIEYHFRVLVSTLHALLNYLGLIIEEEKSASHSALLSKELCMNVRFLEAVRNLPNIKDADKREGGVCRIFISV

SEQ ID NO: 123653 - protein, 161 aa, Glycine max
  Coding DNA Sequence Number=SeqID_6875
MKPIVGPLGIVKLWLNAILANHITPEIDIPTHFKLKIKGARLTYLTPSKEFCTYECYTKYIKAFLNFAQFDNTLALFWTANSVGPEWLNLRFPLDTPSQQAKLVKIWSSFLSWGIIYIGTTSKDLKFYLYQPHIFTRQFECPEFYIGHGHENVVECYPMVK

SEQ ID NO: 123654 - protein, 86 aa, Glycine max
  Coding DNA Sequence Number=SeqID_6876
MSILDLIIEENAIKVDSTLDQLLNIGIEQNTPAIEEQVGIKVPVYISAPIPVIETNKPILEQSICCRRITHDGCKGSSKGNRSIGC

SEQ ID NO: 123655 - protein, 430 aa, Glycine max
  Coding DNA Sequence Number=SeqID_6877
  Gene Ontology: Mol. function=RNA-directed DNA polymerase activity; Biological process=RNA-dependent DNA replication
DMVQTTIDEGRLKFEEKPMKVDTDPFHIQANYVEPMQIKMIGALIWTLKVSTPLSEEEINQALEEFEKEEDAMFDTSAAKAFEASKIQKSFKKVQSLKGVVWHFEGEEQLKVRGRDIIAIKILLGSTSWIQKEMIADSFEFRFEDSLEAICGVISILPVEYTKDYQNMNILSDYTREDYFDDPFLSPKVVWVTQVSCFTPHQNAAIFNLPTKDMRCHMKPLHLIAMVEDQIINKILVYGGDAFNILPRSMLCRFGRTIEDSILHNIVVSDFYGKPSDSEEAICLDVSVGNRRSPTMFLVIWSQHNFNMLSGREWIYGVGDQAMVRTASFEIEDSFYVNNKSAYARFVARLSAYIAENKSKWLLQSSKMRNQLLQLSKKKTRLLRPSKSEKTATTIVKSKTMATMAIEENMMDTDAIEVEKRMMDINAIKE

SEQ ID NO: 123656 - protein, 124 aa, Glycine max
  Coding DNA Sequence Number=SeqID_6878
  Pfam annotation: Domain name=VQ; Domain location=45-75; Score=32.2; E_ value=1.8e-06; Accession=PF05678.4; Description=VQ motif
  Subcellular localization annotation: CTP_CleavageSite=72; ConfidenceScore=5.00e-01
MNSQAASRHKQLQGPKPASLIINRNSTKISKQKQHLSHHSPVIVHLKSPKVIHVRPEEFMSLVQQLTGNPVSAAAVAANSPKMEKSSTVAAMDENPVEDFIGSLGRTANISVDFQALMHFVDFV

SEQ ID NO: 123657 - protein, 141 aa, Glycine max
  Coding DNA Sequence Number=SeqID_6879
MENSMRLGLMAVVAVSGSMAFLVHQVHKRILSNFMEKFECEMGGVLYAHGQKNLCGSEKHQAKKKVRFAKEALGNNNCRKGDRMVKIRVQRIKAEEILVIKNVQKWRHGPKLEDMMPPNRAVLYRGIMKHRNRSIYGRLRF

SEQ ID NO: 123658 - protein, 185 aa, Glycine max
  Coding DNA Sequence Number=SeqID_6880
  Homolog annotation: Hit_ID=Q9SHT0; Match level="QueryCoverage=32%, HitCoverage=36%, E-value=5e-10, Identity=45%"; Hit description =Expressed protein
MRWKGKGRYLLGLQDRVHAHDVEQDNSPAGGWVDEPAAAAAAAAASLEDGDARGGGGGRHGGGVRGGVLLLPLRRGELPPPGNLQGPCGAVPASAEKTAAPEDAEGRAAEAHAPPLLVRLDNNDDATRALEKEMWDQFYGTGFWRSSSNREVREEEVKPSQTLPSSNINVLVPNPQPQLFASSSS

SEQ ID NO: 123659 - protein, 798 aa, Glycine max
  Coding DNA Sequence Number=SeqID_6881
  Gene Ontology: Mol. function=nucleoside-triphosphatase activity; Cellular component=integral to membrane; Biological process=transport
  Homolog annotation: Hit_ID=Q93YS4; Match level="QueryCoverage=86%, HitCoverage=89%, E-value=0.0, Identity=65%"; Hit description=White -brown complex homolog protein 23
  Pfam annotation: Domain name=ABC2_membrane; Domain location=516-725; Score=130.5; E_value=4.7e-36; Accession=PF01061.14; Description=ABC -2 type transporter
  Pfam annotation: Domain name=ABC_tran; Domain location=208-397; Score= 165.2; E_value=1.6e-46; Accession=PF00005.17; Description=ABC transporter
  Pfam module annotation: Pfam domain module=ABC2_membrane::ABC_tran; Domain location=516-725::208-397
MENASTSSLARTKSDQLLETVATTAEKSPPSAEGGGVLSRKSSWRMTASSPGGGGGRNTYIRKARSAQLKVEVDEVGSGVALSRASSASLGLSFSFTGFTLPPDEIADSKPFSDDDIPEDIEAGTPKPKFQTEPTLPIYLKATMKLHLAINTTNRTCYMAINIAWSGSVLYKVSFHFTDVTYKVVMKGITTTKEKDILKGITGSVNPGEVLALMGPSGSGKTSLLNLLGGRLIQSTIGGSITYNDQPYSKFLKSRIGFVTQDDVLFPHLTVKETLTYAARLRLPNTLTKEQKEKRALEVIDELGLERCQDTMIGGSYVRGISGGERKRVCIGNEIIINPSLLFLDEPTSGLDSTTALRIVQMLQDIAEAGKTVVTTIHQPSSRLFHKFDKLILLGKGSLLYFGKASDAMDYFQFIGCAPLIAMNPAEFLLDLANGNVNDISVPSELKDIVQVGNAEAETCNGKPSASVVQEYLVEAYDSRVAEIEKTKLMVPVPLDVELKSKVCSCKRQWGASWFEQFSILFSRGFKERRHDYFSWLRITQVLATAVILGLLWWQSDAKTPKGLQDQAGLLFFIAVFWGFFPVFTAIFTFPQERAMLTKERTTDMYRLSAYFVARTTSDLLLDLVLPVFFLLLVYFMANLRLGSGRFFFSILTVFLCIIAAQGLGLAIGATLMDLKRATTLASVTVMTFMLAGGFFVKLHLERRLCLPLPDPGHRRGPPLASGQGKPLRYREGETASDVEVDGGYLHAVAAVGVGSEQGELLHPKDGGETSRNFFGLLGFGFGQWVSSVVWTESPDLV

SEQ ID NO: 123660 - protein, 63 aa, Glycine max
  Coding DNA Sequence Number=SeqID_6882
MVYESQIPAQFNFFGERAEPAYHTWPDLTPLTKSIHLGSDIATIGTTIISSDSNIDNDNNCDD

SEQ ID NO: 123661 - protein, 73 aa, Glycine max
  Coding DNA Sequence Number=SeqID_6883
MKIEESGWWLSKVVNACLSHASAVSNVEVQHTSHLSNSQKKPAKLLSTELCTVFWPHFPPWTPLFHPNSDLQK

SEQ ID NO: 123662 - protein, 185 aa, Glycine max
  Coding DNA Sequence Number=SeqID_6884
  Gene Ontology: Mol. function=molecular_function; Cellular component =cellular_component; Biological process=biological_process
  Homolog annotation: Hit_ID=UPI00005A19F1; Match level="QueryCoverage =66%, HitCoverage=23%, E-value=5e-13, Identity=33%"; Hit description =PREDICTED: similar to alveolar soft part sarcoma chromosome region, candidate 1 long isoform isoform 1
MLNCTKPNMSIKTATKRKNKKYRNTKTEAKLAAVKERFGREIHVFETSVVSLSSKAALSNGEETDDFYEFTAEDYYRLLATKKEDKFLKTRKIREAEEAARRSRITKAVIRVRFPDNHTLEVTFHPSETIQSLIDLLTKVIAQPEQPFYIYTTPAKKVINDMSRDFYTAGFCPGAIVYFSYNVPK

SEQ ID NO: 123663 - protein, 380 aa, Glycine max
  Coding DNA Sequence Number=SeqID_6885
  Gene Ontology: Mol. function=ribonucleoprotein binding; Cellular component=U4/U6 x U5 tri-snRNP complex; Biological process=assembly of spliceosomal tri-snRNP U4/U6.U5
  Homolog annotation: Hit_ID=Q01E93; Match level="QueryCoverage=88%, HitCoverage=69%, E-value=3e-85, Identity=50%"; Hit description=[A] KOG2574 mRNA splicing factor PRP31
  Pfam annotation: Domain name=NOSIC; Domain location=110-162; Score =97.5; E_value=4e-26; Accession=PF08060.3; Description=NOSIC (NUC001) domain
  Pfam annotation: Domain name=Nop; Domain location=202-350; Score =225.8; E_value=9.2e-65; Accession=PF01798.8; Description=Putative snoRNA binding domain
  Pfam module annotation: Pfam domain module=NOSIC::Nop; Domain location=110-162::202-350
MSVEQKLVTLLRFEATLADSFLADLDELSDNEAEIPEDNDVDAADMEEDVDGDLADLENLNYDDLDSVSKLQKTQRYTDVIQKVEEALNKKESEVLFQVVDIEDDPEYQLIVDCNALSVDIENEIVIIHNFIRDKYRLKFPELESLVHHPIDYARVVKKIGNEMDLTLVDLEGLLPSAIIMVVSVTASTTTGKPLPEEVLSKTVEACDRALDLDSAKKKVLDFVESRMGYIAPNLSAIVGSAVAAKLMGTAGGLASLAKMPACNVQLLGAKKKNLAGFSTATSQFRVGYLEQTEIFQTTPPSLRMRACRLLAAKSTLAARVDSIRGDPSGKTGRAFKDEIHKKIEKWQEPPPAKQPKPLPVPDSEPKKKRGGRRLRKMKE

SEQ ID NO: 123664 - protein, 103 aa, Glycine max
  Coding DNA Sequence Number=SeqID_6886
  Homolog annotation: Hit_ID=Q1SX74; Match level="QueryCoverage=62%, HitCoverage=7%, E-value=7e-14, Identity=54%"; Hit description=Zinc finger, SWIM-type
MASNEGHWGYASHTGLKGSKHEDHIYCSMIFYSVKHGYLLVDFNRIDSKKWVFISDQQKDLEGNVEHRVCVRHLYNNFRKMHLGGHLKDLMWQVARATTVPYF

SEQ ID NO: 123665 - protein, 166 aa, Glycine max
  Coding DNA Sequence Number=SeqID_6887
MTITRHREKPKNNNTAARIMLVCYEETRNDSEKNRKKKQGADEKRNKGLPVQGNGGDDVKQWRRLVRLRETARRRQRRTVFVFVTAEATDTASYRSRTRMCVRCESDVGHAAKVPRPCFLVYMCIGIRFTHLLQCTKANLKEQFSVVDIEVREEGKNKNNDVFLNA

SEQ ID NO: 123666 - protein, 622 aa, Glycine max
  Coding DNA Sequence Number=SeqID_6888
  Gene Ontology: Mol. function=diacylglycerol kinase activity; Cellular component=intracellular; Biological process=protein kinase C activation
  Homolog annotation: Hit_ID=Q9FG16; Match level="QueryCoverage=98%, HitCoverage=99%, E-value=0.0, Identity=63%"; Hit description =Selenium-binding protein-like
  Pfam annotation: Domain name=PPR; Domain location=153-187; Score =11.4; E_value=0.33; Accession=PF01535.11; Description=PPR repeat
  Pfam annotation: Domain name=PPR; Domain location=215-249; Score =43.1; E_value=9.6e-10; Accession=PF01535.11; Description=PPR repeat
  Pfam annotation: Domain name=PPR; Domain location=316-350; Score =37.3; E_value=5.2e-08; Accession=PF01535.11; Description=PPR repeat
  Pfam annotation: Domain name=PPR; Domain location=351-385; Score =23.8; E_value=0.0006; Accession=PF01535.11; Description=PPR repeat
  Pfam annotation: Domain name=PPR; Domain location=387-421; Score =17.6; E_value=0.045; Accession=PF01535.11; Description=PPR repeat
  Pfam annotation: Domain name=PPR; Domain location=453-487; Score=7.5; E_value=0.96; Accession=PF01535.11; Description=PPR repeat
  Pfam annotation: Domain name=PPR; Domain location=83-117; Score=20.9; E_value=0.0045; Accession=PF01535.11; Description=PPR repeat
  Pfam module annotation: Pfam domain module=PPR::PPR::PPR::PPR::PPR::PP R::PPR; Domain location=153-187::215-249::316-350::351-385::387 -421::453-487::83-117
MSITSGSNSILKTLRLKNPKLVLLECCSNARDLKIIHAHMLRTHLFFDVFAASRLIAFCIDSTTNLLHYAIRVASQIQNPNLFIYNALIRGCSTSENPENSFHYYIKALRFGLLPDNITHPFLVKACAQLENAPMGMQTHGQAIKHGFEQDFYVQNSLVHMYASVGDINAARSVFQRMCRFDVVSWTCMIAGYHRCGDAKSARELFDRMPERNLVTWSTMISGYARNNCFEKAVETFEALQAEGVVANETVMVGVISSCAHLGALAMGEKAHEYVMRNKLSLNLILGTAVVDMYARCGNVEKAVMVFEQLPEKDVLCWTALIAGLAMHGYAEKALWYFSEMAKKGFVPRDITFTAVLTACSHAGMVERGLEIFESMKRDHGVEPRLEHYGCMVDLLGRAGKLRKAEKFVLKMPVKPNAPIWRALLGACRIHKNVEVGERVGKILLEMQPEYSGHYVLLSNIYARANKWKDVTVMRQMMKDKGVRKPPGYSLIEIDGKVHEFTIGDKTHPEIEKIERIWEDIILPKIKLAGYVGNTAETMFDIDEEEKEGALHRHSEKLAIAYGIMKIRAPTPIRIVKNLRVCEDCHTATKLISKVFEVELIVRDRNRFHHFKEGTCSCMDYW

SEQ ID NO: 123667 - protein, 428 aa, Glycine max
  Coding DNA Sequence Number=SeqID_6889
  Gene Ontology: Mol. function=receptor activity; Cellular component =nucleus; Biological process=biological_process
  Homolog annotation: Hit_ID=Q2R2A5; Match level="QueryCoverage=97%, HitCoverage=79%, E-value=1e-148, Identity=58%"; Hit description =Transcription factor jumonji, putative, expressed
  Pfam annotation: Domain name=F-box; Domain location=84-131; Score =29.4; E_value=1.3e-05; Accession=PF00646.23; Description=F-box domain
  Pfam annotation: Domain name=JmjC; Domain location=314-425; Score =30.8; E_value=1.3e-06; Accession=PF02373.13; Description=JmjC domain
  Pfam module annotation: Pfam domain module=F-box::JmjC; Domain location=84-131::314-425
MRSFRMRNLLSRVKKKTIKNRNRSCISITKELAHLVEQEEEEEEVNEEGFNIKSSAPSHTHGVQPLGNLYLNTSSTNSRDTGLGNLHTLSDELVLDILGFLDSTSLGVLASVSKSFYVFTNHEPLWRNLVLENLLGGFQYKGSWKSTYVSACYPSFDNFAVALGGFKVRDFYSDYLFQSWLCANLEMKPEWLERDNVVRKRGISVEEFVLNFEEPNKPVLLEGCIDNWGALRNWDRDYLVRLCGDVKFSVGPVEMKLGEYFGYSDQVREERPLYLFDPKFAEKVPKLGDEYEVPVYFREDLFGVLGNERPDYRWVIIGPAGSGSSFHVDPNSTSAWNAVIKGSKKWILFPPDVIPPGVHPSPDGADVASPVSIIEWFMNFYGATKNWNKKPIECVCKAGEVIFVPSGWWHLVINLEESIAITQNYVSR

SEQ ID NO: 123668 - protein, 283 aa, Glycine max
  Coding DNA Sequence Number=SeqID_6890
  Gene Ontology: Mol. function=kinase activity; Biological process =inositol and derivative phosphorylation
  Homolog annotation: Hit_ID=Q1T2N0; Match level="QueryCoverage=94%, HitCoverage=80%, E-value=1e-102, Identity=71%"; Hit description =Inositol 1, 3, 4-trisphosphate 56-kinase
  Pfam annotation: Domain name=Ins134_P3_kin; Domain location=1-282; Score=494.0; E_value=1.8e-145; Accession=PF05770.2; Description =Inositol 1, 3, 4-trisphosphate 56-kinase
MIRFNLAWIIKISLRNRGINFVAIDLNKPLPEQGPFDIILHKAISILSGEVWREIIEDYREKHPEVTVLDPPDAIQHLHNRQSMLQDVLDLNLSDCHGKVGVPRQLVITKEKDPSSIPYEVTKAGMKLPLVAKPLVVDGTAKSHELFLAYDEFSLSAVEPPLVLQEFVNHGGLLFKIYIVGETIKVVRRFSLPNISKRELSKVAGVFRFPRVSCAAASADDADLDPNIAEHPPRPLLERLARELRHRLGLHLFNIDMIREYGTKDVFYVIDINYFPGKYNLSH

SEQ ID NO: 123669 - protein, 425 aa, Glycine max
  Coding DNA Sequence Number=SeqID_6891
  Gene Ontology: Mol. function=pyruvate kinase activity; Cellular component=chloroplast; Biological process=glycolysis
  Homolog annotation: Hit_ID=Q84R73; Match level="QueryCoverage=85%, HitCoverage=66%, E-value=1e-141, Identity=69%"; Hit description =Putative pyruvate kinase
  Pfam annotation: Domain name=HpcH_HpaI; Domain location=31-192; Score= -88.7; E_value=0.077; Accession=PF03328.5; Description=HpcHHpaI aldolase family
  Pfam annotation: Domain name=PK; Domain location=4-235; Score=21.1; E_ value=4.2e-18; Accession=PF00224.11; Description=Pyruvate kinase, barrel domain
  Pfam annotation: Domain name=PK_C; Domain location=250-364; Score =40.6; E_value=5.2e-09; Accession=PF02887.6; Description=Pyruvate kinase, alphabeta domain
  Pfam module annotation: Pfam domain module=HpcH_HpaI::PK::PK_C; Domain location=31-192::4-235::250-364
MGDELVIDGGMACFEVVEKTGNDLHCKCIDAGLFLPGAKLSFWRDGKLVRGNNKLPTLSTKDWADIDFGIAEGVDFFALSFVNHADSVKDLKNYLSSKSTKSIKVLAKIESSESLHKLEEIVRASDGIMVARGDLGVEIPLEQIPTVQEDIIYVCRQLNKPVIVASQLLESMVEYPTPTRAEVADVSEAVRQYADALMLSGESAIGSYAQKALAVLDMASSRMESWSREENRQSLVNYHQLGASLPECITEQICNCAVEMANNLGVDAIFVYTKYGHMASLLSRNRPNPPIFAFTNDDSTRMALTLQWGVVPLLVDLSDDAESNISKSVQLMKSRGLISQGDVVLVVSDVAPTRATPMAFQSIQQVLKPLSRDSYELHFVNCPLILQWQSFSAYTLLHDSVSSFHDILTEGISVACYAGYLQSAK

SEQ ID NO: 123670 - protein, 82 aa, Glycine max
  Coding DNA Sequence Number=SeqID_6892
MKKRDTGHQSVSLENKTGDSTVLKIGDSAKVLIKQGMKGKKNKYGFNKNKREKTEKKMVVDDETGDKHKLYEVLRMPCKTKY

SEQ ID NO: 123671 - protein, 161 aa, Glycine max
  Coding DNA Sequence Number=SeqID_6893
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=1e-21, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGLHALPYRGIHVLAFRGIHNLAIIGVHVVAFRGLHVLTFRGLHMLTFRGLHILAFRGLHTVTFRGLHRTNGLGLQRATRPHLKWPTHPRLQRATHAHLQRTTRPDLQRATRPHLKRPTRPRPQRATHPHLQRTTRPFLQRTTRPHLQRTTRPHLKSATRP

SEQ ID NO: 123672 - protein, 126 aa, Glycine max
  Coding DNA Sequence Number=SeqID_6894
MSQRKDKELKGSSNGPIGGYHRWLKAYAQDLDWLLTLRTTKGMEGEALKEDEEVQALKTKLEKAQTIKEKFKSAAVRIQKKNTELRDVNIATTKALELEAEKNSEGFCGAITTSLSSEERKGTNRE

SEQ ID NO: 123673 - protein, 219 aa, Glycine max
  Coding DNA Sequence Number=SeqID_6895
  Gene Ontology: Cellular component=membrane
  Homolog annotation: Hit_ID=Q8ZIQ1; Match level="QueryCoverage=72%, HitCoverage=69%, E-value=5e-56, Identity=69%"; Hit description =Protein smp precursor
RILFVVFHRIAFCQRRVGGQQGARQNDADRQRQQDHQAQQVGGVVHLLGLGRQHVGVEGDADKADRAVFALNGFDQLVVEVAASALAVERQPIAYTYLLPGVGDQRAVQLIHADVENAAVIGELLEDGVDARVVAVVVQQRRQAVGDLFGQRLRQLFDLFGSRHLVTQAKIRGTLHQQHQQSQANQDNSGTVQAKFQFSASHAGSLGIGDTLCCQNRWR

SEQ ID NO: 123674 - protein, 104 aa, Glycine max
  Coding DNA Sequence Number=SeqID_6896
  Gene Ontology: Cellular component=integral to membrane
  Homolog annotation: Hit_ID=Q1SU09; Match level="QueryCoverage=81%, HitCoverage=31%, E-value=7e-30, Identity=69%"; Hit description =Aldo/keto reductase
MTMESQANGVHSSKHDDDGRLKRRGTWLTATSHIVTAVIGSGVLSLAWAVAQLGWIAGPAILTIFSVITVFTSSLLSDCYRYPDSVHGTRNHNYREMRKRYGTT

SEQ ID NO: 123675 - protein, 298 aa, Glycine max
  Coding DNA Sequence Number=SeqID_6897
  Gene Ontology: Mol. function=transporter activity; Cellular component= membrane; Biological process=transport
  Homolog annotation: Hit_ID=O81339; Match level="QueryCoverage=93%, HitCoverage=58%, E-value=3e-99, Identity=59%"; Hit description =Permease 1
  Pfam annotation: Domain name=Xan_ur_permease; Domain location=1-210; Score=-158.4; E_value=0.032; Accession=PF00860.11; Description =Permease family
MDLQYIPQRMKSRGADRFAVIVAIGLAWAFAEILTAAGAYNKRPPKTQFSCRTDRSGLISAAPWIRVPYPFQWGRPSFNAGDTFAMIAASLVAIVESTGTFIAASRFGSATPVPPSVLSRGVGWLAMGLSCLDSRHKMSYQFSINQRKFGAVLASIPLPIIAAIYCVLYAYVASAGLGFLQFCNLNSYRSMFIVGFSLFMGLSVPQYFNEYVLLSGHGPVHTGTTAFNNIVQVIFSSPATVAIIVAYFLDLTMSRGEGSTRRDSGRHWWEKFRTFNQDTRTEDFYSLPLNLNRFFPSF

SEQ ID NO: 123676 - protein, 155 aa, Glycine max
  Coding DNA Sequence Number=SeqID_6898
MEACSCGTLFIALSNNFPVFITVLPVLPHGVPEGIRVGFLHCLAALGTIVMASSTPVPLMGGDNKFIHSMRAIQRALITASVFQISIGFGRIFCQAMCLSPLSVVPLVTLTGLGLFLLAFPRMLDCIDIGLPAFLILVIVSQVCCFLYQILRQKV

SEQ ID NO: 123677 - protein, 112 aa, Glycine max
  Coding DNA Sequence Number=SeqID_6899
MDRNREEQKRRILSARHRAFYVVTCVVSSESDDDCFYFHYHQQKKIFILEEITIHIICNMHQGKCEKNVYTVMRLHARLRQWGCVKVFLTLKVETEGMKMDFEIWLILLIKS

SEQ ID NO: 123678 - protein, 324 aa, Glycine max
  Coding DNA Sequence Number=SeqID_6900
  Gene Ontology: Mol. function=cyclin-dependent protein kinase regulator activity; Cellular component=nucleus; Biological process =regulation of progression through cell cycle
  Homolog annotation: Hit_ID=Q8GS62; Match level="QueryCoverage=87%, HitCoverage=81%, E-value=5e-53, Identity=43%"; Hit description =Cyclin D
  Pfam annotation: Domain name=Cyclin_C; Domain location=176-295; Score= 12.4; E_value=0.0041; Accession=PF02984.9; Description=Cyclin, C -terminal domain
  Pfam annotation: Domain name=Cyclin_N; Domain location=41-174; Score =117.8; E_value=3.1e-32; Accession=PF00134.13; Description=Cyclin, N -terminal domain
  Pfam module annotation: Pfam domain module=Cyclin_C::Cyclin_N; Domain location=176-295::41-174
MPSSSTMPLSPDPPFLCTEDASEVTSDHHHPPSPFPDSDEAAIAGLLDAETHHMPEKDYLRRCRDRSVDVTARLDAVNWILKVHAFYEFSPVTAFLSVNYLDRFLSRCSLPQESGGWAFQLLSVACLSLAAKMEESHVPFLLDLQLFQPKFVFEPKTVQRMELWVMSNLKWRLRSVTPFDYLHYFFTKLPSSSSQSITTASNLILSTTRVINFLGFAPSTVAAAAVQCSANGQLPLSFHDRLNSEMVRCCHQLMEEYVVDTCPASIKVRITEAAAPSSPVGVLDAATCGSCDTPSERNFAGSAEEQAEPPNKRLRSSASDAPRR

SEQ ID NO: 123679 - protein, 94 aa, Glycine max
  Coding DNA Sequence Number=SeqID_6901
METVSEGRRRRCDSNEHTLAALFNNSDRPVSFSLLQLWLGNHTCTILARNRIRIPPVTMASFLLGITLVFQYFINNSSWHVQIGHLMFGLKSPT

SEQ ID NO: 123680 - protein, 71 aa, Glycine max
  Coding DNA Sequence Number=SeqID_6902
MDWLTGFVVCAGPWTGPFDPRDARHGHINLLGPCKNEARADPVRCQCKFMRTDLTRDGLVRLLIRNAQREI

SEQ ID NO: 123681 - protein, 72 aa, Glycine max
  Coding DNA Sequence Number=SeqID_6903
  Gene Ontology: Biological process=electron transport
MDVRGLGVRNKGSTQYVVKGSQKEFPRELLQELKIVCQDNISLDYDERYIHGKPQNSFHKAVNIPDVIVYPT

SEQ ID NO: 123682 - protein, 105 aa, Glycine max
  Coding DNA Sequence Number=SeqID_6904
  Gene Ontology: Mol. function=D-lactate dehydrogenase (cytochrome) activity; Cellular component=mitochondrion; Biological process =electron transport
  Homolog annotation: Hit_ID=Q4WR52; Match level="QueryCoverage=77%, HitCoverage=14%, E-value=5e-23, Identity=62%"; Hit description=D -lactate dehydrogenase
  Pfam annotation: Domain name=FAD_binding_4; Domain location=1-74; Score=-19.9; E_value=0.061; Accession=PF01565.13; Description=FAD binding domain
MDVVVEPGIGWMELNEYLEPYGLFFPLDPSPGGSIGGMCATCCSGSPAVRYGTMRDNVISLKVVLANGDIVKTASRARKSAAWDYIGHISSQCGISTSAYISFFA

SEQ ID NO: 123683 - protein, 274 aa, Glycine max
  Coding DNA Sequence Number=SeqID_6905
  Gene Ontology: Mol. function=metal ion binding; Cellular component =integral to membrane
  Homolog annotation: Hit_ID=Q7XZZ3; Match level="QueryCoverage=99%, HitCoverage=82%, E-value=3e-93, Identity=56%"; Hit description =Putative SPX domain containing protein
  Pfam annotation: Domain name=SPX; Domain location=1-105; Score=14.3; E_value=3.4e-07; Accession=PF03105.10; Description=SPX domain
  Pfam annotation: Domain name=zf-C3HC4; Domain location=169-217; Score= 19.1; E_value=0.0016; Accession=PF00097.15; Description=Zinc finger, C3HC4 type (RING finger)
  Pfam module annotation: Pfam domain module=SPX::zf-C3HC4; Domain location=1-105::169-217
MCFCFPLVVCDQQFFSELMKEASDVVGYFSSRVKNLLHLHIATGMQRYVLRLRQCFKDDRQALTQEGRILIEYIAMNAIAMRKILKKYDKVHSSVNGENFKSRMHAEHIEILHSPWLIELGAFYLNSSGLDSCDLDGVYGRFSCELNITKAVMTLVLPDSINLEHDLTCAICLDFVFNPYALSCGHIFCKSCACSAASVMIFQGLKAASPESKCPICREVGVYSKAVHMLELDLLVKRRCKDYWKERLAGERGDKLKQSNDYWNLQSTYSIGLM

SEQ ID NO: 123684 - protein, 262 aa, Glycine max
  Coding DNA Sequence Number=SeqID_6906
  Pfam annotation: Domain name=SAM_1; Domain location=194-251; Score =16.5; E_value=0.0048; Accession=PF00536.20; Description=SAM domain (Sterile alpha motif)
  Pfam annotation: Domain name=SAM_2; Domain location=190-256; Score =41.4; E_value=3e-09; Accession=PF07647.7; Description=SAM domain (Sterile alpha motif)
  Pfam module annotation: Pfam domain module=SAM_1::SAM_2; Domain location=194-251::190-256
MVKTKQKRTGEVPGKKSGTSSHCLVDSGDGDNQHEDSDWIIVKKQRVTILVPAAPLNDRSLIANQGPNHMHLMPPEIASNHVQLPMQTSTVHPSGKEHEKATLLAVQKETHAERKALLTLPKSTVVNPPSLDQRIESENPQAMNSLKLHKLLGVSDASKVIKQPRTLLAPRRSFNQETLNKNLRASNLERKLERAGGLSNWLTSLGLGQFVRIFQGNSLSKYQLVNLTMKKLKDMGASAVGPRRKLIHAMDCVCQPYCFEAL

SEQ ID NO: 123685 - protein, 54 aa, Glycine max
  Coding DNA Sequence Number=SeqID_6907
MVVVIIRVLMAVTMMVGWNNGDNNGGVNSDNSSNNDDGNNKSSDGMMVVVTMTV

SEQ ID NO: 123686 - protein, 55 aa, Glycine max
  Coding DNA Sequence Number=SeqID_6908
MVYPIQINFNISLHSSSIYQHDIGVTIRCRFPLGRIPIYRSMVLFLGYGTIDFQL

SEQ ID NO: 123687 - protein, 157 aa, Glycine max
  Coding DNA Sequence Number=SeqID_6909
  Gene Ontology: Mol. function=zinc ion binding; Biological process =cell redox homeostasis
  Homolog annotation: Hit_ID=Q1SEK9; Match level="QueryCoverage=93%, HitCoverage=28%, E-value=7e-63, Identity=79%"; Hit description =Thioredoxin domain 2; Erv1/Alr
MKYRCPACRNYKPHYEKVARLFNEPDAVHPGIILITRVDCGLKINTKLCDKFSADHYPMLFWGSPSKFVGGGWEPKQEKSDIRVIVGARTADRLLDWINKQIGSSFGLDDQKFQNKLPSSNDSDTVQIARAIYDDVEEVTSTGFDIIIEHQELVLHL

SEQ ID NO: 123688 - protein, 76 aa, Glycine max
  Coding DNA Sequence Number=SeqID_6910
MDRIPSIYTLMVLFRGTDLKPGATDLPTLQRSISKDCLVNDRRLLRRLSEDEGVVVPMSYQCHFRCKIIDLGVWWS

SEQ ID NO: 123689 - protein, 39 aa, Glycine max
  Coding DNA Sequence Number=SeqID_6911
GNAYADALATLVYDLESDYEIFQHPPAAVQSLGELLQDL

SEQ ID NO: 123690 - protein, 148 aa, Glycine max
  Coding DNA Sequence Number=SeqID_6912
MYKDNWTQPWPMGSEIYPKVHENPRAFFSSSSPIFLEPLAHGSSDWSLPREDCIRVARRCWTVLVLHAASIGVAMFRYRMEMVWWLWIGWWRGEGSCANLVGVGSDLGWSWFKFVAKIVQCCASRGRGLGGGVMRGRDGVGGWGGVVR

SEQ ID NO: 123691 - protein, 173 aa, Glycine max
  Coding DNA Sequence Number=SeqID_6913
  Homolog annotation: Hit_ID=Q8LK53; Match level="QueryCoverage=28%, HitCoverage=76%, E-value=8e-19, Identity=90%"; Hit description =Ribosomal protein small subunit 28
  Pfam annotation: Domain name=Ribosomal_S28e; Domain location=109-173; Score=149.4; E_value=9.4e-42; Accession=PF01200.9; Description =Ribosomal protein S28e
MSKRLQEDWARAAEEGPRVLMNLRTHLLLEVASPLSLPFSIPLPFIFQEAKESIDEEDPRPTSSNGACITLPTHDPRPLRARPQSLRLFVFGMETGVYGVGVVVVPMMMESQVKHALVVKVMGRTGSRGQVTQVRVKFLDDQNRHIMRNVKGPVREGDILTLLESEREARRLR

SEQ ID NO: 123692 - protein, 87 aa, Glycine max
  Coding DNA Sequence Number=SeqID_6914
FSPHVCFFIDWHKDSLHSQAEQNTCGCLFSTKRTGDDVNHSLSNLAVISLHSCAPRQLATMHLTVALIFPSLHKFASISHNTDIVGM

SEQ ID NO: 123693 - protein, 417 aa, Glycine max
  Coding DNA Sequence Number=SeqID_6915
  Homolog annotation: Hit_ID=Q7EZJ0; Match level="QueryCoverage=26%, HitCoverage=9%, E-value=7e-29, Identity=53%"; Hit description =Putative ubiquitin-specific protease
  Pfam annotation: Domain name=MATH; Domain location=1-108; Score=17.5; E_value=0.0029; Accession=PF00917.16; Description=MATH domain
SSKAFKVGGYKWKIVLYPKGRNVEYLSLYMKVADSLPPYGWSRFVYFRLALINQVDSKKSIVKETQQKFNAGNSAWGSPSFIPLSEFHDLAQGYLVKDACIIEAQVLVSKVAFNIPGSLAQSITTIHEPNGDQARLTEVEMTPSDLTSSPTSTQGSKDDHVNEIELQLIHSEDQEIGPSASDFTPSPKQVQFAPSAPPMYPSLFDESEQVILTPLSDLIDFNSVEAEEASFIPLWEEVCSWHPSLIENQRRRSPRFILWAFIALGRVLHFLKTKTIRDMGNDDCMMHLQVLWEELQPFGFDLTWLEPHVQSAMSAKAYFERGEYVKSIRVNIASLEIELKKLKTKLAVAELDLEVARRDLAEVENDFQERDMDAELDRDGNSGNPAILCEGTATDEREIKREKEIGWDKRTKTTTFR

SEQ ID NO: 123694 - protein, 139 aa, Glycine max
  Coding DNA Sequence Number=SeqID_6916
  Homolog annotation: Hit_ID=Q9FG11; Match level="QueryCoverage=72%, HitCoverage=34%, E-value=5e-15, Identity=40%"; Hit description =Arabidopsis thaliana genomic DNA, chromosome 5, BAC clone:F15M7
MLASKGDFSPQKPEKVQEFKQQHHHDAETEGSNFLSDEKDKENIKSAEAPSPILKILKSEFECLPAYMKGLTSWEDLVVAVDKINSSLSKKTNGCSYFHQDEIPSFELGPKTRSYLLLLVRMNRLVVETIDGLLSYRVL

SEQ ID NO: 123695 - protein, 696 aa, Glycine max
  Coding DNA Sequence Number=SeqID_6917
  Gene Ontology: Mol. function=glutamate carboxypeptidase II activity; Cellular component=integral to membrane; Biological process =regulation of inflorescence meristem size
  Homolog annotation: Hit_ID=Q9M1S8; Match level="QueryCoverage=98%, HitCoverage=97%, E-value=0.0, Identity=50%"; Hit description =Probable glutamate carboxypeptidase 2
  Pfam annotation: Domain name=PA; Domain location=148-239; Score=23.6; E_value=0.00073; Accession=PF02225.12; Description=PA domain
  Pfam annotation: Domain name=Peptidase_M28; Domain location=334-516; Score=81.1; E_value=3.6e-21; Accession=PF04389.7; Description =Peptidase family M28
  Pfam annotation: Domain name=TFR_dimer; Domain location=557-694; Score=54.6; E_value=3.4e-13; Accession=PF04253.6; Description =Transferrin receptor-like dimerisation domain
  Pfam module annotation: Pfam domain module=PA::Peptidase_M28::TFR _dimer; Domain location=148-239::334-516::557-694
  Subcellular localization annotation: CTP_CleavageSite=16; ConfidenceScore=5.09e-01
MMPKPMNVLTTKPSPLSTMVVLLILCILGFYALHLPHSSTPSFTSKSLSQLEKLFLSTSSNSTISSYLRALTLHPHLAGTKPASDTTRHVLNHFTSLGLQAHTTTYTTLLSFPVRSSLSAHFSDGASVSLRLTEASGPGVVAAYHAYSPSGKVHARAVFANYGRERDYLALAAMGVNVSGCVVVVRKGGRMGRGAVVERAEANGAAAVLVYGEGDTWRKGFERGHVMRGGIGDPLTPGWAGVEGGETLGLEDGEVLKRFPKIPSMPLSAEVADIILSSLGGVPLPLQWRGTLKSMVRNVGPGPTILNFTYQGEKKVATIQNVFAVIKGSEEPDRYVLLGNHRDAWTYGAVDPSSGTAALLDIARRFSALLGLGWKPRRTIILCSWDAEEFGMIGSTEWVEQNLINLGSKAVAYLNVDCAVQGPGFFVGSTPQLDSLILEVTKKVKDPDSEGVSLYENWAAAAGGGNNIQRLSGVDSDFAPFVQHAGVPSIDMYYGRDFPVYHTAFDSYNWMAEYGDPFFHRHVAVTGVWGLLALHLADDPVLPFNYVPYANELQLYKNTLSNLIDQKISLHPLTLSIEEFASAAKEANDELKKLRLQESESCFVDMKKRALNDRLMLAEKGFLDADGLQGRQWFKHLVFGPSSNHEKLNFFPGISDSITRLSGISERERLSSIQHEIWRVARAIRRAASALSGEFT

SEQ ID NO: 123696 - protein, 91 aa, Glycine max
  Coding DNA Sequence Number=SeqID_6918
MNDDAFTHLSMFMGGTCEAVRISIVLVEQAAEVNKLKDNVVDLEVKMKKLRGELKAAEAEFEVARRALAEARKGFIEIEVDLNAELGYAMF

SEQ ID NO: 123697 - protein, 55 aa, Glycine max
  Coding DNA Sequence Number=SeqID_6919
MWAFSLGYDSRLGCERHKDKHCILRQNTMFAVAFLPKEQENEDANHSLNNLAWLY

SEQ ID NO: 123698 - protein, 73 aa, Glycine max
  Coding DNA Sequence Number=SeqID_6920
MDEHPDLTNPKYSILPENAVLVFVPVNDKTHVRAIQAPYKYVGWLSLCTEKLPDKTVNVSLHSSQRIHMQPLM

SEQ ID NO: 123699 - protein, 812 aa, Glycine max
  Coding DNA Sequence Number=SeqID_6921
  Gene Ontology: Mol. function=zinc ion binding
  Homolog annotation: Hit_ID=Q6RZU6; Match level="QueryCoverage=38%, HitCoverage=22%, E-value=2e-94, Identity=54%"; Hit description =Hypothetical protein H9-8
  Pfam annotation: Domain name=DER1; Domain location=559-741; Score= -65.2; E_value=0.0067; Accession=PF04511.5; Description=Der1-like family
  Pfam annotation: Domain name=DUF1751; Domain location=592-694; Score=- 25.5; E_value=0.038; Accession=PF08551.1; Description=Eukaryotic integral membrane protein
  Pfam annotation: Domain name=Rhomboid; Domain location=595-731; Score= 39.3; E_value=1.3e-08; Accession=PF01694.12; Description=Rhomboid family
  Pfam annotation: Domain name=UBA; Domain location=771-810; Score =50.6; E_value=5.1e-12; Accession=PF00627.21; Description=UBATS-N domain
  Pfam annotation: Domain name=zf-TRAF; Domain location=216-272; Score =47.2; E_value=5.5e-11; Accession=PF02176.8; Description=TRAF-type zinc finger
  Pfam module annotation: Pfam domain module=DER1::DUF1751::Rhomboid::UB A::zf-TRAF; Domain location=559-741::592-694::595-731::771-810::216 -272
MDMPTIDVDLGPEKLEDEKQGGPLLHCDLCDTEVVHKLAQMFLPGLASACVDNTSGDLFKTPGSVAVDLRKEMIEYVTQRSESFVAESVILEGGPDGEESDHPFDIISDFVDDFVSSKRNLFSRVSGWLLSEKREDRIDDFVQEMEMNGFWTLDRRETIAETLLKNVDFENSYHCNMSFNSAEELVNHVDNCNFRTMICENEGCNSRFCAAHLKNHDSTCPFKIIPCEQKCSDCIMRREMDRHCITICPMKLVNCPFYVVGCRSAVAQCMIEKHRLDDVHSHLWHLLKGIYKQAYGDDLKRRVEQIVQASSSSRLAEARDVRSLNFIVKDIEAKLGPFKVSVLEKNNAEIVTKNDEGEAGDTEKSMKASDMVNSPDKAELSDMKNMNNAKSTTKNEDREPVPVENKGCEEMAQTSNTTNLSDKTEVGLPNDENKDAAASELKIKGDEEHTQTHKEKLSNEEVSAPDEGSAENIIKSKCNEDNKFEDKDNEQSIQNSKMETKGGLENNVKNKDGDLKKSAQTSDGWEVKLGCMRRARNMRPNIVSEAGLPTRMSQWWESIPFLTSAVVVVCGIIYLVCLLVGYDSFNEVCFLPSAVVSRFQVYRIYTSILFHGSLLHVVFNMMALVPLGSELERIMGSVRLLYVIILVATSNAIFHVLIALLVAHNPLLTYDYLMNECAIGFSGVLFSMIVIETSLSGVQSRRTLGAVQGQTASHLHSDSNLQARLLEDSSPNSPLDSSTPSNTQQLSEGRHSVDDVATAAAGVPQNQGAVVSEERIKKLVSMGFDRTQVEVALAAADGDLNVAVEILMSQQG

SEQ ID NO: 123700 - protein, 379 aa, Glycine max
  Coding DNA Sequence Number=SeqID_6922
  Homolog annotation: Hit_ID=Q2QQM3; Match level="QueryCoverage=31%, HitCoverage=10%, E-value=5e-29, Identity=51%"; Hit description =Ubiquitin-specific protease 12, putative, expressed
  Pfam annotation: Domain name=MATH; Domain location=18-136; Score =46.2; E_value=1.1e-10; Accession=PF00917.16; Description=MATH domain
MDNQKGMSISFETFTWKIENFSKQNTKKLQSKTFRIRGYKWRIRLYPLMKNVDHFSLYLMVADSLPPYGWNRNTHFKLALVNQLDGNKSVVKETQQKFNGGYRSWGSFFVNLSDFYDSKQGYLLNDTCIIEAHVCFSDLSTLEANNLKKITPTKDSKSGDQAARNSESTQQGDDKEAETEIETEISDESETFSSSTCGSSETEWEIQSSDLTLKDLLDLASLGKEEAACVPLLEEACIWHPSLIRSQRKSSRWFKLWAFTSLGQVLHLLKTSKVKDMNEEACNRLQGLWEELVKHSGFQLSWLEPYVQSALDMKTHLDKTDEVNKLKDSVVALEIKMKKLREELVAAEAEFEVARRALAEARKGFIEMDLNADLGYAMF

SEQ ID NO: 123701 - protein, 324 aa, Glycine max
  Coding DNA Sequence Number=SeqID_6923
  Gene Ontology: Mol. function=4 iron, 4 sulfur cluster binding; Cellular component=cytosol; Biological process=metabolic process
  Homolog annotation: Hit_ID=UPI00003837C4; Match level="QueryCoverage =80%, HitCoverage=80%, E-value=1e-104, Identity=68%"; Hit description= COG1048: Aconitase A
MVQEVICCDQDVAMAKGLWDGCGPLRCGGRKRDAPAEVGCRPSIATLGNRGGEEPREAVGRLLQVDAILRSLRTGDAWANLGQVDLQDPGIVDLARAHRAEQPLRPVVGFERGDLGLAASGRPAVGDRLLVDREEAHSGSVLGSHVGEGRSVRNGKRRDAVAEELDEHADDLGAAQALGDGQHGIRNRDALGQAFGQVDTHDLRRDEVDGLAEHGSLRLDAADAPAEHGQTIDHGGVRVGADERVGIGDLGAVLVPRPDRLRQVFEVHLVADAGTRRHDGKVAEGRLAPFQEGVAFAVARVFERDVVAERLRGAELVHFFFCDR

SEQ ID NO: 123702 - protein, 270 aa, Glycine max
  Coding DNA Sequence Number=SeqID_6924
  Gene Ontology: Mol. function=N-acetyltransferase activity; Cellular component=cytosol; Biological process=metabolic process
  Homolog annotation: Hit_ID=Q9I640; Match level="QueryCoverage=53%, HitCoverage=92%, E-value=6e-50, Identity=67%"; Hit description =Probable N-acetyltransferase
  Pfam annotation: Domain name=Acetyltransf_1; Domain location=127-211; Score=80.5; E_value=5.1e-21; Accession=PF00583.14; Description =Acetyltransferase (GNAT) family
DGGRELRGIDARAHPMPFAKKQRIVQRHAQPRQRVAQRGCTHRQLIGGETNGTVAIDGIKNKQQIEIEASERRMHNIHHWARPDDASAIYNMIYELAVYEKAPQEVVTTPDEIRETLFGDDSKTEALICEIDGKTAGYAVFFTSYSTWLGRNGIYMEDLYISPDYRGQGAGRALLKTIARYAVARRCGRLEWSVLDWNQPAIDFYLSIGAAAQSEWVRYRLDGEALLALCKKHSSPERAELLKGKASLTPPTCGDGMTFFDPLPDVRRSE

SEQ ID NO: 123703 - protein, 42 aa, Glycine max
  Coding DNA Sequence Number=SeqID_6925
MTLQLADRSVTRPYGVIEDILVKVKEFNEEVLKVGTKFDPDP

SEQ ID NO: 123704 - protein, 270 aa, Glycine max
  Coding DNA Sequence Number=SeqID_6926
  Gene Ontology: Mol. function=RNA-directed DNA polymerase activity; Cellular component=intracellular; Biological process=RNA-dependent DNA replication
IFQSPFPKWYNPSATFAYHGGTPGHSIEQCLALKSKVQSLIEAGWFTFQEDGPNIKTNPLANHGGGAVNAIEGHDSPKTSTPISSVGGRSILFPYKNNRAVPWRYAPPGVRKGEATDISSLSAKVTNITGLSGITRSGRVFAAPSLLIQPAITKGKARMTEGQNVKVIPAPDEDVSTKDLYKGREGCGKKEVSLEEADEFLRIIQQSEFKVLNEAHVAQDIFVEGFGGIVNNITANNYLTFAEEEIPAEGRGHNRALHVSVKCMEHVMAK

SEQ ID NO: 123705 - protein, 807 aa, Glycine max
  Coding DNA Sequence Number=SeqID_6927
  Gene Ontology: Mol. function=methyltransferase activity; Cellular component=cellulose and pectin-containing cell wall
  Homolog annotation: Hit_ID=Q9FMJ2; Match level="QueryCoverage=99%, HitCoverage=100%, E-value=0.0, Identity=65%"; Hit description =Ankyrin-like protein
  Pfam annotation: Domain name=DUF248; Domain location=286-791; Score =1198.9; E_value=0; Accession=PF03141.7; Description=Putative methyltransferase
  Pfam annotation: Domain name=Methyltransf_11; Domain location=405 -500; Score=27.6; E_value=4.3e-05; Accession=PF08241.2; Description =Methyltransferase domain
  Pfam annotation: Domain name=TolA; Domain location=12-317; Score= -137.2; E_value=0.015; Accession=PF06519.2; Description=TolA protein
  Pfam module annotation: Pfam domain module=DUF248::Methyltransf _11::TolA; Domain location=286-791::405-500::12-317
  Subcellular localization annotation: CTP_CleavageSite=52; ConfidenceScore=5.17e-01
MAQAKYTRIDNNKRPSSYCSTVTIVVFVALCLFGIWMMTSSSVTPVQNVDVSQENNSEVKEQATDPSNNNSQQFEDNRGDLSEDATKGDGSVTPDKNSDVKEKQEEKSDEKSQEKPSEDTKTENQDTSVSEKRSDSDESQQKSDSDESQQKSDSDESEKKSDSAESEKKSDSDENERENKSDSDENEKKSGDASETTDKTEEKVEQSGNQESDENSNEKKTDDNANSQGSNEVYPSVAQSELLNESTTQNGSFTTQAAESKNEKESQVSSKQSTIWKLCNVTAGPDYIPCLDNLKAIRSLPSTKHYEHRERQCPEEPPTCLVPLPEGYKRPIEWPKSREKIWYSNVPHTKLAEYKGHQNWVKVTGEYLTFPGGGTQFKHGALHYIDTIQQSVPDIAWGNRSRVILDVGCGVASFGGFLFERDVLTMSLAPKDEHEAQVQFALERGIPAISAVMGTKRLPYPGRVFDVVHCARCRVPWHIEGGKLLLELNRVLRPGGFFVWSATPIYQKLPEDVEIWNEMKALTKAMCWEVVSISKDKLNGVGIAVYKKPTSNECYEKRSQNQPPICPDSDDPNAAWNIPLQACMHKVPVSSTERGSQWPEKWPARLTNTPYWLTNSQVGVYGKPAPEDFTADYEHWKRIVSKSYLNGIGINWSNVRNVMDMRSVYGGFAAALKDLNIWVMNVVSVNSADTLPIIYERGLFGMYHDWCESFSTYPRSYDLLHADNLFSNIKNRCNLKAVVAEIDRILRPEGKLIVRDTVEIISEIESMVKSMKWEVRMTYSKDKVGFLCVQKSMWRPKELETLEYAIG

SEQ ID NO: 123706 - protein, 161 aa, Glycine max
  Coding DNA Sequence Number=SeqID_6928
  Homolog annotation: Hit_ID=Q7X971; Match level="QueryCoverage=80%, HitCoverage=9%, E-value=1e-28, Identity=52%"; Hit description =Putative Splicing factor 3B subunit 3
  Subcellular localization annotation: CTP_CleavageSite=44; ConfidenceScore=5.28e-01
MAVSEEECSSAKSGSSGPSSSSSSASRYYLSKCVFRGSVVLHVLHAHIRSPSSNDVVFGKETSIELVVIDEDGNVQSVFDQPVFGTLKDLAILPWNEKFRAARDPQLWGKDLLVATSDSGKLSLLTFCNEMHRFVPVTHIQLSNPGNQMDFPGRKLAVDSR

SEQ ID NO: 123707 - protein, 550 aa, Glycine max
  Coding DNA Sequence Number=SeqID_6929
  Gene Ontology: Mol. function=nucleic acid binding; Cellular component= nucleus
  Homolog annotation: Hit_ID=Q7X971; Match level="QueryCoverage=99%, HitCoverage=32%, E-value=1e-96, Identity=40%"; Hit description =Putative Splicing factor 3B subunit 3
  Pfam annotation: Domain name=CPSF_A; Domain location=40-467; Score= -80.8; E_value=0.00024; Accession=PF03178.5; Description=CPSF A subunit region
MGHGKRLNVQKFHLEGTPRKVLYHDESKMLLVMRTELNCGPCLSDICCVDSLSGSVLSSFRLELGETGKSMELVRVGSEQVLVVGTSLSSGPHTMPTGEAESCKGRLLVLCLDHVQNSDSGSMTFCSKAGSSSQKTSPFHEIVTYAPELLSSSSLGSSPDDNSSDGIKLHENEVWQFRLAYATKWPGVVLKICPYLDRYFLATAGNAVSSKTVAFSPFILSLAHCPILSQILYPNQKFYVCGFPNDNPQRVRRYAMGRTRYMITSLTAHLTRIAVGDCRDGILLYSYHEEAKKLELLYNDPSQRIVADCILMDADTAVVSDRKGSIAVLCSDHLEASDNAGAQCNMTLSCAYFMAEIAMSIKKAFLYVIYASNVNVLRLSDSTVMEMMGSYSYRLPADDVLEGGNGPKTNVDSLQNTIIASTLLGSIMIFIPLSRTEMAVVNLPGLVSHPPLNTPRSRESEPLMGMTCINYLPVWQGPREEEYELLEVVQARLVVHHLTAPVLGNDHHEFRSRENRVGVPKILDGDILTQFLELTSMQQKMILSLEQPDM

SEQ ID NO: 123708 - protein, 111 aa, Glycine max
  Coding DNA Sequence Number=SeqID_6930
MESKAAALENEVASLRSTLAEMKSQADEHQEKLMEMLTKGMEKLTSSFGWKKLQGNLMDEFRQSVKKVELLMFNGEDPVGWMSDGIIFEQLTALQQVGSVDEMSKYRNLKS

SEQ ID NO: 123709 - protein, 169 aa, Glycine max
  Coding DNA Sequence Number=SeqID_6931
  Subcellular localization annotation: CTP_CleavageSite=51; ConfidenceScore=5.54e-01
MGRKRASKNTHRALVLGVSEELFSTSRCSLSFSRRASVHPTVVKPQPSNVRRSERIKSKSLVVSHPNTNCDIEVIEYITLSDGEKDEADTQLEHESELADNLGEKKSLEQKINCALQRIDALNKAVDENIAFCEAPFRSMYIDSQKKIKALASENQRLNGKLENALGEN

SEQ ID NO: 123710 - protein, 96 aa, Glycine max
  Coding DNA Sequence Number=SeqID_6932
  Gene Ontology: Mol. function=phosphoprotein phosphatase activity; Cellular component=protein phosphatase type 2A complex; Biological process=protein amino acid dephosphorylation
  Homolog annotation: Hit_ID=Q07100; Match level="QueryCoverage=73%, HitCoverage=22%, E-value=2e-34, Identity=95%"; Hit description =Serine/threonine-protein phosphatase PP2A-3 catalytic subunit
MVRGLCEKAKEILMDESNVQPVKSPVTICGDIHGQFHDLAELFRIGGKCPDTNYLFMGDYVDRGYYSVETVSDENRKWDYSQVVDGSGFRMCCKGE

SEQ ID NO: 123711 - protein, 540 aa, Glycine max
  Coding DNA Sequence Number=SeqID_6933
  Homolog annotation: Hit_ID=Q75HI8; Match level="QueryCoverage=99%, HitCoverage=97%, E-value=4e-72, Identity=55%"; Hit description =Putative phosphatase
  Pfam annotation: Domain name=PAP2; Domain location=94-227; Score =64.5; E_value=3.5e-16; Accession=PF01569.12; Description=PAP2 superfamily
MEGEGAAVWQGAVLGGIIFWLVSASYLNVTRKLRSFLQPWVTHHVVTQTPIILKIQSYGFGFLDALFSGLSCVVSVPFYTAFLPLLFWSGHGKLARQMTLLMAFCDYLGNCIKDVVSAPRPASPPVKRVTATRDEEDNALEYGLPSSHTLNTVCLSGYLLHYVLTHTQIQGAYVTYLGVSLACMLVFFIGLGRIYLGMHSVVDVLAGLLIGLVVLAFWLTVDEYMDSFVISGQNEFGFGPGTPFWAALSFLLLFAYPTPELPTPSFEYHTAFDECSMEKLSNNEVFSPPLARRALYKDEIIWKWNASVSDWVLSGIGRAKREKRQKSRWGAGCALSGLLSDFTFSRVPLLLSELASSLSDEKEGLLGSNTLLECWQVVEIADQNGAQENCGVSLGRELSLRPYALGLVSGVQQTYHQFHHANVPRLFSSELTIPVFLGRMLLGIPTILIVKFCSKTLAKWTIPVVANTLGIPIKSTGYIPTLNGSVTGKMSDKLKQGYLQKLLSQHKAFDVDTGIRFVQYAGLAWSVVDLVPSLFSYMSL

SEQ ID NO: 123712 - protein, 58 aa, Glycine max
  Coding DNA Sequence Number=SeqID_6934
MLLSSNVINIYVRVVMLVRMIRTRLFVAAQLVALQYHGVAQELIKGNYWPLNRERKSR

SEQ ID NO: 123713 - protein, 206 aa, Glycine max
  Coding DNA Sequence Number=SeqID_6935
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=3e-28, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
QHVLTFRGLHILAFRGLNVLAFRGLHAFAFVRLHALTFSGLHVLVFRGLHVLAIRGLQVLAIKGLHVLSFRGLHVLTFRVPHALNFRGLHVLAIRGLHVLSFRGLHVLTFRGPHALTFRGPHVFAFRRLHVLAFRGLHALAFVGLHALTFRGLHVLAFRGLHALAFRGRHVLNFRGLHALAFRGLRILTFSGLHIHTLREFKVYCP

SEQ ID NO: 123714 - protein, 271 aa, Glycine max
  Coding DNA Sequence Number=SeqID_6936
  Gene Ontology: Mol. function=triacylglycerol lipase activity; Biological process=lipid metabolic process
  Homolog annotation: Hit_ID=Q2TNK2; Match level="QueryCoverage=89%, HitCoverage=36%, E-value=2e-42, Identity=41%"; Hit description =Phytoalexin-deficient 4-2 protein
  Pfam annotation: Domain name=Lipase_3; Domain location=1-95; Score =3.4; E_value=0.00028; Accession=PF01764.16; Description=Lipase (class 3)
VAIQMLEIVGSKDTKSVVITGHSIGGATASLCTLWLLSYLQSISSSVSVLCITYGAPLLGNESFSQIIFKERWGGNFCHVVSKHDIMPRLLFAPITSLSTQLNSLLQFWHLSMTSPDMGKLANQISEKEKDKLFTAVVDYLETATQDGETSVPILFHPFGSYFFVSEEGAVCVDSSAAIIKMMHLTLATSSPASSIEDHLKYGDYVNKMSAQTLYQSNSMQKSIPDSSYEAGLELAIQSSGIANQILKDLSGARWAYTVSPKQLKAFTIGG

SEQ ID NO: 123715 - protein, 582 aa, Glycine max
  Coding DNA Sequence Number=SeqID_6937
  Gene Ontology: Mol. function=endonuclease activity; Cellular component=nucleus; Biological process=regulation of transcription, DNA-dependent
  Homolog annotation: Hit_ID=Q10R99; Match level="QueryCoverage=95%, HitCoverage=97%, E-value=0.0, Identity=64%"; Hit description =Endonuclease/Exonuclease/phosphatase family protein, expressed
  Pfam annotation: Domain name=Exo_endo_phos; Domain location=261-573; Score=78.5; E_value=2.1e-20; Accession=PF03372.13; Description =EndonucleaseExonucleasephosphatase family
MADPAGIRPREWCERGVAVAALIGLQCGCELTPYVLLRRPDKIVTTDDVPETAPLDGHFLRYKWYRVQSDKKVAVCSVHPSEPATLQCLGCVKSKIPVAKSYHCTPKCFSDAWQHHRVLHDRAASAANENGNEEEELYGRFNNSGSGSINTSLSASASSASLTNGSAPVYPAAVTQRSGGETWFEVGQFKTYTPTADDIGHVLKFECTVVDAETKLTVGHVNTLLTSRVIPAPSPSPRRLIPVDGMGHLDADGRITSSGTFTVLSYNILSDAYASNDLYNYCPTWALSWPYRRQNLLREIVGYRADIICLQEVYNGNINTIDGCATFFRRDRFSHVKKYEVEFNKAAQSLTDAVIPTTQKKTALNRLVKDNIALIVVLEAKVINQPVDNPGKRQLLCVANTHVNVHHDLMDVKLWQVHTLLKGLEKIAASADIPMLVCGDFNSIPGSAPHALLAMGKVDPSHPDLAVDPLNILRPHSKLVHQLPLVSAYSSFARTVGLGFEQHKRRLDDTTNEPLFTNVTRDFIGSLDYIFYTADSLVVESLLELLDEESLRKDTALPSPEWSSDHIALLAEFRCCKNRSRR

SEQ ID NO: 123716 - protein, 90 aa, Glycine max
  Coding DNA Sequence Number=SeqID_6938
MQIHRKKLASKKIRFHFYERKNKIVEKVFDFLHPGVVADNSLAVAVSLEVPIRSRRRPRSAITRISLRTVKMMVSMTSLMSSSTARFQSG

SEQ ID NO: 123717 - protein, 364 aa, Glycine max
  Coding DNA Sequence Number=SeqID_6939
  Gene Ontology: Mol. function=ARF guanyl-nucleotide exchange factor activity; Cellular component=Golgi apparatus; Biological process =protein modification process
  Homolog annotation: Hit_ID=Q1SJF0; Match level="QueryCoverage=97%, HitCoverage=89%, E-value=1e-153, Identity=45%"; Hit description =Regulator of chromosome condensation/beta-lactamase-inhibitor protein II
  Pfam annotation: Domain name=RCC1; Domain location=159-207; Score =24.4; E_value=0.00039; Accession=PF00415.9; Description=Regulator of chromosome condensation (RCC1)
  Pfam annotation: Domain name=RCC1; Domain location=210-259; Score =17.7; E_value=0.0086; Accession=PF00415.9; Description=Regulator of chromosome condensation (RCC1)
  Pfam annotation: Domain name=RCC1; Domain location=262-308; Score =16.4; E_value=0.012; Accession=PF00415.9; Description=Regulator of chromosome condensation (RCC1)
  Pfam annotation: Domain name=RCC1; Domain location=31-81; Score=16.6; E_value=0.011; Accession=PF00415.9; Description=Regulator of chromosome condensation (RCC1)
  Pfam annotation: Domain name=RCC1; Domain location=84-134; Score =20.1; E_value=0.0047; Accession=PF00415.9; Description=Regulator of chromosome condensation (RCC1)
  Pfam module annotation: Pfam domain module=RCC1::RCC1::RCC1::RCC1::RCC 1; Domain location=159-207::210-259::262-308::31-81::84-134
MEDEVMSEVAAPPRRVLLVSAGASHSVALLSGNVVCSWGRGEDGQLGHGDTDDRLFPTKLSALDGQDIICVTCGADHTMARSESGRDVYSWGWGDFGRLGHGDHSDLLIPHPIKALQGLMIQQIACGDSHCLAVTMDSQEIPIKMVAAGAEHSVAITKDGNLYGWGWGRYGNLGLGDRNDRLLPEKVTVDGDKMAMVACGWRHTICVSSSGGLYTNGWGKYGQLGHGDFEDHLVPRKVQALSDKFISQVSGGWRHSMALTSSGQLLGWGWNKIGVGNNFDCCSPMQVNFPHDQKVQMISCGWRHTIAVTERENVYSWGRGANGQLGNGETIDRIFGDEVRLVILVLGVFTTHEVGSQTVDEQGA

SEQ ID NO: 123718 - protein, 58 aa, Glycine max
  Coding DNA Sequence Number=SeqID_6940
SITHTFIVCIWEIIFLEREKESHKESSYEGFNPFSISLTFENSIGVVGGKIGGISGNR

SEQ ID NO: 123719 - protein, 185 aa, Glycine max
  Coding DNA Sequence Number=SeqID_6941
  Homolog annotation: Hit_ID=Q1T6B2; Match level="QueryCoverage=22%, HitCoverage=5%, E-value=4e-13, Identity=92%"; Hit description =Exocyst complex component Sec6
MGSYIPQLLLISSGYLVSKYKLFGIIALISCYTELPWQSFRCSVTLLLVAKKHNCSLNKPSHDIHIATQKLMITTPTDREKEMIDGGVDAKRVVAAEEVETEVSRLHYYGLINVLREGVVRQIKNQGEEPVDLRRSLKLFSDFTQKILTKYPMDTKDMDVSIEFVYELFTRVMRERGATSEKLFG

SEQ ID NO: 123720 - protein, 116 aa, Glycine max
  Coding DNA Sequence Number=SeqID_6942
MEYMCKRDASLLLSKILNEFDKRMMWMSCTSAFVGCPASDSKKDPLQVTKVVNKPIDPCVDVEGWNYVHDEWMPYFFGIMTISGIGVTNLSKCHTSSWYRSQTFKWVSWMKTKGTK

SEQ ID NO: 123721 - protein, 313 aa, Glycine max
  Coding DNA Sequence Number=SeqID_6943
MQNTENSGSEFTETREALQSGNDRTLRRRRRKENSRKELREWLSLQILLLQKHEGHSGEGERENGEKGVDDVAWGIGFGGEFIERDACGAEVGEGSGGLVVVFELLRHGADDGAEVVVGFVGGVGEAREDRTAQIIIGFVYAECGFLHFNAFHGRFDDKTLASSKGLSVYARRAKAKDLNRFRALFNYFYYYAGNIGLLGPVHRMDTQISFEVFLFVHPNYHSLHPFHYGKWSMLMENFLRSKEYWQVVSDGIPVPEASMVMTDARKTKIEGLCLKDLKAKNYLFQAIDRPILETILCKDTSKDIWDSMKKKY

SEQ ID NO: 123722 - protein, 1417 aa, Glycine max
  Coding DNA Sequence Number=SeqID_6944
  Gene Ontology: Mol. function=sequence-specific DNA binding; Cellular component=integral to membrane; Biological process=regulation of transcription, DNA-dependent
  Homolog annotation: Hit_ID=O80784; Match level="QueryCoverage=74%, HitCoverage=43%, E-value=0.0, Identity=49%"; Hit description=Nodulin- like protein
  Pfam annotation: Domain name=NUC173; Domain location=323-521; Score =262.1; E_value=1.2e-75; Accession=PF08161.2; Description=NUC173 domain
MEGIEMEEAAFGIDESNDDLCSSILSRFANSTDETHHHLCAVVGAMSQELKDNNQPSTPFAYFCAARSAPRASEEAEFAGRAILGAPFASSPFSFGVGECDRFRIEVPLASVDHQGKCRLGVTSLLERFILLVGGANANAGEGAKEAQQILYILDALKECLPFLSRKSKTSILNYFKYLLDLHQPLVTRRITDGLSFLCHYPTSEVHPEALLELLNSLARSIESNKMSGDRLTFTARLLDAGMNKVYSLNRQICVVKLPIVFNALKDILASEHEEAIYAATDAFKNMINSCIDESLIKQGVDQISLSENKESRKSAPTIIEKICATIESLLDYHYTALWDRVFQIVSAMFHKLGNHSPYFMRGILKNMEDVQKLPDEDFPFRKQLHECFGSALVAMGPETLLSLIPLNLEAEDSSDANVWLFPILKHYIVGAPLNYFTEEILTMIKHAKEKAQKLEKQGLMVSSRNADALAYSLWSLLPSFCNYPSDTTKSFMNLEKHLRRKLKEEPDIRGIICTSLQLLIQQNNIVDSKDKGYIGEDMAKEQVPVHYSQQVARDNLYVLKSSAKHWLEDLSEVFLKSTKDDGGCLQRTIGDVASIADKADVRKLFQEKMLKLYKCTRKASKAGSSKSSHFMQIDDASNNLSLTILRAQLLDLAVSLLPGLDAEDIALLFEAIKPALQDAEGVMQKKAYKVLSIILRSSSNGFVSSKFEELRQTMVEILPCHFSAKRHRLDCLYFLIVHVSKSKDNMEHWRDIFLTEIILALKEANKKTRNRAYDILVEIARAFADEESGGNRESLNNFFQMVAGHFTGETPHMISAAAKGLARLAYEFSDLVLTSFKLLPGTLTLLRSDNKEIIKANLGFLKVLVAKSQAEGLQMHLKSMVEGLLKWQDNSRNHFKAKVKLLLGMLVTKCGLEAVKAVMPEEHMKLLSNIRKIKERKERNRSAKSEEARSHFSKATTSRQSMWNHTKIFSDFDGDSGNSDAEYMISRGSKASLHPKSAASSFRSNIRLKKNLPEHLSDQSDDEPLDLLDRQKTRSALKMSEHLKRKSRLDDEVELDSEGRLIIHEEVEWRKEKHADEDFDSRSERDSHISAKSGTKAQKKRKTSDSGWAYTGKEYASKKAGGDVKRKDKLEPYAYWPLDRKMMSRRPQQRAAARKGMASVVKMTKKLEGKSASGIGPLEGKALVRLDDIDALATASDYVTVSGGWDMPRLVRELPSHICDVPPAVSRDDDVPVWKHSTDGVFKVASDYKQNNRDPLFLAIWNRVLTESHGNGNAACGGVLRDHLGNVVLACAYNLGVCSISHAELWAILIGLKINWARGFTNLSVESDSIFAIAMLEGSCEQGNGCFRLLQARSLPVMMLFILGSIFLERQIKLLIPWQDMGLSILDEGKVFDYVPDFLSLSVIADKANVIFPRGF

SEQ ID NO: 123723 - protein, 617 aa, Glycine max
  Coding DNA Sequence Number=SeqID_6945
  Gene Ontology: Mol. function=nucleic acid binding; Cellular component= intracellular; Biological process=DNA integration
  Pfam annotation: Domain name=rve; Domain location=331-456; Score =51.7; E_value=2.4e-12; Accession=PF00665.16; Description=Integrase core domain
  Pfam annotation: Domain name=zf-CCHC; Domain location=146-163; Score =21.0; E_value=0.00033; Accession=PF00098.13; Description=Zinc knuckle
  Pfam module annotation: Pfam domain module=rve::zf-CCHC; Domain location=331-456::146-163
MAIFNKMGIHGDKKEDITIVEKILRSMTPKFNFVGCYIEEAHDIEELSIDELQSSLLIHEKKINQQEIEEQALKVSTENHSTSKGERGRGRGRVRGIRGRGRGSNYHGNQQEHQQHHENQFHRRGRGQGGHHFIAHRPKSADKSDVECYRCHRYGHYQSECQTNLNKDNREKTNFVEKEEEVSLLMVCHVKEETQQNMWYLDTSCSNHICGDKMMFSDLDETFCNTVKFGDNSTVSVLGKGMLQEKGYENSIKDGVCQIRDAKIGLIARVKMTANHMFPLYLHNTSHSCFSTKLKDDAWIWHFRYAPSEVYEECVVSKQHRNQFPQGKSWRARKALELVHSDIRGPINLYSNSAFTAFKNFKVLVEKEVNSPIKVLHSDRGREYNSHEFVNFCGAHGIKRQLTATYTPQQNGVCSLLTRSGAPKTFCPEAVNWSIHILNRSPTLVVQNMTPKEAWSGQRPVVDHFRIFRCVAYSHIPNQRRTKLDDRGEKCIFLGVSNQPKAYKLYNPITKKIIVSRDVIFDEERCWPWISSDVVEQQIPTNFDGVDEEDRQQPVENDQQIPPENVADTSGSPTMASDDERPQRGTSFVAQVDDTSTWVVILRTREGTSLVDQFKWR

SEQ ID NO: 123724 - protein, 96 aa, Glycine max
  Coding DNA Sequence Number=SeqID_6946
  Subcellular localization annotation: CTP_CleavageSite=58; ConfidenceScore=5.42e-01
MVHDISVKVKLEVTGTSTALNVFGSRRSSDVTRSIFCPNFCKMVTSILQLDSMNLFVKAQAWFSPITQGMAILTTNTSTTFNRDERLGNTPAKHGK

SEQ ID NO: 123725 - protein, 254 aa, Glycine max
  Coding DNA Sequence Number=SeqID_6947
  Gene Ontology: Mol. function=nucleic acid binding; Cellular component= lysosome; Biological process=regulation of transcription from RNA polymerase II promoter
  Homolog annotation: Hit_ID=Q1SGW2; Match level="QueryCoverage=98%, HitCoverage=64%, E-value=1e-109, Identity=78%"; Hit description=RNA -binding region RNP-1
  Pfam annotation: Domain name=RRM_1; Domain location=133-189; Score =17.3; E_value=0.0036; Accession=PF00076.12; Description=RNA recognition motif. (a.k.a. RRM, R
  Pfam annotation: Domain name=RRM_1; Domain location=48-115; Score =66.1; E_value=1.2e-16; Accession=PF00076.12; Description=RNA recognition motif. (a.k.a. RRM, R
  Pfam module annotation: Pfam domain module=RRM_1::RRM_1; Domain location=133-189::48-115
MQPQRLRQHAMLQPSLYHHPALLTPPQIEPILSGNLPPGFDSSSCRSVYVGNIHPQVTDSLLQELFSTAGALEGCKLIRKEKSSYGFVDYFDRSSAAFAIVTLNGRNIFGQPIKVNWAYASSQREDTSGHFNIFVGDLSPEVTDATLYACFSVYPSCSMFWFCDSIYQDAQSAINDLTGKWLGSRQIRCNWATKGASASDEKQSSDSKIVVELINGSSEEGQETTNDDTPEKNPQYTTVYVGNLAPEARIIFFP

SEQ ID NO: 123726 - protein, 66 aa, Glycine max
  Coding DNA Sequence Number=SeqID_6948
MEGAYIYIIMIKPSSLAHCVILSEVIVGNDNFFFFFRFQILSLGLGQEKTKTFLKDVSMCDNIVRC

SEQ ID NO: 123727 - protein, 165 aa, Glycine max
  Coding DNA Sequence Number=SeqID_6949
  Gene Ontology: Mol. function=alpha-L-fucosidase activity; Cellular component=integral to membrane; Biological process=carbohydrate metabolic process
  Homolog annotation: Hit_ID=Q8GW72; Match level="QueryCoverage=77%, HitCoverage=26%, E-value=4e-30, Identity=52%"; Hit description=Alpha- L-fucosidase 1 precursor
MARLESVDDHSIRGGIQETHFSPYNVLEEGIYTYWAPGENQTKWILYIDLQELVSFNILQLQEPINMGQRVIEFHLEALSLDGVWMRVVYGTTIGYQRLLRFPKLKSQYLKLVVDKLRRPVDIFGIYMDPVTVLSDLSDRKSGACFNGGQVLQTTRNSSYLSATM

SEQ ID NO: 123728 - protein, 90 aa, Glycine max
  Coding DNA Sequence Number=SeqID_6950
  Gene Ontology: Mol. function=hydrolase activity, acting on glycosyl bonds; Biological process=carbohydrate metabolic process
  Homolog annotation: Hit_ID=Q8GW72; Match level="QueryCoverage=60%, HitCoverage=10%, E-value=4e-17, Identity=69%"; Hit description=Alpha- L-fucosidase 1 precursor
MNYLFDSWISLIHQLQPGATNFSDLGPDTRWIGNEYGAAGSTCWSLYNKTGCEIGYIDSHAKLFYRAILEVMELGLSIIHRWVFRGLSLL

SEQ ID NO: 123729 - protein, 356 aa, Glycine max
  Coding DNA Sequence Number=SeqID_6951
  Gene Ontology: Cellular component=endoplasmic reticulum; Biological process=ubiquitin cycle
  Homolog annotation: Hit_ID=Q9LYC2; Match level="QueryCoverage=91%, HitCoverage=79%, E-value=1e-119, Identity=67%"; Hit description=NPL4- like protein 1
  Pfam annotation: Domain name=NPL4; Domain location=155-354; Score =196.3; E_value=7.2e-56; Accession=PF05021.5; Description=NPL4 family
MMLRIRSRDGLERVSVENPLATTVSDLKRIIQTQLGIPVHNQTLSTNQNLLLAKSLEDLLRFTDMSNLDASLSSLNLGHGSIVFLAYEGERRVAGPAFNPAGSFGRKMTMDDLIAKQMRVTRQENPHCELVSFDRDCANAFQHYVNDTLAFAVKRGGFMYGTVSEVGKVEVDFIYEPPQQGSEDNLVFFRDPEEEKFVEAIAVGLGMRKVGFIFTQTITQDKKDYTLSNREVLQAVEYHAESGLKEWATAVVKLEVNEEMGGADVHFEAFQMSDVCVRLFKEGWFETEIKEDDDPKLSKMKKDVVVGVKDTREVDNDFFLVVVKIADHQTSAVDAGTIGVAKTVIFFKLGWLLEGE

SEQ ID NO: 123730 - protein, 53 aa, Glycine max
  Coding DNA Sequence Number=SeqID_6952
  Gene Ontology: Mol. function=structural constituent of ribosome; Cellular component=cytosolic ribosome (sensu Eukaryota); Biological process=translation
  Homolog annotation: Hit_ID=Q9SR73; Match level="QueryCoverage=72%, HitCoverage=78%, E-value=4e-10, Identity=68%"; Hit description=40S ribosomal protein S28-1
  Pfam annotation: Domain name=Ribosomal_S28e; Domain location=1-53; Score=96.7; E_value=7e-26; Accession=PF01200.9; Description =Ribosomal protein S28e
MESQVKHALVVKVMGRTGSRGQNRHIMRNVKGPVREGDILTLLESEREARRLR

SEQ ID NO: 123731 - protein, 179 aa, Glycine max
  Coding DNA Sequence Number=SeqID_6953
  Gene Ontology: Mol. function=peroxidase activity; Cellular component =membrane; Biological process=response to oxidative stress
  Homolog annotation: Hit_ID=Q40487; Match level="QueryCoverage=97%, HitCoverage=55%, E-value=1e-41, Identity=49%"; Hit description =Cationic peroxidase isozyme 40K precursor
  Pfam annotation: Domain name=peroxidase; Domain location=41-179; Score=118.4; E_value=2.1e-32; Accession=PF00141.13; Description =Peroxidase
MKMRFFLVACLAMFCILEVCQGGNLRKQFYKKTCPQAEQMVRTKIQEHVSGRSDLPAKLIRMHFHDCFVRGCDGSVLLDSTATNTAEKDAIPNLSLAGFDVIDEIKEALEAKMSRSSRDAVAVKFNKPMWEVLTGRRDGRVSISGETLANLPAPFFNFTQLKQSFASKGLTVHDLVVLS

SEQ ID NO: 123732 - protein, 132 aa, Glycine max
  Coding DNA Sequence Number=SeqID_6954
  Gene Ontology: Cellular component=intracellular; Biological process =signal transduction
  Homolog annotation: Hit_ID=O82460; Match level="QueryCoverage=66%, HitCoverage=20%, E-value=5e-30, Identity=75%"; Hit description=Rac GTPase activating protein 3
  Pfam annotation: Domain name=PBD; Domain location=66-110; Score=42.0; E_value=2e-09; Accession=PF00786.18; Description=P21-Rho-binding domain
MTGQVVVTNGGGCGGVGKGRRGGGGEEEQNPASPVAVLLAALRKSMVACSVDSPDDVISAVHHPMEIGWPTNVKHVSHVTFDRFNSFLGLPLELQVHVPAPVPSARDFIVGGSVSLELNVLTLDGGMDVILR

SEQ ID NO: 123733 - protein, 220 aa, Glycine max
  Coding DNA Sequence Number=SeqID_6955
  Gene Ontology: Cellular component=intracellular; Biological process =signal transduction
  Homolog annotation: Hit_ID=O82460; Match level="QueryCoverage=99%, HitCoverage=60%, E-value=9e-72, Identity=61%"; Hit description=Rac GTPase activating protein 3
GLLDGLSHEQVLECNTEDESVQLVKQLKPTESALLNWAIDLMADIVAEEDYNKMDARNIAVVFAPNMTQMSDPPTALMHAVQVMNLLKTLILKTLREREETAAAGYSPMSSLSSDCQSEDDYSQQEMDTSGELRETKLDDDDDEKLESPKSCSGYNLESALSFTDIKTVDSCSSPSYEDDSRTTLTTEESNADTSTSTDDVEMIDKFTDSVSLVPLFASS

SEQ ID NO: 123734 - protein, 123 aa, Glycine max
  Coding DNA Sequence Number=SeqID_6956
MDMMKNSPFDVSSSYLLIEASGDSEADWNPYTKGEHADDDAQSCIYDSSEICNASELNGYDESWNIDDDVEDEKKDDVIHHGTSYCDDDDMQHQKSCVSDDSGQELVDEMEKNRLFWEACLAS

SEQ ID NO: 123735 - protein, 439 aa, Glycine max
  Coding DNA Sequence Number=SeqID_6957
  Gene Ontology: Mol. function=nucleic acid binding; Cellular component= ribonucleoprotein complex; Biological process=regulation of alternative nuclear mRNA splicing, via spliceosome
  Homolog annotation: Hit_ID=Q7XAN8; Match level="QueryCoverage=93%, HitCoverage=93%, E-value=1e-86, Identity=45%"; Hit description =Putative CUG triplet repeat RNA-binding protein 1
  Pfam annotation: Domain name=RRM_1; Domain location=117-188; Score =63.1; E_value=8.9e-16; Accession=PF00076.12; Description=RNA recognition motif. (a.k.a. RRM, R
  Pfam annotation: Domain name=RRM_1; Domain location=15-87; Score =48.0; E_value=3.2e-11; Accession=PF00076.12; Description=RNA recognition motif. (a.k.a. RRM, R
  Pfam annotation: Domain name=RRM_1; Domain location=360-431; Score =84.8; E_value=2.6e-22; Accession=PF00076.12; Description=RNA recognition motif. (a.k.a. RRM, R
  Pfam module annotation: Pfam domain module=RRM_1::RRM_1::RRM_1; Domain location=117-188::15-87::360-431
MAEESKSSSEESVKLFVGQVPKHMTEPELLAMFKEFALVDEVNIIKDKATRASRGCCFLICPSREEADKAVNACHNKKTLPGASSPLQVKYADGELERLGHALISSFLWSLNPEHKLFIGMLPKNVSEVEISALFSKYGTIKDLQILRGSQQTSKGCAFLKYETKEQALAALEAINGKHKMEDSSVPLVVKWADTEKERQARRAQKAQSQASNVPHTDSQHLSMFGALPMSYVPPYNGYAYQAPGGYGLMPYRMPPMQSQHGYHNVMPHMNQVNALRPDLGPNMNPRNYHVPPASYVSSYPAVPGLQHPMAYPTGMISPRPMNTSPGSVSPAGGNNSSAASSGASKNSGGQVEGPPGANLFIYHIPQEFGDQELATAFQPFGRVLSAKVFVDKATGVSKCFGFVSYDTPEAAQSAISMMNGCQLGGKKLKVQLKRDNKQ

SEQ ID NO: 123736 - protein, 415 aa, Glycine max
  Coding DNA Sequence Number=SeqID_6958
EVKDVTRLERKLDSLVVRGLKMPVHTPKHERERVTMEEVSPGGREKKGPEEANVKDKHKMEGNHVDTKTKQFQQKRETTSYSKILMAEGRNTGPGRFLKNPSLSGVNLALFDRMEDDLMWNGGEDVTPKYISDDMILLMGLTETIATQMAKEANEQGSSVFYSLEKWAPQLRIGYHLVWLLCWSIPLHAWDLEHIRQIMTLVGEVHKVPLSTSPSHLLPRTQGSRSSQDPNTNNKPGGDQSGSRCFARMLQPYGISIGLKEHSNPVTPKAYTPKSPSGSLPPDSDMILQFPTVRMLEIGFQTWCSNFTTIQRLDKTQILVKTPWQPLIQHKVSAWINGVEYTVHIAEETCYNLDRCKCRGRSFIGSSEEISSDDSESEIGTQMAIKGITLETDPSEEDIPPSTDGDEQSRRDTKE

SEQ ID NO: 123737 - protein, 82 aa, Glycine max
  Coding DNA Sequence Number=SeqID_6959
MSRSRPSSLCWTSLNEELEQLLVNVPKLTIEEHGEWREMTNMMQNVAAPREDFFQTVHARDQIFDEVSKVYAVKWKDVLDDA

SEQ ID NO: 123738 - protein, 44 aa, Glycine max
  Coding DNA Sequence Number=SeqID_6960
MVQVCNSNTIGTSWIGCMLGIKCLSGVDLDQLCITQANLAFELR

SEQ ID NO: 123739 - protein, 459 aa, Glycine max
  Coding DNA Sequence Number=SeqID_6961
  Gene Ontology: Mol. function=transferase activity; Cellular component= membrane; Biological process=cellular metabolic process
  Homolog annotation: Hit_ID=Q5BM98; Match level="QueryCoverage=93%, HitCoverage=98%, E-value=1e-174, Identity=68%"; Hit description =Secondary cell wall-related glycosyltransferase family 47
  Pfam annotation: Domain name=Exostosin; Domain location=102-409; Score=319.3; E_value=6.8e-93; Accession=PF03016.6; Description =Exostosin family
MSEQKKPPQSRVFYVRMKLLHKQGNKPQQDKNNNCFHTYYKWVLWFSFSLYFFTSYLITSNPNNTPTSADTSHVSNSESNVVSPTLVESTTNTLGVLKNMKVFVYELPPKYNTDWLANERCSSHLFASEVAIHRALLTSEVRTFDPYEADFFFVPVYVSCNFSAVNDFPAIGHARTLISSAVNLVSTEYPFWNRSRGSDHVFVASHDFGACFHTLEDVAMADGIPIILKNSIVLQTFGVIHQHPCQEVENVVIPPYVSPESVRSTLEKFPVTGRRDIFAFFRGKMEVHPKNVSRRFYSKRVRTEIWRKFNGDRRFYLQRHRFAGYQLEIARSVFCLCPLGWAPWSPRLVESVALGCVPVVIADGIQLPFSSAVRWSEISLSVAERDVGKLGKILERVAATNLSVIQRNLWDPRTRRALLFNNNKVQEGDATWQVLVSLSEKLGRSQRRSSVAGQLKSDT

SEQ ID NO: 123740 - protein, 156 aa, Glycine max
  Coding DNA Sequence Number=SeqID_6962
  Gene Ontology: Mol. function=oxidoreductase activity; Biological process=metabolic process
  Homolog annotation: Hit_ID=Q2HUL4; Match level="QueryCoverage=71%, HitCoverage=57%, E-value=1e-24, Identity=37%"; Hit description=Short- chain dehydrogenase/reductase SDR
MSRNEKLQDKVAPITGAASGIGNRKGYSYKIHQQWGQGIACRSPLSIVDLDLELFDKVMDINVRGIVAGVKHSACVMIPRGSESILCTASVTGVMGGVAQHPYNIQGVNCEPNDIANTALFLASDDAKYVSGHNLVVDGGFTSFKNLEFPAPDQVQ

SEQ ID NO: 123741 - protein, 632 aa, Glycine max
  Coding DNA Sequence Number=SeqID_6963
  Gene Ontology: Mol. function=protein dimerization activity; Cellular component=nucleus; Biological process=regulation of transcription, DNA-dependent
  Homolog annotation: Hit_ID=Q6YVY0; Match level="QueryCoverage=98%, HitCoverage=83%, E-value=3e-92, Identity=36%"; Hit description =Putative auxin-responsive factor
  Pfam annotation: Domain name=Auxin_resp; Domain location=207-288; Score=120.7; E_value=4.2e-33; Accession=PF06507.4; Description=Auxin response factor
  Pfam annotation: Domain name=B3; Domain location=78-183; Score=116.2; E_value=9.5e-32; Accession=PF02362.12; Description=B3 DNA binding domain
  Pfam module annotation: Pfam domain module=Auxin_resp::B3; Domain location=207-288::78-183
MEHVAAYTQHQQDGHMEIPVYDLPSKILCKIMHIELKAEAFSDEVYAQVTLVPALKQDNLRLEVEENDQIPSITTTYTFSKILTPSDTSTHGGFSVPKKHADECFPPLDMTQQTPAQEIVAKDLNGFEWHFRHIYRGKPKRHLLTSGWSTFVNAKKLVAGDSCIFVRAESGEIRVGIRRATEHLSNVSQSSSLISGHSMQLGILASASHAVSSGTMFIVYYHPWTNPFEFIVPLRTYLKSTVPDYPIGMRVQMQHEVEESLRRHAGTIIGHEDIDKIRWPGSEWRCLKVQWDAVLDDKMNPERVCPWWIEPLESAKEKKQVPALPTTKKALALNQRSLPGISSFGMHDGQNSAGPSSQTRREDRDLQGQDYSGIHSAQPLQRAPPTDVIHPSKVPIRGSRFGKENPNQLPFPMQGPLHKSLSRSMSLTHEDLSITSSNLSSIGSESLGWPSTESRNENDVPFGQPGSCSTFKLFGVSLIDRSSELPSLQSAAFNKTSSLLSNPPMRVAPGKTCKKCHRVNNRSCTKPSREDPDFFSWIERVPRCRHARSLLLDCPSVLVLKLGTALGRAVDLARFHGYTELIAELDSMFEFRGSLINESSGWHVTCMDDDGDMMQLGDYPWQLSSGETNSII

SEQ ID NO: 123742 - protein, 99 aa, Glycine max
  Coding DNA Sequence Number=SeqID_6964
CASSGILPDESLLSESSRKRFSGSLPEEVFFRKTFGYFRKNTSSGNFPEKVLPELPEEPLTGLPEDSVGRLGTPTSNGNGVQPKEAAPGLAVKEKARGR

SEQ ID NO: 123743 - protein, 994 aa, Glycine max
  Coding DNA Sequence Number=SeqID_6965
  Gene Ontology: Cellular component=intracellular
  Homolog annotation: Hit_ID=Q1SSF3; Match level="QueryCoverage=43%, HitCoverage=88%, E-value=1e-119, Identity=55%"; Hit description=BRCT
  Pfam annotation: Domain name=BRCT; Domain location=749-825; Score =21.5; E_value=0.0031; Accession=PF00533.16; Description=BRCA1 C Terminus (BRCT) domain
MAEASSPRSQTSSSPGGYTVKDANEEDQFRETELFEDSFVLNSPFTEMEVENLNLNTEIVEDTEPAEDMTTGTMCEYEQVVLDSEDEEMNDRGVGKGFLKDETSPTVKIHSTLFQKRQPKPPCEQVDANATTFGKSTAGYKGALVDADGFDDNNHLYPPAMLSHIHSPEPGDSTEAALGFVDQYLSSNDVDLFQVIHYGKTTREKSPYVLSSRGPLNLAKKIKARTQSEEKEPFKWVDSCQHDNKAGIFGKKIEESSNFGRYKQTYTRKRQKEGGHLQGQGNCNTSNRCDEKLRQGPRTETENNNSLKELDVQPSAISENVNVYSSVTHIEDLYDIGLDTQIAAEAMNALAFVPPSGCQFNDTHQPENALDGSLSDLTENEALLKNSSEIQNPGLHSITIKSNKKNPSSSRFSKITFSSSCKHTDKQEPSLVSWKMKKMRSKPNSEGQIDNNTSLPICSKHVLLEAVCSLGESTSLQPAAEEPKDWNNESRQTRIKDQPSHHTEGNNNVTEKGIKHKRKGSGLVAEPVKFGVRTKRLKLPTNSCTVARKSRLNHLAQVSPQLSAISSFSRPDSWVYPKRSRGKRKGDNVGTNLNAPTVVCIDGKENNVFSPRGLEDQDDVDKPCFPHTHPLCNASCVDNARCLLQGNFVPPGSAGDAMKVDNLHDMHPLLLAHVELSSNKSIAQSRSEIPATVTASKGIKVSNANHTYTEHHKKPCEKSLPKTSVSVLKELIRLGVPEFTSDMMWKHLRHRRDMTDVQVLFSQHLDDSIIKQQKKILARLNISVASSSIEATHFIADKFTRTKNMLETMALGKLVVNHLWLESCGQANCFIDEENYILRDMKKEKQIGFNMPVSLAQARQKPLLKGKRVYITPHIKPDKEVLVSLVTDVHGQVVDESGVCADMNDNSLDDLLILSCEDDYAICHRFLKRGTAVYSPELVLNGIVIQKLELESYINAIFDLNHVQLFATTMICWLEVKTPKKILSSSCAKSTLGC

SEQ ID NO: 123744 - protein, 83 aa, Glycine max
  Coding DNA Sequence Number=SeqID_6966
MLQNFTDCALTLPFNSRHATELHGLPNDGCQVPRSGQAKVASHQTDGPRTKLGSFVIILEYLEIDLGVSKFLIQRSHHQDLSF

SEQ ID NO: 123745 - protein, 67 aa, Glycine max
  Coding DNA Sequence Number=SeqID_6967
MKTEKQKSERKKWLLRRSFGNEVSTTCCLRWVKGSGKVLLYAHRKQLRGSLPFKTLLVSAINVNQLT

SEQ ID NO: 123746 - protein, 130 aa, Glycine max
  Coding DNA Sequence Number=SeqID_6968
  Gene Ontology: Mol. function=polygalacturonase activity; Biological process=carbohydrate metabolic process
  Homolog annotation: Hit_ID=Q1SGW6; Match level="QueryCoverage=92%, HitCoverage=23%, E-value=3e-63, Identity=90%"; Hit description =Glycoside hydrolase, family 28
MPPLPSYGYGREHPGPRYGSLIHGQHLKDVVITGHNGTINGQGQTWWKKYRQKRLNHTRGPLVQIMFSSDIVITNITLRDSPFWTLHPYDCKNITIKGVTILAPVFGAPNTDGIDPGEYLLLNTKLYFIS

SEQ ID NO: 123747 - protein, 76 aa, Glycine max
  Coding DNA Sequence Number=SeqID_6969
SFGVPVTPSKVIRPPITRAFIEKYCTPRQAQALGSPVGSQPPWAGEEPTGSPGEAEEARMDEDMTDLLGFLGGSGV

SEQ ID NO: 123748 - protein, 235 aa, Glycine max
  Coding DNA Sequence Number=SeqID_6970
  Gene Ontology: Mol. function=polygalacturonase activity; Biological process=carbohydrate metabolic process
  Homolog annotation: Hit_ID=Q1SGW6; Match level="QueryCoverage=60%, HitCoverage=27%, E-value=5e-57, Identity=76%"; Hit description =Glycoside hydrolase, family 28
MVENSTLGRFHHQRLDLRRWVPAFFTSHKTLLTFLWIAAFASVFLWQRNIAGGFLVYGGIPARPMPMLRPMAFNLTDFGGVGDGVTLNTEAFKRAVSAVSKFGKKGGAQLNVPPGRWLTAPFNLTSHMTLFLAEDAVILGIDVVWTHTYKEEKLVKKVEGMICSPMKLKREREIKEDIRAPRREITFSGRTKSFIKYSDKYFCTVSVLNEMVFFMDFVCLFRVSNKSSHMLLAFG

SEQ ID NO: 123749 - protein, 358 aa, Glycine max
  Coding DNA Sequence Number=SeqID_6971
  Gene Ontology: Mol. function=protein binding; Cellular component =mitochondrion; Biological process=ubiquinone biosynthetic process
  Homolog annotation: Hit_ID=UPI000060EAEB; Match level="QueryCoverage =53%, HitCoverage=60%, E-value=1e-37, Identity=39%"; Hit description =UPI000060EAEB related cluster
  Pfam annotation: Domain name=COQ9; Domain location=237-315; Score =167.8; E_value=2.8e-47; Accession=PF08511.1; Description=COQ9
MAYDDHDLVECGAYPIVIIYHSPRKSCVSRPSGSSEMYRTAAKRLLCGARYYYNGNVGLRFRPPQIFIPSSRFSTSETQPLPIPHATDRTIPVVVTTETENPNSSDSSASSSPSSSSTADDATKPRAKYEDQHTRVLQASLSYVLKLGWTEAALVAGARDVGLSPSIVGSFPRKEAALVEYFMDGCLQRLADKIDSDESLQNLTPSDCISKLIRFRLEMQAPYISTWPQALSIQAQPVNVPTSFKQRAVLVDEIWHAAGDNASDIDWYAKRTILGGIYSTTEIYMLTDTSPDFRDTWAFLDARVKDAFDLKKTIQENSQSSKFSGTVFGRSCQYRAGKLLSRVCRESFPEMSRGGNLC

SEQ ID NO: 123750 - protein, 562 aa, Glycine max
  Coding DNA Sequence Number=SeqID_6972
  Gene Ontology: Mol. function=carboxypeptidase activity; Cellular component=proton-transporting two-sector ATPase complex; Biological process=ATP synthesis coupled proton transport
  Homolog annotation: Hit_ID=Q2R860; Match level="QueryCoverage=69%, HitCoverage=89%, E-value=1e-139, Identity=59%"; Hit description =Expressed protein
  Pfam annotation: Domain name=DUF231; Domain location=390-529; Score =53.6; E_value=6.6e-13; Accession=PF03005.6; Description=Arabidopsis proteins of unknown function
EFECTGGGGGGSGNYLLGNRDDQTNKNTGLRMKVGFNGLRGKEISLISIVLMSVTIILWSWEKMPGLSAFLPPQTPPLQLPSDHLASRRSDQVLEPDPHLGEDGSPLAKAKTANEAEELRLKGASWTVPAQSSSGKNMGEEGSSLATEKIFNETEELNLEGASRTVPAQSSFGKNMSESNTKTTSYTEQILSSVPDDEAKHKRILEVCNYAKGKWVPDNNRPLYSGFGCKQWLSGMWACRLMQRTDFEYEKLRWQPKDCQMEEFEGSKFLRRMQNKTLAFVGDSLGRQQFQSLMCMITGGKDKLEVEDVGREYGLVIAEGSARPSGWAFRFSSTNTTILYYWSASLCDVEPIDVNNPNTDYAMHLDRPPAFLRQYIHKFNVLVLNTGHHWNRGKLTANRWVMHVGGVPNTDKKIAVIWGAKNLTIHSVVSWANSQLPKYPGLKVFYRSISPRHFVGGDWNTGGSCDNTKPMSVGKEILGEESIDEGAASAVKGTGVKLLDITALSQLRDEGHISRFSLTAKPGVQDCLHCYNHSFAWKWSFTLKENYSFAEDAVMEVAMCPS

SEQ ID NO: 123751 - protein, 417 aa, Glycine max
  Coding DNA Sequence Number=SeqID_6973
  Gene Ontology: Mol. function=nucleoside-triphosphatase activity; Cellular component=membrane; Biological process=cobalt ion transport
  Homolog annotation: Hit_ID=Q6AF27; Match level="QueryCoverage=99%, HitCoverage=78%, E-value=1e-166, Identity=73%"; Hit description=ABC transporter, ATP-binding protein
  Pfam annotation: Domain name=ABC_tran; Domain location=236-401; Score= 135.4; E_value=1.6e-37; Accession=PF00005.17; Description=ABC transporter
  Pfam annotation: Domain name=ABC_tran; Domain location=7-116; Score =40.5; E_value=4.4e-11; Accession=PF00005.17; Description=ABC transporter
  Pfam module annotation: Pfam domain module=ABC_tran::ABC_tran; Domain location=236-401::7-116
MKRYARLTEQFEAQGGYAAEAEAASIAHNLSLPDRILDQPLSTLSGGQRRRIELARILFSDAQTMILDEPTNHLDADSVVWLREFLKGYKGGLIVISHDVELVGETVNRVFYLDANRQVIDTYNMNWKNYLRQRVADEERRKKERANAEKKATTLQLQAARFGAKASKAAAAHQMIARAEKLLAGLDEVRQEDRVAKLRFPKPAPCGKTPMMASGLSKSYGSLEIFTDVDLAIDRGSKVVVLGLNGAGKTTLLRMLAGVDKPDTGQLEPGHGLKVGYYAQEHENLDVNRSVLENMVSAAPHITETEARKVLGSFLFTGDDVLKPAGVLSGGEKTRLSLATLVVSSANLLLLDEPTNNLDPASREEILGALAHYEGAVVLLSHDPGAVQSLNPERVLILPDGVEDIWSQEYQDLIELA

SEQ ID NO: 123752 - protein, 332 aa, Glycine max
  Coding DNA Sequence Number=SeqID_6974
  Gene Ontology: Mol. function=RNA-directed DNA polymerase activity; Cellular component=chromatin; Biological process=chromatin assembly or disassembly
MGTPSQIQEQSRCWPLPTITRRGEILRHGRPNWVTKVGCTKLWVLPSSTSNTTRWLAIIPTIRKALSARWPENELRLLWAWNGSGSFDGSGGGSVGSILGSEVKHNPRSRREVISSGVRCFIIGGGVAEGLGARGVEVDEVQRLQGEHERGWVARGVREAVGDCGCRQSSPPEAWPDRRLGRGTSLRISEVRLEMKQLSRKGDGGPIIRANLVCRACRNPGHEVNWALLDIHWNQASALPSMRGFWLRRGKRGRAVKKFIKFKVHGLHGVGEASEDGFQVARRCLVGTRHSIKGNESTNVMNLADLEHQQEDCGRSRELAIPIRFLQAKSFK

SEQ ID NO: 123753 - protein, 456 aa, Glycine max
  Coding DNA Sequence Number=SeqID_6975
  Gene Ontology: Mol. function=RNA-directed DNA polymerase activity; Cellular component=chromatin; Biological process=chromatin assembly or disassembly
MDLHVLPVVGANVVLGVQWLKTLGPILTDYGSLRMQFFYQDQLIELKGDNAIDSGLLSHHQLRRLCRTQTQASYFRIAILTDNQKPTHSQDLPTEIQALLIHFSTLFQSPSGLPPTRDTDHHIHLLPHTDPVNVCPYRYPHYQKKEIEQQVNDMLRKGLIRPSTSPLSSPVLLVRKQDGSWRFCVDYRALNAVTVRDRFSIPTIDELLDELGGAQTHHGHYEFKVMPFGLCNAPSSFQATMNSIFRQHLRHFIIVFFDDILVYSTSLEAHLQHLTITFQVEYLGHVVSHKGVEPVASKIEAIRQWPTPRSAKAVKSFLGLAGFYRRFIRNYATIAAPLVRLTTKDFFDWSPQTQEAFDQLKTALSTAPVLALPDFTLPFTVETDVSGVGMGVVLTQKGHPVAFFSKPFTPKLAVASTYVRELVAITTAVKWWRQYLLGQRFIIITDHRSLKELLTQ

SEQ ID NO: 123754 - protein, 303 aa, Glycine max
  Coding DNA Sequence Number=SeqID_6976
  Gene Ontology: Mol. function=RNA-directed DNA polymerase activity; Cellular component=chromatin; Biological process=chromatin assembly or disassembly
  Pfam annotation: Domain name=rve; Domain location=1-108; Score=0.8; E_ value=0.0051; Accession=PF00665.16; Description=Integrase core domain
MVASLFIDMVVKIHGVPHSLVSDRDPLFISKFWQELFKASGTHLRMSSAYHPQSDGQTEVLNRVVEQYLRAFIHRRPNRWGKLLPWIEWSHNTSWNTGIGTTPYEITFGRKPFNFPEYITGSSNIEAVEHLLTDRDATFQTIRKKLLKAQEAMKRQADSKRRDAQYQIGDWVEDRIGTVAYKLKLPDSARIHPVFHCSKLKPFRADLEQHPKLNLPSTFVNDQPGLSPDETSWEDWEQLQQDFHLKDKVRLQGPKSDMNREASMEDSIDITATTEGELTNKEVKRETVLKRKIKKPTNLKDFV

SEQ ID NO: 123755 - protein, 142 aa, Glycine max
  Coding DNA Sequence Number=SeqID_6977
MDGGYEINSASDDEPMRKLFLLLVPNRKKPRKEEESLRQELGKQEGEARKGGARGSPSLGRLCPGSGNLSSGQLVVACALLQVVIPPVPLVFSTVLESEVAVMSRPQYSDRFHVSPEFHQFQAFLSQQEDARLNLKELTRFT

SEQ ID NO: 123756 - protein, 281 aa, Glycine max
  Coding DNA Sequence Number=SeqID_6978
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=30%, E-value=1e-147, Identity=83%"; Hit description=DNA -directed RNA polymerase beta chain
  Pfam annotation: Domain name=RNA_pol_Rpb2_6; Domain location=1-190; Score=102.6; E_value=1.2e-27; Accession=PF00562.18; Description=RNA polymerase Rpb2, domain 6
  Pfam annotation: Domain name=RNA_pol_Rpb2_7; Domain location=192-269; Score=144.1; E_value=3.6e-40; Accession=PF04560.10; Description=RNA polymerase Rpb2, domain 7
  Pfam module annotation: Pfam domain module=RNA_pol_Rpb2_6::RNA_pol _Rpb2_7; Domain location=1-190::192-269
MAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 123757 - protein, 300 aa, Glycine max
  Coding DNA Sequence Number=SeqID_6979
  Homolog annotation: Hit_ID=Q2QMG9; Match level="QueryCoverage=87%, HitCoverage=15%, E-value=3e-23, Identity=29%"; Hit description =Expressed protein
  Pfam annotation: Domain name=KIP1; Domain location=11-85; Score =164.5; E_value=2.7e-46; Accession=PF07765.3; Description=KIP1-like protein
MAGMTNNQPSQWWWLESHTTTNRSPWLQSTLSELNEKTRAMLKLIEEDADSFAKRAEMYYKKRPELVSMVEDFYRAHRSLAERYDQVKPDTTGIGHLITGGSPFASAKYQLEKLMTFSDNGYDTYSEHCDVYESEESEVDDPEQEEEEEEGTKFLHKSTKKEQVLFVVAGDVEVMKLRDEIKRLNEENKAQRDQIKQKDTICDEVMMLREEIERLRDENEAQKERLKQKDEEKIEVIRQLSLAIDVLKQENAKMRNYIAKESTKKWKNPFEINKLVEAFSVKLFSGTPKNQPGVELSRCG

SEQ ID NO: 123758 - protein, 361 aa, Glycine max
  Coding DNA Sequence Number=SeqID_6980
  Gene Ontology: Mol. function=oxidoreductase activity; Cellular component=microsome; Biological process=aromatic compound metabolic process
  Homolog annotation: Hit_ID=Q9FVQ0; Match level="QueryCoverage=82%, HitCoverage=81%, E-value=2e-70, Identity=41%"; Hit description =Flavin-containing monooxygenase, putative
  Pfam annotation: Domain name=FMO-like; Domain location=4-329; Score= -424.3; E_value=0.00035; Accession=PF00743.9; Description=Flavin -binding monooxygenase-like
  Pfam annotation: Domain name=Pyr_redox; Domain location=174-248; Score=7.9; E_value=0.0034; Accession=PF00070.17; Description =Pyridine nucleotide-disulphide oxidor
  Pfam annotation: Domain name=Pyr_redox_2; Domain location=6-249; Score=-40.5; E_value=0.089; Accession=PF07992.4; Description =Pyridine nucleotide-disulphide oxidor
  Pfam module annotation: Pfam domain module=FMO-like::Pyr_redox::Pyr _redox_2; Domain location=4-329::174-248::6-249
MQEATKVIIIGAGTSGIATAGCLTKQSIPYIMLEREDCFASLWQKYTYDRLHLHLRKQVCELPHLPFPKSYPHYVPRKQFIDYLGNYVNHFEIKPLYQRAVELVEYDGWKGIWRVKAQNRRSGELEEYAGKYLVVASGETAEPRLPQIQGLESFNGKVIHSTAYKNGNEFKNKHVLVVGSGNSGMEIALDLSNFGAKPSIIVRSPVHFLSRDMMYYASLMLNYLSLSTVEKVLVMVSKVVYGDLSEYGIPYPSEGPFTMKMKYAKFPIIDVGTVKKIKSREIQDGKSYTFDSIVFCTGFKRSTQKWLKASPPQHAYLWKKYSYTASTSTSGNSTANFGRTVELAEEYRGRFLVVATGETNE

SEQ ID NO: 123759 - protein, 161 aa, Glycine max
  Coding DNA Sequence Number=SeqID_6981
  Gene Ontology: Mol. function=protein binding; Cellular component =integral to membrane; Biological process=defense response to fungus
  Homolog annotation: Hit_ID=Q949G9; Match level="QueryCoverage=95%, HitCoverage=14%, E-value=7e-21, Identity=42%"; Hit description =HcrVf1 protein
  Pfam annotation: Domain name=LRR_1; Domain location=118-141; Score =10.3; E_value=3.3; Accession=PF00560.23; Description=Leucine Rich Repeat
  Pfam annotation: Domain name=LRR_1; Domain location=41-62; Score=3.9; E_value=53; Accession=PF00560.23; Description=Leucine Rich Repeat
  Pfam annotation: Domain name=LRR_1; Domain location=67-89; Score=7.6; E_value=11; Accession=PF00560.23; Description=Leucine Rich Repeat
  Pfam annotation: Domain name=LRR_1; Domain location=91-116; Score =2.6; E_value=91; Accession=PF00560.23; Description=Leucine Rich Repeat
  Pfam module annotation: Pfam domain module=LRR_1::LRR_1::LRR_1::LRR _1; Domain location=118-141::41-62::67-89::91-116
MGKIPSQIGNLSNLVYLGLGGYSVVEPLLAENVEWVSSMWKLEYLHLSTVDLSKAFHWLHTLQSLPSLTHLYLSGCTLPHYNEPSLLNFSSLQTLILYNTSYSPAISFVPKWIFKLKKLVSLQLWGNEIQGPIPGGNIPTSLGNLCNLRDIDFSNLKLNQQ

SEQ ID NO: 123760 - protein, 171 aa, Glycine max
  Coding DNA Sequence Number=SeqID_6982
  Homolog annotation: Hit_ID=Q9FQ13; Match level="QueryCoverage=45%, HitCoverage=80%, E-value=6e-14, Identity=42%"; Hit description =Cystatin-like protein
MGERRMEMGFEMEENVICMGGGPKRRATEKTKSNVQGGGFEGSEIPEMEPRLLQHGGLVTGRGGSILDLEDQARQLCPRTLVVLAHRVVRDLRHVAVVHVLDGAPAAQRRFRPPGSVGDQDEGEEKETVHWKNAVNGLVLNILVWASACLPFCFLDIAAETRVPVPAFLKR

SEQ ID NO: 123761 - protein, 251 aa, Glycine max
  Coding DNA Sequence Number=SeqID_6983
  Gene Ontology: Mol. function=transporter activity; Cellular component= membrane; Biological process=sodium ion transport
  Homolog annotation: Hit_ID=Q2A9T7; Match level="QueryCoverage=71%, HitCoverage=45%, E-value=2e-23, Identity=39%"; Hit description =Sodium-dependent transporter family protein
MPAHMTGSNIKGNVQGSARFNIRVLLPEYKLCYIRQDSRFSQPLKAKPPDLVRGQRIHRSKDKGATEMMAETPFSILIKFKPDGKLLSKALQIKHCTFGATFKHNISQNISSFTPSGGARKIIKPGQKFKDSKFTVTVVSLICSIVTEFITSNAATATLLVPLLYHIAGTMHVHPLILIIPGGIATEFAFWLPTSTPSNVVGFATGHIEIKDMFKVGVPLKVVGIVVLSLLMPSLGELPTNYNLCSSKQML

SEQ ID NO: 123762 - protein, 173 aa, Glycine max
  Coding DNA Sequence Number=SeqID_6984
  Gene Ontology: Mol. function=transferase activity; Cellular component= cytoplasm; Biological process=DNA integration
  Homolog annotation: Hit_ID=Q1T0C4; Match level="QueryCoverage=67%, HitCoverage=24%, E-value=6e-43, Identity=59%"; Hit description =Polynucleotidyl transferase, Ribonuclease H fold
DSHHFFTNVTKSPLPRNPASALQDPNWKMAMDDEYIALIKNKMHKAQLLGDGVGQQIRVDCGETFSPIVKPATIQTVLSLAVSKALPIHQLDVKNAFLHSELKEIMYMHQPLGFKDPDHPNHDMTKSKGKDPLEGLGGAMTRARARKAKEALQKVLSILFEYKPKFQGEKSKV

SEQ ID NO: 123763 - protein, 1007 aa, Glycine max
  Coding DNA Sequence Number=SeqID_6985
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=96%, HitCoverage=97%, E-value=0.0, Identity=67%"; Hit description=Leucine- rich receptor-like protein kinase
  Pfam annotation: Domain name=LRRNT_2; Domain location=30-70; Score =61.2; E_value=3.3e-15; Accession=PF08263.3; Description=Leucine rich repeat N-terminal domain
  Pfam annotation: Domain name=LRR_1; Domain location=101-123; Score =5.9; E_value=22; Accession=PF00560.23; Description=Leucine Rich Repeat
  Pfam annotation: Domain name=LRR_1; Domain location=125-147; Score =16.4; E_value=0.1; Accession=PF00560.23; Description=Leucine Rich Repeat
  Pfam annotation: Domain name=LRR_1; Domain location=149-171; Score =21.2; E_value=0.0037; Accession=PF00560.23; Description=Leucine Rich Repeat
  Pfam annotation: Domain name=LRR_1; Domain location=173-195; Score =15.0; E_value=0.28; Accession=PF00560.23; Description=Leucine Rich Repeat
  Pfam annotation: Domain name=LRR_1; Domain location=197-220; Score =12.8; E_value=1.2; Accession=PF00560.23; Description=Leucine Rich Repeat
  Pfam annotation: Domain name=LRR_1; Domain location=222-244; Score =13.5; E_value=0.75; Accession=PF00560.23; Description=Leucine Rich Repeat
  Pfam annotation: Domain name=LRR_1; Domain location=246-268; Score =9.6; E_value=4.6; Accession=PF00560.23; Description=Leucine Rich Repeat
  Pfam annotation: Domain name=LRR_1; Domain location=270-292; Score =15.2; E_value=0.24; Accession=PF00560.23; Description=Leucine Rich Repeat
  Pfam annotation: Domain name=LRR_1; Domain location=294-316; Score =11.1; E_value=2.4; Accession=PF00560.23; Description=Leucine Rich Repeat
  Pfam annotation: Domain name=LRR_1; Domain location=317-339; Score =10.9; E_value=2.6; Accession=PF00560.23; Description=Leucine Rich Repeat
  Pfam annotation: Domain name=LRR_1; Domain location=341-363; Score =12.8; E_value=1.2; Accession=PF00560.23; Description=Leucine Rich Repeat
  Pfam annotation: Domain name=LRR_1; Domain location=365-384; Score =7.6; E_value=11; Accession=PF00560.23; Description=Leucine Rich Repeat
  Pfam annotation: Domain name=LRR_1; Domain location=389-411; Score =5.7; E_value=24; Accession=PF00560.23; Description=Leucine Rich Repeat
  Pfam annotation: Domain name=LRR_1; Domain location=413-435; Score =11.2; E_value=2.3; Accession=PF00560.23; Description=Leucine Rich Repeat
  Pfam annotation: Domain name=LRR_1; Domain location=437-459; Score =4.3; E_value=45; Accession=PF00560.23; Description=Leucine Rich Repeat
  Pfam annotation: Domain name=LRR_1; Domain location=461-480; Score =8.9; E_value=6.3; Accession=PF00560.23; Description=Leucine Rich Repeat
  Pfam annotation: Domain name=LRR_1; Domain location=485-507; Score =13.0; E_value=1.1; Accession=PF00560.23; Description=Leucine Rich Repeat
  Pfam annotation: Domain name=LRR_1; Domain location=509-531; Score =7.8; E_value=9.8; Accession=PF00560.23; Description=Leucine Rich Repeat
  Pfam annotation: Domain name=LRR_1; Domain location=533-555; Score =10.5; E_value=3.1; Accession=PF00560.23; Description=Leucine Rich Repeat
  Pfam annotation: Domain name=LRR_1; Domain location=557-579; Score =13.9; E_value=0.6; Accession=PF00560.23; Description=Leucine Rich Repeat
  Pfam annotation: Domain name=LRR_1; Domain location=580-603; Score =13.2; E_value=0.98; Accession=PF00560.23; Description=Leucine Rich Repeat
  Pfam annotation: Domain name=LRR_1; Domain location=76-99; Score=7.3; E_value=12; Accession=PF00560.23; Description=Leucine Rich Repeat
  Pfam annotation: Domain name=Pkinase; Domain location=693-950; Score =122.8; E_value=9.4e-34; Accession=PF00069.15; Description=Protein kinase domain
  Pfam annotation: Domain name=Pkinase_Tyr; Domain location=693-974; Score=71.5; E_value=2.7e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=30-70::101-123::125-147::149-171::173-195::197-220::222 -244::246-268::270-292::294-316::317-339::341-363::365-384::389 -411::413-435::437-459::...
  Pfam module annotation: Domain location=461-480::485-507::509 -531::533-555::557-579::580-603::76-99::693-950::693-974
MTNPKPLIVIVYILLSLLATTTTTTLVSCLNQEGLYLYQLKLSFDDPDSRLSSWNSRDATPCNWFGVTCDAVSNTTVTELDLSDTNIGGPFLANILCRLPNLVSVNLFNNSINETLPLEISLCKNLIHLDLSQNLLTGPLPNTLPQLVNLKYLDLTGNNFSGSIPDSFGTFQNLEVLSLVSNLLEGTIPASLGNVSTLKMLNLSYNPFFPGRIPPEIGNLTNLEVLWLTQCNLVGVIPASLGRLGRLQDLDLALNDLYGSIPSSLTELTSLRQIELYNNSLSGELPKGMGNLSNLRLIDASMNHLTGSIPEELCSLPLESLNLYENRFEGELPASIANSPNLYELRLFGNRLTGRLPENLGKNSPLRWLDVSSNQFWGPIPATLCDKVVLEELLVIYNLFSGEIPSSLGTCLSLTRVRLGFNRLSGEVPAGIWGLPHVYLLELVDNSFSGSIARTIAGAANLSLLILSKNNFTGTIPDEVGWLENLVEFSASDNKFTGSLPDSIVNLGQLGILDFHNNKLSGELPKGIRSWKKLNDLNLANNEIGGRIPDEIGGLSVLNFLDLSRNRFSGKVPHGLQNLKLNQLNLSYNRLSGELPPLLAKDMYKSSFLGNPGLCGDLKGLCDGRSEERSVGYVWLLRTIFVVATLVFLVGVVWFYFRYKSFQDAKRAIDKSKWTLMSFHKLGFSEDEILNCLDEDNVIGSGSSGKVYKVVLSSGEFVAVKKIWGGVRKEVESGDVEKGGRVQDNAFDAEVETLGKIRHKNIVKLWCCCTTRDCKLLVYEYMPNGSLGDLLHSSKGGSLDWPTRYKIAVDAAEGLSYLHHDCVPAIVHRDVKSNNILLDGDFGARVADFGVAKAVETTPIGTKSMSVIAGSCGYIAPEYAYTLRVNEKSDIYSFGVVILELVTGKHPVDPEFGEKDLVKWVCTTWDQKGVDHLIDSRLDTCFKEEICKVFNIGLMCTSPLPINRPSMRRVVKMLQEVSTEDQTKPAKKDSKLSPYYYDDASDHGSVV

SEQ ID NO: 123764 - protein, 335 aa, Glycine max
  Coding DNA Sequence Number=SeqID_6986
  Gene Ontology: Mol. function=protein serine/threonine kinase activity; Cellular component=integral to membrane; Biological process=protein amino acid phosphorylation
  Homolog annotation: Hit_ID=Q9FNL4; Match level="QueryCoverage=98%, HitCoverage=99%, E-value=6e-93, Identity=55%"; Hit description =Serine/threonine protein kinase-like protein
  Pfam annotation: Domain name=Pkinase; Domain location=65-326; Score =37.6; E_value=8.4e-11; Accession=PF00069.15; Description=Protein kinase domain
  Pfam annotation: Domain name=Pkinase_Tyr; Domain location=65-326; Score=-37.9; E_value=3.8e-10; Accession=PF07714.7; Description =Protein tyrosine kinase
  Pfam module annotation: Pfam domain module=Pkinase::Pkinase_Tyr; Domain location=65-326::65-326
MNHDTYIAYDVVMVALSISFFVLAVVLYLVCKKKPVNVESEETLALKHCVRAYSLMDIDAATDGFDHSRIVGKGRVGTVYAAVQENGELVAVKRIHSVLVLSNAGFGFSSVLKWLSSAHHPNIVPIIGFSEAPGERIIVMEFGRMVSLDFYLHQNVNGASLLDWNKRIRIVAGAARGIQYLHEVATPNIVHGCVKSSNVLIDVNFCTRICDYGLNFLAPREKRGLVGNVDDEYWNEEGGGASKESDVYGLGVVMLELLSGRGCEEGLIAKWAMPLIKEMSFGELLDARLVIPSDMKPLVRLAKVALACVGNSRKCRPSIAQVTTILNNIEMEVCI

SEQ ID NO: 123765 - protein, 149 aa, Glycine max
  Coding DNA Sequence Number=SeqID_6987
  Homolog annotation: Hit_ID=Q2QP93; Match level="QueryCoverage=74%, HitCoverage=56%, E-value=8e-15, Identity=41%"; Hit description =Expressed protein
  Pfam annotation: Domain name=rRNA_processing; Domain location=1-113; Score=-48.6; E_value=0.0037; Accession=PF08524.2; Description=rRNA processing
LVKQQNQQNDPSLAQRLKENVNETEENKDKSERRKRKNSALSLEELYKKQHEEKEKERMEKEAVLRVKKEDREQAEAQRKAMREKMLKKTRKGQPVMKYRIEHLLETIQGSTKSSCQSWPVIHHDAPLRGGADEHEGESNYQRHEKSHE

SEQ ID NO: 123766 - protein, 58 aa, Glycine max
  Coding DNA Sequence Number=SeqID_6988
MACVELCIDFMGLLMALVIALTLMLICSSPKRRVVVTGDVPSSLPLPLSQIDTLCSYN

SEQ ID NO: 123767 - protein, 71 aa, Glycine max
  Coding DNA Sequence Number=SeqID_6989
MKKNDKVRSDKQKQIMTKKKNISRLGGSGLSLDAFANAKSKNNLYNPAIITCYVPFIIPAEYESLWRNGQL

SEQ ID NO: 123768 - protein, 112 aa, Glycine max
  Coding DNA Sequence Number=SeqID_6990
  Gene Ontology: Cellular component=membrane; Biological process =protein modification process
  Homolog annotation: Hit_ID=Q6Z8K4; Match level="QueryCoverage=71%, HitCoverage=68%, E-value=4e-21, Identity=58%"; Hit description =Membrane-anchored ubiquitin-fold protein 3 precursor
  Pfam annotation: Domain name=ubiquitin; Domain location=13-95; Score =25.2; E_value=0.00023; Accession=PF00240.13; Description=Ubiquitin family
MAEGEGCIELKFRIYDGTDIAHSTYSSSTTVGTLKQKLVAEWPQGKTVTPKSVSDLKLIHAGKVLENNKTLADYRITFGEIPGGVVTMHVVVQPPVTKKKQSLSKQNWLKKA

SEQ ID NO: 123769 - protein, 88 aa, Glycine max
  Coding DNA Sequence Number=SeqID_6991
MEQHSASASASEKREDLGKLQYGLGDIVDYVSAVKNQCDKIYDLTHLVASTASCRFTTGFSRGPIRRSQISAKLPILINGTAQSTTED

SEQ ID NO: 123770 - protein, 353 aa, Glycine max
  Coding DNA Sequence Number=SeqID_6992
  Gene Ontology: Mol. function=metal ion binding; Cellular component =intracellular
  Homolog annotation: Hit_ID=O82256; Match level="QueryCoverage=69%, HitCoverage=64%, E-value=1e-53, Identity=45%"; Hit description=Zinc finger protein CONSTANS-LIKE 13
  Pfam annotation: Domain name=zf-B_box; Domain location=4-51; Score =55.4; E_value=1.8e-13; Accession=PF00643.14; Description=B-box zinc finger
  Pfam annotation: Domain name=zf-B_box; Domain location=52-94; Score =9.1; E_value=0.013; Accession=PF00643.14; Description=B-box zinc finger
  Pfam module annotation: Pfam domain module=zf-B_box::zf-B_box; Domain location=4-51::52-94
MSGAEARPCDYCGNSTALLYCRADSAKLCFSCDREVHSTNQLFSKHTRTLLCDACDDSPATILCSTDTSVLCQNCDWENHNPALSDSLHERRPLEGFTGCPSVSELLSIVGFSDISKKSLLFSPQGSVADGFFGASEIEGLSDMFVWDAPSFVTLDDLISSSPSSHSFQAMKVPPLPKNRKAACGQHKEEILSQLRELAKSEPLDLEPYVQSGNLSLGFERDPEADIFPSHELGLMPDDGLFVFSNHWHRESSEPMHQVVPPDPSMGTYTEEIPVKHSTSAVGENHTYGDNEGKPSISLKSETLSTTPKAAACELTSQERDSALLRYKQKKKTRRYYNYSIFCLLCVCVRGIY

SEQ ID NO: 123771 - protein, 170 aa, Glycine max
  Coding DNA Sequence Number=SeqID_6993
MLLKFWGGGVWEEGWGCGKRLRGCGGRGGGAWALGANHGASGSNALTRACQLGATQSASLQGATRGANCGHVQSRPCHVSPIRGSALRVVSRICPLDLMMKYVQFQLSLAHQWAKRASTTKHSFSATEESGRASISRSRAKHEISALNAIVVFSQAQRTTGTKLKSTYSC

SEQ ID NO: 123772 - protein, 85 aa, Glycine max
  Coding DNA Sequence Number=SeqID_6994
MKKGEALLPSLPRTDPRYEKRHYCRCQRGKGGARRRRRSFRRRRFEAGLKSKHRRRCCWRSQGKRGEREGSKHGERKGEQEKRKV

SEQ ID NO: 123773 - protein, 656 aa, Glycine max
  Coding DNA Sequence Number=SeqID_6995
  Gene Ontology: Mol. function=protein dimerization activity; Cellular component=nucleus; Biological process=regulation of transcription, DNA-dependent
  Homolog annotation: Hit_ID=Q1SGV7; Match level="QueryCoverage=74%, HitCoverage=43%, E-value=0.0, Identity=79%"; Hit description =Transcriptional factor B3; Auxin response factor; Aux/IAA_ARF _dimerisation
  Pfam annotation: Domain name=Auxin_resp; Domain location=252-334; Score=196.6; E_value=5.9e-56; Accession=PF06507.4; Description=Auxin response factor
  Pfam annotation: Domain name=B3; Domain location=125-230; Score =108.1; E_value=2.6e-29; Accession=PF02362.12; Description=B3 DNA binding domain
  Pfam module annotation: Pfam domain module=Auxin_resp::B3; Domain location=252-334::125-230
MKAPSNGYLPNSGEGERKTINSELWHACAGPLVSLPPVGSLVVYFPQGHSEQVAASMQKEADFIPSYPNLPSKLICMLHNVALHADPETDEVYAQMTLQPVNKYEKEAILASDMGLKQNRQPTEFFCKTLTASDTSTHGGFSVPRRAAEKIFPPLDYSMQPPAQELVAKDLHDNTWAFRHIYRGQPKRHLLTTGWSVFVSTKRLFAGDSVLFIRDEKQHLLLGIRRANRQQPALSSSVISSDSMHIGILAAAAHAAANNSPFTIFYNPRASPSEFVVPLAKYNKVTYTQVSLGMRFRMMFETEESGVRRYMGTITGINDLDPVRWKSSQWRNIQVGWDESTAGERPSRVSIWEIEPVVTPFYICPPPFFRPKFPRQPGMPDDESDMENAFKRAVPWLGDDFGMKDASSSIFPGFSLVQWMSMQQNNQLTAAQSGCFPSMLPFNTLQGNLSTDDPSKLLSFQAPVLSTPSLQLNKPNLPNQINQLQQSPVSWPQQQQLQQQQQLQQQQQQQQQQQQQLQQQQQQQLQSLLQVPMNHLQQQREQQLPEPQNLPLWQQLPQQLGQQPQKQQSSQHATIMNNGVVASNQITNQFSQQPMAYGQLQQQQLLSGGIQSATKNTLPLTSLPQDSQFQQQIDQQASLLQRQQQQQQTQLQQSPL

SEQ ID NO: 123774 - protein, 37 aa, Glycine max
  Coding DNA Sequence Number=SeqID_6996
MWSFAPFPEMSASSGRDYFSLTPLSQELRRRIISNWA

SEQ ID NO: 123775 - protein, 128 aa, Glycine max
  Coding DNA Sequence Number=SeqID_6997
  Homolog annotation: Hit_ID=Q1SZM6; Match level="QueryCoverage=41%, HitCoverage=17%, E-value=1e-07, Identity=50%"; Hit description =Ribonuclease H
MGALSVILVRQALLECFEIDSIGQWIIGFSGYCGFTTNLHAELLAILHGLQIAWSRDFILITLSSTKFVSSITLIGRLSSSTLIEKAIKLQIALRKMELQSINICSFGLLALINVVCLSGVMGIVEFR

SEQ ID NO: 123776 - protein, 662 aa, Glycine max
  Coding DNA Sequence Number=SeqID_6998
  Gene Ontology: Mol. function=nucleic acid binding; Cellular component= chromatin; Biological process=DNA integration
  Homolog annotation: Hit_ID=Q1T2W1; Match level="QueryCoverage=96%, HitCoverage=91%, E-value=0.0, Identity=53%"; Hit description =Integrase, catalytic region; Asp/Glu racemase
MESIKQTSTCACRHMWTYQSNIKQQQKLTVAYTPQQNRVAERKNITVMNMVRSMLVGKQVPKIFWVEVARWCVHILNRSPTTNVQNKTLEEAWSGVKPTVDYFQEYQLFDPINKRVLISKDVVFEEQKGWNWKQNTEEHQQDTLEWGDNEEYVSDSKEQSEENVVESIGAQETEDQNEDVENDSTDYERGEGLSDDNGLNVMMVTKDDPISFKEAIKSEKWRNAIMKEMESIEKNITWELTDLPRGVKPIEVKWIFKTKFKETGEIDKFKARLVAKGYVQQYGVDYTEVFAPVARLDTILLILAIATQYSWNVFQLDVKSVFLHGELKEEIYVQQPNGFVKKGEEKKVYMLKKALYGLKQAPRDWYNKIEAYFVRNGFDRCLCEHTLFTKSKEGGKMRYFLGIKVMQNSSGIFICQRKYAQEVLSWFDMENCNAVKNPIVLGTRLSKNDAGTKVDATLFKQVVGCLMYLTTTRPNLMYGVCLISRFMSNPTEPHWFAAKRILRYLKGTTELGIYYKKGGNAKIVAYFDSDFDGDIDDKRSTSGFVFLFGSGAVLWSSKKQPVVTLSTTEAEYIVAASYACQCIWIQRVLEKLSLEEQKNTLILCDNNSTIQLSKNPVFHGRGKHIDIKFHFLRDLVKERTIKLEQFSKLRRMLGMLEASEIN

SEQ ID NO: 123777 - protein, 346 aa, Glycine max
  Coding DNA Sequence Number=SeqID_6999
  Gene Ontology: Mol. function=protein binding; Cellular component =membrane; Biological process=defense response
  Homolog annotation: Hit_ID=Q1SW19; Match level="QueryCoverage=89%, HitCoverage=33%, E-value=8e-78, Identity=49%"; Hit description =Disease resistance protein
  Pfam annotation: Domain name=NB-ARC; Domain location=145-343; Score= -6.8; E_value=7.5e-10; Accession=PF00931.13; Description=NB-ARC domain
MAPQTSIVLGTNKLLPLLSDETKLVWDIPKEFADIKKELEYIQAFLKDADSRAAEGGNANEGIKTWVKELREASFRIEDAIDEYMIHVEQEHHDPGCAALLCQIIHLIETLMPRHRIASGIQQIKSVIDRIKQRGKEYNFLRQSVQWIDPGSASPHLDEDQIVGFEDPRDELIGWLVKGPVERIVISVVGMGGQGKTTLVGRVFNNQEVIAHFGGCRAWITVSQSYTVEGLLRDVLEKMCKEIREDPPLGISKMDLNSLIVEVKNYLQKKRYVVIFDDVWSVELWGQIENAMLDNNNGSRILITTRSKDVVDSFFLLNFPLPALSLVDIVSKQPIKEVYSRKKRGN

SEQ ID NO: 123778 - protein, 508 aa, Glycine max
  Coding DNA Sequence Number=SeqID_7000
  Gene Ontology: Mol. function=cystathionine beta-lyase activity; Cellular component=chloroplast; Biological process=methionine biosynthetic process
  Homolog annotation: Hit_ID=P53780; Match level="QueryCoverage=93%, HitCoverage=93%, E-value=1e-151, Identity=62%"; Hit description =Cystathionine beta-lyase, chloroplast precursor
  Pfam annotation: Domain name=Beta_elim_lyase; Domain location=132 -357; Score=-112.4; E_value=0.0039; Accession=PF01212.11; Description= Beta-eliminating lyase
  Pfam annotation: Domain name=Cys_Met_Meta_PP; Domain location=91-504; Score=508.4; E_value=8.3e-150; Accession=PF01053.10; Description =CysMet metabolism PLP-dependent enzyme
  Pfam module annotation: Pfam domain module=Beta_elim_lyase::Cys_Met _Meta_PP; Domain location=132-357::91-504
  Subcellular localization annotation: CTP_CleavageSite=25; ConfidenceScore=5.02e-01
MFSSAISQKPFLQSLVIDRYAQSTTAATRWECLGFNKSENFSTKRVLRAEGFKLNCLVENREMEVESSSSSLVDDAAMSLSEEDLGEPSISTMVMNFESKFDPFGAISTPLYQTATFKQPSAIENGPYDYTRSGNPTRDALERFDHDVIAKLDKADRALCFTSGMAALSAVVRLVGTEYDSSLLLTPDNVHIGEEIVTGDDVYGGSDRLLSQVVPRTGIVVKRVNTCDLDEVAAAIGLRTKLVWLESPTNPRLQISDIRKISEMAHSHGALVLVDNSIMSPVLSQPLELGADIVMHSATKFIAGHSDIMAGVLAVKGDISVTVTPIDKKENKTSVKCIGHVQIRPLKALVRRVVRMAFIPEKRRGRPKRTSEELIKRDLMDNAQKIAEFLASHPRVKEVNYAGLPGHPGRDLHYSQAKGAGSVLSFLTGSLALSKHIVETTKYFSITVSFGSVKSLISMPCFMSHASIPAAVREARGLTEDLVRISVGIEDVNDLIADLGNALRTGPL

SEQ ID NO: 123779 - protein, 98 aa, Glycine max
  Coding DNA Sequence Number=SeqID_7001
  Gene Ontology: Mol. function=DNA binding
  Homolog annotation: Hit_ID=Q9LTA2; Match level="QueryCoverage=100%, HitCoverage=35%, E-value=2e-16, Identity=49%"; Hit description =Similarity to AT-hook DNA-binding protein
PMIRQVVERRDNHEHRVRGEEPLEDESANNLSLRSEKGHDEGIRDHRQRTMVEEGCRFGEDIEAAMESDGGDSGTDGCERRLMKSDVGDGSETGYNTQ

SEQ ID NO: 123780 - protein, 125 aa, Glycine max
  Coding DNA Sequence Number=SeqID_7002
MQKIPKRRGKKGLFIEFLDPRSPRLASGSPGPPKDFKVKLPACLGEPVTSRVSLSSPGTADIAPSSHFPINRHAREVEGGLKVQYLRELRELREKKKKEEKTRPRHCRIATMINLYIVPRSVFFA

SEQ ID NO: 123781 - protein, 372 aa, Glycine max
  Coding DNA Sequence Number=SeqID_7003
  Gene Ontology: Mol. function=RNA-directed DNA polymerase activity; Cellular component=chromatin; Biological process=RNA-dependent DNA replication
VMDLSNVEQGKKITNLSSRKDDEGIALPHELPKVSNEQRLEESTGAIWGTSTPLGLSKLIELDKEEVNIEEEAKSDEEGSPHISLHAIEGMEGTTTMRIQGQVGRKMLQILIDNGSTHDFLDYALAKRLGWKANGDELSAVEVAGGKRSKDEDFTSDLRVMELHTYDMVLGLKWLKSIKNAFWDYDALVVEGHNHPIVLQRGADPINLKSYKYPAAQKDVIEGLVGDLLRIGMIQESSSPFEAPIVLIKKKDGTWRLCINYRELSKRPVKIQYPIPVVEDLFDELSSAGWFTKLDLRADYHQIRMVPEDVYKTAFKTHSGHYEWLVMPFGLTNAPATFQGAMNSVFRTHLRRFVPMLLMADGGSWRKAKNPS

SEQ ID NO: 123782 - protein, 54 aa, Glycine max
  Coding DNA Sequence Number=SeqID_7004
MVKHGAAKVVGVEGYGYVNGGGGREAAILAVAEGGGLPEERELQGRTTDNNNLT

SEQ ID NO: 123783 - protein, 126 aa, Glycine max
  Coding DNA Sequence Number=SeqID_7005
MYSTVVHLLPLTKVHDHHSNSPHGDQPECQGSSKLSDMPPSSSIPPHEKLQRNYERKDSELVLHQILEVDSEDSASIKTFISMWWFDGKQRRLVEVTGDCGWWRRSFYGGLDGVLRGKGMKSCFSS

SEQ ID NO: 123784 - protein, 101 aa, Glycine max
  Coding DNA Sequence Number=SeqID_7006
MDGERLREMEEMGCGHYVGHGYVSNWGMQCNSMRRRHHTGEAPLSTTAVSSYRKYLKGTESEMKRTRRVGKDKSYETEKKGSMRRMHWLVKNKSAKMTHNC

SEQ ID NO: 123785 - protein, 118 aa, Glycine max
  Coding DNA Sequence Number=SeqID_7007
MEVEGSARFSESSKKEDDLFLQSTRKVKRMSHGEEMLDMEVDDEGPWMVANHRIMVQRWWSFFLANTKVGCRLAIWPHNTKCVEKITRQTQERRGVNEVDVQNNTSPTMAALSENVPG

SEQ ID NO: 123786 - protein, 185 aa, Glycine max
  Coding DNA Sequence Number=SeqID_7008
  Gene Ontology: Mol. function=nucleic acid binding; Cellular component= intracellular
  Homolog annotation: Hit_ID=Q39265; Match level="QueryCoverage=58%, HitCoverage=54%, E-value=5e-11, Identity=35%"; Hit description=Zinc finger protein 6
  Pfam annotation: Domain name=zf-C2H2; Domain location=66-88; Score =20.4; E_value=0.0063; Accession=PF00096.16; Description=Zinc finger, C2H2 type
MSALANPIIDETTEGKASSSSSPSPKATLKLFGFLLTQAGNINNNEDIHMPASSTNIPYSSTYKRFTCDFCYRKFSNSQALGGHQNAHKRERKMVALSPFGYYHHHHHPWSKAPSPIVVPHGGLSGPLIRPRGGPHHEVGFVRPMGASMGIETNIVDGDVDLNLSLAHTPSNFRDNKKIAKWRRT

SEQ ID NO: 123787 - protein, 59 aa, Glycine max
  Coding DNA Sequence Number=SeqID_7009
MFNRALSGKWVWLFSMGKECLWMKVVEKYGPLVLEGSFRERMGEELHMPLQGHPVYTQK

SEQ ID NO: 123788 - protein, 194 aa, Glycine max
  Coding DNA Sequence Number=SeqID_7010
  Gene Ontology: Mol. function=nucleic acid binding; Biological process= DNA integration
  Homolog annotation: Hit_ID=Q1SRN1; Match level="QueryCoverage=49%, HitCoverage=6%, E-value=2e-27, Identity=63%"; Hit description =Integrase, catalytic region
  Subcellular localization annotation: CTP_CleavageSite=78; ConfidenceScore=5.52e-01
MRFHTFGTNSTNEASSSSISPEPTTSSPLPTSIDNLTSPKPKESSNPVISAPASLFLCHPLQNLFLCRSDLISLTQCVQEESWCPIGGKWVFRVKENLDGTINKYKVRVVAKGFHQRLGSDYNETFSLVIKPVTVRILLTLVVTNRWKLQQLGVNNVFLNGILEEEVYMNQLPRFEDSNKHTLFTILWFICWSM

SEQ ID NO: 123789 - protein, 46 aa, Glycine max
  Coding DNA Sequence Number=SeqID_7011
MEEKGIMARDGRFFLFEKLRLWGDHALSAVTSGLSKVMMRLVWDSR

SEQ ID NO: 123790 - protein, 198 aa, Glycine max
  Coding DNA Sequence Number=SeqID_7012
  Gene Ontology: Mol. function=transposase activity; Cellular component= membrane; Biological process=transposition, DNA-mediated
  Homolog annotation: Hit_ID=Q1WIR8; Match level="QueryCoverage=88%, HitCoverage=57%, E-value=8e-23, Identity=48%"; Hit description=PIF -like transposase
MLEQLASVRNTQERLQHFGETIFRQFHRVLKVVLALSKDIIKPIDPTFKDILDQIIKDDRYHPFKNCTNAIDGTHVQIIVPIEHQIPYTCRKGYTSTNVMVVCDFNILGPRARGRNEVFNYIHSSLQSTIEQSFGCCKVKWRILGSMPQFSLKATTIACMTLHNFIRRNDTSDEEFCLFNENVDLKDNVDLHDTAMQL

SEQ ID NO: 123791 - protein, 181 aa, Glycine max
  Coding DNA Sequence Number=SeqID_7013
  Gene Ontology: Mol. function=DNA binding
  Homolog annotation: Hit_ID=Q1S0F5; Match level="QueryCoverage=92%, HitCoverage=34%, E-value=9e-12, Identity=30%"; Hit description=IMP dehydrogenase/GMP reductase
MDQLQRKAFRKTYGKIWDLAMMIEVSVEAIVSLTQYYDQSLRCFTFGDFQLVPIVEEFEEILGCPLGGRKPYLFSGFYPSMARIAKVVKILGQELDRVKQNRNGVVGIPRKHLEEKAKALADQGEWALFIDVLALLVFGVVLFPNVDGLVDLAVTNAFLAYRHSKERPVVGVLADAYDTFD

SEQ ID NO: 123792 - protein, 330 aa, Glycine max
  Coding DNA Sequence Number=SeqID_7014
  Gene Ontology: Mol. function=DNA binding; Cellular component=nucleus; Biological process=regulation of transcription, DNA-dependent
  Homolog annotation: Hit_ID=Q9FJ07; Match level="QueryCoverage=93%, HitCoverage=97%, E-value=2e-64, Identity=43%"; Hit description =Similarity to myb-related transcription factor
  Pfam annotation: Domain name=Myb_DNA-binding; Domain location=14-61; Score=45.8; E_value=1.5e-10; Accession=PF00249.21; Description=Myb -like DNA-binding domain
  Pfam annotation: Domain name=Myb_DNA-binding; Domain location=67-112; Score=51.6; E_value=2.6e-12; Accession=PF00249.21; Description=Myb -like DNA-binding domain
  Pfam module annotation: Pfam domain module=Myb_DNA-binding::Myb_DNA -binding; Domain location=14-61::67-112
MGRSPCCEKVGLKKGRWTAEEDKILTDYIQENGEGSWKTLPKNAGLLRCGKSCRLRWINYLRADVKRGNITPEEEEIIVKLHAVLGNRWSVIAGRLPGRTDNEIKNYWNSHLRRKIYCFMRSLNESLPPTDMAAVNSATSKRRVRGSRNKPATEEEKNMALSQNSFESMPSCNREEGEEISMMDACYEMESITISSTFASCPSLEASLGPYHHWSDDEIMKLSNMFENGVLVNPSGNNVTLKDEPNGIECGQMNVDIMGTDQSKNNASNGDSGEWYPNCSSVNSAIDYQWSDWDMGGSVQSNNQWNLCDDQVMNCLWSTGIGEINYGFHP

SEQ ID NO: 123793 - protein, 935 aa, Glycine max
  Coding DNA Sequence Number=SeqID_7015
  Homolog annotation: Hit_ID=Q10MM5; Match level="QueryCoverage=99%, HitCoverage=93%, E-value=1e-98, Identity=32%"; Hit description =Expressed protein
SLKQGRKVDYNVAMTQPSYLVDDDEIGVGASVRGSCDHSYASSVTDDEAYGTRAPSVVARLMGLDSLPTSSFSDPYSTPYFDTRSLQDSHDFKKNLRHQHDHHTPYSGKLLEKVESSSRNFMEPKPQKAITRPIEKFQTEVLPPKSAKSIPVTHHKLLSPIKNPGFVPTNNAAYIMEAAARIIEPGSQVSTKFKTPLIASSTPLRVRDLKDKVEASQKEPLIGPSSMTSRTRDLKEKREITHRTTRTSESSQRSVESNAAKYLKGQSLNRSWNGSADTSVSVKSPTNEEEDSSLKNKGKSISLAIQAKVNVQRREGLSLTGGRSLTGQKEHPDVKSNQPMKASVQKNLHKKSSGALRQNNLKQNYSIDKDKLPSKPLVTNSNSRKVLTGDSSYGRHRSSSNKSNAKPKVGSRKSAMEVTDSEKEVLYTSTNSFPRKKRSTDKDWNDRVVDNLFIEKMQKPAKSNLVSNKQNSWTEEVKKKDMDVVSFTFTTPLTRSNPGFETSGQAGQNTNGLSLDQRIKRVLLDPDNTKSPIGYNIIGGGDALGILLEQKLRELTNMETTCHDSSKVRQPAITAPISDDQVTSHNVVNLNPRLQQKKDQGVLFSDKLSSNYDSNIFFTGPPELSLKHNSWYLSVKHAKWKVRLVYFVLKIILIKENKRNRFIVCFPRKPIFKIDEMESQLLNCRHPSPISVLEPSFSMESCESSLSTDITSTEGSKLSSSVQAHEVHGLNFSRKFYPCESDTELSDSASSTSAGNPMRKRTSTCSVTRFGRSSTWELDYVKDIVCNVELMYIDFSLGQASEVINPHLFKQLEGCKGGFKRGDESRMARKVTFDCVSECLDLRCRRYVGGGYKMWIKGFEMVKRKEWLAEDVYKEISDWSGMGDSMVDELVDKDMSSQYRRWLEYEVDASELGSEVVDQIFNSLVDDVVTEMLQL

SEQ ID NO: 123794 - protein, 348 aa, Glycine max
  Coding DNA Sequence Number=SeqID_7016
  Homolog annotation: Hit_ID=Q20CD0; Match level="QueryCoverage=99%, HitCoverage=99%, E-value=3e-91, Identity=54%"; Hit description =Fgenesh protein 81
  Pfam annotation: Domain name=OTU; Domain location=202-342; Score =123.6; E_value=5.7e-34; Accession=PF02338.9; Description=OTU-like cysteine protease
MEDTQEIEEQAHKEVISDKTSEKQQETLDEILSRHRLAPSTFGFSTTYVNCHFPLATAMKKEILQLQKKEVEMKKAAARGSKAEQKAKKKQVEEEVCQLSAKLKENHAKELTALGYISGNGNEKSNLDSLVKAIAGVSVTSQPEHTKVSKAKQRRDKRAQQEAEREQRIQAEQSDIISDRVIENEKLEKKLKPLGLTVCEIKPDGHCLYRAIEDQLAILSGGRSPYTYQELREMVAAYMRNHTSDFLPFFLSENLIEDDSNESFAQKFENYCKEVESTATWGGQLELGALTHCLKKHIMIFSGSFPDVEMGKEYKSDGGTGLSNSSIMLSYHKHAFGLGEHYNSVVPT

SEQ ID NO: 123795 - protein, 102 aa, Glycine max
  Coding DNA Sequence Number=SeqID_7017
  Gene Ontology: Mol. function=protein disulfide oxidoreductase activity; Cellular component=chloroplast; Biological process=cell redox homeostasis
  Homolog annotation: Hit_ID=Q9LYC8; Match level="QueryCoverage=99%, HitCoverage=100%, E-value=9e-33, Identity=60%"; Hit description =Glutaredoxin-like protein
  Pfam annotation: Domain name=Glutaredoxin; Domain location=13-75; Score=62.9; E_value=1e-15; Accession=PF00462.14; Description =Glutaredoxin
MDVITSMVAEKPVVIFSKSTCCLSHSMTSLIRSFGANPTVHELDEMANGQQIESALLQMGCQPSVPTVFIGQRFIGGSKKIMSLHVRNELVPLLKNAGAIWI

SEQ ID NO: 123796 - protein, 137 aa, Glycine max
  Coding DNA Sequence Number=SeqID_7018
MGLRDSKVSVSERTPLASQRVVINVGNPSLEELDCAIWVIWDDIMLSSGLQADKAWLLWPGGLGRCGGTEKEDYALFRRVVLRVVDVRIELLNQGHVNVVVWQPELIILCGNQLDIPLRKDVSKMNVLNVSYPGNLR

SEQ ID NO: 123797 - protein, 105 aa, Glycine max
  Coding DNA Sequence Number=SeqID_7019
  Gene Ontology: Mol. function=protein disulfide oxidoreductase activity; Cellular component=chloroplast; Biological process=cell redox homeostasis
  Homolog annotation: Hit_ID=Q9LYC8; Match level="QueryCoverage=96%, HitCoverage=100%, E-value=7e-30, Identity=58%"; Hit description =Glutaredoxin-like protein
  Pfam annotation: Domain name=Glutaredoxin; Domain location=13-75; Score=72.9; E_value=1e-18; Accession=PF00462.14; Description =Glutaredoxin
MDVLTTLTADKPVVIFSKSTCCMSHTVKALICSFGASPTIIEVDKMPSGQQVERALIQLGCKPSVPAVFIGQQFIGGADEVIKLNVQNKLAQLLLGAKAIFIWSR

SEQ ID NO: 123798 - protein, 79 aa, Glycine max
  Coding DNA Sequence Number=SeqID_7020
MYSEIETGSATSPSLTPEGPVAVSAPAVPGPSYLLKEVLRCHNRLVEHNSDLLEALHNQKLVMVDALQHGSRRLLRSGS

SEQ ID NO: 123799 - protein, 603 aa, Glycine max
  Coding DNA Sequence Number=SeqID_7021
  Gene Ontology: Mol. function=signal transducer activity; Cellular component=membrane; Biological process=response to light stimulus
  Pfam annotation: Domain name=BTB; Domain location=8-105; Score=10.1; E_value=0.0005; Accession=PF00651.21; Description=BTBPOZ domain
  Pfam annotation: Domain name=NPH3; Domain location=185-455; Score =447.9; E_value=1.3e-131; Accession=PF03000.5; Description=NPH3 family
  Pfam module annotation: Pfam domain module=BTB::NPH3; Domain location= 8-105::185-455
MSEEMMPISDVSSDLTIEVGASTFALHKFPLVSRSGRIRKLLLDAKDSKVLRISLPNVPGGPEGFELASKFCYGINVEFTLSNVALLRCTAHFLEMTEEFAEKNLEARAEAYLRDTVLPNISSTVYVLHCCEALRPISEEINLVNKLINAIANNACKEQLTTGLLKLDHTFPSKTTPTMEPETSSDWWGKSFNVLSLEFFQRVVSVVKSKGLKQDMISKILINYAHGSLQGIRVRDPQVVKGSLHDLELQKKQRVVVETIVSLLPTHSRKSPVPMGFLSSLLKAAIAASASTPCKSDLERRISLQLDQAILEDILIPTNSPQNSHNTMYDTDLILRIFSIYLNTDEEDGEDSDNYIDESQMAYDFDSPGSPKQSSIIKVSKLLDSYLAEVALDSNLLPSKFTALAELLPDHARIVSDGLYRAVDIFLKVHPNMKDSERYRLCKTIDCQKLSQEASSHAAQNERLPVQTVVQVLYLEQMRLRNAMNGGHNQVFFGQFPHRSGSGAGSGAISPRDNYASVRRENRELKLEVARMRMRLTDLEKDHVSMKQELVKSHPANKLFKSFTRKLSKLNSLFRINSIKPIGGKASSETRFPFPKRRRHSVS

SEQ ID NO: 123800 - protein, 136 aa, Glycine max
  Coding DNA Sequence Number=SeqID_7022
MEEFLKKVKKYINYENVLEAGKVLQKLYLKEVFKVKFKQAGLDNPKPIRVHANTNLEKYCQYHKAIGQETEECIHLAKAIEDLIQQGQLERFVKYGGVYSRRQGRQYRKNSVEKIPKPSQVEETLTFSEKVFTIFA

SEQ ID NO: 123801 - protein, 188 aa, Glycine max
  Coding DNA Sequence Number=SeqID_7023
  Homolog annotation: Hit_ID=Q1SP02; Match level="QueryCoverage=56%, HitCoverage=22%, E-value=3e-14, Identity=41%"; Hit description=IMP dehydrogenase/GMP reductase
MWHRCNICPLQACSIALSLFLKYWIYECFPSVGSAIVVEDYDEKKPRACHSKSGKVLSVSTYHKHLDRLRFDFVCWIPYGEHHAFREFEVISLFSGHIRWGPSIFIHRPERVIRKFGYVQTIPSHPVAPSIYVTQHPVAATAMDEAPEDAHVDVEQPRHAMCLRIARGVTAQWNVYVRSRRMRHMKDT

SEQ ID NO: 123802 - protein, 632 aa, Glycine max
  Coding DNA Sequence Number=SeqID_7024
  Homolog annotation: Hit_ID=Q10FY4; Match level="QueryCoverage=59%, HitCoverage=84%, E-value=2e-40, Identity=29%"; Hit description =Expressed protein
  Pfam annotation: Domain name=DUF580; Domain location=259-575; Score =283.6; E_value=3.9e-82; Accession=PF04515.3; Description=Protein of unknown function, DUF580
  Subcellular localization annotation: CTP_CleavageSite=36; ConfidenceScore=5.36e-01
MAAMDNGMMTTVAVTSGANGGGGGAAKNERKQRKKRGTSGVAPRAVVACWRFSTGGPNVNDILSKKRRRRQQGMVVVEKEKENETVAEAKKEEKDLEKGGGVGVEERKFHSNNNNNDVNDHEESHISSFHRLNPTNPLRIVINSSTRVATPPPPAQSQRSHTHTRSIPTPQQQQPEPQPQPVTLNSRKYTNRISLFLFVLHMFLAVTLVFFLVFKGVQGLIQESESNKRKEKNVLKYFLPQVEAASFMSIILAFIWQGAIRKWPTFMLHFILWFTFVVSLAAGILLICFQKPATDGVGVCFIAFAIGNGLYACWVLSLSLQPVSKFPDLSKPTYYVLGAGFLWISLWILAVIGALNFYFPPLVIIALVLSLAWTTEVMRNVVNITVSRVIALYYLRGMQSSTQFCFLRALTRNLGSACLGSLFVPAIEALRIVARGLNLLEGEDEFMFCCAHCCLRVMESIFRNGNGWAYVQIAAYGKGFVKASQDTWALFEKEDMVSIVDADITSSICFLTGVCSGSLCVIVVAAWTYKTRIAMAVPHACVSCYYVCYAETPENRLFDKTIKDRQALLKTGRDVVPTPRGIRRTWFMSKRVKIEIHGGWLRWWFVENDLARLSHYWNGRNVKDNQHGHYRK

SEQ ID NO: 123803 - protein, 156 aa, Glycine max
  Coding DNA Sequence Number=SeqID_7025
MVKTCNQRASSVAIRPPSIVANAILAGAHDGEEASVTPTEKPQSLKDNNDSSTDSSLYPWKRPPQVGEPTEDEAIPFNLSFPDNVLRIRVSKQLQQLPTMEFYNGFTNPDDHLLGFEFALSYRGANNLKMCRAFRLSLKLAALKWLQSLLRGSISS

SEQ ID NO: 123804 - protein, 154 aa, Glycine max
  Coding DNA Sequence Number=SeqID_7026
MVGIVGGIREVVLTIGGALFMVVHRQVVVVMVVGLAINDKDKAGVNEEHVDCFDAFNTSQVFATRDDVLHWARFVAYETGFVVVIMRSYTNNGIRGRTSFVLIGCERSGQYRAKKKDLSMVKPRNILLMLKEHNANSYAIIKQIYNARNAYRLP

SEQ ID NO: 123805 - protein, 129 aa, Glycine max
  Coding DNA Sequence Number=SeqID_7027
DEDDLNLVVEMGVGMVMKGKGLVEGSINAGVKLIHFGGHGVLSNNEVELIGETQKGKGPSVPALGTLLSIRRKKRDKIPDVSWCNDLSLGSLIRACGGILQHLLLLISSDSNDNLMNCSKLAHGGGTIV

SEQ ID NO: 123806 - protein, 126 aa, Glycine max
  Coding DNA Sequence Number=SeqID_7028
MGSDCRVVPDYMDWFFWISHSFITSIEETAEPRHPPPPHDEEFVEAPIPEVSVASDLPTHSVVDCQGCQGMAEDLGTIAEDLERVINLRMITKGTDLYDIMTRCLRRARGDAADGSLRLRQRCRID

SEQ ID NO: 123807 - protein, 59 aa, Glycine max
  Coding DNA Sequence Number=SeqID_7029
MSLLVIMFVLVICMVLLTAGVGAVVGLVAAGEVEVGTEGQLIEKHVSPPLIDVVPPAVD

SEQ ID NO: 123808 - protein, 119 aa, Glycine max
  Coding DNA Sequence Number=SeqID_7030
MAFFQVSVRRWILTFAILYVCVFGKNFGNADEDESEAQTGGGGYGGVGGGFGGAGAGVVGGGGGFGAGGGGFGAGGGGVGSGDPAQIVSKALLCFNDKNVSAQTDFYVYCFSRRFQVFK

SEQ ID NO: 123809 - protein, 182 aa, Glycine max
  Coding DNA Sequence Number=SeqID_7031
MLKFIAVQLVDDEDVEAMIYVICQNSQAFDATKDQPHPYLSTPIVKPTSSTQPNEPEFTPEPGLPNEELDPFSEDRDKVLHNQPKSKMMRKKLTWIVKKSNIKWGLSLKGYVFCQNKKHNMLCKNIMESYTLPIKASNLIENDPSTSVLALIAYIKSIEGYTTMYRKVWLEKQKAIENIYDN

SEQ ID NO: 123810 - protein, 79 aa, Glycine max
  Coding DNA Sequence Number=SeqID_7032
MPFLSLDNSLELNISHTTIHIQIFSKKNKLETQNVRKREKERRTCDKGERARVLKGGEEGELRGIRGGGGGEEREFKWE

SEQ ID NO: 123811 - protein, 236 aa, Glycine max
  Coding DNA Sequence Number=SeqID_7033
MKSFEAKGKETEELHKRFKKLEQEWQGFKDSKPTTRTTRASHKHSLHSSNETIHKPRQYSPRELMFNLQQEESPSPEEEASRTNDRAVQEILQERRQAIERGKLKGRRLFQSEEEDENSSHEVRSMSFNEDGEFSESERAHDYCTHELSDSSSSSSLSCLVGGDNHDQDNETVARLVAMIMAEVGVASNGRRGNGGTRYAVFLGGVVAIILLGIAMFMRLGKSFGGDDCDMHFVPT

SEQ ID NO: 123812 - protein, 66 aa, Glycine max
  Coding DNA Sequence Number=SeqID_7034
MSTINLLHTGPACTLVMIISSRLDILPTRVFSFVLLLDTVCFLSPLTIRKTLISDSQNPSLNRNYQ

SEQ ID NO: 123813 - protein, 85 aa, Glycine max
  Coding DNA Sequence Number=SeqID_7035
MARNQLCPSILLLYCFSDMPGKILIGGDGCSGDSSSNSIDNDNDCNDDDGDNNNNDNSRSDNNNKDDNNNNVGDNDNKNYAVEIM

SEQ ID NO: 123814 - protein, 452 aa, Glycine max
  Coding DNA Sequence Number=SeqID_7036
  Gene Ontology: Mol. function=nucleoside-triphosphatase activity; Cellular component=membrane; Biological process=peroxisome organization and biogenesis
  Homolog annotation: Hit_ID=Q93X55; Match level="QueryCoverage=96%, HitCoverage=46%, E-value=0.0, Identity=77%"; Hit description=Peroxin 6
  Pfam annotation: Domain name=AAA; Domain location=205-394; Score =280.8; E_value=2.7e-81; Accession=PF00004.19; Description=ATPase family associated with various cellular activities (AAA)
  Pfam annotation: Domain name=AAA_2; Domain location=201-334; Score= -44.0; E_value=0.02; Accession=PF07724.4; Description=ATPase family associated with various
  Pfam annotation: Domain name=AAA_5; Domain location=205-339; Score= -11.5; E_value=0.013; Accession=PF07728.4; Description=ATPase family associated with various
  Pfam module annotation: Pfam domain module=AAA::AAA_2::AAA_5; Domain location=205-394::201-334::205-339
MSVKVEKNAEKTSGHQVLLIAAADSSEGLPSTIRRCFSHEISMGALTEEQRAEMLFQSLQSVSGLLSNTNSEALVKEIVGQTSGYMPRDICALIADAGANLFPRNNAKVDKDVHDDVGSSLSSKMAEDNNHGKVSPQITGKEDLLNALERSKKRNASALGTPKVPNVKWEDVGGLEDVKKSILDTVQLPLLHKDLFSSGLRKRSGVLLYGPPGTGKTLLAKAVATECSLNFLSVKGPELINMYIGESEKNVRDIFQKARSARPCVIFFDELDSLAPARGASGDSGGVMDRVVSQMLAEIDGLSDSTQDLFIIGASNRPDLIDPALLRPGRFDKLLYVGVNSDASYRERVLKALTRKFKLHEDVSLYSIAKKCPPNFTGADMYALCADAWFHAAKRKVLRANPESSSQDNEADSVVVEYNDFIQVLEELSPSLSMAELNKYEQLRDQFEGTSK

SEQ ID NO: 123815 - protein, 452 aa, Glycine max
  Coding DNA Sequence Number=SeqID_7037
  Gene Ontology: Mol. function=translation release factor activity, codon specific; Cellular component=cytoplasm; Biological process =translational termination
  Homolog annotation: Hit_ID=Q2R068; Match level="QueryCoverage=78%, HitCoverage=89%, E-value=1e-132, Identity=64%"; Hit description =Peptide chain release factor 1, putative, expressed
  Pfam annotation: Domain name=PCRF; Domain location=178-305; Score =182.0; E_value=1.5e-51; Accession=PF03462.9; Description=PCRF domain
  Pfam annotation: Domain name=RF-1; Domain location=334-436; Score =103.0; E_value=9e-28; Accession=PF00472.11; Description=Peptidyl -tRNA hydrolase domain
  Pfam module annotation: Pfam domain module=PCRF::RF-1; Domain location=178-305::334-436
MEKSVCFGESNEQPRLAGIKKLSVIDKEPNPTEAAPHLIGTPTTMYVPSASLSGYSVAMNSLTASFTARICATRRDLLHIRHRSFHPLTTRRVATKLTPPRIVCMAEPYLITKLESAEKTWQELSVKLADPDVVSDPKEYQKLAQSVAELDEVVSTYRRFKDCEKVLEETKGLLNSTILAKDDGNDEDMVEMISFEIDSLSKQLAELEEKLKVLLLPSDPMDAKNILLEVRAGTGGDEAGIWAGDLVAYSDAVLMLNQVRMYERYSERNSWKYSLVSSSAAEKGGYKTYVMEIKGNRVYSKLKYESGVHRVQRVPLTETQGRVHTSTATVAIMPEADEVEVIIDPKDIELTTARSGGAGGQNVNKVETAIDLFHKPTGIRIFCTEERTQLKNKNRAFQLLRAKLVTDHRLKINYELTSFLDGDIEDAVQSCVTMEQKELLEELAESVGAPAG

SEQ ID NO: 123816 - protein, 81 aa, Glycine max
  Coding DNA Sequence Number=SeqID_7038
VDSRGSHPNKSGEWRIALGNHYAWLQTHGWRMHERQSIHGAPNKSGEWRIALGNHYAWLQTHGWRILTGGGCMNDNQFMGL

SEQ ID NO: 123817 - protein, 472 aa, Glycine max
  Coding DNA Sequence Number=SeqID_7039
  Gene Ontology: Mol. function=nucleoside-triphosphatase activity; Cellular component=membrane
  Homolog annotation: Hit_ID=Q93X55; Match level="QueryCoverage=96%, HitCoverage=50%, E-value=9e-95, Identity=43%"; Hit description =Peroxin 6
MVERRRKPLILCSTKHLINSTVPTNNLFPHESLPTFRLPVGILRFSNPANPSLDHSALLALSTSLLKTLSITSGSPVLVKNVDTNTQKIAVAIALDPPGTATNMDSPSSSNSRIMLVFPSCDFPSSGSVLDDQVAYISPLLAFNLNLHVTCLKSILHHGQDALASYFKRGDEDATKSTVDFVINVELEPLAQPPKFASLLRVSFVKIPECGILESIRASSPVESQERQDMIDLELQKYFEVDRYLSKGDVFGIKISWNCNSPICIPCNQRSLNKNDNLVCFKVVGMEPSDEPVFRVNNTLTALVLVGSSPSALPPDLLIGGQAEGPVPLQGDTVNILASILTPTFCPSVLSSKFRVSVLLYGLAGCGKRTVVRYVARQLGVHVVEYNCHDLMVSDRQSVALAQAFKTARRYSPAILLLRHFDVFRDSQSPEVSPHDQRGNTSEVASVIRKFTEPVNEHGDSSVPGKSNSESV

SEQ ID NO: 123818 - protein, 703 aa, Glycine max
  Coding DNA Sequence Number=SeqID_7040
  Gene Ontology: Mol. function=protein binding; Cellular component =cellular_component; Biological process=multicellular organismal development
  Homolog annotation: Hit_ID=A0F0B0; Match level="QueryCoverage=97%, HitCoverage=82%, E-value=0.0, Identity=86%"; Hit description=Cold -induced thioredoxin domain-containing protein
  Pfam annotation: Domain name=DUF255; Domain location=1-35; Score= -1.3; E_value=0.039; Accession=PF03190.5; Description=Protein of unknown function, DUF255
MAILFEVGYSTCHWCHVMEVESFEDEAVAKLLNDWFVSIKVDREERPDVDKALYGGGGWPLSVFLSPDLKPLMGGTYFPPDDKYGRPGFKTILRKLKEAWDSKRDMLIKRGSYAIEQLSEAMSASSDSDKLPDGVPADALRLCSEQLSGSYDSKFGGFGSAPKFPRPVEINLMLYHSKKLEDTGKLDGANRIQKMVFFSLQCMAKGGMHDHIGGGFHRYSVDECWHVPHFEKMLYDQGQLANVYLDAFSITKDTFYSYISRDILDYLRRDMIGPEGEIFSAEDADSAETEGAARKKEGAFYIWTGKEVADILGEHAALFEEHYYIKQSGNCNLSGMSDPHDEFKGKNVLIERKEPSELASKYGMSIETYQEILGECRHKLFEVRSRRPKPHLDDKVIVSWNGLAISSFARASKILKGEVEGTKFYFPVVGTEAKGYLRIAEKAAFFIWKQLYNVETHRLHHSFRHSPSKAPAFLDDYAFLISGLLDLYEFGGGINWLLWAIELQETQDALFLDRTGGGYFNNTGEDSSVLLRVKEDHDGAEPSGNSVSAINLIRLASMVAGTVLVYVLTMVGSGMGAVFERRLKDMAMAVPLMCCAADMLHVPSRKQVVVVGERTSGDFENMLAAAHALYDPNRTVIHIDPNNKEEMGFWEVNNSNVALMAKNNFAVDKVVALVCQNFTCSPPVTDHSSLESLLSKKPSSSLT

SEQ ID NO: 123819 - protein, 137 aa, Glycine max
  Coding DNA Sequence Number=SeqID_7041
MGREVKTRATSRFGYVVILFGQGCKMRRAVISTGARDRVEFFKLLAGVIGLGGFLILRNGSKREWDFDWDEGFSMRRFKLEGGRDAIKGLGLGLGLGLGAGRKEMVESELEEGEACSFQNHEDYDATVDPDVSLSYI

SEQ ID NO: 123820 - protein, 192 aa, Glycine max
  Coding DNA Sequence Number=SeqID_7042
  Pfam annotation: Domain name=VQ; Domain location=48-78; Score=49.9; E_ value=8.7e-12; Accession=PF05678.4; Description=VQ motif
MENMRLMRKHNTTHTCMANNSHTPSSSLAMHKDSHMISKTKPKIRIIHIFAPEIIKTDVENFRELVQKLTGRPSGENLKCCNKKKETRVVVAKQREELESYSSESGMSEDHHKNTVKNNNGGCCWGLDVTTRGKVKEEVVGVCNCSDESNSSGGYLGGFSDLEGFISDFGGFPLLPLDGNHIMEGFEESQLL

SEQ ID NO: 123821 - protein, 58 aa, Glycine max
  Coding DNA Sequence Number=SeqID_7043
MSHNLTGQLVSAEIHGFHTLEAGFWLLEMIVCDFQCKVGVKKESVVGFGCGLFLLDQV

SEQ ID NO: 123822 - protein, 1494 aa, Glycine max
  Coding DNA Sequence Number=SeqID_7044
  Gene Ontology: Mol. function=zinc ion binding
  Homolog annotation: Hit_ID=Q10LI9; Match level="QueryCoverage=60%, HitCoverage=84%, E-value=9e-39, Identity=30%"; Hit description=CW -type Zinc Finger family protein, expressed
  Pfam annotation: Domain name=zf-CW; Domain location=582-630; Score =66.6; E_value=8.2e-17; Accession=PF07496.5; Description=CW-type Zinc Finger
  Subcellular localization annotation: CTP_CleavageSite=73; ConfidenceScore=5.40e-01
MTGAKFGGYGSFLPTYQRSPVWSHPRTPHKNYSQNTPRSPNNLQPEGGQGDGVQCSTGTQSSRLGPGSGNSSRMAANKGLSLDDGTNQEKYMTATKADTSTSKQESLNKKISSTSDQKTLKVRIKMGPDSLSTRKNAAIYSEIGLDVSPSSSLDDSPSESEGISRGPQDAPFESPTIILQIMTDLPQLLSPIPDDTIELTVKETHARDSIPGPVHMDDLESFDMYESNNVKGDRKLLGGSGRKMKSLEGCESSMEVKGSTKKNARNDVGVLSRKEQSTDALTMEELVSKTMKLPLLSSSYSFSDDLVKAVDGQCDSLKEANKVIVREKTFSDQGQKERMESTSTEVNGFAEKAKGSSGRKVVGDKVSLDDYPVKENHQGDKNFNSMIVENNVSKVRTEPNTEEPPKKANQRGNLSEQDGVEHPFPGGKKKPKGSHGTMVMEREKENLKVGSSLVPKIKKSSDDSSASRNETEDARIQKSLGKTRDTYKDFFGELEDEEDRLDSLETPYGEKLKESEVVERSAPTTSYGAKERSGGKKVDKPFTAEIYPKTATNISCTGNANGTDLENGKGIPVMIPPVEMDDKWVQCDRCQKWRLLPVGTNLDSLPEKWLCSMLDWLPDMNRCSFSEDETTKARIALYQGPPLDSQSNLQNVSGSVMLGGTMAMSQHPYQHQLNNDMHAAPGGKKKLMKERSNSINKDSFSQSSYSIKKNWQSAVKSRSLNDVNKSPVVSEADVPADKHKNKHWMLEHNSDRGDTKNMKVKSRKDPDQDSSRPSKKSKSDKVHSTNEEWIVEQSGTTRKVGDHSSNSTFPNTSVGKDRHRQKDPSSLRDSKSGKDRLPVSAETTKDKGQGSLDEGSLDLGNCDSIGSVKKRKLKGYQDAQTYSPGNPRLQESKTSEHEFSNSRKEKKAKNSKYEGKESSASKGSGRSDKKVSHTKTQKFRQKPESSLSHRSLDGMDCSKRDLGSVHASVAATSSSSKVSGSHKTKASFQEVKGSPVESVSSSPIRISNADKFTNKEIIGKDDPHDIAAVDSPRRCSDHEDDGGSDRSGTAKKDKSFTIAHRSDFQDKGVNHMSDTKLKAQTTSYCTNGGVDTIVLDGTHPGTEQINHPGEDKIDVYYATTSQARKNGIESGLEDNNVNDSCKSESHADKVKSTSSPCQLKDQSPLHEAKHKDGKIKLQEKFGFKPDQNEIIHAGKKDYTGKNESRNKENHSNRGHDFQDVSTDAPCKQEVFHAPIQNQFPDCDTERSTKRSLLERTDQEVHGKGKPLSSLPYEGSQVEILGRCPRPVGLLKGNGDMEVDPSKVDDVSKLQKKQLKKTDHQNGNLQIGSRNPILNGHKSKELDAPSPARRDSSSHAANNALKEAKDLKHLADRLKNTGSSVEGTSLYFEAALKFLHGASLLESGNNDNAKHNEMIQSMQIYSSTAKLCEFCAHEYEKSKDMASAALAYKCMEVAYMRVVYSSHTSASRDRHELQTALQMAPLGNEFCYLIFTPFA

SEQ ID NO: 123823 - protein, 711 aa, Glycine max
  Coding DNA Sequence Number=SeqID_7045
  Gene Ontology: Mol. function=protein binding; Cellular component =nucleus; Biological process=multicellular organismal development
  Homolog annotation: Hit_ID=Q94AH6; Match level="QueryCoverage=97%, HitCoverage=99%, E-value=0.0, Identity=77%"; Hit description=Cullin-1
  Pfam annotation: Domain name=Cullin; Domain location=12-602; Score =777.2; E_value=9.7e-231; Accession=PF00888.12; Description=Cullin family
MERKIIDFDQGWDYMQKGITKLKRILEGAPETPFSSEEYMMLYTTIYNMCTQKPPNDFSQQLYDKYKDAFDEYINTTVLPSLREKHDEFMLRELVQRWLNHKVMVRWLSRFFHYLDRYFISRRSLAGLGAVGLTCFRDSVYMEVRVNARKAVIALIDKEREGEQIDRSLLKNVLDIFVEIGMGEMDQYEQDFEAEDCLRRERDRVSHYLHSSTEQKLVEKVQQEVLVIHANQLLEKENSGCHALLRDDKVEDLSRMYRLYHKIPKGLDPVANVFKQHITAEGAALVQQAEEASSNQVLVRKFLELHDKYMAYVNDCFMNHTLFHKALKEAFEIFCNKTVGGSSSAELLSTFCDNILKKGGSEKLSDEAIEDTLEKVVKLLAYISDKDLFAEFYRKKLARRLLFDRSANDDHEKCILTKLKQQCGGQFTSKMEGMVVDLTLARDNQLKFEEYLRDNSHVNPGIDLTVTVLTTGFWPSYKSFDLNLPSEMIRCLEVFKGFYETRTKHRKLTWIYSLGTCHVTGKFDTKNIELIVPTYPAAALLLFNNADRLSYSEILTQLNLGHEDVVRLLHSLSCAKYKILIKEPNNKVISQNDIFEFNHKFTDKMRRIKIPLPPADERKKVIEDVDKDRRYAIDAAIVRIMKSRKILGHQQLVLECVEQLGRMFKPDIKAIKKRIEDLITRDYLERDKDNPNTFSRLLDSEAPGATFFWHT

SEQ ID NO: 123824 - protein, 125 aa, Glycine max
  Coding DNA Sequence Number=SeqID_7046
  Gene Ontology: Mol. function=sequence-specific DNA binding; Cellular component=nucleus; Biological process=regulation of transcription, DNA-dependent
  Homolog annotation: Hit_ID=Q38796; Match level="QueryCoverage=88%, HitCoverage=11%, E-value=2e-38, Identity=73%"; Hit description =Homeobox protein LUMINIDEPENDENS
MDAWNEDFSVLEIGSSAESFQKFLVSQKELFHSQIDQFQEIVVTQCKLTGVNPLSQEMAAGALSIKIGKRPRDLLNPKAVNYMQSVFSIKDAISKKELHEISALLGVTVTQFVILLLDRRGSDSI

SEQ ID NO: 123825 - protein, 765 aa, Glycine max
  Coding DNA Sequence Number=SeqID_7047
  Gene Ontology: Mol. function=sequence-specific DNA binding; Cellular component=nucleus; Biological process=regulation of transcription, DNA-dependent
  Homolog annotation: Hit_ID=Q38796; Match level="QueryCoverage=62%, HitCoverage=57%, E-value=9e-92, Identity=39%"; Hit description =Homeobox protein LUMINIDEPENDENS
FLSRGGGMNLATWLSKAAAEEQTSVLLLILKVLCHLPLHKAIPMHISAILQSVNKLRFYRTSDISNRARVLLSKWSKLFARNQLAMHFQFACFLVVLSCSQEDILALSSECSDNFRKMGSPQGYISCLFLNTLSESRERRKVQLVEQPGQKSVSRSSQVTRAGPVSQGRPMSVDDIQKAKMRALFMQSKYGKSGSKESKETKIDSPNKQPQTNPASIAACSSKVPTPPKIEENKKPLLLTSKTTNRLEASYSKPKMDVKEPLWEKCKRVQIPWRTPAEVELKDTWRVGGGENSKEVEVQRNRNRRDKEIIYKTVQEMPPNPKEPWDLEMDYDDTLTLEIPIEQLPDGDGADIAISPNQVGTHTVQGVASTSSTGVATAEPDLELLAVLLKNPELVFALTSGQGGSIPNQETVKLLDMIKSGGVNLGLSENTNGSYGTSVKSPEKVEVSLPSPTPLSDPRTSGWSSEASKNPFSRRSLAPDRITQNHAAVATTNLLSQIPITGTTVRQQPTVVVPSSRHLTSTSVSPYSLPHATNVIPEKPSPLGQVQTSSDVGLTMKNLTTANASSVNFPGTHSTLALRGDGTNYVKPVPNLSVQHEGLSNSFRQPFMPPSPTPSHSSLQQQRHQHLTQEVHYTEPPYRNPGRSYPPQIEKSDHGSDNMWRVRQDHVSSSYHSQRNHNNNYNTMVGGSRQSGFWDRNNHARGEFESWSPENSPTRNPRYAPGRNYPESRMNHGRNPRPEWSRQRGSSGHWDPGRQGNRKWHDQRR

SEQ ID NO: 123826 - protein, 477 aa, Glycine max
  Coding DNA Sequence Number=SeqID_7048
  Gene Ontology: Mol. function=nucleic acid binding; Cellular component= intracellular; Biological process=chromatin modification
  Homolog annotation: Hit_ID=Q1RSK1; Match level="QueryCoverage=92%, HitCoverage=77%, E-value=1e-101, Identity=49%"; Hit description=Zinc finger, C2H2-type
  Pfam annotation: Domain name=RS4NT; Domain location=88-125; Score =14.8; E_value=0.034; Accession=PF08071.2; Description=RS4NT (NUC023) domain
  Pfam annotation: Domain name=zf-C2H2; Domain location=103-125; Score =24.2; E_value=0.00046; Accession=PF00096.16; Description=Zinc finger, C2H2 type
  Pfam annotation: Domain name=zf-C2H2; Domain location=130-151; Score =17.5; E_value=0.05; Accession=PF00096.16; Description=Zinc finger, C2H2 type
  Pfam annotation: Domain name=zf-C2H2; Domain location=27-49; Score =26.4; E_value=0.0001; Accession=PF00096.16; Description=Zinc finger, C2H2 type
  Pfam module annotation: Pfam domain module=RS4NT::zf-C2H2::zf -C2H2::zf-C2H2; Domain location=88-125::103-125::130-151::27-49
MGVFYEIDPNAEVVALSPTTLMATNRFVCEICNKGFQRDQNLQLHRRGHNLPWKLRQRTSTEVKKRVYVCPEPSCVHHNPARALGDLTGIKKHYSRKHGEKKWKCDKCSKRYAVQSDWKAHQKTCGTREYKCDCGTIFSRRDSFITHRAFCDALTEENNRVNNQGLTSGMPPNLQSQIPDLMSTMPLTTSPNTASKFGEYDPKNPLKSLAQELVPIPFKFMSMGGGMFSTNAGALFGGPKTMSPSSSSLQLGSSTSSSFNYLQDSENGGLIAASAQMSATALLQKAAQMGATASNSINSPMMQKGFVSGTTTGPDHVSSTTRPPYSGAMLQHNNSYDHFSPQPDLSSMAEVSGGGAFINQLFHKGQEISQVFDTNNPGSAMNDVGMFGQMPMGRDHHNQGLMKSVEQEVSNSSSLMHGRDVNDGNHPMQPSTRFGGSDMTTVHDFLGIGGSTSRVMNHFHHHFPHEDSTIEEPMWDV

SEQ ID NO: 123827 - protein, 296 aa, Glycine max
  Coding DNA Sequence Number=SeqID_7049
  Gene Ontology: Mol. function=DNA binding; Cellular component=nucleus
  Homolog annotation: Hit_ID=Q10LJ1; Match level="QueryCoverage=84%, HitCoverage=29%, E-value=2e-32, Identity=33%"; Hit description =Expressed protein
MKVELSHQGNNNTLKIEDYSKTHFPRSIFSRAFKPIPLKMDSRCIDDNKEDNEMKSAEGFEDIFGDPEVLPRVGEEYQAEIPSLITTPYLSQLVKKTRDSEITVIEQESMSLGLPIPLKWAHCKFEGSCGCGLSESFTSEAGPIISENECPEVEVTLQTVSHGGEKNVGGFSNFESSSKSVQPRGKYLLPGLLDDQSWTDIEYNNFLLGLYVFGKNLKFLKRFVGSRTMGDILFFYYGKFFKSKEYCRWSECRKLRTKRCIYGQKIFTGWRQQELLSRLFPRVPGESQTTLVEVSL

SEQ ID NO: 123828 - protein, 749 aa, Glycine max
  Coding DNA Sequence Number=SeqID_7050
  Homolog annotation: Hit_ID=Q1SZ21; Match level="QueryCoverage=94%, HitCoverage=92%, E-value=4e-93, Identity=58%"; Hit description=WD40 -like
MSNPAPFSTGNPPFWIPIHIVIPERPTECAVFNVIADTDISVLSTPVGGFTMKDSPRDSVQFIEWSPTCCPHALLIANFHGRVTIWAQPSQICFSCLFVSDFLSIPGQANLALDASCWLREHEWQQDIAVVTKWLSGYRWLSSKPSAPANSRSTFEEKFLSRQCQTSGSVQLHWSQWPPQNATTPKWFCTSKGPLGCGPCGIMAGDAIITDSGTMLVTGVPIVNPSTIVVWEVMPGPGNGFQYMSPYDPDEGPSITGWRVQRWESSLQHDVLHPIFGNPTSSMGGQPPMQTVWQTKVELSIPPTNDFKNHQAPAVGMNTDMQKISVGSAIAAPAFSSTSCCSASVWHDTSKDQTILKIIRVLPHAIPTSQVKANSSNWERAIAERKSRFWWSLLVGVNWWDAVGCTQSAAEDGIVSLNSVIAVLDADFHSLPSAQHRQHYCPILSQLVPASKGGEEPSLGRSRIGTGNAGQGYTYGERLTVNLWSYYTGNAGLQHPLPVSQVGSNNIQVRLHYIDGNYTVLPEVVEAALGPHMQMAMQNMPRPRGADAAGLLLCELELHPPAEEWHRRNMFGGPWSDPDVLDSANDALKLVSLNPLDSSSLENCDVYYGANGLWPRKRRMSERDAAFGLNTYVGLGAYLGIMGSRRDAVTALWKTGIEGIWYKCMRCLRQTCAFASPASTNLPSQNDREIWWISSWAYGCPMCGGTWEKRHVDYLTGSLSIKIVYVSEKAELVEGMDEELVTLRMRRND

SEQ ID NO: 123829 - protein, 64 aa, Glycine max
  Coding DNA Sequence Number=SeqID_7051
  Subcellular localization annotation: CTP_CleavageSite=13; ConfidenceScore=5.04e-01
METKTADPLFSVQTMKGRKAPPSQYTFKIKSFSWLSKASVQKCTSEEFEAGGYKWYMHALLLIQ

SEQ ID NO: 123830 - protein, 295 aa, Glycine max
  Coding DNA Sequence Number=SeqID_7052
  Gene Ontology: Mol. function=protein serine/threonine kinase activity; Cellular component=membrane; Biological process=protein amino acid phosphorylation
  Homolog annotation: Hit_ID=Q1SZ16; Match level="QueryCoverage=95%, HitCoverage=95%, E-value=2e-98, Identity=57%"; Hit description =Protein kinase
  Pfam annotation: Domain name=Pkinase; Domain location=48-251; Score =22.9; E_value=6.3e-10; Accession=PF00069.15; Description=Protein kinase domain
  Pfam annotation: Domain name=Pkinase_Tyr; Domain location=48-264; Score=-39.3; E_value=4.7e-10; Accession=PF07714.7; Description =Protein tyrosine kinase
  Pfam module annotation: Pfam domain module=Pkinase::Pkinase_Tyr; Domain location=48-251::48-264
IIMTCGCFGAKSIKAKRPSYVPGEIDGYPLDNVRQFSDKELRLATDNYNPNNKIGRGGNIKRWKAYSSEDSLSLVKAGRPSRTLVYEYVENGSLNSALLGTRNENMKLDWRKRSAICLGTAKGLAFLHEELSPPIVHRDIKASNVLLDRDFNPKIGDFGLAKLFPDDITHISTRIAGTTGYLAPEYALGGQLTKKADIYSFGVLILEIISGRSSARRTNGGGSHKFLLEWAWQLYEERKLLEFVDQDMEEFPEEEAIQLNEKELTAPGFFTNEGESSRNNSNPVSSFITITQVTP

SEQ ID NO: 123831 - protein, 53 aa, Glycine max
  Coding DNA Sequence Number=SeqID_7053
MTTDEDAINLAMEDPLNDRPMVTLINGVFHPSKVVAKALTLSIRQQFGQPWPT

SEQ ID NO: 123832 - protein, 138 aa, Glycine max
  Coding DNA Sequence Number=SeqID_7054
METSMIDAANGGALGDMTPTEARNLIEKMTSNSQQFSARNNAIVLRGVHEKSAPVARVYGLCSSVDHHTDLCPLQQSRVNEQPETYAANIYNRPPQKQTQQKQNNYNLSSNRYNPGWRNHPNLRWASPPQQQQLAPPF

SEQ ID NO: 123833 - protein, 125 aa, Glycine max
  Coding DNA Sequence Number=SeqID_7055
MAMGRTQLKYLPRRRTRKHEQEQAAKHEQEVAMHECQKMKHECRKKQWSKVNNTQEGEEETRSGRGIMKAKKKHEVEEALGTRRTNTKRKKQNTKKKQEGEDEEMETAQIMTRMDESLFLFKCIG

SEQ ID NO: 123834 - protein, 120 aa, Glycine max
  Coding DNA Sequence Number=SeqID_7056
MVHKLSMHSNYHSSIFTRSGGEYDTGNERKKSGKVAFFQENEEKEKESEGEKEVVTDSVGVSKARDLSVKEEKLKAKTSIDKDLPYPKNPTKKDKERQFAYFLNIFERLHINLPFLEALE

SEQ ID NO: 123835 - protein, 97 aa, Glycine max
  Coding DNA Sequence Number=SeqID_7057
MMIMMPPTIVEELHKEQQEAPIEDPPTDVEGFPSGPYDTSILRDFENHIALSVWNGEESPELKLSSHGRKMTKFGSPAPEIEGLVAASGLKIKHVES

SEQ ID NO: 123836 - protein, 76 aa, Glycine max
  Coding DNA Sequence Number=SeqID_7058
VLERINYNAYRIDRLEEYGVSNTFNIIDLVPFAGQILFKREGMMQSSQGGDPSPEPWLGDSKKIGPKMQEKALGFS

SEQ ID NO: 123837 - protein, 261 aa, Glycine max
  Coding DNA Sequence Number=SeqID_7059
  Homolog annotation: Hit_ID=Q1RYA5; Match level="QueryCoverage=25%, HitCoverage=17%, E-value=6e-20, Identity=70%"; Hit description=Auxin Efflux Carrier
  Subcellular localization annotation: CTP_CleavageSite=20; ConfidenceScore=5.21e-01
SSQSSPWPVARVFSYGSCLRDRSVSSGYPNLVLLSTNFRGMFPVEQGDLHKRWKLVSMELRNFHKCVVLPIGSLSSGLCRHQTILFKRLADYIGLPCRIARGCKYCVADHRSSCLVKIKDDKQLSRVFQKTLSCIHQWVLSEKRARDQSTINHCCWLASCTGQCKFVGKRCKDSSESSCALCFQSCTGGWQFGRHDHFLECCFIVVHAGQYPLDVYNRLCLRMDPYQINKGSLTLGSEYQRVYRPSLLHGLLALKSVSEQS

SEQ ID NO: 123838 - protein, 94 aa, Glycine max
  Coding DNA Sequence Number=SeqID_7060
MGTVLVTNVVVTVCEGNMLDRKGKRTTVPSDQKLSSLYLIDNIVKNVEQDYVKYFASRLPEVKKLEELGIGRPSTYASTIKVLLLFYNWNSVMP

SEQ ID NO: 123839 - protein, 73 aa, Glycine max
  Coding DNA Sequence Number=SeqID_7061
MSPWTGRGLAWAMKIAAHLKIGPIRLCRNLPFGGKATRELMGASSMGGKCAESPPTFIQGKRQNNWKGVVYEL

SEQ ID NO: 123840 - protein, 68 aa, Glycine max
  Coding DNA Sequence Number=SeqID_7062
MVDLRGRGSTLVRFSFLLDYYRFSFLFGTNSTYEFVGHLFVTHGHIKVNCVTEDQVVVWSPAPTTLES

SEQ ID NO: 123841 - protein, 187 aa, Glycine max
  Coding DNA Sequence Number=SeqID_7063
  Subcellular localization annotation: CTP_CleavageSite=20; ConfidenceScore=5.45e-01
MDRLTTMMSALLSAQNSQAAAAAVEQPLVSTTPLSTVTSPPLFLPPGCTWGMPPPVCGSSQPAVSEAPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMS

SEQ ID NO: 123842 - protein, 457 aa, Glycine max
  Coding DNA Sequence Number=SeqID_7064
  Gene Ontology: Mol. function=calcium ion binding; Cellular component =nucleus; Biological process=regulation of transcription, DNA -dependent
  Homolog annotation: Hit_ID=Q1T0C7; Match level="QueryCoverage=87%, HitCoverage=48%, E-value=1e-148, Identity=61%"; Hit description=IQ calmodulin-binding region; CG-1
MTPSVGYVSDRTGPEKLQLQGSPATPVNSNSSSASDPAASWIPSEDLDSGVNSAYAVELNDNLTAKSHEQRLHEINTLEWDDLVVPNVNTSTTSNGGNVPYSFQENQSLLSGRFGNVSSNPSAEIPSFGNLTQPVSGSNSAPYSFPDSAILLKNSPISSGGVDTLGTLVNEGLQSQDSFGTWMNIISDTPCSIDESALKASISSVHVPYSSLVADNLQSSLPEQVFNLTEVSPTWASSTEKTKVLVGVYRCCVPPHSPGLVNLYLSFDGHKPISQVVNFEYRTPILHEPTASMEEKYNWNEFRLQMRLAHLLFASDTSLNIFSSKVSPNALKEARRFSFKTSYISKSWQYLMKSIDDNTIPFSKVKDSLFETALKNKLKEWLLERIILGRKSTEYDAQGQGVIHLCAMLGYSWAISLFSWSGLSLDFRDKFGWTALHWAASYGMYDTWILHLPEQLA

SEQ ID NO: 123843 - protein, 113 aa, Glycine max
  Coding DNA Sequence Number=SeqID_7065
  Gene Ontology: Mol. function=nucleotide binding; Cellular component =endoplasmic reticulum; Biological process=small GTPase mediated signal transduction
  Homolog annotation: Hit_ID=Q01474; Match level="QueryCoverage=77%, HitCoverage=45%, E-value=5e-46, Identity=98%"; Hit description=GTP -binding protein SAR1B
  Pfam annotation: Domain name=Arf; Domain location=5-113; Score=51.6; E_value=8.4e-14; Accession=PF00025.11; Description=ADP-ribosylation factor family
  Pfam annotation: Domain name=MMR_HSR1; Domain location=21-107; Score=- 20.9; E_value=0.082; Accession=PF01926.13; Description=GTPase of unknown function
  Pfam module annotation: Pfam domain module=Arf::MMR_HSR1; Domain location=5-113::21-107
MFLFDWFYGILASLGLWQKEAKILFLGLDNAGKTTLLHMLKDERLVQHQPTQHPTSEELSIGKIKFKAFDLGGHQVARRVWKDYYAKVLPVGDRFFGFCNVPLLLAQLLLTRL

SEQ ID NO: 123844 - protein, 213 aa, Glycine max
  Coding DNA Sequence Number=SeqID_7066
  Gene Ontology: Mol. function=transporter activity; Cellular component= intracellular; Biological process=transport
  Homolog annotation: Hit_ID=Q94FN0; Match level="QueryCoverage=83%, HitCoverage=44%, E-value=4e-81, Identity=83%"; Hit description =Phosphatidylinositol transfer-like protein IV
  Pfam annotation: Domain name=CRAL_TRIO; Domain location=45-212; Score= 84.3; E_value=3.7e-22; Accession=PF00650.10; Description=CRALTRIO domain
MWHDIKVTMDKWMNIIDMGYIIASRYNVILDFEFKEIDEVLQYYPQGHHGADKDGRPVYIERLGQIDATKMMQVTTMERYIKYHVKEFERTFDIKFAACSIVAKKHIDQSTTILDVQGVGLQNFNKHARELVTCLEKIYGDNYPETLNCMFIVNAGSGFGILWNIVKSFLDSKTTTKINVLGNKYDTKLLEIIDARWSRMVTTNVQKVRRSKC

SEQ ID NO: 123845 - protein, 48 aa, Glycine max
  Coding DNA Sequence Number=SeqID_7067
MQAAQKAVETIKETAANIGAAANTGAPANSSLEKTKTTIQEKHCLIHC

SEQ ID NO: 123846 - protein, 69 aa, Glycine max
  Coding DNA Sequence Number=SeqID_7068
MRKGEAERERGGGEKEKHKEKGMRARGRGYKRRENCFLLHQIRGLFLFFIPNNSKALVRMVRLSVAMAE

SEQ ID NO: 123847 - protein, 129 aa, Glycine max
  Coding DNA Sequence Number=SeqID_7069
MVCIVKSGLSYKLCTISFGGKIKIPSFMIILEFIEKGVLSKAVFEKDDVDTNFLSQFIVNIWLLTMLRHCNSIDEKSLTGNVPWIPFQNMKQPSATKMYLIMDRGGNRPGQPTGAYDLTYIKPSLNWPI

SEQ ID NO: 123848 - protein, 485 aa, Glycine max
  Coding DNA Sequence Number=SeqID_7070
  Homolog annotation: Hit_ID=Q00UZ0; Match level="QueryCoverage=44%, HitCoverage=21%, E-value=2e-30, Identity=35%"; Hit description=[G] KOG2175 Protein predicted to be involved in carbohydrate metabolism
MEELEEAETQVRGMITDFGDDMHCQFLEILRCLLDSCSLSGAQRDTIIDIFYEKHLGQLIEVITASCLSENVAHVNSKSIDRGLVKYQSGTKPEILSNICDLLCFCILHHPYRIKCNFLPNKVIDKILLLTRRREKYLVVGAVRFVRTILSRHDEHLVDHFVRSDLLKPIVDAFVANGNRYNLLHSAVLELFEYIRKENLKLLLKYIVDSFWDQLVKFEYLVSIHSLKVKYEQCLDNDGAKGTAIMIDLRRRLDERALEKEEEDYFNDRRFYTTGMGSLDIWWLISDEEDTTSASISHNQKVQQQQPALSNGVAASYSELSPRSGGLVDYDDDDDEDYRPPPKKKPEASEEDEGTMESLSRKRKLPSKNPELAKKLSKNSKSKDSVFAALCSTLSQAVLPGKKPSINVHTDPCREDNKEKEPNVSRNCCENSNATAEANHVEKETSAYRNFSDGLYGTSDNGQLGGEEHTLVSPKSSPEMAVNGS

SEQ ID NO: 123849 - protein, 101 aa, Glycine max
  Coding DNA Sequence Number=SeqID_7071
MVLQCHYSRGVFIIFFLYLEVHTVYLFPRNAALLEALHKLTRNRTIKTIHSPAVLPKVLKAGQNLRVLEWLGMGNQELLNYFSAYDVVKARHSYGPRDIGG

SEQ ID NO: 123850 - protein, 173 aa, Glycine max
  Coding DNA Sequence Number=SeqID_7072
  Gene Ontology: Cellular component=nucleus
  Homolog annotation: Hit_ID=Q54I18; Match level="QueryCoverage=75%, HitCoverage=11%, E-value=5e-25, Identity=44%"; Hit description =Supressor of Mek1
MWSGMNCNMDIYHIKISIYSSTHSVLSVFSLVIGERVKVYRMNDDGKWDDKGTGHVTVDYLERLEELGLFVFDEEDNENILSHRISPDDIYRKQEDTIISWRDPEYAAELALSFQESGGCSYIWDNICNVQRSMHFNTLNSEAFNSVNSESRELPAVELSTLPLILKINCGYC

SEQ ID NO: 123851 - protein, 105 aa, Glycine max
  Coding DNA Sequence Number=SeqID_7073
  Gene Ontology: Mol. function=hydrolase activity, acting on ester bonds; Biological process=lipid metabolic process
  Homolog annotation: Hit_ID=Q9M8Y5; Match level="QueryCoverage=58%, HitCoverage=16%, E-value=4e-14, Identity=54%"; Hit description =Putative GDSL-motif lipase/acylhydrolase
MENFVAEEEKLCQGHKDNVDAMCNDAKTLGGKGAVGGKPYNGLGLCTPLSNLCSNRQQCSFWDAFHVSEKDNRLILEEIMLGSKGYMNQSTLAASYLWMQLPHAD

SEQ ID NO: 123852 - protein, 150 aa, Glycine max
  Coding DNA Sequence Number=SeqID_7074
  Homolog annotation: Hit_ID=Q47336; Match level="QueryCoverage=31%, HitCoverage=53%, E-value=6e-21, Identity=100%"; Hit description=LacZ- alpha peptide
MGNMGDLDVSRVVGEINDIVRAENDSSTLEEMLENLSYGLNSEVFDMVLKRCFKLKDEYSHTMRTYNTMLHIAREAKEFPFVKNGRHRGGAPIRPIVSRITIHWPSFYNVVTGKTLALPNLIALQHIPLSPAGVIAKRPAPIALPNSCAA

SEQ ID NO: 123853 - protein, 55 aa, Glycine max
  Coding DNA Sequence Number=SeqID_7075
  Subcellular localization annotation: CTP_CleavageSite=22; ConfidenceScore=5.00e-01
MPTFYAAFPQTPSVQAAPRISVISMKSAREASMSEGLLESCFIKLIDTVDLEGGP

SEQ ID NO: 123854 - protein, 123 aa, Glycine max
  Coding DNA Sequence Number=SeqID_7076
METPFCARSLLSCASWLEKKKAYISSRESSEHSEIRLSNGRRGTRGVPQLSGSLVGDEGFEFSEPPSNYRTGGGLTGIYLRAAVQARMVLALAEGPKIHFKKQECQSNLEKEAKGNAIGTAFG

SEQ ID NO: 123855 - protein, 107 aa, Glycine max
  Coding DNA Sequence Number=SeqID_7077
EEPGGGVPLRGRRCLLGEEGGAPFAWEDSLREVGVKVGEGGANSLRVLGHTGPKIETATHDATKPEIETFANKTIGPGLTMLHTQLHTKTLGLILRLPHIPLVGPGM

SEQ ID NO: 123856 - protein, 74 aa, Glycine max
  Coding DNA Sequence Number=SeqID_7078
MEKKKAIANSNVVERVKGTHSFVVGDETLNVKVKIINVSRVGLRVDVDGPVKVAMNYSEYVLQKMKEKMKRERG

SEQ ID NO: 123857 - protein, 103 aa, Glycine max
  Coding DNA Sequence Number=SeqID_7079
MQKSREGETGEVSAGMCITYSLGKTLVTLSITEEGFAGRINVVYIDISEDSGKGSFANLYLRVTKNERSGGASEAYKGLYESCGFKNGEEDEELEGGKHGGSC

SEQ ID NO: 123858 - protein, 217 aa, Glycine max
  Coding DNA Sequence Number=SeqID_7080
MSVEEGLLLASSTLNGPRSMQRLPERKNPISQGGGVLKSSSFLYGRDTDRKCLIVILREKRSDDDEELPYMITVKHYFVAACCSHGVSFVAKIRSSDGGLSVELGKPSIRPKGSLLSMFDDVKGKGWCPDPIEPIPSQNKNPTIANINPGLQNLPIAVIGNGGYFKGNAVKLCLGDLLVMGSNPETASLHMQGKAAYNIPPPYLRITKSLWAMGYEV

SEQ ID NO: 123859 - protein, 293 aa, Glycine max
  Coding DNA Sequence Number=SeqID_7081
  Gene Ontology: Mol. function=protein kinase activity; Cellular component=integral to membrane; Biological process=protein amino acid phosphorylation
  Homolog annotation: Hit_ID=Q2LJM2; Match level="QueryCoverage=82%, HitCoverage=40%, E-value=6e-55, Identity=47%"; Hit description =Putative receptor kinase
  Pfam annotation: Domain name=Pkinase_Tyr; Domain location=155-291; Score=-144.9; E_value=0.0014; Accession=PF07714.7; Description =Protein tyrosine kinase
  Subcellular localization annotation: CTP_CleavageSite=57; ConfidenceScore=5.39e-01
MINLSHLQDFNVSSNQLSGQIPDSLSGFPGSAFSNNLFLCGVPLRKCKGQTKAIPALASPLKPRNDTVLNKRKTHGAAPKIGVMVLVIIVLGDVLVLALVSFLLYCYFWRLLKEGKAETHSKSNAVYKGCAERGVNSDGMVFLEGVMRFELEELLRASAEMLGKGVFGTAYKAVLDDGTVAAVKRLKEVSVGGKREFQQRMEVLGRLRHCNVVPLRAYYFAKDEKLLVSDYMPNGSLSWLLHGVHVDAMKILKLDHVIMHLCLQHGINRSFFLPSNLQLFMHLPSFTDKTIVK

SEQ ID NO: 123860 - protein, 148 aa, Glycine max
  Coding DNA Sequence Number=SeqID_7082
  Gene Ontology: Mol. function=protein kinase activity; Cellular component=integral to membrane; Biological process=protein amino acid phosphorylation
  Homolog annotation: Hit_ID=Q2LJM2; Match level="QueryCoverage=67%, HitCoverage=14%, E-value=4e-35, Identity=71%"; Hit description =Putative receptor kinase
MVDSGRNLAGEVVVGDVEAVEVGEGGDGGGKLAGEFVVGEEEELEGGEVGEGGEGTVKTVAFKAEDAELGEGSEGEDGAGEVEVFEDEVGDAVVEAGDAVPGGGSRGCWRRSGRQGRGKTTGRWWWEGGGKGNQVTPLLEWVKSEVSE

SEQ ID NO: 123861 - protein, 96 aa, Glycine max
  Coding DNA Sequence Number=SeqID_7083
MKNIFNPLEKLDDHCVEQKINKRNDEGCDLRSQPYSATPLPFSFLSPGFELLLCFYGASEFELRGANQLIQNSTFEPKDANLRDIRTTPRGTNREI

SEQ ID NO: 123862 - protein, 140 aa, Glycine max
  Coding DNA Sequence Number=SeqID_7084
MVLQGRTPSIGDRIDGLTLDVSDMPAFCEQVPFINGEDQTHSNTPRSPPHSYIPSKATSRKTRQLTQLRRLIVRSLDQTRPSVNVNPVTGRGSGPHKTPCGACRPWIFFINGVLCFLKIMAAEWRRKKDDWRCHFKENMS

SEQ ID NO: 123863 - protein, 84 aa, Glycine max
  Coding DNA Sequence Number=SeqID_7085
MSVEEFIQSVAWPGVQPSPSGRVIAQEDVASPELFPQAEPSPSPSPEPEPSAPAPMPNQSTSQDPSSTLMLDLNEHAEDHSQDD

SEQ ID NO: 123864 - protein, 47 aa, Glycine max
  Coding DNA Sequence Number=SeqID_7086
MKWHGGRFKEMKAAYKVQCGVSIFMKVMAEPLWLRQVTISTPILQSM

SEQ ID NO: 123865 - protein, 111 aa, Glycine max
  Coding DNA Sequence Number=SeqID_7087
SGPDDMRRPITVIHTLDEWEQQAEWVNAQRQILRPLSFRSSESSGTTSWVVNAQRQILRPLSFRSSESSGTTSWVVNALMQSYPARALARRLQVDWARDPRKGPRVLMSLR

SEQ ID NO: 123866 - protein, 322 aa, Glycine max
  Coding DNA Sequence Number=SeqID_7088
  Homolog annotation: Hit_ID=Q6CQF2; Match level="QueryCoverage=22%, HitCoverage=91%, E-value=2e-16, Identity=62%"; Hit description =Kluyveromyces lactis strain NRRL Y-1140 chromosome D of strain NRRL Y- 1140 of Kluyveromyces lactis
SFAPIPKSDERFARQYRCGPPPEFPLASARSGIVHHLSGPDRYALTRTLHRRSGSVGGATHRGIPPISFLAPYGPTPGARRCRGMPRARAAIHNRDDDVSTSISTARAWATIAIRVGQCPESIGGPALTVPHPTGTHRRPPSASLPTNFKHSLTLFSKSFSSFPRGTCSLSVSPPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSRE

SEQ ID NO: 123867 - protein, 203 aa, Glycine max
  Coding DNA Sequence Number=SeqID_7089
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=2e-22, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHAFAFRGQHVLAFRGLEFLAFRGLHVLAFGGLHVLAFRGLHVLAFRGLHVLGIGGLHLHDFRVLHVLAFRGLYVLTIRGLHALAFKGLHILALTFRGQHVLTLRGLHPLAFKGLHVLAFKGLHFLAFRDCTTTPPCLQRNARPRLRRTTCPRHLRAARPRLHRAVPPRLQRATRFRLQRTSPSEGVRSSPSEGCMRWPSEDC

SEQ ID NO: 123868 - protein, 354 aa, Glycine max
  Coding DNA Sequence Number=SeqID_7090
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=37%, E-value=0.0, Identity=88%"; Hit description=DNA -directed RNA polymerase beta chain
  Pfam annotation: Domain name=RNA_pol_Rpb2_6; Domain location=48-354; Score=294.2; E_value=2.4e-85; Accession=PF00562.18; Description=RNA polymerase Rpb2, domain 6
MVATGNSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAG

SEQ ID NO: 123869 - protein, 261 aa, Glycine max
  Coding DNA Sequence Number=SeqID_7091
  Gene Ontology: Mol. function=transporter activity; Cellular component= outer membrane-bounded periplasmic space; Biological process=sulfur metabolic process
  Homolog annotation: Hit_ID=Q6FFY7; Match level="QueryCoverage=48%, HitCoverage=37%, E-value=7e-35, Identity=54%"; Hit description =Alkanesulfonate transport protein
KRVGLNKGSDVNYLLVKALEDAGLNYKDVTPVYLPPADARAAFQKGAIDAWVIWDPYLAEVEANAGAREVRNAEGLVPHYTFYLASRPFAENHPQTAKQVVDELSKLSDWANQHQDEAAAILAKSTGASGHLHPRRPAAGEVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 123870 - protein, 140 aa, Glycine max
  Coding DNA Sequence Number=SeqID_7092
  Homolog annotation: Hit_ID=Q2HU19; Match level="QueryCoverage=33%, HitCoverage=4%, E-value=2e-09, Identity=76%"; Hit description =Bromodomain; WD40-like
MKMQFSPRTIQKLQNFFLLTNPPIFGGETKIRGRDLFRRFSLWFPVPISIELIQSRLENNYYRSLEALKHDRCQQKSNAFQNGSHGHYHLYSSWLSGVTGQHYGRSSLAETPHCGKCIIRIQNFWSLSYGVVGAITSDAL

SEQ ID NO: 123871 - protein, 800 aa, Glycine max
  Coding DNA Sequence Number=SeqID_7093
  Gene Ontology: Mol. function=protein serine/threonine kinase activity; Cellular component=membrane; Biological process=protein amino acid phosphorylation
  Homolog annotation: Hit_ID=Q5NJB1; Match level="QueryCoverage=62%, HitCoverage=80%, E-value=1e-121, Identity=44%"; Hit description=S -receptor kinase-like protein 1
  Pfam annotation: Domain name=Glyco_hydro_18; Domain location=27-288; Score=126.7; E_value=6.4e-35; Accession=PF00704.18; Description =Glycosyl hydrolases family 18
  Pfam annotation: Domain name=PAN_2; Domain location=311-370; Score= -0.4; E_value=0.0015; Accession=PF08276.2; Description=PAN-like domain
  Pfam annotation: Domain name=Pkinase; Domain location=481-752; Score =175.5; E_value=1.4e-49; Accession=PF00069.15; Description=Protein kinase domain
  Pfam annotation: Domain name=Pkinase_Tyr; Domain location=481-752; Score=116.3; E_value=8.9e-32; Accession=PF07714.7; Description =Protein tyrosine kinase
  Pfam annotation: Domain name=RIO1; Domain location=494-644; Score= -98.2; E_value=0.1; Accession=PF01163.12; Description=RIO1 family
  Pfam module annotation: Pfam domain module=Glyco_hydro_18::PAN _2::Pkinase::Pkinase_Tyr::RIO1; Domain location=27-288::311-370::481 -752::481-752::494-644
MNMFLFPSYVLLLLFLILNLPHTTHSDDIAIYWGSNDGEGSLAETCATGLYSFVNIAFLAHFGNGQVPQVILGRHCDPFGGNCSVLGRDIRNCQKQGIKVMLSIGGPSMSYSLVSSEDAKSVSDYLWNNFLGGGGNSSSSSSPLGDVILDGIDFGLGGSLMTKHWEDLAHYLKSHRRNVYLSAAPQCIFPDSALGKALETGLFDYVWIQFYNNPLCQYNEGNASNLLNAWKQWTTSLKSGKMFLGLPASPTASIGGYVPPDLLISRILSTVKTSSNYGGIMLWSRLFDKESGYSKRILENSVCLQKRETECGRHKNGFIEHLGYMAKEGFVASESKSIDMQCCEVICRNNCSCEAYAPLNFVNNTGCQFWGKGTKFIKDSGGNFKRVYFVKHKVNKLWKWIVIGVGAAVAALVSCYLFYVLRRKCKEEVDRKMKRKELLVEVGGNAMGNYGKAKGSKKEGKTINEIEVFSLENIIVATHNFSPDNKLGEGGFGPVYKGTLIDGQEIAIKRLSKSSGQGLVEFKNEAKIMAKLQHTNLVRLLGFCIDSDERILVYEYMSNKSLDHYLFDASRNNELEWNKRLKIIEGTAQGLVYLHRYSRLKVIHRDLKASNILLDEEMNPRISDFGLARIFGLKGSEENTSRVVGTYGYMSPEYAINGVVSVKTDVYSFGVLLLEIISGMKNNSCIHSNHPFNLIAHAWQLWNQGRALELMDPSLNESFSSDEVERCIQIGLLCVQDHAIERPTMEDVVTFLSNDTTQLGQPKQPAFFMYVVAGESGCPNNSKQENYSLNHLSISTAYGR

SEQ ID NO: 123872 - protein, 184 aa, Glycine max
  Coding DNA Sequence Number=SeqID_7094
MVRTKGLRRTLGRVLGRVLVRQVAGDEEEVPRCRRSTTSACRQWIAAVVAKNVDHVDHVADEVHEQPQEPVTNHIGANTKGFPGGPHDTSVLTSLENYHERKSRACHWKSGKALLVTTYLMARKLQEDWARDAGEGPRDQQVMNALNPHIYLCHQAGGDPSPESWLGDSKKIGLEMQEKVLGFS

SEQ ID NO: 123873 - protein, 288 aa, Glycine max
  Coding DNA Sequence Number=SeqID_7095
MEGKDRLAMQQGGEGGVNGVWCHGTTGKGRKRQWRGKKFPEILDWSVEFTYLTIKNRVLLVVHMFLFLPTSSNNALLSSASCSSSAYAALLSYDSSSSSSSSTLCAFVLISVFFRHSFLPVVVVVAVPVFFRRWWFRLLGNHLPAPVEEGVGHVEGFPGGPHDTSVLSDFENHIAFRVWNGEERPKLKLSSHGRKMVKFRRPALEIEGLVVANELSPLIACSLDTGDRGLIFEQLHVDDAIEMLVELLEVSATEARAETIQCHGISLDAHSLPTRVPYTSRGILGCIA

SEQ ID NO: 123874 - protein, 56 aa, Glycine max
  Coding DNA Sequence Number=SeqID_7096
MAAAAPTEASIDQHDLRHAVVGQATEPEDFLPKEQKPTLLLKNVWASQDATLASQL

SEQ ID NO: 123875 - protein, 37 aa, Glycine max
  Coding DNA Sequence Number=SeqID_7097
  Homolog annotation: Hit_ID=Q2HU19; Match level="QueryCoverage=97%, HitCoverage=2%, E-value=2e-13, Identity=89%"; Hit description =Bromodomain; WD40-like
MSAGYDGRTIVWDIWEGLPIRTYEISRFKLVDGKFSP

SEQ ID NO: 123876 - protein, 113 aa, Glycine max
  Coding DNA Sequence Number=SeqID_7098
MGEVIDSSSASICNFCLETQLLSGRLCSYSKKGIFIIYGMWPKCLKNKKRKGRVIVVVASTFLFLHADDGGDLTNPKGGVKEDEKNMCMRSLDDRWKATLPTMEDVTRVMDKS

SEQ ID NO: 123877 - protein, 205 aa, Glycine max
  Coding DNA Sequence Number=SeqID_7099
  Gene Ontology: Mol. function=ATP binding; Biological process=electron transport
  Homolog annotation: Hit_ID=UPI000034F2E0; Match level="QueryCoverage =48%, HitCoverage=5%, E-value=9e-38, Identity=75%"; Hit description =nucleotide binding
  Pfam annotation: Domain name=WD40; Domain location=31-69; Score=36.9; E_value=6.8e-08; Accession=PF00400.22; Description=WD domain, G-beta repeat
  Pfam annotation: Domain name=WD40; Domain location=73-147; Score=7.4; E_value=4.9; Accession=PF00400.22; Description=WD domain, G-beta repeat
  Pfam module annotation: Pfam domain module=WD40::WD40; Domain location=31-69::73-147
MYSTAIFDRAGRYVITGSDDRLVKIWSMETAYCLASCRGHDGDITDLAVSSNNALVASSSNDCVIRVWRLPDGLPISVLRGHTGAVTAIAFSPRPNAVYQLLSNIEGANSVLSMHVIVLRSWGGEAEWPLATPKALAAACLKIRVICGLHSCSFICPVAKQALATFSVAGQGCDICCPWKSVCNLPSSIPFSSTGVVLANLATDG

SEQ ID NO: 123878 - protein, 202 aa, Glycine max
  Coding DNA Sequence Number=SeqID_7100
  Homolog annotation: Hit_ID=Q2HU18; Match level="QueryCoverage=76%, HitCoverage=32%, E-value=4e-53, Identity=67%"; Hit description=WD40 -like
MALQKYAPSGNAPSVNMKHLSFSSKVPKKAELDEANLNHNMDVDIDLREIYFLIMHFLSAGPCHKTHLQFWNELLEHQLLPRRYHAWYSRTGACSGDKDDDGLSFPLNYNMLVERYSHIEKDHLVKLLKQLLLNTASPSLGMNLGNAPNAADVPTLLGSGSFSLLSLFLVKVGFVPRISRRYCLLILEILAPKDAKRLWGCS

SEQ ID NO: 123879 - protein, 72 aa, Glycine max
  Coding DNA Sequence Number=SeqID_7101
MWGVAGNQDTTAYTIIPDLTIQSTTQVIAQALRADEYLHHVVTTAPLTGRCSSMCPPTLAPDWHSANSGSVS

SEQ ID NO: 123880 - protein, 120 aa, Glycine max
  Coding DNA Sequence Number=SeqID_7102
MTHIRLHCSGHWQMVFILPKENLVVWFCSLNNRPDDYLKGIINSALKGLDDTPQPKSKAVVRWIVVKCNRQKGSTECGYYVMHWMSTIMSGTLRNNWRTTIGSRGIQGVSHPVNTVLSKS

SEQ ID NO: 123881 - protein, 53 aa, Glycine max
  Coding DNA Sequence Number=SeqID_7103
MTRAYDEGKRYGHMTTNLAEWHRYSEDVYVMMQENQHIATSHYVRMYVRDIGV

SEQ ID NO: 123882 - protein, 60 aa, Glycine max
  Coding DNA Sequence Number=SeqID_7104
PAVDALDFLEGDEDPLLEVDSPEEVMSASEADSTEDSGPREMAISGGSSSYHHYGHLCSG

SEQ ID NO: 123883 - protein, 89 aa, Glycine max
  Coding DNA Sequence Number=SeqID_7105
MGDTEGPPKCLAWVYHQLLALQWHIQGKARSQLDCGSEFHVSPPRWEAGHMTGRRACSRNLLFGERATRDSRDACSTKGIRAESPPTFI

SEQ ID NO: 123884 - protein, 88 aa, Glycine max
  Coding DNA Sequence Number=SeqID_7106
MPLNGKQLVVYSCKTLWRALNFSPNHNPCIPQQVKSLLLWKKWEKLDHIEERLRAIEGGEDYGFANLEELFLVPNIITPPKFKVPDFD

SEQ ID NO: 123885 - protein, 597 aa, Glycine max
  Coding DNA Sequence Number=SeqID_7107
  Pfam annotation: Domain name=Transposase_23; Domain location=294-358; Score=-6.2; E_value=0.0055; Accession=PF03017.5; Description =TNP1ENSPM transposase
  Subcellular localization annotation: CTP_CleavageSite=36; ConfidenceScore=5.07e-01
AKFDIAEATKVKTKVMSTVATRWRQFKSTLTSKFVFAKSEGQQMQDVVTKYGLDPEAWKQFEETRLTHNWEGIRKRAQSIQKHNDCPHVLSRGGYDLLQKKLLDEKRKRIQEEALLSDNPASLDDPPSPIKRHDSLEEQVTQGSFVPHGRQDILNTAIGRPDHGGRIRAAGSGVTITQYYGRASRTCSSSSTSISQQQLDEVVARLREDMTGQIREELRTQLEEENKMSLEIMTNALKEAIKKELSNKGSPESLQIQLDIQQLGARVSTKGSNVVINVQPSQEHHADAIPLMGLYVQRKDGTLRLVAMGKIMEGDSIIHTVAYADDVVRVSVETIIDPEAEVPYATSEIQYVKQAVNTFVAWPTHLVKAVLDEDPESIPHNEDAHAPKPANVDADDPLRGLIKYSFDIYDKPVEINFDGSCFGIVDAPTSIFITYSDVSEIIAGDKSLNISVLQLWLMIHAANANNIMKDGLRNLTERAHWQLVLLCPRQHVVVWLCSLRRKPGMHIKATINSVMTKLKTTLSPETKVVAPKWIEVKFILSFDLAFALIPLLKFTSSKMTSSTSIEELSVLYGIGTEIAGMPREGDQGMKIMIKESS

SEQ ID NO: 123886 - protein, 254 aa, Glycine max
  Coding DNA Sequence Number=SeqID_7108
MASNPSRAQKKAKSSKRKQGECSRSTLNRLDTWFIDESKKNNFKMIYSVKNLRIPKYLDLEWFSQQGAVVGLDMGGVHKFEESTDGYSKMQTYKGMLLDPARNMRNCLGVGDLTIEDRMLVYLITYILTPRSCNYTQVTDDDLHIVFGLKSGIKMIWILLIEDIMLKSPRLVDYEFSYVVLALRFIDYFNIDDSNEIVDFTKAFSEITKRHLKMLGMRFVEHEWIMAREPPAIANMDQMEEEAEAEAQQEPAQQ

SEQ ID NO: 123887 - protein, 236 aa, Glycine max
  Coding DNA Sequence Number=SeqID_7109
  Gene Ontology: Mol. function=RNA-directed DNA polymerase activity; Cellular component=chromatin; Biological process=RNA-dependent DNA replication
MDASGALSGMSSRLARMFPLPTIDELLDNLGHATWFSKVDLTQGFHQIRMVEADISKTAFRTHQGHYGYVIMPFGLYNAPSTFQATMNDLFQPFIYKFILEEFYLKLPKCAFGQRHIHYLGHIVSANGVELESSKIQAMLNWPVSIFLRSLCWFLGLTGFYQCFVKNYTQLASHMTHLLCKDKFKWSPEALTTFDNLNLPMTQTLILTLPDFNIPFVFETDASVLDWESFLCNGIT

SEQ ID NO: 123888 - protein, 90 aa, Glycine max
  Coding DNA Sequence Number=SeqID_7110
  Gene Ontology: Mol. function=hydrolase activity, hydrolyzing O -glycosyl compounds; Cellular component=apoplast; Biological process =carbohydrate metabolic process
  Homolog annotation: Hit_ID=Q2HTE2; Match level="QueryCoverage=97%, HitCoverage=15%, E-value=9e-33, Identity=82%"; Hit description =Sialidase
SSLKSDLYKPQFAGFVDVDLAADKKIFLRSLIDHSVVESFGAGGKTNILSRVYPELAVMNQAYLFVFNNGTEPIVVENLKAWSMISADIK

SEQ ID NO: 123889 - protein, 299 aa, Glycine max
  Coding DNA Sequence Number=SeqID_7111
  Gene Ontology: Mol. function=chitin binding; Cellular component =extracellular region; Biological process=chitin metabolic process
  Homolog annotation: Hit_ID=UPI00006A17C9; Match level="QueryCoverage =63%, HitCoverage=100%, E-value=2e-20, Identity=32%"; Hit description= UPI00006A17C9 related cluster
GLHVLTFRGLHVLTFKGRHALAFGGLHILAFKGLHALASRGLDILTFRGLHVLTFRGLRILAFRGLHVLAFRGLHVLAFRGLHALAIRGLHILPFRGLQVLTFRGLHPLAFRGLHVLTFRWLHALAFKGGLHVLAFRGLHICAFEGLKFLGHPPDLEGGPTVRAQPEREAIVQLLCIPGQDFTQSLQGDEWIMPARHLVDPEKSNRVLGFPALITGLYQFYGVSVAPSKVIRPPTNRAFIKKYCVTRQAQDKAPQQSRDGRQRAIDAPAPAPEPLSSSTKVGALPTTCGRSAGDQVQSR

SEQ ID NO: 123890 - protein, 231 aa, Glycine max
  Coding DNA Sequence Number=SeqID_7112
  Homolog annotation: Hit_ID=P52644; Match level="QueryCoverage=51%, HitCoverage=83%, E-value=3e-38, Identity=66%"; Hit description=Heat shock protein hslJ
  Pfam annotation: Domain name=META; Domain location=26-124; Score =109.3; E_value=1.1e-29; Accession=PF03724.6; Description=Domain of unknown function (306)
  Subcellular localization annotation: CTP_CleavageSite=23; ConfidenceScore=5.07e-01
FAALLAAGMLLSGCVYNSKVSTNAEQLQHHRFVLTSVNGQALPTGQTPPPEISFGEKMYVSGTMCNGFSGQGKLSDGELKVEQLAMTRKLCADPQRNALDNTLSKMLRDGAQVDLTENQLTLATADQSLRLPFGSAHMPIALPSSWRATDNEPPTIAQFAWPLSLIAARMPGGTCAAVACCTGSLLQADSNNAAHPTKNAARILSPFQKHLRINKLKNNRQRSACRREAKY

SEQ ID NO: 123891 - protein, 121 aa, Glycine max
  Coding DNA Sequence Number=SeqID_7113
GVVLAEVLLADHDHSTGYGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 123892 - protein, 199 aa, Glycine max
  Coding DNA Sequence Number=SeqID_7114
  Gene Ontology: Mol. function=hydrolase activity, acting on glycosyl bonds; Biological process=metabolic process
  Homolog annotation: Hit_ID=Q8A1K0; Match level="QueryCoverage=99%, HitCoverage=30%, E-value=9e-86, Identity=72%"; Hit description=Alpha- glucosidase
MNTSIARKKEMQWMQRVGIKGIKVDFFGGDKQETLKLYEDILSDANDYGLTVIFHGCTLPRGWERMYPNFVGSEAVLASENLIFTQHANDTESFNATLHPFIRNAVAAMDFGPVLLNKRHNRENNGGTIRKTTETFQLATAILFQTPVQNFGLTPNNLKDMPAHVIDFMKQVPTTWDETTFIEGYPGKYVILARRKGDT

SEQ ID NO: 123893 - protein, 131 aa, Glycine max
  Coding DNA Sequence Number=SeqID_7115
MSHAVKDNQGKWASNYERPFIVKRTFSGGALGQNHLRSWSDAGTKLKAETNQGMPPTRHPMDPEKSNRALGFPALITGLYPTYKVPVPPSKIMPSDHARRTPNGPKEVQQGPGISSSDYGPLSVLWSARHP

SEQ ID NO: 123894 - protein, 111 aa, Glycine max
  Coding DNA Sequence Number=SeqID_7116
MACNLCLTASRYLAPFVAQYVKFRDMPEIKRKQCYAIREPKRSNYVTRKVTEPYGKKTSIVTKFVKFRNVTEKESPKKQGVYLVKKGVQIANMPTWAFQDVPPEGGCLWRK

SEQ ID NO: 123895 - protein, 101 aa, Glycine max
  Coding DNA Sequence Number=SeqID_7117
MPATLGKTGNKEPLFRGAHYLADRTRAEPLFIGITDCFPADLHIGHFLLMWLSASLGAIGGFWLSWQIGRRYQHHLQRLRWLGAERVLRSQLFLRRHGGWA

SEQ ID NO: 123896 - protein, 188 aa, Glycine max
  Coding DNA Sequence Number=SeqID_7118
  Gene Ontology: Mol. function=oxidoreductase activity
  Homolog annotation: Hit_ID=Q5PHS2; Match level="QueryCoverage=100%, HitCoverage=21%, E-value=2e-53, Identity=53%"; Hit description =Putative periplasmic protein
MKGKYKAALALLLALILLPLALLATLTHWVPTLAGIWLPVGTRISLGESPRLTRSSLVIPDLRYLVGDCEIARVSNARLTRPSRWRLHLSELDINSACLAKIPASEPLSGAPRTLAEWQSMLPYSWLTIDNLRLSPWEKWQGKLVMSLTPGQQDIGYSGKEVTLQAKLRGQTLTVSNFSARLVEDQAP

SEQ ID NO: 123897 - protein, 93 aa, Glycine max
  Coding DNA Sequence Number=SeqID_7119
GKDHLELPYGVGTKRGQQKPIKVLRNECKWGWGHDRLIVALLCARQAENVSSPGRATPAPNYKNDERGRVFAFKNFFFPLSKAIPTGFTSLQP

SEQ ID NO: 123898 - protein, 78 aa, Glycine max
  Coding DNA Sequence Number=SeqID_7120
MAYSLSASYSMAKRGMSELTPILCGLNWEKPAPEQNVCLQVMEVGKEVLEMNGSGMKKEEREETPLQGENESRRSSPP

SEQ ID NO: 123899 - protein, 47 aa, Glycine max
  Coding DNA Sequence Number=SeqID_7121
MSEIEQPPRSESENSNCGVAKEQDSRRRGGGGALGGTSESPWLTGRY

SEQ ID NO: 123900 - protein, 410 aa, Glycine max
  Coding DNA Sequence Number=SeqID_7122
  Gene Ontology: Mol. function=siderophore-iron transporter activity; Cellular component=outer membrane; Biological process=siderophore transport
  Homolog annotation: Hit_ID=P94265; Match level="QueryCoverage=69%, HitCoverage=38%, E-value=1e-113, Identity=74%"; Hit description =Putative ferric siderophore receptor
MVRQRQVRVINMSSVAGKAYCDIVAAHYAATKAALLGLTRHWAAELGEHDVTVNGLAPGRISTPLLKSVPKEINDAVAEVTALRRLGTPEEVADACLFFASDQARPPGRCLSWPARRPPGGGHPRSEVHAGAQRERARAAQHQVAVARVAAHRRPVVAVGDVLDAGAQRHHVAVDVHHVAQAGVEAGPAGHLEGVGVVRIGGAGVDHAPVHRQALHAGNVPFRAQVGLEARHADDAVAVDGAVASGALLGVQEGHAAQHAHAVDGFAEHRQFDALVAVLAGGGECVAGVVGRARLVGGEQRQAGAQAAAVVLDADLLLLGHVGLQALAGVGHGLAVGRLRRRIAGHQGFDVVGVQRHARRHLEDDAGGRRVAAGVVGALLLAGVVGVVTLRQALVADAPASAAPCRPGTT

SEQ ID NO: 123901 - protein, 313 aa, Glycine max
  Coding DNA Sequence Number=SeqID_7123
  Gene Ontology: Mol. function=metal ion binding; Cellular component =nucleus; Biological process=transcription from RNA polymerase II promoter
  Homolog annotation: Hit_ID=UPI00006AB88A; Match level="QueryCoverage =60%, HitCoverage=59%, E-value=3e-31, Identity=40%"; Hit description =pirin-like protein
  Pfam annotation: Domain name=Pirin_C; Domain location=187-303; Score =24.7; E_value=1e-06; Accession=PF05726.3; Description=Pirin C -terminal region
PYILDHPPQPARRPPVRTRGRHLFVPAFSAFRFPPGHVAAGAGGPLHHDRAGGRAAPSRRHIDGDAAAGRHPRRPAHPRQPGQRTRSPGGRPALDSGRPRHRARPRIGGRGAAQWPAVVRQPAGATEIDATIGNAGAGLGNAGAAKRCGPGAGGVGPLRRLGRAAGDARAAAHPGRLAAAGSVAPGAAAGGLERLVTTPPPRPPVEAAPVIPAARFRPAGRAATTGRRAADPDFAVLPPGAALTATADRDGFLQLLAAGAPAHFILVAGAAIDEPVIQRGPFVMTDARALAQAVAAYEAGDFGQLRQESGVPG

SEQ ID NO: 123902 - protein, 63 aa, Glycine max
  Coding DNA Sequence Number=SeqID_7124
MALIEVHDAKHQSWQLSEILCGNMSAKRVLLSGQLAKRAYRAKRVHPLRMNTHPLAELLVAKQ

SEQ ID NO: 123903 - protein, 302 aa, Glycine max
  Coding DNA Sequence Number=SeqID_7125
  Gene Ontology: Mol. function=transcription factor activity; Biological process=regulation of transcription, DNA-dependent
  Homolog annotation: Hit_ID=Q5PFE2; Match level="QueryCoverage=98%, HitCoverage=97%, E-value=1e-104, Identity=64%"; Hit description =Hypothetical transcriptional regulator
  Pfam annotation: Domain name=HTH_1; Domain location=5-64; Score=74.9; E_value=2.6e-19; Accession=PF00126.17; Description=Bacterial regulatory helix-turn-helix protein, lysR family
  Pfam annotation: Domain name=LysR_substrate; Domain location=88-294; Score=159.6; E_value=8e-45; Accession=PF03466.10; Description=LysR substrate binding domain
  Pfam module annotation: Pfam domain module=HTH_1::LysR_substrate; Domain location=5-64::88-294
MKASSEELKVFIAVVESGSFSRAAEQLQMANSAVSRTVKKLENKLGVSLLTRTTRQLALTYEGELYFRRVQKLILEMATAENELIERQQAPQGVLRIDAATPVILNLLMPMIKPFRERYPAVTLSLISSESFINLIDRKVDVAIRAGDLTDSTLRARLLFISYRKMVATPAYLAKYGTPASVEALAQHQCLGFVETPRLNRWPVSANGSDLYEIDAAMSSNSGETIKQLCLNDQGIACLSDFMVNAEIAAGTFVEVLAHQSVPVEMPFNAVYYSDLGVSQRVRAFIDFLSEWVRDQPWRVQG

SEQ ID NO: 123904 - protein, 84 aa, Glycine max
  Coding DNA Sequence Number=SeqID_7126
  Subcellular localization annotation: CTP_CleavageSite=62; ConfidenceScore=5.37e-01
MNIKHQQTTNTKHSTKQLENAQKTITDSQLTGRKVRPALIPLNVTTRLVATGTVLSLSRPPGCARNSPPPIGDQPGSPKVFPTK

SEQ ID NO: 123905 - protein, 186 aa, Glycine max
  Coding DNA Sequence Number=SeqID_7127
  Homolog annotation: Hit_ID=UPI0000DB79DC; Match level="QueryCoverage =79%, HitCoverage=15%, E-value=1e-07, Identity=25%"; Hit description =PREDICTED: hypothetical protein, partial
  Subcellular localization annotation: CTP_CleavageSite=57; ConfidenceScore=5.70e-01
MALRHRNLRKHITDSKAKQGSNRFQKTSTQPTNFMATPTKPTESMAMLGVTPNQPTRSMKIFGVTLTQPTESMAAPNVTHIQPIDQSMEIPCVTHIQPIEPMEMPGLIPIQPTSSMTMPGVTPTQQTLTIEKPSETPPSLEFMKQRLEMMASTMETSGHTLSPQMRAQLDSGIKNLLRRVNARLNA

SEQ ID NO: 123906 - protein, 98 aa, Glycine max
  Coding DNA Sequence Number=SeqID_7128
MAYNDYEFKEERELMHQKETLEYNAFKKLKLLTSKMFNTCIIIEDIALIALNSARKHSLSYCRGFLLWRCIPLAIALSMKGYSIEESDNVLGNGHSED

SEQ ID NO: 123907 - protein, 116 aa, Glycine max
  Coding DNA Sequence Number=SeqID_7129
MLPRRFRERFREDSSSFFIVLRRSLFFNRLWRAKNQHMRGVLIPSPCVKTTPKPFTLKVRRPHLFRFFRHFPQINVGGDSAHFPPMEDAPVNLASPSRRRVGCDNWRLHWGRFLES

SEQ ID NO: 123908 - protein, 185 aa, Glycine max
  Coding DNA Sequence Number=SeqID_7130
  Subcellular localization annotation: CTP_CleavageSite=56; ConfidenceScore=5.79e-01
MALHRNLRKHRTDSKAKQGSNRFQKTSTQPTNFMATPTKPTESMAMLGVTPNQPTRSMKIFGVTLTQPTESMAAPSVTHIQPIDQSMEIPCVTHIQPIEPMEMPGLIPIQPTSSMTMPGVTPTQQTLTIEMPSETPPSLEFMKQRLEMMASTMETSGHTLSPQMRAQLDSGIKNLLRMVNARLNA

SEQ ID NO: 123909 - protein, 93 aa, Glycine max
  Coding DNA Sequence Number=SeqID_7131
MTKPRLQCTSFSPFLLLGLFSPNRPMAALEFCALVVLYKCVEAVIKGVYPNSAQDRLKASVSSLVPPSRLARVSEIGLSASLELTLAEGTCCA

SEQ ID NO: 123910 - protein, 90 aa, Glycine max
  Coding DNA Sequence Number=SeqID_7132
MADLPSQIAAMVVPWPLFNNTGHDWINNCTVILTINWNEQGNSDGSSNAKGSGVGVILEIPDEVILEQFLTFKFETTNNQAEYEALLADL

SEQ ID NO: 123911 - protein, 352 aa, Glycine max
  Coding DNA Sequence Number=SeqID_7133
  Homolog annotation: Hit_ID=O48847; Match level="QueryCoverage=83%, HitCoverage=31%, E-value=3e-70, Identity=52%"; Hit description =Expressed protein
AQQIKAKEQQQLQMQQLQLMRQAQMQRRDSNHPPLGGPVNAITTEGVLGQSTASALAAKMYEERMKHSNPMDTETSQPLLDARMALLKSTNHPGQMVQGNSGSVTAALQQIQTRTQQTPDIKPEVNMGTMQRSLPMDPSSIYGQGGMQSKPGIVNAGFSCALGESKSGSLGSAIWISARAVGATGLLVGGAAGSVVGAELILIVSISPISKRLNPGVGSLTLKGWPLTGIDQIRPGFGAPVQKPLLQSANQFQLLPQQQQQQLLAQVQAQGNIGNSPVYGDMDPQRLRGLARGSLNAKDGQSIANDGSIGSPMQSTSSKNVELILVSVFLICSSPVLSIADRGKTRKAENPL

SEQ ID NO: 123912 - protein, 433 aa, Glycine max
  Coding DNA Sequence Number=SeqID_7134
  Gene Ontology: Mol. function=DNA binding; Cellular component=nucleus; Biological process=regulation of transcription, DNA-dependent
  Homolog annotation: Hit_ID=Q6H975; Match level="QueryCoverage=95%, HitCoverage=51%, E-value=1e-150, Identity=64%"; Hit description=STY -L protein
  Pfam annotation: Domain name=WD40; Domain location=181-219; Score =29.8; E_value=9.7e-06; Accession=PF00400.22; Description=WD domain, G-beta repeat
  Pfam annotation: Domain name=WD40; Domain location=223-261; Score =33.9; E_value=5.6e-07; Accession=PF00400.22; Description=WD domain, G-beta repeat
  Pfam annotation: Domain name=WD40; Domain location=266-305; Score =29.1; E_value=1.5e-05; Accession=PF00400.22; Description=WD domain, G-beta repeat
  Pfam annotation: Domain name=WD40; Domain location=348-385; Score =34.0; E_value=5.3e-07; Accession=PF00400.22; Description=WD domain, G-beta repeat
  Pfam annotation: Domain name=WD40; Domain location=389-428; Score =3.9; E_value=13; Accession=PF00400.22; Description=WD domain, G-beta repeat
  Pfam module annotation: Pfam domain module=WD40::WD40::WD40::WD40::WD4 0; Domain location=181-219::223-261::266-305::348-385::389-428
MNPKRNSRGAISLQSPDSTLSEIDDATAMAQFLFKVQIQPYQHATDPTIHLPSTTGSFASTTIGAGPANSTGTGNTLGPSNSQPSTPSTHTPGDGVAMAGNLQNVAGISKGLIMYGTDGVGGLASSTNQLDDMEHFGDVGSLEDNVESFLSQDDGDGRDLFGTLKRNPSEHATDASKGFSFSEVGSIRKSNSKVVCCHFSSDGKLLASAGHDKKVVLWNMETLQTESTPEEHSLIITDVRFRPNSTQLATSSFDTTVRLWDAADPTFPLHTYSGHTSHVVSLDFHPKKTELFCSCDNNNEIRFWSISQYSSTRVFKGGSTQVRFQPRLGHLLAAASGSVVSLFDVETDRQMHTLQGHSAEVHCVCWDTNGDYLASVSQESVKVWSLASGECIHELNSSGNMFHSCVFHPSYSTLLVIGGYQKLLGRHKLTHHS

SEQ ID NO: 123913 - protein, 76 aa, Glycine max
  Coding DNA Sequence Number=SeqID_7135
  Homolog annotation: Hit_ID=O48847; Match level="QueryCoverage=85%, HitCoverage=8%, E-value=6e-19, Identity=72%"; Hit description =Expressed protein
  Pfam annotation: Domain name=LisH; Domain location=10-36; Score=39.5; E_value=1.1e-08; Accession=PF08513.1; Description=LisH
MAQSNWEADKMLDVYIYDYLVKKKLHNTAKAFMTEGKVSPDPLFLEYPNSNGFVPCSCTSTGWEIFEVVILATDYS

SEQ ID NO: 123914 - protein, 123 aa, Glycine max
  Coding DNA Sequence Number=SeqID_7136
MEEMNVHIITRGNPYGYIDHIQTLKKRKAKPTNCCTKNTEQENDAGNDHGGDSAKGHLGAVAARPGELKLNPKAVSSPRRASPLALNIFGGPGEPNAGLGELGPMKNKEKTFLHSFSGYLLSS

SEQ ID NO: 123915 - protein, 219 aa, Glycine max
  Coding DNA Sequence Number=SeqID_7137
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=1e-32, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MKRLHALAFRGQHTLAFRGLHGLAFRRLHTLTFRGLLALAFRGLRVLAFRGLHVLTFKGLHALAFRGLHAFAFRGLHALAFSGLPVLAFKGLHVLAFRGLHVLAFRGLHVLSFRGLHILAFRGLHILAFSGLHVLTFRGLNVLAFRVLHVLTFKGLHVLPFRGLHIVTFRGLHTVAFIRLHILAFRGVHVLAFRGLHILAFKGLHICPFGELQVLCLNA

SEQ ID NO: 123916 - protein, 316 aa, Glycine max
  Coding DNA Sequence Number=SeqID_7138
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q9FLD7; Match level="QueryCoverage=67%, HitCoverage=47%, E-value=5e-70, Identity=63%"; Hit description =Glycosylation enzyme-like protein
  Pfam annotation: Domain name=Branch; Domain location=62-273; Score =225.2; E_value=1.5e-64; Accession=PF02485.11; Description=Core-2I -Branching enzyme
  Subcellular localization annotation: CTP_CleavageSite=31; ConfidenceScore=5.50e-01
MISLFSLFFLLLFALTLTPLSATRFFPFPISTATTPPPPYPFVESKLFPLPIPPPSPLPPRLAYLISGSSADASAILRTLSALYHPRNRYVLHLDRDSSPEDRRLLTHQVDRHLTFQKFRNVRVVTKANLVTYRGPTMVANTLHAAAIALTESDDWDWFINLSASDYPLVTQDDLLHAFSHLPRDLNFIDHTSDIGWKDHQRARPIIIDPGLYMTKKQDVFWITQRRSRPTAFKLFTVCVEGLGKSLYTCWMNCKKLTNNFSFRITHIYHEDNACADKLASYGAQSFRGWGGNMVGDANLFCSLSSALSFAKKKKV

SEQ ID NO: 123917 - protein, 188 aa, Glycine max
  Coding DNA Sequence Number=SeqID_7139
  Gene Ontology: Mol. function=acetylglucosaminyltransferase activity; Cellular component=membrane; Biological process=electron transport
  Homolog annotation: Hit_ID=Q9FLD7; Match level="QueryCoverage=97%, HitCoverage=41%, E-value=8e-83, Identity=73%"; Hit description =Glycosylation enzyme-like protein
MRTTHSRSLLGSAPRVPGSAWMVLSRSFIDYCIWGWDNLPRTVLMYYTNFISSPEGYFHTVVCNAQEFKNTTVNSDLHFIAWDNPPRQHPHYLSLDDMKRMVDSNAPFARKFHGDDPVLDKIDAELLSRGPGMVVPGGWCIGSRLNGSDPCSVVGNTTVLRPGPGSKRLETLIKSLLSDENFRPKQCV

SEQ ID NO: 123918 - protein, 499 aa, Glycine max
  Coding DNA Sequence Number=SeqID_7140
  Gene Ontology: Mol. function=nucleoside-triphosphatase activity; Cellular component=membrane; Biological process=response to abscisic acid stimulus
  Homolog annotation: Hit_ID=Q1S4Z7; Match level="QueryCoverage=90%, HitCoverage=87%, E-value=1e-168, Identity=64%"; Hit description=AAA ATPase
  Pfam annotation: Domain name=AAA; Domain location=243-444; Score =54.1; E_value=4.6e-13; Accession=PF00004.19; Description=ATPase family associated with various cellular activities (AAA)
MGSEWSILGTFTATIMIAYTVIDKFVPTHIRSYALIYVHKLIGFLSPYIHITFPEFSGERLQRSELFTAIQTYLIQNSSQRARKLKAEPANDSHNKFLLSMDDNEEITETFQGVKVWWVSNKTMNKSQSISFYPSSDEKRFYTLTFHKRHRDLIASSYITHVLEQGKSLKLKNRQLKLYTNSCHTSWGGYRKSKWSHVVFEHPARFETLAMDKKAKEEIIDDLDTFQNGKEYYKKIGKAWKRGYLLYGPPGTGKSTMIAAMANFMYYDVYDLELTAVKDNTQLRTLLIETTSKSIIVIEDIDCSLDLTGKRVVKKGKEKSEDAKDPVKKTEQEENNNESKVTLSGLLNCIDGIWSGCAGERIIVFTTNYLDKLDPALIRSGRMDKKIELSYCCYEAFKVLAKNYLDVDHHDLFHDVEGLLEKTNMTPADVAENMMPKSKGDNVETCLKKLIESLEKAKKKQEEEARKKEEEEKEQLAMEEAKESDEKAGKEVKENGFVH

SEQ ID NO: 123919 - protein, 247 aa, Glycine max
  Coding DNA Sequence Number=SeqID_7141
  Gene Ontology: Mol. function=nucleoside-triphosphatase activity; Cellular component=membrane; Biological process=response to abscisic acid stimulus
  Homolog annotation: Hit_ID=Q1S520; Match level="QueryCoverage=99%, HitCoverage=47%, E-value=2e-95, Identity=65%"; Hit description=AAA ATPase
MGSLMATIMFVYAMVERFFPAALRDTLQIHTQKVVNLLYPYVQITFPEFSGERLKRSEAYTAIQTYLSENSSQLAKRLKAEVVKDSQNPLVLSMDDDEEVTDEFQGVKLWWAASKTASNPHAYSFSYYSPPDGKRYFKLTFHKKHRDLITISYIKHVLEEGKEIALRNRQRKLYTNNPSSGWYGYKQSKWSHIVFEHPATFETLAMDHRKKEEIINDLVKFRNGKDYYAKIGKAWKRGYLLYGPPGT

SEQ ID NO: 123920 - protein, 87 aa, Glycine max
  Coding DNA Sequence Number=SeqID_7142
MKPHLRQVGHGSKHLNGTRKPEVILIVEPHIPNRKSNKGFGLVSPWKQPSGMEVKLLLLRKTLSNMERFESEGNVPKSALFWREKAG

SEQ ID NO: 123921 - protein, 155 aa, Glycine max
  Coding DNA Sequence Number=SeqID_7143
MGESERATTSPDADSVESSEMITIGEDGGATSSLGQDGSATREYGLVGIGSTCTGQAICSRNCSTNRMDPGEATICRLCIIITCPWNKLCSIVVVIWELWASGPVDADGGAGVDGEGMCRWWRWLWGLSWSGDDDGAGAGDDDAAAAGGSLIIGS

SEQ ID NO: 123922 - protein, 295 aa, Glycine max
  Coding DNA Sequence Number=SeqID_7144
  Subcellular localization annotation: CTP_CleavageSite=48; ConfidenceScore=5.21e-01
MASSSSSILSQSSHSESSRYSLERGPRMCPAHPSSRFFLALSGWLAKPADSLSEKLKFNDRTKHDHVALSAFILLMSFNDELAKRIYALSESPCLRISGRFDRSIFTSQEASDRYSDIVIGRKILHERNVMIYHTEFDEFKKRNWHKELTNFMDGSIDVAILKEFYANFYFPKDKSPKQARVKGHLIKFDEDALNTFLKMIVIIEERESLPAYSRFCRLRPNPQELAARLSIPERGFELNEDGLLLKILRKNLTTLTQTWSILSFSNLAPTSHTSDITLDRARLIYGIIQKMDMN

SEQ ID NO: 123923 - protein, 76 aa, Glycine max
  Coding DNA Sequence Number=SeqID_7145
MGMYACPCCILIFMKNNVLTNGILVSSEDLGSVNLRHELYISKASKIILMMPKIFKKIHSNKIKEIKKIQEKTQDM

SEQ ID NO: 123924 - protein, 157 aa, Glycine max
  Coding DNA Sequence Number=SeqID_7146
MSKNRVLKEHNKTFLNWFKDTIFGDDNGCETLRKLSNDPKRNFITWQGYDINNYSFYTKAQHEKITMQNSGVTQRAESQHFASVHDGNPRVASIPYFGFVATYPMTGVQTKSKGKGAALAPMHPQLLKEASQGSFSKKPHEEASQGSLTRKFLKEAV

SEQ ID NO: 123925 - protein, 98 aa, Glycine max
  Coding DNA Sequence Number=SeqID_7147
KKRCKDKLNLTRNKRRITVTSKKIVKVRLGFILYRNRETSLEDSAPIEGFLSVWGFNGELRRFVVAIGGCGWRRRSLGRWGRVLEERRRKEWLFSKAT

SEQ ID NO: 123926 - protein, 228 aa, Glycine max
  Coding DNA Sequence Number=SeqID_7148
  Gene Ontology: Mol. function=transition metal ion binding; Cellular component=cytoplasm; Biological process=proteolysis
  Pfam annotation: Domain name=Transposase_21; Domain location=144-228; Score=-122.9; E_value=0.00041; Accession=PF02992.5; Description =Transposase family tnp2
MEDRLEDMICDLGQESFQQARACMYDTLQTDSKKPLYPRCNNFLMLLSTVLSLVNVKAKYGWSDKSFSSLLQIVHDMLPDENMLPKSYYQAKKILCPMGIEYKKIHACPNDCILYRHEFEEKRKCPRCGVSRYKVKDNNVCSSEENSKKGPQRRCCAKVHDVIYDEDLKKLWDKGISIFDGFRNETFDLRAMLFCTINDFLVYENLSGYSVKGIVHAPFVKKTQATYN

SEQ ID NO: 123927 - protein, 84 aa, Glycine max
  Coding DNA Sequence Number=SeqID_7149
MGEKDDEFGLSLSLSLGGVNQQQQPPSLNHMHQPQQQQPVPMNHNKTLFGDLFQLPGTSHFFSHLYAIHYDKKDEEHIVMATAI

SEQ ID NO: 123928 - protein, 136 aa, Glycine max
  Coding DNA Sequence Number=SeqID_7150
  Gene Ontology: Mol. function=transcriptional activator activity; Cellular component=nucleus; Biological process=regulation of transcription, DNA-dependent
  Homolog annotation: Hit_ID=Q6I664; Match level="QueryCoverage=44%, HitCoverage=51%, E-value=2e-27, Identity=91%"; Hit description=HD -ZIP protein
  Pfam annotation: Domain name=HALZ; Domain location=30-74; Score=83.7; E_value=5.8e-22; Accession=PF02183.8; Description=Homeobox associated leucine zipper
MGVDVANGTLVVETCYCCYFGLFMLLTKLKQTEVDCEYLKKCCENLTEENRRLHKEVQELRALKLSPQMYMHMNPPTTLTMCPSCERTHSSASSSPATIHSTVAAATSSNCKLLGANIRRPVPVNTWPFEGPIPRP

SEQ ID NO: 123929 - protein, 518 aa, Glycine max
  Coding DNA Sequence Number=SeqID_7151
  Gene Ontology: Mol. function=endopeptidase inhibitor activity; Cellular component=membrane; Biological process=aromatic compound metabolic process
  Homolog annotation: Hit_ID=Q9PDX7; Match level="QueryCoverage=99%, HitCoverage=31%, E-value=0.0, Identity=73%"; Hit description=UPF0192 protein Xf1252 precursor
  Pfam annotation: Domain name=A2M_N_2; Domain location=28-178; Score =113.8; E_value=5e-31; Accession=PF07703.4; Description=Alpha-2 -macroglobulin family N-termina
  Pfam annotation: Domain name=CARDB; Domain location=290-390; Score= -5.3; E_value=0.032; Accession=PF07705.2; Description=CARDB
  Pfam module annotation: Pfam domain module=A2M_N_2::CARDB; Domain location=28-178::290-390
DPSTGLTSRYPFRAGWSWGDDNRGLDARPDKVKLGLDKTGYKAGDTLEVTVTPPHAGKGILMVETDRMLYVQDIEAKPGSTFKIPVTADWERHDVYITALVFRGGSAPSKITPARAVGVVHVPMDRKGRTVAVGLVAPKQMRPEQDLPVTVSAPQLAGKTAHVTVSAVDVGILNITRFPVPDAGAHFFAQRRLGIDAYDIYSRVIESFDGGSGKLKFGGDMALQALPQAKRPTARVQTVDLFSGPVQLDAKGNARIRLKVPDFNGTLRVSALVYSDDQYGKRDVETIVRAPILAEASMPRVLAPGDRSTVTLDVQNFTGKPGQFNVKVESEGPLNLGEGSRSVQLNADAKTTLSFPLSAREGHSVAKVRVRVDGNGFKADRRYDLPVRAAWPQVLRSQVRTLDPLAAVSLDNSLTDGLMAESVNARLLVSPLPPIPFASALQGALNYPYGCAEQTTSKGYAALILDQATSSMLGADGLDAKTRRERMEGAFGRLASMHVANGNFSMWGDDGYVNPWLT

SEQ ID NO: 123930 - protein, 174 aa, Glycine max
  Coding DNA Sequence Number=SeqID_7152
MSSGSEASVEPTILKIDTTIMHTENKPTIYIKHYFDILYLESIGLDTHETFLSCCIRVFRKKVPLSVPTISQVTGFLRKAEEEAFSRFGIANRIIQEQENKKKKERNKHPKTTPTKKEVLRKKKRTKKKHEPIPSSNSPNKHPKTTPTKKSPKKPTEKKTTNQRLRDLSEKVRG

SEQ ID NO: 123931 - protein, 96 aa, Glycine max
  Coding DNA Sequence Number=SeqID_7153
  Gene Ontology: Mol. function=nucleic acid binding; Biological process= DNA integration
  Homolog annotation: Hit_ID=Q1RXW3; Match level="QueryCoverage=97%, HitCoverage=14%, E-value=6e-21, Identity=49%"; Hit description=Zinc finger, CCHC-type
MQDHESIKDMFPRFTTIVNDLNTLGEKYTTHQGIKKILRSLPNIWRPKVISITKAKDLKILAMDEVIGLLNVHEQELIGELQLPNGKAITLKASQS

SEQ ID NO: 123932 - protein, 46 aa, Glycine max
  Coding DNA Sequence Number=SeqID_7154
MENWRTALPNNFAGLQTRRRMENWRKALRNNFAELQTRRWRMHEQR

SEQ ID NO: 123933 - protein, 247 aa, Glycine max
  Coding DNA Sequence Number=SeqID_7155
  Homolog annotation: Hit_ID=Q69V30; Match level="QueryCoverage=88%, HitCoverage=22%, E-value=3e-11, Identity=24%"; Hit description =Hydroxyproline-rich glycoprotein-like
MLTRRTLDQPRPIVTVDAATGRGSGPHKEKFHNYLGDVAREKVPIVHNSWKDVPDTLKELLWNEILAKFDIPEALHAKKKDQHKEDPSVKYGFDAQIWEEFAATRKVPNWQGIRKKMQEIQKNNDCPHLLSRGGYDLLEKKLLDEKMKKRQHDTLMTENPALIEDPLSPIQRHVKWKMARTNQYGKMTSEAARQIADKIVNSNFNLDYNNFNFGLNDSLEEQVTQGEFVPQGRQDILNMAIGRPDHG

SEQ ID NO: 123934 - protein, 82 aa, Glycine max
  Coding DNA Sequence Number=SeqID_7156
MGTNQTGKRFYQVKIKGLDVTSLKELGRLMGPLQMQAFHKAYGKILDLTIAEVFTEAVVSLTQYYDQPLRCFTFGGLPNSTD

SEQ ID NO: 123935 - protein, 913 aa, Glycine max
  Coding DNA Sequence Number=SeqID_7157
  Subcellular localization annotation: CTP_CleavageSite=33; ConfidenceScore=5.45e-01
MADSSPYTKPHFPLSDHSSRIQPKPTNQGKSCSGFILKALLLALFVVVLPLFPSQAPDFMSQTILKKFWELLHLLFIGIAVTYGLFSRRNSELDTTHIELETAHSSADDSTAAPSYVSKVFPASSTIFDDDGCENENGNPCGVDEKRMMMMTHCWNNQYFDGRPGGMCSNGGDTVGVFDEQYKTHLSISEDSFGYSFRCDGNGIGTNEVQAWNSEYYHSEPVVVVAQPNYNAGECGEVVGYKPLGLPVRSLRSVSRDVDSPKYANESDSSSGSRGSSRGSGKSGDREFGDLDPSNLEKKFNDAGGGGGSASPIPWHSRNRRTEREKRHGNVTRPSHFRPLSADETKFEALSSGSWQSTTSFSSLNNMYSSLDSILLDNMNFQEEEMRQKEASYVSASEKMNFQEEDVGQRKTSFVPVSEIMNFQEKDMGSSYVPASENTSFQERHLGKKIFQGSSSRNRKMATKGKYGAASFPSHFRPMSVDETQFDSLGSNSNTFEAVRSFSSNARMHSSLDSISSDMDFQEEDMGQKKTSHMHTSENMNFQEDIGPKKTSYVHDSEIVNFPEEEMEQKKTSYVPASGNMNFQEVDLGKKISEVSSSRNGMIESKGKFGADSPPSHFRPMSVDETQLESLNSRSFQSMGSFSSQSSLCSLLDSALSENMNSPKEDLGEKKSSHGSSSSSPSPLARRNGEASLQAFQARGYTNGSSLLDDIKSSLNGDLRGLNEIEGEDPSGKKELRMQVLQSDSEKPARVAKAPSRGKSVRTRRASGLTSGTMRIGETSSKQTDEKVEKNNKDVESVLRKDKMKSGESDLPLKGVSKKTLDSYCPKPEISFSNHRRRDKLEPSKNLSKQDSDIELDNTRVSSDENRVPECVNDSDLDSEVDKKASEFIAKFKAQIRLQKMGSIERSKEQKIT

SEQ ID NO: 123936 - protein, 204 aa, Glycine max
  Coding DNA Sequence Number=SeqID_7158
MAYISSPAKWERRRPTTSACRQREAAPIAEDVEHVDHATDEVYEQPEKVGVDDLVVDAKGFPGGPHSTSFFMDYIYQVALTVWNEKKCLELKLFSHWRKVEKFDKLAPEIEGLVAAIRLSLLIALGEVTITLDDVASLLHLPIIGAFHSFEDFLVDEVVFLLVEFLEVSSEEARAETVQCHGTYVRISWVETFIVANVAQDSGL

SEQ ID NO: 123937 - protein, 704 aa, Glycine max
  Coding DNA Sequence Number=SeqID_7159
  Gene Ontology: Mol. function=binding; Cellular component=nucleus; Biological process=lateral root development
  Homolog annotation: Hit_ID=O22161; Match level="QueryCoverage=92%, HitCoverage=80%, E-value=0.0, Identity=58%"; Hit description=F-box protein family, AtFBX5
  Pfam annotation: Domain name=Arm; Domain location=388-428; Score=3.7; E_value=4.3; Accession=PF00514.13; Description=Armadillobeta-catenin -like repeat
  Pfam annotation: Domain name=Arm; Domain location=437-477; Score =25.5; E_value=0.00018; Accession=PF00514.13; Description =Armadillobeta-catenin-like repeat
  Pfam annotation: Domain name=Arm; Domain location=478-518; Score =34.2; E_value=4.6e-07; Accession=PF00514.13; Description =Armadillobeta-catenin-like repeat
  Pfam annotation: Domain name=Arm; Domain location=519-569; Score =16.7; E_value=0.086; Accession=PF00514.13; Description=Armadillobeta- catenin-like repeat
  Pfam annotation: Domain name=Arm; Domain location=570-611; Score =36.6; E_value=8.8e-08; Accession=PF00514.13; Description =Armadillobeta-catenin-like repeat
  Pfam annotation: Domain name=Arm; Domain location=616-656; Score =46.5; E_value=9e-11; Accession=PF00514.13; Description=Armadillobeta- catenin-like repeat
  Pfam annotation: Domain name=Arm; Domain location=657-700; Score =34.1; E_value=4.8e-07; Accession=PF00514.13; Description =Armadillobeta-catenin-like repeat
  Pfam annotation: Domain name=F-box; Domain location=90-137; Score =36.8; E_value=7.2e-08; Accession=PF00646.23; Description=F-box domain
  Pfam module annotation: Pfam domain module=Arm::Arm::Arm::Arm::Arm::Ar m::Arm::F-box; Domain location=388-428::437-477::478-518::519 -569::570-611::616-656::657-700::90-137
MGLIYFLASGVGLFCAVGFQGGVIFSNGCWIYFSEAVVWVNCFSGLEIWDMNRRVRRKLARKSKGNVVQSSFPEVQDEVLDLETQRQGVVDWKCLPDDTVIQLLSCLSYRDRASLSSTCKTWRSLGSLPCLWSSLDLRSHRFDAGMASSLAPRCVHLQKLRFRGAESADAIIHLQARNLRELSGDYCRKITDATLSVIVARHEFLESLQLGPDFCERISSDAIKAIAHCCPKLNKLRLSGIRDVNADAINALAKHCSKLTDIGFIDCLNVDEVALGNVLSVRFLSVAGTSSMKWGVVSHLWHKLPNLIGLDVSRTDIGPSALLRMLSLSQNLRVLIALSCPILEEDTSFSASKYKSKTSKNNDKDLNEIIPWLEWMLSHTLLRSAENPQQGLDSFWVEQGGALLLSLMQSSQEDVQERAATGLATFVVIDDENASIDCGRAEAVMRDGGIRLLLGLAKSWREGLQSEAAKAIANLSVNANVAKAVAEEGGIEILAGLARSMNKLVAEEAAGGLWNLSVGEEHKGAIAEAGGIQALVDLIFKWSSSGDGVLVSLSDFMERAAGALANLAADDKCSTEVATAGGVHALVMLARNCKFEGVQEQAARALANLAAHGDSNSNNAAVGQEAGALDALVQLTRSPHEGVRQEAAGALWNLSFDDRNREAIAAAGGVQALVALAQACANASPGLQERAAGALWGLSVSETN

SEQ ID NO: 123938 - protein, 455 aa, Glycine max
  Coding DNA Sequence Number=SeqID_7160
  Gene Ontology: Mol. function=amino acid transporter activity; Cellular component=membrane; Biological process=amino acid transport
  Homolog annotation: Hit_ID=Q6H6H8; Match level="QueryCoverage=77%, HitCoverage=57%, E-value=1e-135, Identity=69%"; Hit description =Amino acid permease-like
  Pfam annotation: Domain name=AA_permease; Domain location=52-446; Score=29.8; E_value=1.6e-06; Accession=PF00324.11; Description=Amino acid permease
  Pfam annotation: Domain name=DUF973; Domain location=199-440; Score= -154.8; E_value=0.07; Accession=PF06157.2; Description=Protein of unknown function (DUF973)
  Pfam annotation: Domain name=Spore_permease; Domain location=47-396; Score=-162.9; E_value=0.025; Accession=PF03845.4; Description=Spore germination protein
  Pfam module annotation: Pfam domain module=AA_permease::DUF973::Spore_ permease; Domain location=52-446::199-440::47-396
  Subcellular localization annotation: CTP_CleavageSite=27; ConfidenceScore=5.47e-01
MRIGSPSSSSSSSGCSRFWSSALRSKRLMSPAEKAARESSDLGLSRRLGVLDLVLLGIGASIGAGIFVVTGTVARDAGPGVTISFILAGASCVINALCYAELATRFPAVVGGAYLYAYTAFNELTAFLVFGQLMLDYHIGAASIARSLASYLINILELFPVFKDNIPKWIGHGEDIGDVLSINVLAPILLVLLTFILCRGVQESSVVNSLMTVTKIIIVIIVIFAGAFEVDVSNWSPFAPNGLKAIFTGATVVFFAYVGFDAVANSAEESKRPQRDLPIGIIGSLLICIALYIGVCLVITGMVPYNLLGEDAPLAEAFSSKGLKFVSILISVGAVAGLTTTLLVGLYVQSRLYLGLGRDGLLPLVFAKVHSKYHTPVHSQIWVGLVASVLAGLFNVHVLSHILSVGTLGNHMVCLDRSILSVCIFLVSASHMINSLISDWLFGCLSMCCRSSLEG

SEQ ID NO: 123939 - protein, 246 aa, Glycine max
  Coding DNA Sequence Number=SeqID_7161
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=99%, HitCoverage=73%, E-value=1e-114, Identity=89%"; Hit description =Ribulose bisphosphate carboxylase large chain precursor
  Pfam annotation: Domain name=RuBisCO_large; Domain location=1-246; Score=396.9; E_value=3.1e-116; Accession=PF00016.10; Description =Ribulose bisphosphate carboxylase large chain, catalytic domain
SVTNMFTSIVGNVFGFKALRALRLEDLRIPTAYIKTFQAIFKSQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGVLPVASGGIHVWHMPALTEIFGDDSVLQFGGGTLGHPWGNAPGAVANRVALEACVQARNEGRDLAREGNEIIREASKWSPELAAACE

SEQ ID NO: 123940 - protein, 110 aa, Glycine max
  Coding DNA Sequence Number=SeqID_7162
  Gene Ontology: Mol. function=hydrogen ion transporter activity; Cellular component=cytosol; Biological process=ATP biosynthetic process
  Homolog annotation: Hit_ID=O82702; Match level="QueryCoverage=93%, HitCoverage=94%, E-value=5e-29, Identity=57%"; Hit description =Vacuolar ATP synthase subunit G 1
  Pfam annotation: Domain name=V-ATPase_G; Domain location=2-109; Score= 174.2; E_value=3.3e-49; Accession=PF03179.5; Description=Vacuolar (H+)-ATPase G subunit
MDPFKGQGGIQMLLIAEQEAQHIVSNARNLRTQRLKQAKDEVEREAAQYRSHMEDEYQKLISENTGSSGSNVKRLEEETDAKIKNLKKSTSKISSEVVDMLLKYVTNIKT

SEQ ID NO: 123941 - protein, 77 aa, Glycine max
  Coding DNA Sequence Number=SeqID_7163
MESSEDSENEEINLCLMAKSYESDEEESLRKKWYIDSGCSKHMMGDESKFTHISPKKNRTCNLWVTTTKVEFLELEK

SEQ ID NO: 123942 - protein, 124 aa, Glycine max
  Coding DNA Sequence Number=SeqID_7164
  Gene Ontology: Mol. function=palmitoyl-(protein) hydrolase activity; Biological process=protein modification process
  Homolog annotation: Hit_ID=Q336S3; Match level="QueryCoverage=94%, HitCoverage=41%, E-value=7e-38, Identity=56%"; Hit description =Palmitoyl protein thioesterase containing protein, expressed
IGDACKHSGIRNFIKELSKWSGSPGYCLEIGNGSWDSWTKPLLKQVKKMSDLGQGYNIVGLSQGNLIGRGIIEFCDGAPPVKNFISLGGPHAGTASIPLCGVCACSTTALRKSLQFLYILFVFC

SEQ ID NO: 123943 - protein, 54 aa, Glycine max
  Coding DNA Sequence Number=SeqID_7165
MEPFIPLYQFNSCFAAACESIILSPPSSMRYECMTTDCESPLVHRPPLEERPPQ

SEQ ID NO: 123944 - protein, 353 aa, Glycine max
  Coding DNA Sequence Number=SeqID_7166
  Homolog annotation: Hit_ID=Q9AVH2; Match level="QueryCoverage=70%, HitCoverage=100%, E-value=1e-75, Identity=55%"; Hit description =Putative senescence-associated protein
MARHKVTRTHTHTHSRRHKGEEGLGREGRIKATRAESQWIVAARPLCHLQYPVAYLSRLQRILPAARWELRFKASRRANPPHEGHQRHVPLGGRCPLLLVGKRTAGARVASSPDSDLEAFSHNPTHGSFAPLGFSTKRDDQLCESTGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPHPNSPPDNVFRPDRPAEADLGSKKRGSAPLPIHGITPTYPTPLKSFHKVGLESSSTGSSFPADSAKPVPLAVVLLDSRQGQWESR

SEQ ID NO: 123945 - protein, 148 aa, Glycine max
  Coding DNA Sequence Number=SeqID_7167
MSLLIEDSALENYLVANIQRLILKDILNTHSSWLQTQEADSSKKYPSGKPTLDKFDDKRIHSSWIFVMVSTRNKKASTTTTTSSPVIEATNSPRMEENVAFMSAQLTELVEMLKQQKVVLEEQHKVIADLRIENDDVQNEHSKSVEDK

SEQ ID NO: 123946 - protein, 79 aa, Glycine max
  Coding DNA Sequence Number=SeqID_7168
MNGTDCAPAKNSASANSSLTTSLGPPTWNLPIAILFYHAHAGLCTPFLPFGNYRSLKIKNGYSVCFLGNYPHAVNLNRR

SEQ ID NO: 123947 - protein, 93 aa, Glycine max
  Coding DNA Sequence Number=SeqID_7169
MIMRGQDIYSSQDEATTSPSSSKSEEAKGEESSEEIYPQEEGQPLMVKEECKEVSVSSKRVPMNPKRIKVIPEWPAPTSVLREGAQSIKNLRI

SEQ ID NO: 123948 - protein, 57 aa, Glycine max
  Coding DNA Sequence Number=SeqID_7170
  Gene Ontology: Mol. function=DNA binding; Cellular component =chromatin; Biological process=DNA integration
  Homolog annotation: Hit_ID=Q1SP23; Match level="QueryCoverage=74%, HitCoverage=11%, E-value=3e-10, Identity=74%"; Hit description =Polynucleotidyl transferase, Ribonuclease H fold
  Subcellular localization annotation: CTP_CleavageSite=15; ConfidenceScore=5.23e-01
MDASTSQGPKNGRMSSSKENYPNFPFSLRHTPLKGPPVTVWSVQFGHQFKDGRLNLV

SEQ ID NO: 123949 - protein, 42 aa, Glycine max
  Coding DNA Sequence Number=SeqID_7171
MVDLAAIYMGMRKRLLHSKQIKLYGLWCVINSRWRLFALLAK

SEQ ID NO: 123950 - protein, 142 aa, Glycine max
  Coding DNA Sequence Number=SeqID_7172
MAKRELPSMPFGKGVGQGSKEWPTRFGVLLNQIWIRRNNFIFDGVLWGDDSKCSILLAEKLMQEIELLSLAKDFRKISVESNSKNVVELVKRGVASNRSRGQLVLMVHRLKEEIEDFRLSRVMCEGNVVAASLAKHDLLFLS

SEQ ID NO: 123951 - protein, 113 aa, Glycine max
  Coding DNA Sequence Number=SeqID_7173
MYQLPRQLAEIVKPMVLNEMQQTKELEVRRVNASENYASSMLINHEVQISFYLVLELAFELNTKLVNIDDESGESYEKEAEIMASKILRSKTYSRPTLKHGEISKIKLEVGVE

SEQ ID NO: 123952 - protein, 164 aa, Glycine max
  Coding DNA Sequence Number=SeqID_7174
  Homolog annotation: Hit_ID=Q1PEU4; Match level="QueryCoverage=46%, HitCoverage=13%, E-value=2e-09, Identity=42%"; Hit description =Pentatricopeptide repeat-containing protein
MKQRALTSGHTRRATLHERGEGVPIGRKRWCLAAKVSEEGEGLRKLASGEVGGDHGVAEEGVAGVGGIEEAARVVNDCERALGGGGEGGTSCDESGEEVEVAVERVSEDEGVDLEKRGDALCSALENVSSNLVLDMNHIQDSRQMVNADIKQWHDKKQKEKFLA

SEQ ID NO: 123953 - protein, 455 aa, Glycine max
  Coding DNA Sequence Number=SeqID_7175
  Gene Ontology: Mol. function=methyltransferase activity; Cellular component=intracellular; Biological process=protein kinase C activation
  Homolog annotation: Hit_ID=Q1PEU4; Match level="QueryCoverage=75%, HitCoverage=96%, E-value=1e-108, Identity=44%"; Hit description =Pentatricopeptide repeat-containing protein
  Pfam annotation: Domain name=PPR; Domain location=139-173; Score =46.4; E_value=9.6e-11; Accession=PF01535.11; Description=PPR repeat
  Pfam annotation: Domain name=PPR; Domain location=174-208; Score =18.3; E_value=0.028; Accession=PF01535.11; Description=PPR repeat
  Pfam annotation: Domain name=PPR; Domain location=209-243; Score=9.2; E_value=0.6; Accession=PF01535.11; Description=PPR repeat
  Pfam annotation: Domain name=PPR; Domain location=38-72; Score=51.2; E_value=3.4e-12; Accession=PF01535.11; Description=PPR repeat
  Pfam module annotation: Pfam domain module=PPR::PPR::PPR::PPR; Domain location=139-173::174-208::209-243::38-72
MRERNVVSWTSMVSGYCGNGDVENAKLMFDLMPEKNVFTWNAMIGGYCQNRRSHDALELFREMQTASVEPNEVTVVCVLPAVADLGALDLGRWIHRFALRKKLDRSARIGTALIDMYAKCGEITKAKLAFEGMTERETASWNALINGFAVNGCAKEALEVFARMIEEGFGPNEVTMIGVLSACNHCGLVEEGRRWFNAMERFGIAPQVEHYGCMVDLLGRAGCLDEAENLIQTMPYDANGIILSSFLFACGYFNDVLRAERVLKEVVKMDEDVAGNYVMLRNLYATRQRWTDVEDVKQMMKKRGTSKEVACSVIEIGGSFIEFAAGDYLHSHLEVIQLTLGQLKLWLFPKVLNNDLQLQCQDLWGLYDCIVATSIAFACTFAISRIATKLQLRQFKTVLFALCNVASTPHQREAFLHILLKFSHSSSHDYSTQLFCTAKEILPRNSTTYQLWDAI

SEQ ID NO: 123954 - protein, 85 aa, Glycine max
  Coding DNA Sequence Number=SeqID_7176
MVLTVTVPQLLSCTAGSIEKEEEDCLELPMHIDDVTVFNDGNGKGVRESVKALMRSLSPPSCRSVDNDAGDEITRQKGRQRFDGG

SEQ ID NO: 123955 - protein, 73 aa, Glycine max
  Coding DNA Sequence Number=SeqID_7177
MDGYIVVYMGPTNMVASLPDWDMLVTFMKEFQERLYHLKVEPYRSLMVYADNHTSFIQMDAAKMERMVEAPVE

SEQ ID NO: 123956 - protein, 277 aa, Glycine max
  Coding DNA Sequence Number=SeqID_7178
  Gene Ontology: Mol. function=metal ion binding; Cellular component =intracellular
  Homolog annotation: Hit_ID=Q8GZ43; Match level="QueryCoverage=97%, HitCoverage=93%, E-value=2e-38, Identity=34%"; Hit description =RanBP2-type zinc-finger protein At1g67325
  Pfam annotation: Domain name=zf-RanBP; Domain location=173-204; Score= 22.4; E_value=0.0016; Accession=PF00641.9; Description=Zn-finger in Ran binding protein and others
  Pfam annotation: Domain name=zf-RanBP; Domain location=24-55; Score =32.6; E_value=1.4e-06; Accession=PF00641.9; Description=Zn-finger in Ran binding protein and others
  Pfam annotation: Domain name=zf-RanBP; Domain location=244-275; Score= 18.8; E_value=0.0047; Accession=PF00641.9; Description=Zn-finger in Ran binding protein and others
  Pfam module annotation: Pfam domain module=zf-RanBP::zf-RanBP::zf -RanBP; Domain location=173-204::24-55::244-275
  Subcellular localization annotation: CTP_CleavageSite=43; ConfidenceScore=5.15e-01
MASTKVNNRGSPGSKRFRNDASRKDGDWTCPNCGNLNFSFRTVCNQGRCGAPRPPLTPPAPIISPYRNSHPFYYGGVGIPPPSYGMPSQFGSPIPHPGIQYDYGLYARARAPYSPLPMFPPASFGGINYGPRPRIDGYGYGYGFQSPPPPWVEGLIADNFASRKRRGGPDGLFEGDWICPKCDNVNFSFRTTCNIKHCGVVKPEMMNLGGNQGSQRPTPFSPLLLCLPPSLKMNTNKPNAAVVPEGSWTCEKCSNLNYPFRNVCNRKDCRTEKTVSA

SEQ ID NO: 123957 - protein, 286 aa, Glycine max
  Coding DNA Sequence Number=SeqID_7179
  Gene Ontology: Mol. function=galactosyltransferase activity; Cellular component=Golgi stack; Biological process=regulation of transcription, DNA-dependent
  Homolog annotation: Hit_ID=Q2R1F4; Match level="QueryCoverage=68%, HitCoverage=61%, E-value=5e-32, Identity=33%"; Hit description =Pentatricopeptide, putative, expressed
  Pfam annotation: Domain name=PPR; Domain location=162-196; Score =20.9; E_value=0.0044; Accession=PF01535.11; Description=PPR repeat
  Pfam annotation: Domain name=PPR; Domain location=197-231; Score =17.0; E_value=0.07; Accession=PF01535.11; Description=PPR repeat
  Pfam annotation: Domain name=PPR; Domain location=232-266; Score =30.1; E_value=8e-06; Accession=PF01535.11; Description=PPR repeat
  Pfam module annotation: Pfam domain module=PPR::PPR::PPR; Domain location=162-196::197-231::232-266
MGKEASLYSPNETTPLKCLEMQGEVNTLFMLSYVILITHASPHKLTSLFILRTKTLTHITSPSCVQSTVTRVCSLVYDSYHHHYNHARFSPPTLHLDVDPNSLTHDQAVTIVASLASDAGSMVALSFFNWAIASSKFRHFTRLYIACAASLISNKNFEKAHEVMQCMVKSFAEIGRVKEAIEMVIEMHNQGLAPSTKTLNWVVKIVTEMGLVEYAENLFDEMCARGVQPNCVSYRVMVVGYCKLGNVLESDRWLGGMIERGFVVDNATLSLIVREFCEKGFVTRAL

SEQ ID NO: 123958 - protein, 254 aa, Glycine max
  Coding DNA Sequence Number=SeqID_7180
MALPGKHYVAPSYKDVKDLFEKWKETNKEDQKKMFTKFINENVNLNKADESMLITAIVAPPAAMMAKKAGQVVPQLALMNAIPDVVFVPSATLLALIAIKIIKLTFIGNTTSKDTESNVQPTPKQKLPTTTAFEKEPQIATAPTTEQEPQPTTAIEAEPQIATKQEPQTTTTIEEPRIATEQEPQTTTAPAIEEEPQTTALAATPVEEEPQTTTAPSYIPRHVHKDNIICPLCEELIAKAKKEAKRSDAVALKT

SEQ ID NO: 123959 - protein, 182 aa, Glycine max
  Coding DNA Sequence Number=SeqID_7181
  Gene Ontology: Mol. function=galactosyltransferase activity; Cellular component=Golgi stack; Biological process=metabolic process
  Homolog annotation: Hit_ID=Q2R1F4; Match level="QueryCoverage=96%, HitCoverage=53%, E-value=1e-58, Identity=36%"; Hit description =Pentatricopeptide, putative, expressed
  Pfam annotation: Domain name=PPR; Domain location=114-148; Score =13.1; E_value=0.21; Accession=PF01535.11; Description=PPR repeat
  Pfam annotation: Domain name=PPR; Domain location=43-77; Score=24.0; E_value=0.00053; Accession=PF01535.11; Description=PPR repeat
  Pfam annotation: Domain name=PPR; Domain location=79-113; Score=46.1; E_value=1.2e-10; Accession=PF01535.11; Description=PPR repeat
  Pfam annotation: Domain name=PPR; Domain location=8-42; Score=42.3; E_ value=1.6e-09; Accession=PF01535.11; Description=PPR repeat
  Pfam module annotation: Pfam domain module=PPR::PPR::PPR::PPR; Domain location=114-148::43-77::79-113::8-42
MGLGPNLINFTCMIEGLCKRGSMKQAFEMLEEMVGRGWKPNVYTHTALIDGLCKKRWTDKAFRLFLMLVRSENHKPNVLMYTAMISGYCRDEKMNRAEMLLSRMKEQGLVPNTNTYTTLVDGHCKAGNFERVYELMNEEGSSPNVCTYNAIVDGLCNKRLTRCLRVGLVMGCKLIKLLILFS

SEQ ID NO: 123960 - protein, 151 aa, Glycine max
  Coding DNA Sequence Number=SeqID_7182
  Gene Ontology: Mol. function=transcription factor activity; Cellular component=nucleolus; Biological process=regulation of transcription, DNA-dependent
  Homolog annotation: Hit_ID=Q8LLR3; Match level="QueryCoverage=42%, HitCoverage=32%, E-value=3e-23, Identity=78%"; Hit description =Ethylene-responsive element binding protein 1
  Pfam annotation: Domain name=AP2; Domain location=50-114; Score =125.6; E_value=1.4e-34; Accession=PF00847.10; Description=AP2 domain
MDNYYDATTATTESDMTLSDLIQHYMHDDEANALNNNVEGAKAQKEVPKWTRYKGVRRRAHGKFAAEITDPNKNGRVWLGTYDTEEEAALAYDNAAFKIRGSKSKLNFPHLIPPKLPLDASIASSQMSDPPSSSSTFEDGLEGSKKTKGIA

SEQ ID NO: 123961 - protein, 67 aa, Glycine max
  Coding DNA Sequence Number=SeqID_7183
  Subcellular localization annotation: CTP_CleavageSite=46; ConfidenceScore=5.02e-01
MTISDSFIVGFSCNLSTRKKNKSYEDNTNGGFNPFSVSLTFENSIGAVEGKKLEESQGTARDAAIAG

SEQ ID NO: 123962 - protein, 269 aa, Glycine max
  Coding DNA Sequence Number=SeqID_7184
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-39, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAIKGLQVLNFGGLHALTFRGLHVLAFRGLHVLAFRGLQVLAFRGLHALTLRGLQALAVRGLQLQTLSGPHVLTLRRLHALAFRGLHVLAFRGLHALAFRGLHVLAFRGLHVLAFRGLHVLNFRELHVLAFRGLHVHAFRGLHILPFRGLHVLAVRGLHVLAFRGLHVLNFRGQHILAFRRLHVHAISGLYILSFRGLHFLDIRGLHVLAFRGLHVLAFRGLRVLPVRGLHVLAFIGLHTLTLRATCPPLKRTTCPRRQRTTPTNP

SEQ ID NO: 123963 - protein, 96 aa, Glycine max
  Coding DNA Sequence Number=SeqID_7185
LDREEKLMDIGSRNFFLCPRKCGGNGDEGSGTTPFGSCSREADKTNKGGAFGPVPGDVKDCTSSVEVSLFCYIVKKKLQGIEASFTPSYKLRQQLT

SEQ ID NO: 123964 - protein, 121 aa, Glycine max
  Coding DNA Sequence Number=SeqID_7186
  Homolog annotation: Hit_ID=Q6Z856; Match level="QueryCoverage=95%, HitCoverage=29%, E-value=3e-19, Identity=44%"; Hit description=Kelch repeat containing F-box protein family-like
MFEVVGSRIRSVEQYEVGRDQWVPMENLPGFRAECVGFVEEEGREFWVMGGYGESKTISGVFSMDEYYKDAVVMGVESGAWREVGDMGGNGERVRVGKIVVVEYNGCPMIFMLDGNEILSS

SEQ ID NO: 123965 - protein, 368 aa, Glycine max
  Coding DNA Sequence Number=SeqID_7187
  Homolog annotation: Hit_ID=Q1RVR4; Match level="QueryCoverage=38%, HitCoverage=46%, E-value=1e-14, Identity=30%"; Hit description =Peptidase aspartic, active site; Aldehyde dehydrogenase
  Pfam annotation: Domain name=RVP_2; Domain location=231-330; Score= -42.7; E_value=0.0021; Accession=PF08284.2; Description=Retroviral aspartyl protease
MEAKVAVLENEVTSIKDALQALNLEVDVNQDKLIALLTKRIEDVGGDTFGVKTMSEIVTKNSEIARLKKHQGESLDEFYQLVKKVELSLFNGDDPAGWITRVELKVELIERYGGIKEGDVFKQLASLQQLGSVEEYIQEFERLTSQHASFGTTIEVEVIECGTRSGVRATRTMRKYTVEQWDPKPFWIGFLSSGKEMHDKGHSGPRHEDQKEGGTQGLRDAKDEGEVKMLAESEGKKAKADGVPILILLDSGATHNFISKTMMSTMGAMVQGQCRGLEVVMGDVSVKVDALLFKLEGIDMVLGMAWLASLGGMWVNWKEQVIKLQLAKKCVELRRELSWNITQDALQIFFSEPKRAGEMQAPKSEKGC

SEQ ID NO: 123966 - protein, 127 aa, Glycine max
  Coding DNA Sequence Number=SeqID_7188
  Gene Ontology: Mol. function=identical protein binding; Cellular component=cellulose and pectin-containing cell wall; Biological process=negative regulation of enzyme activity
  Homolog annotation: Hit_ID=Q1SX60; Match level="QueryCoverage=87%, HitCoverage=54%, E-value=5e-41, Identity=73%"; Hit description =Proteinase inhibitor, propeptide
  Pfam annotation: Domain name=Subtilisin_N; Domain location=2-86; Score=62.7; E_value=1.2e-15; Accession=PF05922.7; Description =Subtilisin N-terminal Region
CYIVYLGAHSHGPSPTSLDLEIASHSHYDLLASVLGSEEKAKEAIIYSYNKHINGLAALLEEEEAADIAKNPNVVSVFLSKEHKLLTTRSWEFLGLDSNNKDSAWQKGRFGENTIIGNIDTDNILYQ

SEQ ID NO: 123967 - protein, 74 aa, Glycine max
  Coding DNA Sequence Number=SeqID_7189
  Subcellular localization annotation: CTP_CleavageSite=46; ConfidenceScore=5.14e-01
MTVAPASSLQGMLSGEKAVWQRKRGGSHTAPTVKVTLYSRPVWGCPCERNMNIVCIVSAFQHIRFFYALHCFKH

SEQ ID NO: 123968 - protein, 167 aa, Glycine max
  Coding DNA Sequence Number=SeqID_7190
  Gene Ontology: Cellular component=signalosome complex; Biological process=red or far red light signaling pathway
  Homolog annotation: Hit_ID=Q94JU3; Match level="QueryCoverage=77%, HitCoverage=45%, E-value=8e-29, Identity=51%"; Hit description=COP9 signalosome complex subunit 7
MDGMVYKENYRGKEESSDEREIETLKMEKKQSEVMEQLVKQASASPNANALTSILVQATSHPNVFSFSQFLALPNLLQYLVSAISVADFFELEATENSTYLDMLRLFAHGTWSDYKSNADCFPQLIPDQILKLKQLTVLTLAETYKDCLVEVILINNTLKFLPGIAV

SEQ ID NO: 123969 - protein, 976 aa, Glycine max
  Coding DNA Sequence Number=SeqID_7191
  Gene Ontology: Mol. function=protein-tyrosine kinase activity; Cellular component=integral to membrane; Biological process=protein amino acid phosphorylation
  Homolog annotation: Hit_ID=Q1SX58; Match level="QueryCoverage=99%, HitCoverage=98%, E-value=0.0, Identity=62%"; Hit description =Tyrosine protein kinase, active site
  Pfam annotation: Domain name=LRRNT_2; Domain location=3-42; Score =42.4; E_value=1.6e-09; Accession=PF08263.3; Description=Leucine rich repeat N-terminal domain
  Pfam annotation: Domain name=LRR_1; Domain location=108-130; Score =9.3; E_value=5.2; Accession=PF00560.23; Description=Leucine Rich Repeat
  Pfam annotation: Domain name=LRR_1; Domain location=132-154; Score =18.4; E_value=0.026; Accession=PF00560.23; Description=Leucine Rich Repeat
  Pfam annotation: Domain name=LRR_1; Domain location=156-178; Score =17.6; E_value=0.045; Accession=PF00560.23; Description=Leucine Rich Repeat
  Pfam annotation: Domain name=LRR_1; Domain location=180-202; Score =16.4; E_value=0.11; Accession=PF00560.23; Description=Leucine Rich Repeat
  Pfam annotation: Domain name=LRR_1; Domain location=204-226; Score =14.2; E_value=0.48; Accession=PF00560.23; Description=Leucine Rich Repeat
  Pfam annotation: Domain name=LRR_1; Domain location=228-250; Score =13.5; E_value=0.79; Accession=PF00560.23; Description=Leucine Rich Repeat
  Pfam annotation: Domain name=LRR_1; Domain location=252-274; Score =16.5; E_value=0.094; Accession=PF00560.23; Description=Leucine Rich Repeat
  Pfam annotation: Domain name=LRR_1; Domain location=276-298; Score =10.4; E_value=3.2; Accession=PF00560.23; Description=Leucine Rich Repeat
  Pfam annotation: Domain name=LRR_1; Domain location=324-346; Score =9.1; E_value=5.6; Accession=PF00560.23; Description=Leucine Rich Repeat
  Pfam annotation: Domain name=LRR_1; Domain location=348-370; Score =10.9; E_value=2.6; Accession=PF00560.23; Description=Leucine Rich Repeat
  Pfam annotation: Domain name=LRR_1; Domain location=372-394; Score =13.8; E_value=0.64; Accession=PF00560.23; Description=Leucine Rich Repeat
  Pfam annotation: Domain name=LRR_1; Domain location=396-418; Score =7.2; E_value=13; Accession=PF00560.23; Description=Leucine Rich Repeat
  Pfam annotation: Domain name=LRR_1; Domain location=420-442; Score =11.5; E_value=2; Accession=PF00560.23; Description=Leucine Rich Repeat
  Pfam annotation: Domain name=LRR_1; Domain location=444-466; Score =11.3; E_value=2.2; Accession=PF00560.23; Description=Leucine Rich Repeat
  Pfam annotation: Domain name=LRR_1; Domain location=468-490; Score =17.1; E_value=0.065; Accession=PF00560.23; Description=Leucine Rich Repeat
  Pfam annotation: Domain name=LRR_1; Domain location=492-511; Score =14.0; E_value=0.56; Accession=PF00560.23; Description=Leucine Rich Repeat
  Pfam annotation: Domain name=LRR_1; Domain location=514-536; Score =19.9; E_value=0.0089; Accession=PF00560.23; Description=Leucine Rich Repeat
  Pfam annotation: Domain name=LRR_1; Domain location=538-557; Score =12.3; E_value=1.4; Accession=PF00560.23; Description=Leucine Rich Repeat
  Pfam annotation: Domain name=LRR_1; Domain location=560-581; Score =9.6; E_value=4.5; Accession=PF00560.23; Description=Leucine Rich Repeat
  Pfam annotation: Domain name=LRR_1; Domain location=71-93; Score =10.1; E_value=3.6; Accession=PF00560.23; Description=Leucine Rich Repeat
  Pfam annotation: Domain name=Pkinase; Domain location=684-956; Score =130.9; E_value=3.4e-36; Accession=PF00069.15; Description=Protein kinase domain
  Pfam annotation: Domain name=Pkinase_Tyr; Domain location=678-956; Score=72.5; E_value=1.3e-18; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::Pkinase::Pkinase _Tyr; ...
  Pfam module annotation: Pfam domain module=Domain location=3-42::108 -130::132-154::156-178::180-202::204-226::228-250::252-274::276 -298::324-346::348-370::372-394::396-418::420-442::444-466::468 -490::492-511::514-536::...
  Pfam module annotation: =538-557::560-581::71-93::684-956::678-956
AAEDSEANALLKWKQSFDNYSQGLLSTWRGNSPCRWQGIQCDKSNSVSNIDLPFYGLKGTLHTLNFSSFPNLLGLNIYNNSFSGTIPPQIGSNNFSSHIPPGIGKLHKLEFLGIAGSKLSGSIPQEIGMLANLTYIDLSRNSLSGTIPETIGNMSNLNILVLSNNSLSGPIPPSIWNMSNLTLLYLDANKLSGSIPASIENLANIEHLALDRNHLSGSIPSTIGNLTKLIELYLLFNNLSGSIPPSIGNLINLNVLSLQANNLSGTIPPTFGNLKMLTILELSTNKLNGSIPQGLNNITNWYSLLLAENDFTGHLPPQVCSAGTLVYFNAFGNRFTGSVPKSLKNCSSIERIRLEGNQLEGDIAQDFGVYPNLEYIDLSDNKFHGHISPNWGKCHILETLKISNNNISGGIPIELVEATKLGVLHLSSNHLNGKLPNELGNMKSLFQLKISNNQLSGNIPTEIGLLQNLEDLDLGNNELSGTIPKEVGELHKLRNLNLSKNKIEGSIPSKFSQSLESLDLSGNLLSGTIPTNLGGLQSLFMLNLSHNSLSGTIPSTFSRMLSIVNISDNQLEGPLPNIPAFLDASIESLKNNKGLCGNVTGLVLCPTSHNRKSNKVILVVFLSLGALLLVLCGVGLSMYILCRSKRKGKSHSNSEEAQKDVLFSIWSYDGKIMFENIIKATESFDDKYLIGAGSQGYVYKVVLPSGLVVAVKKLHSVIDEEMSDFSSKAFASEIQALTEIKHRNIIKLHGFCSHSQVSFLVYEFMQGGSLDQMLKNDTQAIAFDWEKRVNVVKGVANALSYLHHDCSSPIVHRDISSKNVLLDLEYEAHVSDFGTAKFLKPSSDSWTQFAGTFGYAAPELAQTMEVNEKCDVFSFGVLALEIIMGKHPRDIISQLMSPSMAPTINDLLLSEVLDQRPPQPTKVIDGEVILIVRLALACLSENPRSRPTMDQVSKAFGTGKSPLDDQFPMIRLGQLR

SEQ ID NO: 123970 - protein, 96 aa, Glycine max
  Coding DNA Sequence Number=SeqID_7192
MERHGKVGMVESRKGEGRVLVYFRRWIPCRIYKSGSKFLFSLWVFLSEEKTIKQEPLGFSAKPSKWKTKIQKNRLEKNPKINGERTKHMKNQNAEG

SEQ ID NO: 123971 - protein, 209 aa, Glycine max
  Coding DNA Sequence Number=SeqID_7193
  Homolog annotation: Hit_ID=Q56XC8; Match level="QueryCoverage=80%, HitCoverage=36%, E-value=7e-25, Identity=37%"; Hit description=BZIP like protein
TPSHYSHKTQQRTNTQIHDTDSERSEYDFFDGKHETENEKTDSHHLPEEYTETEREEVQCSEWGDHYSTTSSSDDDGVEGDVESRSEIGTRSNFGSSVRAESVVGVGGGGGAKRFDAASSVAAAEMKMVVRHRDLREIVEAIKENFDNAASAGDQVSEMLEISRAQLDRSFKQLRSMFSTKFPFLKFLNTLVFAASVLLSESEFYLILI

SEQ ID NO: 123972 - protein, 129 aa, Glycine max
  Coding DNA Sequence Number=SeqID_7194
  Gene Ontology: Cellular component=cytoskeleton; Biological process =phagocytosis
  Homolog annotation: Hit_ID=O80516; Match level="QueryCoverage=76%, HitCoverage=37%, E-value=2e-43, Identity=81%"; Hit description =Expressed protein
MNKASLLGGTMIETKQVDSIMIKAKTTLPSAEFVTGSTAWLGRGLSCVCAQRRESDARPSFDLTPAQEECLQRLQNRIDIPYDGSIPEHQDALRALWSAAFPEEELHGLISEQWKNMGWQGKDPSTDFR

SEQ ID NO: 123973 - protein, 49 aa, Glycine max
  Coding DNA Sequence Number=SeqID_7195
MKVDTITPLATTQIHPRMNALPLSSKSSVCFKDELSHVIIQNSQYRYAC

SEQ ID NO: 123974 - protein, 93 aa, Glycine max
  Coding DNA Sequence Number=SeqID_7196
MALPLHRSIRLPTVVLHRRAETASDFTPLSRNLKKGKRAEVDKLAALEAAELLSSNRSQVNSQAVEAKSSAVKEQDSYEEVANLLKTKGTFVC

SEQ ID NO: 123975 - protein, 114 aa, Glycine max
  Coding DNA Sequence Number=SeqID_7197
  Gene Ontology: Cellular component=cytoskeleton; Biological process =phagocytosis
  Homolog annotation: Hit_ID=O80516; Match level="QueryCoverage=97%, HitCoverage=33%, E-value=4e-28, Identity=78%"; Hit description =Expressed protein
  Pfam annotation: Domain name=ELMO_CED12; Domain location=1-94; Score=- 2.5; E_value=0.00047; Accession=PF04727.4; Description=ELMOCED-12 family
  Subcellular localization annotation: CTP_CleavageSite=25; ConfidenceScore=5.13e-01
MLSVTNAFLHSQTSDTGGSNFPKISCSLDGKQGGRNLTITKWKNVTKVLENDSAFDLLYCITFKMMDQQWLSMRASYMDFNTVMKSTRRQLEKELLLEDIMRLEDVPSYKLLTR

SEQ ID NO: 123976 - protein, 193 aa, Glycine max
  Coding DNA Sequence Number=SeqID_7198
MDMNGHERASIESGKFHPAHGMCGRIDMCKLQNANCTLVTCWSWVRIRKQPLCICKGKAAYNIPLPYLRITKSLRAMGEMGNGKFYPTRRTSDRRSAKNNTQEQLIGRVTYRQLILHCNGMCVLGYAMGELKTCALSSLNSVCAVYFMNFEEGLWRAYILRELMTNIYTHGVVLCPFLYLNGQPLPTLNAAKL

SEQ ID NO: 123977 - protein, 56 aa, Glycine max
  Coding DNA Sequence Number=SeqID_7199
MNQSQLCGKFGHSADNFWYRFDGDFNGPIRSSQQQIRRSSSKVHLRMESDFLRFRS

SEQ ID NO: 123978 - protein, 264 aa, Glycine max
  Coding DNA Sequence Number=SeqID_7200
  Gene Ontology: Mol. function=nucleic acid binding
  Homolog annotation: Hit_ID=Q1SUT7; Match level="QueryCoverage=89%, HitCoverage=43%, E-value=7e-78, Identity=60%"; Hit description=RNA -binding region RNP-1 (RNA recognition motif); WW/Rsp5/WWP
  Pfam annotation: Domain name=WW; Domain location=180-209; Score=34.1; E_value=5e-07; Accession=PF00397.16; Description=WW domain
  Subcellular localization annotation: CTP_CleavageSite=26; ConfidenceScore=5.32e-01
MNGGLNGLGFVYRKAQKGIVFTFYSRASFFRGNFLSVNANFGPCSQEPAVWPLPNFGDSNNGGIILPHAPYHSSIAHPQVTSHMQNWEPGATVLQHPFPPQQVHPHVASMPLGSIQAPKLSSQPFITEVPRQSHPADSSVQNIEQQLSSQLPSQTESNPSTVTGITLPDMPTSPQDEDFPECDWSEHYCPDGDKYYYNCITCESRWDKPEEYALYEKESQKQQEREDNCCSLSQLSLSSSQLVGQKQQETDHDHKQSETIPVVG

SEQ ID NO: 123979 - protein, 169 aa, Glycine max
  Coding DNA Sequence Number=SeqID_7201
  Gene Ontology: Mol. function=nucleic acid binding; Cellular component= ribonucleoprotein complex; Biological process=multicellular organismal development
  Homolog annotation: Hit_ID=Q1SUT7; Match level="QueryCoverage=85%, HitCoverage=32%, E-value=2e-39, Identity=51%"; Hit description=RNA -binding region RNP-1 (RNA recognition motif); WW/Rsp5/WWP
  Pfam annotation: Domain name=RRM_1; Domain location=49-121; Score =63.2; E_value=8.6e-16; Accession=PF00076.12; Description=RNA recognition motif. (a.k.a. RRM, R
MENNPKEQAEQQRVNFNGDPHIHDNGNVFHHFQPTPAVDSDQVDVSCKVYVAPVPRTATEDEICTVFEEHGTIVEIVLLKHKKTGTRQGSCFVKYATFDEADRAIKALNNKYTFAGESYPVVVKFADRELERLGVRGFCRNMEKKDPLEGKLLIFFQDRCCLLFDYMIV

SEQ ID NO: 123980 - protein, 376 aa, Glycine max
  Coding DNA Sequence Number=SeqID_7202
  Gene Ontology: Mol. function=nucleic acid binding
  Homolog annotation: Hit_ID=Q1SUT8; Match level="QueryCoverage=71%, HitCoverage=94%, E-value=1e-109, Identity=72%"; Hit description=Zinc finger, CCHC-type
  Pfam annotation: Domain name=zf-CCHC; Domain location=88-105; Score =12.4; E_value=0.0088; Accession=PF00098.13; Description=Zinc knuckle
MANRPDPDIDDDFRELYKEYTGPLGTATTNMQERAKSNKRSNAGSDEEEEARDPNAVPTDFTSREAKVWEAKSKATERNWKKRKEEEMICKLCGESGHFTQGCPSTLGANRKSQDFFERIPARDKNVRALFTEKVLSKIEKDVGCKIKMDEKFIIVSGKDRLILAKGVDAVHKIREEGDQRGSSSSQMTQSRSPERSPVSARFQRSEPQRSHSGPRNTSQFQQRFGRQERAVEDRIRDDVQKFSRGSPQGRDSIGYVYSILRKPQECLTYSSFPEAYGNSGARGRSSQSRSPRHAPYTGNSYNSFDDRNQNMGAYRNEGWDSHRRESGIQPGHQFDYNASPQTLEELELEYKNEATELMKIRDREEDEENFKHREV

SEQ ID NO: 123981 - protein, 327 aa, Glycine max
  Coding DNA Sequence Number=SeqID_7203
  Gene Ontology: Mol. function=protein serine/threonine kinase activity; Cellular component=cytoplasm; Biological process=protein amino acid phosphorylation
  Homolog annotation: Hit_ID=Q5I6E9; Match level="QueryCoverage=86%, HitCoverage=39%, E-value=1e-132, Identity=82%"; Hit description =AvrPto-dependent Pto-interacting protein 3
  Pfam annotation: Domain name=Pkinase; Domain location=2-258; Score =41.6; E_value=4.8e-11; Accession=PF00069.15; Description=Protein kinase domain
  Pfam annotation: Domain name=Pkinase_Tyr; Domain location=5-252; Score=-155.1; E_value=0.0059; Accession=PF07714.7; Description =Protein tyrosine kinase
  Pfam module annotation: Pfam domain module=Pkinase::Pkinase_Tyr; Domain location=2-258::5-252
MESGFSLKSETRGRCQNNPIYYIIELTNIFYAAEVLLALEYLHMLGVVYRDLKPENVLVRDDGHIMLSDFDLSLRCAVSPTLIRNFDSDPSKRGGGAFCVQPACIEPSSVCIQPSCFMPRLFAQKNKKSRKPKGDPGLPSSTLPELVAEPTTARSMSFVGTHEYLAPEIIKGEGHGSAVDWWTFGIFLHELLYGKTPFKGSGNRATLFNVVGQQLRFPESPATSYASRDLIRGLLVKEPQHRLGVKRGATEIKQHPFFEGVNWALIRCSTPPEVPRPVEFDPPAKFEPVDTVGVGNNNINNNNSSKRMVGNNNDMKSGGKYLDFEFF

SEQ ID NO: 123982 - protein, 182 aa, Glycine max
  Coding DNA Sequence Number=SeqID_7204
  Subcellular localization annotation: CTP_CleavageSite=48; ConfidenceScore=5.16e-01
MDRARLIFGLVSQLDMNVGALISGQITSMAQSNSSRLGFPALITALCRSRGVASDSLVFERLIPVINLAYIRKNYWNPTDLTVTIRGARRARARPVEAPSTFAAPPPAPWPETQPPLHREDEGLTAQVPQQREDESSETSMPKPLIRRKRVVETQEAAATSKKSLEDTAEPSEPVANTTSIQ

SEQ ID NO: 123983 - protein, 891 aa, Glycine max
  Coding DNA Sequence Number=SeqID_7205
  Gene Ontology: Mol. function=double-stranded RNA binding; Cellular component=intracellular
  Homolog annotation: Hit_ID=Q5YDB6; Match level="QueryCoverage=98%, HitCoverage=88%, E-value=0.0, Identity=56%"; Hit description=C -terminal domain phosphatase-like 1
  Pfam annotation: Domain name=dsrm; Domain location=637-700; Score =41.6; E_value=2.7e-09; Accession=PF00035.15; Description=Double -stranded RNA binding motif
  Pfam annotation: Domain name=dsrm; Domain location=772-840; Score =41.8; E_value=2.3e-09; Accession=PF00035.15; Description=Double -stranded RNA binding motif
  Pfam module annotation: Pfam domain module=dsrm::dsrm; Domain location=637-700::772-840
MPLRGEEIHLVAMYSRNNDRPCFWGFIVASGLYNSCLTMLNLRCLGIVFDLDETLVVANTMRSFEDKIEVLHRKMNSEVNPQRISTMQAEIKRYLDDKNILKEYAENDQVVDNGKVIKIQSEIVPALSDSHQPIVRPLIRLQEKNIILTRINPQFLVIKTCRLFRIIGLTMTCVFGKIRDTSVLVRLRPAWEDLRSYLTARGRKRFEVFVCTMAERDYALEMWRLLDPELNLINSKELLDRIVCVKSGLKKSLFNVFQNGLCHLKMALVIDDRLKVWDEKDQPQVHVVPAFAPYYAPQAEASNAVPTLCLARSVACNVRGGFFKDFDDGLLQKIPLIAYEDDIKDIPSPPDVSNYLVSEDDASASNGNKNLLLFDGMADAEVERRLKDAISASSTVPAMTTNLDPRLAFNSSLQYTMVSSSGTVPPPTAQASIVQFGNVQFPQPNTLVKPICQVTPPGPSLHSSPAREEGEVPESELDLDTRRRLLILQHGQDTREHTSSEPPLPVRHPTQVSAPSVPSRRGWFSVEEEMGPQQLNQLVPKEFPVGSEPLHIEKRWPRHPSLFSKVDDSVSSDRVFHESHQRLPKEVHHRDDHSRLSQSLSSYHSFPGDDIPLSGSSYSNRDFDSESGRSLFHADITAGVLQEIALKCGTKVEFLSSLVASTALQFSIEAWFAGKKVGEGFGRTRREAQNKAAECSIKQLADIYMSHAKDDSGSTYGDVSGFHGSNNNGFVSSGNSLGNQLLPKESVSFSTSSDSSRVSDPRLEVSKRSTDSISALKEFCMMEGLAANFQSSPAPASTHFAQKDEVHAQVEIDGQIFGKGFGLTWEEAKMQAAKKALESLRTMFNQGTRKRHGSPRSMQGLANKRLKQEYPRTLQRIPYSARYPRNAPLVP

SEQ ID NO: 123984 - protein, 81 aa, Glycine max
  Coding DNA Sequence Number=SeqID_7206
  Gene Ontology: Mol. function=metal ion binding
  Homolog annotation: Hit_ID=Q1RSL7; Match level="QueryCoverage=84%, HitCoverage=17%, E-value=5e-26, Identity=79%"; Hit description=WD40 -like
MYYFALIGVWPKYFNSEWSVAQFHLQEGSHYTVAFGLQKNTVIILGMDGSFYRCQFDPVRGGEMTQLEHRNFLKPEPETAL

SEQ ID NO: 123985 - protein, 245 aa, Glycine max
  Coding DNA Sequence Number=SeqID_7207
  Gene Ontology: Mol. function=galactosyltransferase activity; Cellular component=Golgi stack
  Homolog annotation: Hit_ID=Q2HUE1; Match level="QueryCoverage=60%, HitCoverage=53%, E-value=4e-43, Identity=60%"; Hit description =Glycosyltransferase sugar-binding region containing DXD motif; Alpha 1,4-glycosyltransferase conserved region
  Pfam annotation: Domain name=Gly_transf_sug; Domain location=152-244; Score=62.6; E_value=1.3e-15; Accession=PF04488.5; Description =Glycosyltransferase sugar-binding region containing DXD motif
  Subcellular localization annotation: CTP_CleavageSite=18; ConfidenceScore=5.69e-01
MFSHFLPYPQPQPPSPTPSSLLPSIHHSSRPPHLPLLQNSTERFSFSSIQRPRRVKKHKRGLRSMRSEPLFPVPLFHSRLKAFFKNSSSSSSCKVRFFMTWISPLKAFGERKLFSIEILFGSHPEACLVIVSKSLDSDAGTQILKLFVSNCFKFMAVAPDFGYIFKNTHAETWFRLKEGNVDPGEVSLGQNLSNLLRLALLYKFGGTYIDLDVVVLKSFSKLRNTIGGHRTLMSKPASGSSLNNA

SEQ ID NO: 123986 - protein, 76 aa, Glycine max
  Coding DNA Sequence Number=SeqID_7208
MDHKFTLDVPYRIPSSNYLIGLGRIYNEATAVEKSHYVLSLTSAYNWMEAHSDGFITNVYNWMGVLHMVSSTPIQL

SEQ ID NO: 123987 - protein, 331 aa, Glycine max
  Coding DNA Sequence Number=SeqID_7209
  Gene Ontology: Cellular component=clathrin vesicle coat; Biological process=intracellular protein transport
  Homolog annotation: Hit_ID=Q9SKU1; Match level="QueryCoverage=63%, HitCoverage=58%, E-value=2e-40, Identity=47%"; Hit description =Expressed protein
MSSFDAFADDLNVNSSSTHHHDEDEDNFSGYGGYSSFTGGFSADGDVAVDHSAAASPEIYGFTDPNPAYSQSPFESATVENGNENGNGYGQGDGDGDGVFISDGPVLPPPTEMEPEEGYALREWRRYNYCAVRATIKTHFYPCQNAIQLEEKEKREKEMRLKIIEEAEEYKVAFYEKRKLNVETNKLFLANQEKFHKEADKAYWKTIAELIPREVPNIEKKRSKKDQDKKPSITVIQGPKPGKPTDLSRLRQILLKLKHTPPPHMIPPPPAPAKDAKDGKDSKDGKEKAASKATGSAAEGAPGSQPKDATSNGSSEEPQKEAPATEEQPAA

SEQ ID NO: 123988 - protein, 516 aa, Glycine max
  Coding DNA Sequence Number=SeqID_7210
  Gene Ontology: Mol. function=sugar porter activity; Cellular component=integral to membrane; Biological process=carbohydrate transport
  Homolog annotation: Hit_ID=Q2HUE2; Match level="QueryCoverage=86%, HitCoverage=95%, E-value=0.0, Identity=80%"; Hit description=Sugar transporter superfamily; Major facilitator superfamily MFS_1
  Pfam annotation: Domain name=MFS_1; Domain location=60-460; Score =105.0; E_value=2.2e-28; Accession=PF07690.6; Description=Major Facilitator Superfamily
  Pfam annotation: Domain name=Sugar_tr; Domain location=56-500; Score =403.3; E_value=3.4e-118; Accession=PF00083.14; Description=Sugar (and other) transporter
  Pfam module annotation: Pfam domain module=MFS_1::Sugar_tr; Domain location=60-460::56-500
MGLVEVQENGNGNGDGISEIPLGTKTKYIKMTSDPVEEDEVLQSRKYETKKYIFACAVFASLNSVLLGYDVGVMSGAIIFIQEDLKISEVQQEVLVGILSIISLLGSLAGGKTSDAIGRKWTIGLAAVIFQTGGAVMALAPSFKVLMIGRLMAGVGIGFGVMIAPVYIAEISPAIARGSLTSFPEIFINFGILLGYISNYAFSRLPSHINWRIMLGVGLIPSLVIAIALFVIPESPRWLVVQNRIEEARAVLLKINESEKEAEEKLQEIQVAAGSANADKYEPKAVWKEILCPTPPVRRMLITGCGIQCFQQITGIDTTVYYSPTIFKNAGITGNSELLAATVAVGFTKTLFILIAIFLIDKLGRKPLLYASTIGMTVCLFSLSLSLAFLSHAKVGIALAILAVCGNVASFSVGLGPICWVLSSEIFPLRLRAQASALGAVGSRVSSGAISMSFLSVSRAITVAGTFFVFGIVSCCAVAFVHYCVPETRGKTLEEIEVLFKDEDDLQESEVENGEM

SEQ ID NO: 123989 - protein, 1023 aa, Glycine max
  Coding DNA Sequence Number=SeqID_7211
  Gene Ontology: Mol. function=catechol oxidase activity; Cellular component=chloroplast; Biological process=metabolic process
  Homolog annotation: Hit_ID=Q7Y249; Match level="QueryCoverage=99%, HitCoverage=98%, E-value=0.0, Identity=53%"; Hit description =Polyphenol oxidase
  Pfam annotation: Domain name=Tyrosinase; Domain location=119-434; Score=576.9; E_value=2e-170; Accession=PF00264.10; Description =Common central domain of tyrosinase
  Pfam annotation: Domain name=Tyrosinase; Domain location=651-932; Score=218.5; E_value=1.5e-62; Accession=PF00264.10; Description =Common central domain of tyrosinase
  Pfam module annotation: Pfam domain module=Tyrosinase::Tyrosinase; Domain location=119-434::651-932
  Subcellular localization annotation: CTP_CleavageSite=50; ConfidenceScore=5.59e-01
MASISPLSFVPTVNNVSSNSIAPPSPLHPFSRFQSIKNRKPKPHHIPRITCSGNQNNPTPNPNSQGEPPHIVGHRRNVLLGLGGLCGAVTLNNNNPFAFAAPISPPDLNTCGPPDLPAGVKPTNCCPPSSKIIDFKFSPSNQPLRVRPAAHLVNDEYLAKYKKALDLMKKLPSDDPRNFTQQANVHCAYCDGAYHQVGFPDLDLQVHNSWLFFPFHRWYLYFYERILGSLINDPTFALPFWNWDAPKGMQLPSIYADPKSPLYDTLRNANHQPPTLVDLDFNLEDPISNGKISNNLTIMYRQVVSNGKTPTLFLGNPYRAGDEPDPGFGSVENVPHGPVHLWTGDINQPNIENMGTFYSAARDPIFYSHHSNIDRMWSIWKTLGGKRRDFTDSDWLESAFLFYDENKNLVRVKVKDSLDTRKLGYVYQDVDIPWLNSKPTPRRSRVQKVALAQNFGVGAAHAAETSRNVKFPLVLDSVVSTMVKRPNKSRSKKEKEEEEEVLVIEGIEFERNTPVKFDVFINDEDDKQIRPDNTEFAGSFVSVPHSHMHKNKDIITCLRLGLTDLLEELEAEDDDSVRVTLVPRYGKGLKFVHASALKSDHKRVFDDIAYLGVVCKPSLTYSGNQNNPTPNPKSEGEPPHIVVHRRNVLLGLGGLCGAATLNNNNNNNPFAFAAPLSPNITTCDPPNLPAAKYERALNLMKNLPSDYPRNFAELANAHCAYCEGAYKLVGFHDLDLQVHNSWIFFPFHRWYLYFYKRILGSLINDPTFAIPFWNWDSRQGMQFPSIYANPTSPLYETLRDANHQPPTLVDPNFNDNPNVDGNISTNLTIMYMQVVSNGRTPNDQPNFEDMVSFYSAARDPIFYSHHSNVDRIWSIWKKTLGGRDFTDSDWLNPDVDIPWSNSRPTPLGSRVRKVALAQNFGVGAAHAVETSRNNVKFPVMLNSVVTDSGEEAKEVYEQEEEGSGGGDSSDLLISICRHVPHSQKHINKNIITSLKLGLTDLLQDLGAEDDDSVMVTRVPKFGK

SEQ ID NO: 123990 - protein, 62 aa, Glycine max
  Coding DNA Sequence Number=SeqID_7212
MNDLFYINKRMIRYGNGAGMSIVSHPYSYSIPDEFEFIVSSSYPSGIGYKNWRCNKQKGQKN

SEQ ID NO: 123991 - protein, 370 aa, Glycine max
  Coding DNA Sequence Number=SeqID_7213
  Gene Ontology: Mol. function=zinc ion binding; Biological process =regulation of transcription
  Homolog annotation: Hit_ID=Q0GLC6; Match level="QueryCoverage=65%, HitCoverage=96%, E-value=1e-119, Identity=85%"; Hit description=Dof25
  Pfam annotation: Domain name=zf-Dof; Domain location=40-102; Score =122.6; E_value=1.1e-33; Accession=PF02701.6; Description=Dof domain, zinc finger
MGLSSKQVSNRGLDWNQTLLQAQNLELPNPPPMRKQQQTQPSEPLKCPRCDSINTKFCYYNNYNKSQPRHYCRACKRHWTKGGTLRNVPVGGGRKNKRVKKSTTPAIATTSISTSTSNANMDGELNNPITIPSLAVDDHKTTPSSLYQYVCLPQQNLMSTKDSEEGKDFGIGNGIFLSSTVPFPQSQSLLFPFTTSNSFDPNLCAISSSFRSSSVYNYGEEFKIMEEPTLNSIMPNTSGSTNTQPWEIAATSSGMEMSNYWTWEDIDSFVSTDPNGFVVLLNKKAFAFASPALATTTMFPLVLDSAVSAVVVLLIDFEGNAHPKFDVIINAQDYNLIRPDHTDFLQDDDDDDTVVVTLVPRDIKTQLLPD

SEQ ID NO: 123992 - protein, 109 aa, Glycine max
  Coding DNA Sequence Number=SeqID_7214
MVGSGKVENIARQYIDERSLLEDFEDYGHLYHFKVHDLVHDLALYVAKEELLVVNSQTRNIPEQVRHFSVVENDSLSHALFPKSTSVRTILVRIEGMGVNNETLLDIWI

SEQ ID NO: 123993 - protein, 486 aa, Glycine max
  Coding DNA Sequence Number=SeqID_7215
  Gene Ontology: Mol. function=carboxypeptidase activity; Cellular component=proton-transporting two-sector ATPase complex; Biological process=ATP synthesis coupled proton transport
  Homolog annotation: Hit_ID=Q8RV74; Match level="QueryCoverage=76%, HitCoverage=91%, E-value=1e-112, Identity=49%"; Hit description=Leaf senescence protein-like
  Pfam annotation: Domain name=DUF231; Domain location=245-415; Score =115.4; E_value=1.7e-31; Accession=PF03005.6; Description=Arabidopsis proteins of unknown function
MKFLNIDLLCGNNTQKQTISKVTILAFIILLIFSLTTLSCSMFSYYSLLKINKYKQSNIAIDDLSEPQSSPSTPVKKCNIFSGEWVPNPEAPYYTNTTCWAIHEHQNCMKHGRPDSEFMKWRWKPNECELPIFNPLQFLEIMRGKSMAFIGDSTSRNHMQSMICLLSRVEWPIDVSQVNDLSFKRWKYLSYNFTIANFWTPHLVRAKKTDSNSVLFNVYLDEFDETWTTQIKEFDYVIINGGQWFLGPMVFYEKQKIVGCQYCDIENVTHLNLNYGIRKVFRTAFKAIISLENFKGITFLRTFSPSHFENGLWNKGGNCVRTKPFRNNETKLEGHNLELHMIQLEEFKIAKKEGIKKGLKFMLLDTTQAMLLRPDGHPNRYGYWPNENMTLYNDCVHWCLPGAIDIWSDFLLEMLKMEGQKWLIRPKSTTFNFYPLPTVGAFGFVGCVVSGVQARMKSKSAKACRGDETRSTPSNHDYMSFEQNKT

SEQ ID NO: 123994 - protein, 92 aa, Glycine max
  Coding DNA Sequence Number=SeqID_7216
  Gene Ontology: Mol. function=inorganic diphosphatase activity; Cellular component=cytoplasm; Biological process=phosphate metabolic process
  Homolog annotation: Hit_ID=Q43187; Match level="QueryCoverage=81%, HitCoverage=34%, E-value=1e-18, Identity=61%"; Hit description =Soluble inorganic pyrophosphatase
MSDNGEEAGENCQVPRLNERILSSLSRRSVTAHPWHGLEIGPEAPQIFCFGRIVVEITKGSKVKYEPNTKTRLNKVQTNCLVTGMEAPTAVA

SEQ ID NO: 123995 - protein, 251 aa, Glycine max
  Coding DNA Sequence Number=SeqID_7217
  Gene Ontology: Mol. function=methylenetetrahydrofolate dehydrogenase (NADP+) activity; Cellular component=cytoplasm; Biological process =folic acid and derivative biosynthetic process
  Homolog annotation: Hit_ID=Q9ZTV0; Match level="QueryCoverage=99%, HitCoverage=100%, E-value=1e-120, Identity=78%"; Hit description=5 ,10-methylenetetrahydrofolate dehydrogenase-5,10- methenyltetrahydrofo late cyclohydrolase
  Pfam annotation: Domain name=THF_DHG_CYH; Domain location=3-120; Score=217.5; E_value=3.1e-62; Accession=PF00763.13; Description =Tetrahydrofolate dehydrogenasecyclohydrolase, catalytic domain
  Pfam annotation: Domain name=THF_DHG_CYH_C; Domain location=83-247; Score=234.0; E_value=3.3e-67; Accession=PF02882.9; Description =Tetrahydrofolate dehydrogenasecyclohydrolase, NAD(P)-binding domain
  Pfam module annotation: Pfam domain module=THF_DHG_CYH::THF_DHG_CYH _C; Domain location=3-120::83-247
MATVIDGKAVAQIIRSEIADEVRLLSQKYGKVPGLAVVIVGNRKDSQSYVGMKRKACAELGIKSFDVDLPEQVSQAELIKQVHELNVNPDVHGILVQLPLPKHINEEKVLTEISLEKDGKKAVVVGRSNIVGLPASLLLLKADATVTIVHSHTSQPESIIHEADIVIAAAGQPMMGNWIKPGAAVIDVGTNAVDDPTKKSGYRLVGDVDFEEASKVAGWITPVPGGVGPMTVTMLLKNTVEGAKRYIEQNN

SEQ ID NO: 123996 - protein, 381 aa, Glycine max
  Coding DNA Sequence Number=SeqID_7218
  Gene Ontology: Mol. function=binding; Cellular component=thylakoid; Biological process=photosynthesis
  Homolog annotation: Hit_ID=Q00YR0; Match level="QueryCoverage=84%, HitCoverage=95%, E-value=2e-25, Identity=27%"; Hit description =Homology to unknown gene
  Pfam annotation: Domain name=TPR_1; Domain location=59-92; Score =32.8; E_value=1.2e-06; Accession=PF00515.18; Description =Tetratricopeptide repeat
  Pfam annotation: Domain name=TPR_1; Domain location=96-129; Score =5.4; E_value=1.2; Accession=PF00515.18; Description=Tetratricopeptide repeat
  Pfam annotation: Domain name=TPR_2; Domain location=59-92; Score =32.1; E_value=1.9e-06; Accession=PF07719.7; Description =Tetratricopeptide repeat
  Pfam annotation: Domain name=TPR_2; Domain location=96-129; Score =14.6; E_value=0.35; Accession=PF07719.7; Description=Tetratricopeptid e repeat
  Pfam module annotation: Pfam domain module=TPR_1::TPR_1::TPR_2::TPR _2; Domain location=59-92::96-129::59-92::96-129
MAVVAVQQFQCFTESNWRNITRPCIPPHSSLLLRSRNKIQISLISCSSSQTPEADTQTAESCVNLGLELFSKGRVKDALTLFETALSLNPNPVEAQAAYYNKACCHAYRGEGKKAADCLRTALREYDLKFGTILNDPDLASFRVLPEFKELQEEARLGGEDIGYSFRRDLKLISEVQAPFRGVRRFFYVAFTAAAGISLFFTVPRLLRAINGGDGAPDLLATAGNAAINIGAGKKETVSLAMQRAERFQTELLRRGVLLVPVIWGEGQETKLEKKGFGLKPKAAEALPSIGEDFEKRAQSITAKSKLKSEIRFKAEVVSPVEWERWIRDQQKSEGVSLGEDVYIILRLDGRVRRSGKGMPDWQQIVKELPPKEAFLSKIER

SEQ ID NO: 123997 - protein, 84 aa, Glycine max
  Coding DNA Sequence Number=SeqID_7219
  Homolog annotation: Hit_ID=Q6A151; Match level="QueryCoverage=51%, HitCoverage=21%, E-value=3e-08, Identity=63%"; Hit description =Peripheral-type benzodiazepine receptor
WFIQTKRSLRFRIERKATHAKQGLMKSAAMGLTGRKKRMQPNRVRNKPSRVAPEHREVKQQSRGVSVETSICPHHPSRETHQEA

SEQ ID NO: 123998 - protein, 101 aa, Glycine max
  Coding DNA Sequence Number=SeqID_7220
  Gene Ontology: Mol. function=receptor activity; Cellular component =integral to membrane
  Homolog annotation: Hit_ID=Q6A151; Match level="QueryCoverage=52%, HitCoverage=27%, E-value=4e-15, Identity=66%"; Hit description =Peripheral-type benzodiazepine receptor
  Subcellular localization annotation: CTP_CleavageSite=17; ConfidenceScore=5.52e-01
MASSESHPIQTPPTTSRGGGKRDKRRMAPPMPMNMMLLSLRRPFWFPPSWALHLTCPASSFLMGLSAWMVWADGGFHRNPTALLLYFTVLWGNTAWLVSDP

SEQ ID NO: 123999 - protein, 305 aa, Glycine max
  Coding DNA Sequence Number=SeqID_7221
  Gene Ontology: Mol. function=mannosyltransferase activity; Cellular component=endoplasmic reticulum; Biological process=amino acid metabolic process
  Homolog annotation: Hit_ID=O82244; Match level="QueryCoverage=95%, HitCoverage=68%, E-value=3e-94, Identity=59%"; Hit description=Not56- like protein
  Pfam annotation: Domain name=ALG3; Domain location=42-305; Score =380.7; E_value=2.2e-111; Accession=PF05208.4; Description=ALG3 protein
MEIGGRKLKSGETMAAESVTQSAPPTRSRGRITLLENPKIPFALALLFADAVLVSLIIAFVPYTKIDWDAYMSQITGFLGGERDYRNLKGDTGPLVYPAGFLYIYSAFKYLTGGQVYPAQILFGVLYIVNLAIVLAIYVKTDVVPWWALCLLSLSKRVHSIFVLRLFNDCVAMTLLHAALLLFVHRRWNLGLILFSGAVSVKMNVLLYAPPLLLLMLKAMDISGVLLALSGAALVQILLGLPFLVSYPVAYISRAFNLGRVFIHFWSVNFKFIPEPVFVSRGFAILLLAAHLILLASFAHYSWCK

SEQ ID NO: 124000 - protein, 254 aa, Glycine max
  Coding DNA Sequence Number=SeqID_7222
  Gene Ontology: Mol. function=transferase activity, transferring hexosyl groups; Cellular component=integral to membrane; Biological process=electron transport
  Homolog annotation: Hit_ID=Q5TIN3; Match level="QueryCoverage=97%, HitCoverage=63%, E-value=1e-132, Identity=85%"; Hit description =Alpha-1,6-xylosyltransferase
  Pfam annotation: Domain name=Glyco_transf_34; Domain location=1-184; Score=204.3; E_value=2.8e-58; Accession=PF05637.3; Description =galactosyl transferase GMA12MNN10 family
MALLDAEMAGFWAKLPLIRKLLLSHPEVEFYGGWIRYKDSNLVMHGWNEMVYDDKNWIGLNTGSFLLRNCQWSLDILDAWAPMGPKGKVRDEAGKVLTRELKDRPVFEADDQSAMVYLLAKEREKWGGKVYLENGYYLHGYWGILVDRYEEMIENYHPGFGDHRWPLVTHFVGCKPCGKFGDYPVERCLKQMDRAFNFGDNQILHIYGFTHKSLGSRGVKRIRNETSNPLEVKDELGLLHPAFKAVEIIPIREL

SEQ ID NO: 124001 - protein, 138 aa, Glycine max
  Coding DNA Sequence Number=SeqID_7223
  Gene Ontology: Mol. function=sequence-specific DNA binding
  Homolog annotation: Hit_ID=Q9S1D9; Match level="QueryCoverage=55%, HitCoverage=77%, E-value=5e-21, Identity=63%"; Hit description =Putative transcriptional regulator
  Pfam annotation: Domain name=HTH_3; Domain location=70-124; Score =39.5; E_value=1.1e-08; Accession=PF01381.12; Description=Helix-turn -helix
HYGPLLPRPYADTVNGSRFHNMKELRIQYAGQPIRALYAFDTQRKASEFTEAEQADIQLMADELILETGLQLLREELALSQRTVAEAMGVKQPRITQIEQGGADQRLITIKRYIEAMGGKLSLLIEMPDGSGGRILRV

SEQ ID NO: 124002 - protein, 322 aa, Glycine max
  Coding DNA Sequence Number=SeqID_7224
  Homolog annotation: Hit_ID=Q5JK24; Match level="QueryCoverage=40%, HitCoverage=50%, E-value=2e-47, Identity=66%"; Hit description =Putative thiamin pyrophosphokinase 1
  Pfam annotation: Domain name=LSM; Domain location=184-250; Score =83.3; E_value=7.7e-22; Accession=PF01423.12; Description=LSM domain
  Pfam annotation: Domain name=TPK_B1_binding; Domain location=96-168; Score=20.2; E_value=0.0029; Accession=PF04265.5; Description=Thiamin pyrophosphokinase, vitamin B1 binding domain
  Pfam annotation: Domain name=TPK_catalytic; Domain location=1-85; Score=26.4; E_value=8.5e-08; Accession=PF04263.7; Description =Thiamin pyrophosphokinase, catalytic domain
  Pfam module annotation: Pfam domain module=LSM::TPK_B1_binding::TPK _catalytic; Domain location=184-250::96-168::1-85
MDSIRTEVLDFYAKLGTKIIDESHDQDTTDLHKCVAYIRDLTPNIDGAELCILVAGALGGRFDHEIGNINVLCRFSNTRIILLSDDCLIHLLPKNHCHKIFVQSSVEGPHCGVIPIGMPSGSSTTTGLKWDLRWKGIRELFFNIGSSVFKEVTYIPWISCISNGLLVAALLCGSGPLPQQLPLSLLKTAQGHPMLVELKNGETYNGHLVNCDTWMNIHLREVICTSKDGDRFWRMPECYIRGNTIKYLRVPDEVIDKVQEETKSRADRKPPGVGRGRGRGREDGPGGRPAKGIGRGLDDGGAKGAGGGRGRGGPSGKPGGNR

SEQ ID NO: 124003 - protein, 166 aa, Glycine max
  Coding DNA Sequence Number=SeqID_7225
  Gene Ontology: Mol. function=transferase activity, transferring glycosyl groups; Cellular component=integral to membrane
  Homolog annotation: Hit_ID=O22775; Match level="QueryCoverage=100%, HitCoverage=36%, E-value=6e-46, Identity=56%"; Hit description =Putative glycosyltransferase 2
MIPNGIFARFRRRPSYEKHAGLVGSKEIREIGILAKPARSLFVPDRYFGAETIRLVWVNFLAVLVFCFVDQDGVDVEGVVIGGGSGTFKRRRCGMELGEEAMGFGELAGVEAVANVNQVLLRRAEFSGADGAAQDNDGEDEAEDRDLAMPESSVESSRPLSSQTLF

SEQ ID NO: 124004 - protein, 285 aa, Glycine max
  Coding DNA Sequence Number=SeqID_7226
  Homolog annotation: Hit_ID=Q1RSS7; Match level="QueryCoverage=45%, HitCoverage=57%, E-value=6e-46, Identity=72%"; Hit description=CS domain containing protein
  Pfam annotation: Domain name=CS; Domain location=17-93; Score=67.8; E_ value=3.5e-17; Accession=PF04969.6; Description=CS domain
MYFEIWVPDVLLLGRHPEVKWAQRLDKVYITVQLADSKNAKVDLTPDGIFTFSGSAGAEDHQYELKLELFDKVNVEESKINVGVRSIFCVVQKAEDGWWKRLLRGEGKPPHYVKVDWDKWVDEDEDDGNNGEVDLGGMDFSKFGGMGADAMGAMGGMGAGAMGGMDFSKFGGMGDAMDDIDESDDEVLRIFVSMSYMGFDGYDDGYGGRVWTLEESADLVGGSSFVSKKCQSLLNRMLARHQQRKKRLLQAHDAVAVQGATLEDVYENSRVKFSLSVAWIGSCFK

SEQ ID NO: 124005 - protein, 204 aa, Glycine max
  Coding DNA Sequence Number=SeqID_7227
  Gene Ontology: Cellular component=cytosol; Biological process =electron transport
  Homolog annotation: Hit_ID=Q2QTH8; Match level="QueryCoverage=98%, HitCoverage=52%, E-value=3e-69, Identity=62%"; Hit description =Transducin family protein, putative, expressed
  Pfam annotation: Domain name=WD40; Domain location=118-158; Score =18.4; E_value=0.025; Accession=PF00400.22; Description=WD domain, G -beta repeat
  Pfam annotation: Domain name=WD40; Domain location=18-58; Score=38.1; E_value=3e-08; Accession=PF00400.22; Description=WD domain, G-beta repeat
  Pfam module annotation: Pfam domain module=WD40::WD40; Domain location=118-158::18-58
MAVSLSTNAVKLYSPVAGQYYGECKGHSETINQILFSGPSNPHVLCSCSSDGTIRAWDIRTFQQVSSINAGPSQEVFSFCIGGTGGNLVAAGCKSQWYVSFVLKYDFVQILFWDWRNMKQVACLEDSHVDDVTQVHFVPNEQGKLISASVDGLICTFDATGDINDDDHLESVINMGTSIAKVGIFGENYQKLWCLTHIETLGYS

SEQ ID NO: 124006 - protein, 112 aa, Glycine max
  Coding DNA Sequence Number=SeqID_7228
  Subcellular localization annotation: CTP_CleavageSite=66; ConfidenceScore=5.07e-01
MHSFPLTNIYRERPFFPFSGGIALLNNKRGVKNFSQITPSQESNNKQVMGLGRLMVTLKSKIRSLKIMKKPDYDKVEKSESMRMEIRSRKARKLIEETLKVADSPKSKAFAF

SEQ ID NO: 124007 - protein, 84 aa, Glycine max
  Coding DNA Sequence Number=SeqID_7229
MLALSSEKGLGGVEEAREGFVRGFPNLPFHVKYASHKPTLRWKNCDSALTTTRRTPYNQTSSEDCNAETESSGSSTEPVVVYVV

SEQ ID NO: 124008 - protein, 88 aa, Glycine max
  Coding DNA Sequence Number=SeqID_7230
MKLYYFASSLSINSQLKRGIKITCVLWDDLENIVVAEVVHVEARISSNVVQHEVVEVRTIWTTKTSKEAMEGKVARGHDACKKGTSAR

SEQ ID NO: 124009 - protein, 496 aa, Glycine max
  Coding DNA Sequence Number=SeqID_7231
  Gene Ontology: Mol. function=zinc ion binding; Cellular component =intracellular; Biological process=regulation of alternative nuclear mRNA splicing, via spliceosome
  Homolog annotation: Hit_ID=Q10ML5; Match level="QueryCoverage=17%, HitCoverage=6%, E-value=1e-11, Identity=36%"; Hit description=BRCA1 C Terminus domain containing protein, expressed
  Pfam annotation: Domain name=BRCT; Domain location=49-127; Score =54.1; E_value=4.6e-13; Accession=PF00533.16; Description=BRCA1 C Terminus (BRCT) domain
  Pfam annotation: Domain name=PHD; Domain location=447-491; Score =24.0; E_value=0.00023; Accession=PF00628.19; Description=PHD-finger
  Pfam annotation: Domain name=zf-C3HC4; Domain location=349-393; Score= 50.5; E_value=5.8e-12; Accession=PF00097.15; Description=Zinc finger, C3HC4 type (RING finger)
  Pfam module annotation: Pfam domain module=BRCT::PHD::zf-C3HC4; Domain location=49-127::447-491::349-393
MEVQRYSGVNVICLRKKGNVEILEIMEVQHCESAMEAEEQFELPHQSHVADSPVQGMERVVATVSGYHGSERFNLIKLISQAGGNYVGAMSKSITHLVCWKFEGKKYDIALKFRIHVVNHRWVEDCIKEGRRVPEDSYTLQSGHEVGPLLLEVPLVRASSLTKKKLVGDKLHATGSERKNSDFSSGASGTYVLEDSCLMKKENTTVARPSRKGRRLASDLVDKVVLGPSILDLTTDDHLFRMDSQQTDAEATSSLSVGVNNNIILQNSEGPNAGLSNQSRTIIGGSNDIEQIKDSSHISKPRNSTSFIEDPLPVPQTSIDLCSSDDEKFTDGDQADNVAGLPTSTEMSCVICLTEFSSTRGILPCGHRFCFPCIQNWADHTTSMRKTSTCPLCKASFMMIKKVEHAATADQKIYSQTIPCDNSASVIFIPVDQNLPDNIFESAQSNACVVCRGREPEDLLESCDVCHIRKIHSYCMDPPLRPWICTHCKELRMHYR

SEQ ID NO: 124010 - protein, 116 aa, Glycine max
  Coding DNA Sequence Number=SeqID_7232
MRSEPIRAYIYINGEIIQSSSTNAIFKGDKTKSLLLNPTMTLPNIITAIQSFITDNGVTPIINALWYCCPVYELNGEVQYRAIQIIDEEVIIVYTCMILEMRSNVRANPHMHQQPH

SEQ ID NO: 124011 - protein, 965 aa, Glycine max
  Coding DNA Sequence Number=SeqID_7233
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=1-192; Score=4.3; E_value=0.0065; Accession=PF03372.13; Description =EndonucleaseExonucleasephosphatase family
  Pfam module annotation: Pfam domain module=Exo_endo_phos::RVT_1; Domain location=1-192::352-606
MRGLGDNSKRKRLAKIINSALPSSGLSGGLLMMWKRGLWVVKSNFSDHGFIGVCVEFKSKLFFFVNVYAPCNTAGRRVLWETLYNLKYGSSAGEWCLVGDFNAVSNREERTGRSEKWGYIDMVDFNAFVNEMNLIDPPLHGNKFTYFCSDGIAASRLDRFLVSDGIMNLWQVKGQRVGKRDISDHCPIWLECSNLNWGPKPFRFNNCWLEHDGFKSFIVEEWKKIQITGRKAYVIKEKLKIIRESLKKWNKEVFGWLDLNIENIVADMNELDRGIEEGCNLNVVVKKKEANALFWQQLMMKESLLKQKSRLRWIKEGDSNTKFFHSCLQDRRRKNQILSLQVEGRCVEQVGEVKMEITGVLPKAITASFLALIPKVLASRLKKVIAKLISPCQSAFISGRQILDGVLMINEVVDLAKRRKDECLLFKVDFEKAYDSVSWSFLTYMLNRMGFDKRWIGWIQACVFSSSMSVLVNGSPTDEFTAHKGLRQGDPLSPFLFLIVAQGLSGLVQKAIQVGNFVGYQVVDGLNLSLLQFVDDTILLGKGSWKNLWSIKTIFRSFELVSGLQVNFHKSKLIGLNINEGFLESASIFLSCCMTLIPFKFMGVPVGANPRRRSTWKPVVDSIRAKLSCWRGRNLSIGGKVTLINSVLSSLPLYLFSFFKAPKVVIKELTQIQRDFLWGSHEEERKICWVSWEDICKSKKEGGLGVKNLEVFNISLLAKWKWRCIHDHNALWRDLLAFRYGNLIAKQTCSLDRSWGTKDSIWWRDLMLLEKDLSQNQNFFQRAVSCDVGDGQSILFWYNKWLGSEPLKDAFPELFAISSQQLVSVGNAGSWRRDQWTWGLTWKRQLNPNEEESLHSLETILVDVHLVAESHDRWKWSLHNSKLFTVRNNSIFKAEEKVIPKTINQIKHICWAWFMGKVGGRHVCTSRFLKFGHVTWHRPMRCVSWNDAPLVSLSSVNREKCVLDG

SEQ ID NO: 124012 - protein, 306 aa, Glycine max
  Coding DNA Sequence Number=SeqID_7234
  Gene Ontology: Mol. function=binding; Cellular component=anaphase -promoting complex; Biological process=cell division
  Homolog annotation: Hit_ID=Q8LGU6; Match level="QueryCoverage=98%, HitCoverage=38%, E-value=1e-130, Identity=76%"; Hit description =HOBBIT protein
  Pfam annotation: Domain name=TPR_1; Domain location=133-166; Score =32.3; E_value=1.7e-06; Accession=PF00515.18; Description =Tetratricopeptide repeat
  Pfam annotation: Domain name=TPR_1; Domain location=214-247; Score =5.9; E_value=1.1; Accession=PF00515.18; Description=Tetratricopeptide repeat
  Pfam annotation: Domain name=TPR_1; Domain location=248-281; Score =16.3; E_value=0.061; Accession=PF00515.18; Description =Tetratricopeptide repeat
  Pfam annotation: Domain name=TPR_1; Domain location=65-98; Score =43.4; E_value=7.5e-10; Accession=PF00515.18; Description =Tetratricopeptide repeat
  Pfam annotation: Domain name=TPR_1; Domain location=99-132; Score =23.2; E_value=0.00092; Accession=PF00515.18; Description =Tetratricopeptide repeat
  Pfam annotation: Domain name=TPR_2; Domain location=133-166; Score =24.7; E_value=0.00033; Accession=PF07719.7; Description =Tetratricopeptide repeat
  Pfam annotation: Domain name=TPR_2; Domain location=214-247; Score =14.8; E_value=0.31; Accession=PF07719.7; Description=Tetratricopeptid e repeat
  Pfam annotation: Domain name=TPR_2; Domain location=248-281; Score =15.7; E_value=0.16; Accession=PF07719.7; Description=Tetratricopeptid e repeat
  Pfam annotation: Domain name=TPR_2; Domain location=65-98; Score =32.0; E_value=2.1e-06; Accession=PF07719.7; Description =Tetratricopeptide repeat
  Pfam annotation: Domain name=TPR_2; Domain location=99-132; Score =15.9; E_value=0.14; Accession=PF07719.7; Description=Tetratricopeptid e repeat
  Pfam module annotation: Pfam domain module=TPR_1::TPR_1::TPR_1::TPR _1::TPR_1::TPR_2::TPR_2::TPR_2::TPR_2::TPR_2; Domain location=133 -166::214-247::248-281::65-98::99-132::133-166::214-247::248-281::65 -98::99-132
MKVGKAYFELVDYLEADRAFSHARQITPYSLEGMDIHSTVLYHLKEDMKLSYLAQELISTDRLAPQSWCAMGNCYSLQKDHETALKNFQRAVQLNPRFAYAHTLCGHEYVALEDFENGIKCYHSALRVDSRHYNAWYGLGMLYLRQEKYEFSEHHFHMAYQINPRSSVILSYLGTALHALKVNNLLPHWLYWYNRSGEALAIMEKAILEDKKNPLPMYQKASILVSLERFDEALDVLEELKEAQPRESSVYALMGNIYRRRHMHERAMFHYGVALDLKPSVTDAATIKAAVEKLIIPDEFQDEDDS

SEQ ID NO: 124013 - protein, 187 aa, Glycine max
  Coding DNA Sequence Number=SeqID_7235
  Gene Ontology: Mol. function=RNA-directed DNA polymerase activity; Cellular component=intracellular; Biological process=RNA-dependent DNA replication
MAPEDMEKTTFVTLWGTFYYKVMSFGLKNTRATYQQAMVTLFHDMMHKEIEVYVDDMIAKSKIEDEHLVNLRKLFERLHKYRLRLNPAKCTFRVKSGKLLSFIVCQKGIEVDLDKVKLIATCEPLFKLLHKNQSVQWDDDCQVAFERIKRCLMNPPHDESGKKEWAVYYLSKKFTTCEMNYSLLERM

SEQ ID NO: 124014 - protein, 87 aa, Glycine max
  Coding DNA Sequence Number=SeqID_7236
STLEDPTPIRIIKIRLPKILNNKEESGLQDGKPKDAMLPTPTKERWASKRSPRKSAILVKKRSSRDIYGEPMLLRAGDHLMIEDKHR

SEQ ID NO: 124015 - protein, 108 aa, Glycine max
  Coding DNA Sequence Number=SeqID_7237
  Subcellular localization annotation: CTP_CleavageSite=48; ConfidenceScore=5.30e-01
MQKHVGAKRNTPRTVAFSFPAKTQNSFSKTTIPDFVNRWIFMKVGYVLRNAIAHTFTVGICEIIFVEGEKESHEDSTSGGFNPFSVSLTFGNSIGAVGGKIGGISRKR

SEQ ID NO: 124016 - protein, 69 aa, Glycine max
  Coding DNA Sequence Number=SeqID_7238
IVPARHPVDPEKSNRVLGFLALITGLCQFYEVPVAPNKVIRPPINRAFIKKYCALRQAQGEIPQQPGDG

SEQ ID NO: 124017 - protein, 203 aa, Glycine max
  Coding DNA Sequence Number=SeqID_7239
MCCSKSVGIFVSLLKACLHFSGENTETFSSLTSYPELRRSEFLIGGYVGARASLLSTIPPFVAMTQELVARGDTLRLSAPQTKFGHSAPMIRGDTLRLSAPFCHPEAAGPMTSRDQVWSFCTQDTRRYLTVICTPLLGRHSCVRWQAETKFGHSAPKIRGDTLRLSAPFCHPEAAGPMTSRDQVWSFCTQDTRRYLTVICTPC

SEQ ID NO: 124018 - protein, 204 aa, Glycine max
  Coding DNA Sequence Number=SeqID_7240
DILGQSGFDWDGTKYMITVENENAWNEYCTLHKSAKPFRFKVLQNWDDIVNLCAKDKGTDYGAKTAMDVDEAVSRETNEVEFMGLGATAIDLEEPSSNTKGKRQGSTSSGTHPHKRKMGEKEGIVASLDKMANSFNRMVEKMDGKVDDEDIQEVLREAALIPDFNRQQWAKAIKWLADDPKQLAIVKTLPIHQKTDYVLTHLGE

SEQ ID NO: 124019 - protein, 54 aa, Glycine max
  Coding DNA Sequence Number=SeqID_7241
MLKIQGSIKQSYFQLKIGARDKSIMHKRNKNPISDLGPVVVVGPDPWPPRSSPM

SEQ ID NO: 124020 - protein, 33 aa, Glycine max
  Coding DNA Sequence Number=SeqID_7242
MAQVEWEWLQKSHPPGMIEVPGLRRLHPLPKEK

SEQ ID NO: 124021 - protein, 42 aa, Glycine max
  Coding DNA Sequence Number=SeqID_7243
MARKPCSQPASVPDPTSSIKQYLNYLGKKKENHARELLCKNK

SEQ ID NO: 124022 - protein, 167 aa, Glycine max
  Coding DNA Sequence Number=SeqID_7244
  Gene Ontology: Mol. function=two-component response regulator activity; Cellular component=nucleus; Biological process=two -component signal transduction system (phosphorelay)
  Homolog annotation: Hit_ID=Q1T3X9; Match level="QueryCoverage=47%, HitCoverage=14%, E-value=2e-13, Identity=43%"; Hit description =Response regulator, RegA/PrrA/ActR type
  Pfam annotation: Domain name=Response_reg; Domain location=16-116; Score=29.9; E_value=8.8e-06; Accession=PF00072.14; Description =Response regulator receiver domain
MATTDEEVPTQFPARLRVLAIDNDSTVLETVKQMCNECHHQVITYSNALHALDRVREDRYCVDVILIDVNMPNMDGHEFLQRIRMEIDVPVNQAYRYRRPRGGARYQLLFPLVRVNFELGVIMVIAVSFGKPVVPAALMNRPTRGERRFAYWALAECILAYYVGTDE

SEQ ID NO: 124023 - protein, 407 aa, Glycine max
  Coding DNA Sequence Number=SeqID_7245
  Gene Ontology: Mol. function=transporter activity; Cellular component= periplasmic space; Biological process=transport
  Homolog annotation: Hit_ID=Q6D3E3; Match level="QueryCoverage=64%, HitCoverage=49%, E-value=1e-123, Identity=81%"; Hit description =Periplasmic dipeptide transport protein
  Pfam annotation: Domain name=SBP_bac_5; Domain location=188-407; Score=30.1; E_value=4.3e-07; Accession=PF00496.12; Description =Bacterial extracellular solute-binding proteins, family 5
MGDKAYARRARPVARFHGGHGGMLINHHILQTEIAQLLRQQFRHGVLRRRTGQRAGFGIALAGDRQITVKTLGQLTGKLVCHHNSLLALRHWRYARRLNHVIYEINTDAGSWKSIKSEKTMKKMIGKLALSALGLAVAGGVSAKTLVYCSEGSPENFNPQLYTSGTSVDASAVPIFNRLVDFKPGTTELVPSLAERWEISPDGKVYTFHLRKGVKFQSNKQFTPSRDLNADDVIFSFMRQLDTKNPYHTVSGGNYANFESLELAKLITRIDKVDDLTVRITLAHAEAPFLADLAWYFASIHSAEYADQMLKAGTPEKVDMQPIGTGPFELVQYQKDSRILYKAFPQYWQGKAKIDRLVFSITPDASVRYAKLEKNECQVMPFPNPADLDNMRHNPNITLEQKSGLNT

SEQ ID NO: 124024 - protein, 140 aa, Glycine max
  Coding DNA Sequence Number=SeqID_7246
  Gene Ontology: Mol. function=cytosol alanyl aminopeptidase activity; Cellular component=cytoplasm; Biological process=peptide metabolic process
  Homolog annotation: Hit_ID=Q6D3E2; Match level="QueryCoverage=99%, HitCoverage=34%, E-value=5e-54, Identity=73%"; Hit description =Peptidase
MQANASQAVLKASIRDFDLKGFDAKKQQLVEVADQIAAHYPTGHVALKINDIYSNISNAIGEDRRAIDLIFAALQQVGVEPKVIPMRGGTDGSALSAKGLLTPNFFTGAHNFHSRFEFLPIPSFVKSYQVAEALCYLAAR

SEQ ID NO: 124025 - protein, 622 aa, Glycine max
  Coding DNA Sequence Number=SeqID_7247
  Gene Ontology: Mol. function=transferase activity, transferring nitrogenous groups; Cellular component=mitochondrion; Biological process=biosynthetic process
  Homolog annotation: Hit_ID=Q147C3; Match level="QueryCoverage=61%, HitCoverage=99%, E-value=1e-137, Identity=65%"; Hit description =Putative aminotransferase
  Pfam annotation: Domain name=Aminotran_1_2; Domain location=31-383; Score=201.8; E_value=1.6e-57; Accession=PF00155.11; Description =Aminotransferase class I and II
  Pfam annotation: Domain name=Aminotran_5; Domain location=48-383; Score=-184.9; E_value=0.0061; Accession=PF00266.9; Description =Aminotransferase class-V
  Pfam annotation: Domain name=Beta_elim_lyase; Domain location=48-272; Score=-88.7; E_value=9.3e-05; Accession=PF01212.11; Description=Beta -eliminating lyase
  Pfam annotation: Domain name=Cys_Met_Meta_PP; Domain location=46-306; Score=-280.4; E_value=0.0079; Accession=PF01053.10; Description =CysMet metabolism PLP-dependent enzyme
  Pfam annotation: Domain name=DegT_DnrJ_EryC1; Domain location=47-342; Score=-183.9; E_value=0.0035; Accession=PF01041.8; Description =DegTDnrJEryC1StrS aminotransferase family
  Pfam annotation: Domain name=SBP_bac_3; Domain location=388-615; Score=266.3; E_value=6e-77; Accession=PF00497.10; Description =Bacterial extracellular solute-binding proteins, family 3
  Pfam module annotation: Pfam domain module=Aminotran_1_2::Aminotran _5::Beta_elim_lyase::Cys_Met_Meta_PP::DegT_DnrJ_EryC1::SBP_bac_3; Domain location=31-383::48-383::48-272::46-306::47-342::388-615
  Subcellular localization annotation: CTP_CleavageSite=54; ConfidenceScore=5.02e-01
MTLNSSVKLSSKQPDVGTTIFSVIGQLSAQHQAVNLSQGAPNFPCDPQLVELVSQAMRDGHNQYAAMTGLPALREALAEKVHRLYGQQYDAASEVLITGSASQGIYMAISALVHPGDEVIFFEPAFDSYAPVVRLQGATPIGLKLQVPDFAIDWDALRAAITPRTRMIIINTPHNPSGQVLNAADLDQLAALTRNTDIVVLSDEVYEHIVFDGQTHCGMATHAELAQRSVVVSSFGKTFHVTGWRVGYALAPAALMAEIVKVHQFMMYAADTPMQVGFAQYLQNPQNYLQLSSFYQAKRDRLQTLLQDSPFRLLPSAGSFFMLASYGHFSDESDSEMVKRLIVDHGVATIPLSAFYMDGTDNKLIRLSFAKDDATLEAGAQALCRESLRYGLESQYPPFESRNAQGELEGFDIELGKAICQVGHFDCKWVESSFDALIPALQAKKFDAINSAMNITEARAKSIDFTNPIYRIPTMLIVKQGEKLEPTAASLKGKNIGVLQGSIQETYAKKHWESQGVTVTSYQDQNQVYNDMVAGRLDGTLVMSAAGQSGFLDKPQGKGFAFAGKPVEDDTILGSGIGFGLRKGDSKLKGELDAAIAKVQADGTVTKLAAKFFPGIDVSVSK

SEQ ID NO: 124026 - protein, 702 aa, Glycine max
  Coding DNA Sequence Number=SeqID_7248
  Gene Ontology: Mol. function=serine esterase activity; Cellular component=extracellular space; Biological process=metabolic process
  Homolog annotation: Hit_ID=Q6A3R0; Match level="QueryCoverage=52%, HitCoverage=92%, E-value=1e-111, Identity=55%"; Hit description=Elip protein
  Pfam annotation: Domain name=Abhydrolase_3; Domain location=1-206; Score=-68.3; E_value=0.0029; Accession=PF07859.3; Description =alphabeta hydrolase fold
  Pfam annotation: Domain name=COesterase; Domain location=1-385; Score= 11.6; E_value=3.4e-13; Accession=PF00135.18; Description =Carboxylesterase
  Pfam annotation: Domain name=HAMP; Domain location=542-611; Score =32.7; E_value=1.3e-06; Accession=PF00672.15; Description=HAMP domain
  Pfam module annotation: Pfam domain module=Abhydrolase_3::COesterase:: HAMP; Domain location=1-206::1-385::542-611
MVWLHGGGFSIGAGSLDPYRGKALAAQGVVVVTLNYRLGHFGFFAHPALDAQYLPGKVVNNFALLDQIAALQWIQRNIPAFGGDRHNVTLFGESSGARSVLSLCCSPLAEGLFHKGIVQSAYSLPDVPHKQAQQTGLQVAAHFNLAADASAEQLRALPADSFWPLERPLALGPVAISGDAVLPRPMLDTFMAGKQHRVPLMIGSNSDEASVLDYFGVDARSVLQQLRSKSRLSYRLLKWLYDIHDDSLLGRAVARDMAFTVMPLLVAQSQHSIGMPAWRYWFDYVSENARHLYPHGTWHGNEIPYVFNTLATLPPPGDWYYSASDIAFAGRVSAWWVAFARDASEFSHRLRLDGEPDWPVWRPGEDLTLAFGHDGLFSVHSLNALGEGNEIDRQLVNQMTALSKGNDQYFRVVTRLSRVMEGRTAGNAPTAEAFAPVQQALDNMKQQLTQFKAMAPGPMDSETVNNVISSWQKLLDEGIAPQVALAQQASLDAWRAQANNVTPPLSRAFGASAEAFNQAASSKLDETRVTVDTLTSMTKVIIVSAVVFGLLILLFTDRYLVTMLVKPLDRIRNHFTVIAQGDLSQPVEEFGRNCVGKLVPLLRAMQDSLREAVSAIRSGTENIYRGAAEISAGNNDLSSRTEEQAAALEQTAASMEQLTATVKFNADNARQASALAETATGTAQQGGRLVGEVVTTMQGISG

SEQ ID NO: 124027 - protein, 178 aa, Glycine max
  Coding DNA Sequence Number=SeqID_7249
MVWGDTLAKFDIPEAEKAKKKVMSTVATRWRQFKSSLTTKFVYADTQAGQEENPSVKYGIDKQTWDKLVASGKTPDWQEIQKKAQDSQKYNDSPHVLSRGGYDLLEKKLLDEKTKQRQQQTLLTENPLFDLEEPPSPIKRHVKWKMARTKRYGQMTSKAAKEISDRIMSCSMIISIWN

SEQ ID NO: 124028 - protein, 155 aa, Glycine max
  Coding DNA Sequence Number=SeqID_7250
MRGWRLRRLQQPAFDQPRPRILGVLFKPRLGGSQPIRIPPGIHVGHQPRSANTRQLPGQHDLQVAGGIFLGHRVGGVGMHLRTPLRRQHDQVAGFVQHRMYGSVVAHIHVAGDDAGLGLAPVAAGNRFTGRDLMQPQAMRGEQALRIGEGDVAHA

SEQ ID NO: 124029 - protein, 288 aa, Glycine max
  Coding DNA Sequence Number=SeqID_7251
  Gene Ontology: Mol. function=RNA-directed DNA polymerase activity; Cellular component=intracellular; Biological process=RNA-dependent DNA replication
  Pfam annotation: Domain name=RnaseH; Domain location=166-286; Score =38.8; E_value=1.4e-08; Accession=PF00075.14; Description=RNase H
MYLTVLEDLWGCVLGQQDETGRKEHAVYYLSKKFTDCESRYSLLEKTCCALAWAAKRLRHYMINHTTWLISKMDPIKYIFEKPALTGRIARWQMLLSEYDIEYRTQKAIKGSVLADHLAHQPIEDYQPIKFDFPDEEIMHLKMKDCDEPLLGEGPDPESRWGLIFDGAVNVFGNGIGAVIITPEGNHLPFAARLQFDCTNNMAEYEACILGIEKAIDLRIKNLDIYGDSALVINQITGEWETRHPGLIPYKDYAKHLLTFFNKVELHHIPRDENQMADALATLSSMYE

SEQ ID NO: 124030 - protein, 172 aa, Glycine max
  Coding DNA Sequence Number=SeqID_7252
  Gene Ontology: Mol. function=calcium ion binding; Cellular component =periplasmic space
  Homolog annotation: Hit_ID=P0AFH8; Match level="QueryCoverage=98%, HitCoverage=84%, E-value=1e-64, Identity=77%"; Hit description =Osmotically-inducible protein Y precursor
  Pfam annotation: Domain name=BON; Domain location=109-172; Score =66.7; E_value=7.5e-17; Accession=PF04972.7; Description=Transport -associated domain
  Pfam annotation: Domain name=BON; Domain location=30-93; Score=63.1; E_value=9.1e-16; Accession=PF04972.7; Description=Transport -associated domain
  Pfam module annotation: Pfam domain module=BON::BON; Domain location =109-172::30-93
MAADTSSSAGSKIDSSMKKVDGFMDDSGITAKAKAALVDDEAIKSTDISVKTQQGVVTLSGFVTSQDQAEKAVALVQKVEGVKSVSDKLHVRDSKQSSLKGYAGDAATTSEIKAKLLADDIVPSRNVKVETTDGVVQLSGEVANQAQSDRAEKIAKAIEGVKSVKNDLKVKS

SEQ ID NO: 124031 - protein, 111 aa, Glycine max
  Coding DNA Sequence Number=SeqID_7253
MYTERRLALSTLISSKSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 124032 - protein, 80 aa, Glycine max
  Coding DNA Sequence Number=SeqID_7254
MGFHPTKLNFVPSDADEAPLDVSICLHAFGIVGCGSFSGVKSCELNVGGLVPPHCSLKSVVSDDACPGACFVQRDATTLS

SEQ ID NO: 124033 - protein, 139 aa, Glycine max
  Coding DNA Sequence Number=SeqID_7255
MTMIVDTLPVFYYGKWWATHLQSFEDLVFASERIDVGLKKGKFSHPAWTNEKTGANEEGEKEGETHAVTAIPIRPSFPPTQQCHYSANNKPPPYPPPSYPQRPSLNQPQSLSTALPMTKTTFSTNQETPTKRNFAAKSL

SEQ ID NO: 124034 - protein, 84 aa, Glycine max
  Coding DNA Sequence Number=SeqID_7256
TSFGYRKDRNGQWLKKDALPPQRDDSALMTEVLFELRGLRTYVGEHFDSLDTRFAGMDIRLTQLEEDVGYIHQSLDLPPPPPPS

SEQ ID NO: 124035 - protein, 287 aa, Glycine max
  Coding DNA Sequence Number=SeqID_7257
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=32%, E-value=1e-146, Identity=79%"; Hit description=DNA -directed RNA polymerase beta chain
  Pfam annotation: Domain name=RNA_pol_Rpb2_6; Domain location=48-287; Score=4.0; E_value=5.6e-14; Accession=PF00562.18; Description=RNA polymerase Rpb2, domain 6
MVATGNSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQLTANSLWEKTSLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNK

SEQ ID NO: 124036 - protein, 52 aa, Glycine max
  Coding DNA Sequence Number=SeqID_7258
MHMTQMQFTNTGARETVSFLDTTSRGSKVPQQGIKTEPMCDAYAKGATRECT

SEQ ID NO: 124037 - protein, 78 aa, Glycine max
  Coding DNA Sequence Number=SeqID_7259
MHVAQLVSDAIYCLQGSRLQDTQWTQRSSTGSWGSSSDYGPLSVLRSGRRPQQGHQALINRAFIEKYYAPRQAQGEAS

SEQ ID NO: 124038 - protein, 162 aa, Glycine max
  Coding DNA Sequence Number=SeqID_7260
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-22, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=24; ConfidenceScore=5.47e-01
MWSPLKARTCSPLKVRTCNPLKVRACIPMKARMCSPLKVRACSPLKARTCSPLKARACSPLKARTCSSLKVRMCSPLVARKCSPLKVRMCSPLKARTYSPLKAKACSPLKMRASSPLKARTYSPLNARACSPLKARTCSPLKARTCNPMKGKGVQPSEGEGM

SEQ ID NO: 124039 - protein, 163 aa, Glycine max
  Coding DNA Sequence Number=SeqID_7261
  Homolog annotation: Hit_ID=Q6DXT0; Match level="QueryCoverage=42%, HitCoverage=14%, E-value=3e-17, Identity=63%"; Hit description =Putative permease
AYKAASRLTSATPPPAHVLSRGIGWQGIGILLNSLFGTLTGSTVSVNTILYKKEIGISKYFSVGVSLFFSTGSIYIYSAESDNVQRTEKLTSINQQPHCAQTVSNIIYLDSPASVGLSYSENTSKYATGDLCHWGSPIPISLSFVILLIYGYTKVLISKWSQC

SEQ ID NO: 124040 - protein, 824 aa, Glycine max
  Coding DNA Sequence Number=SeqID_7262
  Gene Ontology: Mol. function=protein dimerization activity; Cellular component=nucleus; Biological process=regulation of transcription, DNA-dependent
  Homolog annotation: Hit_ID=Q8S976; Match level="QueryCoverage=81%, HitCoverage=98%, E-value=0.0, Identity=59%"; Hit description=Auxin response factor 10
  Pfam annotation: Domain name=Auxin_resp; Domain location=401-484; Score=178.2; E_value=2e-50; Accession=PF06507.4; Description=Auxin response factor
  Pfam annotation: Domain name=B3; Domain location=231-336; Score =114.8; E_value=2.5e-31; Accession=PF02362.12; Description=B3 DNA binding domain
  Pfam module annotation: Pfam domain module=Auxin_resp::B3; Domain location=401-484::231-336
MGPNIDFDTLWGNIGYEKLEYNTNKEVMRLILQSQQQVDNTVWCKHRRKVKIVHAKACVSSSCNGPSNHDEYFPIKVDAMCRNGLSPLEKCIVALRILAYGSPANNVDEYIHIVETTIVDCLQRLEGEKVLDPQLWHACAGGMVQMPQMNSKVFYFPQGHAEHAHTNIHLRLPPFILCNVEAVKFMANPETDEVFAKLSLLPLRNSELGADSDGAGGDDVAEPSCCEKPASFAKTLTQSDANNGGGFSVPRYCAETIFPRLDYTAEPPVQTVVAKDVHGETWRFRHIYRGTPRRHLLTTGWSSFVNQKKLVAGDSVVFLRAENGDLCVGIRRAKKGISEGSGSGSSSVWSSASGSGNGNCGIGPYGPFSFFLKEENKMLRNGCGGNLSGRVKVRAEDVVEAVTLAASNKPFEVVYYPRASTPEFCVKASAVRAAMRIQWCSGMRFKMAFETEDASRISWFMGTIASVQVVDPIRWPNSPWRLLQVTWDEPDLLQNVKRVSPWLVELVSNIPLINFTPFSPPRKKLRPQHPDFPLDVQFPIPMFSGNQLGPNSPLCGFSDNAPAGIQGARHAQFGKSLSDLHLNNKLQLGMLPTNIHQLGVYNEISNGNMMTNHDKSKESLSCFLTMGKSTKSLEKSDDVKKHQFLLFGQPILTEQQISSCSGDVLSHRKRSVSDDKDKAKCLMDDSQSTLSQQFSPGKASSAEFSWQLGLDTGHCKVFLESEDVGRTLDLSLFGSYEDLYRRLAIMFGIERSEILNHVLYHDAAGAAKKTGEEPFSDFMKTAKRLTILTDSSSKNIKRAFITGTRNGEHGLDASNKTGPLSIFA

SEQ ID NO: 124041 - protein, 865 aa, Glycine max
  Coding DNA Sequence Number=SeqID_7263
  Gene Ontology: Mol. function=protein phosphatase binding; Biological process=regulation of phosphoprotein phosphatase activity
  Homolog annotation: Hit_ID=Q922D4-4; Match level="QueryCoverage=52%, HitCoverage=94%, E-value=1e-52, Identity=29%"; Hit description =Isoform 4 of Q922D4
  Pfam annotation: Domain name=SAPS; Domain location=129-491; Score =493.9; E_value=1.9e-145; Accession=PF04499.6; Description=SIT4 phosphatase-associated protein
MFWKLASISSSSPVEVILDKENFTLEELLDEEEIIQECKALNSRLINFLRDRAQVEQLLRYIIEEPPEDAENKRVFKFPFIACEIFTCEIDVILKTLVDEEELMNLLFSFLESDRSHSTLLAGYFSKVVICLMIRKTVPLMNYVQAHQHVFRQLVDLIGITSIMEVLVRLVGADDHVYPNFIDVMQWLAESNLLEMIVDKLSPSSPPEVHANVAETLCTITRVASSTLAIKLSSPSFVAKILGYALEDSQSKSSLVNSLSVCISLLDPKKSAISSPLFHSFRSQNMYEPPIPVNPDTIGAMLPKLGEFLVLLDLSSDNKVLPTTYGELRPPLGKHRLKIVEFIAVLLKTGNEVAEKELANSGTIQRVIDLFFEYPYNNSLHHHVESIISSCLESKSNAIIDHLLRDCDLVGMFLQTDKHCILSAESSQPTVPAAGKQGTRVGNIGHITRIINKLLHLSHNQSHILACLQENSEWNEWQATVLQQRNVVENVHRWACGRPTALQDRMRDSDDEDLHDRDYDVAALANNLSQAFRYKIYGNDNNEEEHGGLDRDDEKIGRNPHFKDLNHKFITDVYFDDDSAEVVISSLRLGDDQGSNLFTNSNWFAFQDDRIGDAPGGTSSSEMMDEIKLNAVANSGSNSSDDEVVVGEDEELADSKNTVNGTSSLSADFFSGLTASDSMNGGTLNFESEKTSPSNDMGFFRFEAPDNEDLFGDRPLPDWVGWGEPSEMQDAGSSMNPFLDNDESGRPQVGSPNLSSPSNGESVPSNGLPTTSDSINGNSDSSPTSVAVPSLFEEDVEFVGVELEGTEKAMDQALKEGIVGEAGPLKRNVVSKVPDKENSEEGSPGVKEFNDANYWRVDNEVAVLE

SEQ ID NO: 124042 - protein, 82 aa, Glycine max
  Coding DNA Sequence Number=SeqID_7264
MEFLDLPLDFEDVETDAVEEQDWDAQFNKFLEDPPPPLGSFPLQSSEFCGQTQHENVKLGKSFRASDLYFSMNVTFTLDLLR

SEQ ID NO: 124043 - protein, 91 aa, Glycine max
  Coding DNA Sequence Number=SeqID_7265
  Gene Ontology: Mol. function=sequence-specific DNA binding; Cellular component=nucleus; Biological process=regulation of transcription, DNA-dependent
  Homolog annotation: Hit_ID=Q9AVU3; Match level="QueryCoverage=96%, HitCoverage=28%, E-value=3e-29, Identity=63%"; Hit description=GATA -1 zinc finger protein
  Pfam annotation: Domain name=GATA; Domain location=34-69; Score=67.2; E_value=5.3e-17; Accession=PF00320.17; Description=GATA zinc finger
MVSKKLRKKDIPMLANRIEMKRSSSQESVALRKCLHCEVTKTPQWREGPMGPKTLCNACGVRYRSGRLFAEYRPAASPTFVSSLHSDSHKK

SEQ ID NO: 124044 - protein, 234 aa, Glycine max
  Coding DNA Sequence Number=SeqID_7266
  Homolog annotation: Hit_ID=Q9FF50; Match level="QueryCoverage=93%, HitCoverage=23%, E-value=1e-104, Identity=80%"; Hit description =Arabidopsis thaliana genomic DNA, chromosome 5, P1 clone:MUP24
ALMAYHYDPQVSLPELSSISLYTPKLVEVVKERPKWNATEFFKHIHPYTPYRHQLPCSWGAVFFPKHWREFYVYMNMRFTEDAKANPVQIPKSRTNGWQASWKKFLIDMMYLRGYVSLYPNFPQQASFSTNHMEPGAHISAKDNVVKHNKRDFEVPLMKEDFRNFLPAMKMPPAPRLPSLNLFNQPVSLKGLKAAGAKLGQDVLRCDNATEVVAVDKDTVGNWVSDFAVMGIGM

SEQ ID NO: 124045 - protein, 781 aa, Glycine max
  Coding DNA Sequence Number=SeqID_7267
  Homolog annotation: Hit_ID=Q9FF50; Match level="QueryCoverage=81%, HitCoverage=68%, E-value=0.0, Identity=75%"; Hit description =Arabidopsis thaliana genomic DNA, chromosome 5, P1 clone:MUP24
  Pfam annotation: Domain name=Glycos_transf_2; Domain location=322 -485; Score=14.1; E_value=9e-05; Accession=PF00535.16; Description =Glycosyl transferase
  Pfam annotation: Domain name=Lysine_decarbox; Domain location=1-83; Score=59.9; E_value=8.1e-15; Accession=PF03641.4; Description=Lysine decarboxylase family
  Pfam module annotation: Pfam domain module=Glycos_transf_2::Lysine _decarbox; Domain location=322-485::1-83
MMYVLFVCEGGYGTLEELLEVITWAQLGIHDKPVGLLNVDGYYNSLLCFIDKAVEEGFISPKARHIIVSAPSTKELVKKMEEYFPQHERVASKLSWETEQIDYSSNCGMSRADFNLAVKPNYSSAQCEFWLEDIESSTQLCKMGFGRNSTSRSGDYLEGMLNDYVGGRNKLKAQKSAATTKFVAALTCLQFFFAVYATFLLYYMGPSIDLRTKPEFTWATKIAQQWKQLMITPHVIGHYQEAASSLIKEDLLPTTPSQVCENEKIDFMQKKSNDVQMIKIKRELYDEVLNFQSKTIGTETLQELMAMKSKWDLKGPKRPKITVLLNHFKRKTLCAQLDSLLQQTLPFHHVWVLSFGSPNEVSLKRIVDTYNDSRISFISSSYDFKYYGRFQMALQTEADLVYVVDDDMIPGRKMLQILAHVAGTDKYKNSVLGSIGRILPFRQKDFTFPSYRKFRSKEAGLYLPDPAYDITVDKIVQVDFLSSSWFLSADLVKTLFIETPFTFSTGEDLHLSYQLQKYKNAGSFVLPVDPKDKETWGDSEHRLAYVSETTVIFKDVVQVRDDQWWKALSTGYVTQWAAMYPQKIDALFYAHSVDEVKVLAPLLEKFRSTVGKKAYIVVSGGNYCPCEDAARALKWPALVCKERRFKIFDLAVEALSGVSDSEAPVIHAVYTSLKGLIKIHNPSLVISVAEIDPHVRKALKMASETNSNGTTFVLLPSSSVSQVLWMADLRSTALPNWNRMRISVNIITQNRVNSLARLLKSLSNAYYLGDEIPITFNMDSK

SEQ ID NO: 124046 - protein, 73 aa, Glycine max
  Coding DNA Sequence Number=SeqID_7268
MRGTVHEPQVNIGADQKFSPIEVFNKKKGDKPWNFNRLINYQTTPFPSLQNGQVTKSKRTYTLREFPKRFAKR

SEQ ID NO: 124047 - protein, 651 aa, Glycine max
  Coding DNA Sequence Number=SeqID_7269
  Gene Ontology: Mol. function=voltage-gated potassium channel activity; Cellular component=integral to membrane; Biological process=potassium ion transport
  Homolog annotation: Hit_ID=Q9SL29; Match level="QueryCoverage=93%, HitCoverage=93%, E-value=0.0, Identity=69%"; Hit description =Putative cyclic nucleotide-gated ion channel 15
  Pfam annotation: Domain name=Ion_trans; Domain location=114-353; Score=49.8; E_value=8.8e-12; Accession=PF00520.21; Description=Ion transport protein
  Pfam annotation: Domain name=cNMP_binding; Domain location=454-554; Score=35.6; E_value=1.7e-07; Accession=PF00027.19; Description =Cyclic nucleotide-binding domain
  Pfam module annotation: Pfam domain module=Ion_trans::cNMP_binding; Domain location=114-353::454-554
DAELAKLPTTNGGNGIKPNETQVAETSGEKGLKKDTRKFLKARVLSRVFSEDYEKVRKRTLLDPRAQTIHRWNKILLVACLVSLFVDPLFFYLPLVRDEVCIDIGTTLEVFLTMIRSMADVFYMIQILLKFRTAYVAPSSRVFGRGDLVIDSSKIATRYLIKGFWLDFVAALPLPQALIWIVIPNLGGSTMANTKNVLRFIIIFQYLPRLFLIFPLSSQIIKATGVVTETAWAGAAYNLVLYMLASHELAGTFYQLKDKKHAGGVSAIWRSHLVNMDSLTAKGLKIRSGRPVTSQVTTSSFFHKYFFCLWWGLRNLSSLGQGLLTSTFVGEIMFAIVVATLGLVLFGLLIGNMQTYLQSTTVRLEEWRVRRTDTEQWMHHRQLPPELRQSVRKYNQYKWLATRGVDEEALLKGLPADLRRDIKRHLCLELVRRVPLFDQMDERMLDAICERLKPALCTENTYLVREGDPVNETLFIIRGHLDSYTTNGGRTGFFNSCHIGPGDFCGEELLTWALGSRPSFILPSSTRTVKAISEVEAFALMAEDLKFVASQFRRLHSKQLRHKFRFYSHQWRTWAACFVQAAWRRYKKRKEAAELRARENVHEGETAAYRSGLVVVYATRMARKGVHHVRSGTDSGVSLQKPEEPDFSVDE

SEQ ID NO: 124048 - protein, 226 aa, Glycine max
  Coding DNA Sequence Number=SeqID_7270
  Gene Ontology: Mol. function=protein histidine kinase activity; Cellular component=integral to membrane; Biological process=two -component signal transduction system (phosphorelay)
  Homolog annotation: Hit_ID=UPI00005FA7BC; Match level="QueryCoverage =99%, HitCoverage=26%, E-value=9e-41, Identity=39%"; Hit description =COG0642: Signal transduction histidine kinase
MRCLSKRGIVLLRRLSIQSLHIWRYCLRKQLEIAAAQQRRGSLIVVALLYRIVSQLLLNQGQQRIKQRIAEIEIDPELLVVEGVMPHFVARQQQRPAVKACRVVRHQHIMLLPGQAFVRGQAICPPVLEVAADNFVYVLDRDIHQRRHAFQQFLFLLALLLQRQRQLNVVARADIRFGDNLQLAAHLFAQLLTQEKCHARRLTVTVLRGFAKVREIDVGQLVAGQA

SEQ ID NO: 124049 - protein, 43 aa, Glycine max
  Coding DNA Sequence Number=SeqID_7271
MALGVMATRPGELLLQPEGSKDKDTNFIRATLLFDRATGEPRK

SEQ ID NO: 124050 - protein, 387 aa, Glycine max
  Coding DNA Sequence Number=SeqID_7272
  Gene Ontology: Mol. function=RNA-directed DNA polymerase activity; Cellular component=intracellular; Biological process=RNA-dependent DNA replication
VMDIQAAYSCLLGRPWIHEAGAVTSTLHQKLKFVRNGKLITVSGEEALLVSHLSAFSFIGADETEGTSFQGLTLEGKKPERNEVSFATWKSAQKVVQEGTGVGWGKVVQLLESKNREGLGFASSAGSATNSVGSSSITSTFCSAGFINNSPEANAVLEDAPEEIVLAFVTPGKLVRNWDAVDIPSVVHASKLGIYEPVEHNNPALSPNYESPVYEAEEEEDDEIPKELARLLEYEKKTIRPHEEVVEVINLGTEEDKKEVKIGASLEATVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHID

SEQ ID NO: 124051 - protein, 136 aa, Glycine max
  Coding DNA Sequence Number=SeqID_7273
MLCAEPAQGQVIIMKHLQSSGLQPMMSVKEFLSQVAWPGVQPSPSGGDKASAAQEPVLEDDEPVPPEPFVYETDPTSAQEEVASPEPVPHPSPAPVLDDSQPFAPAPVPDQPLAQDPPAAPVLDLNEHAEDHLQND

SEQ ID NO: 124052 - protein, 404 aa, Glycine max
  Coding DNA Sequence Number=SeqID_7274
  Homolog annotation: Hit_ID=Q2R320; Match level="QueryCoverage=86%, HitCoverage=88%, E-value=9e-44, Identity=31%"; Hit description =Expressed protein
  Pfam annotation: Domain name=DUF247; Domain location=47-390; Score =555.4; E_value=5.6e-164; Accession=PF03140.6; Description=Plant protein of unknown function
MVAVFNKELLSCEDAAKFQEEPNSPTSEWVVTIREKLDEAGQDDVASSWSKLSIYKIPHYLRDGSGDDKSFAPQIVSIGPYHHGKKRLRPMDCHKWRSLNHVLKRTKHDIELYLNSMKEIEERARSCYEGPISLSSNEFVEMLVLDGCFVLELFRGATEGFKQLGYSRNDPVFAMRGSMHSIQRDMIMLENQLPLFFDPLMPTDEPLTKSDRNKLESSLGGTNTFDPLSDQEGLHCLDVFRRSLLRSGPQPDGKLQIPRLLIHDGTKSLFLNLIAFEQCHLDCSNDITSYVIFMDNLINSPEDVGYLHYRGIIEHWLGSDAEVADLFNRLCQEVVFDINNSYLSLLSEEVNRYYNHRWNTWCASLRHNYFSNPWAIISLVAAVVLLLLTLAHTYYSIYGYYRPA

SEQ ID NO: 124053 - protein, 76 aa, Glycine max
  Coding DNA Sequence Number=SeqID_7275
MDEEEPERGVKVQPKKLSGWRQREKDMKNVVGAPDSKLFFDSDLGSYFNLSSYRKWYSASMVFSLVSSNAYSFEGN

SEQ ID NO: 124054 - protein, 261 aa, Glycine max
  Coding DNA Sequence Number=SeqID_7276
MARRDKLWSFCALLSSRGGGSDDMRRQIMVIPHTPFAIQTQSCPMARRDKLWSFCTLLSSRGGGPDDMRRQIMVITHILLPFRHSRVRWHAETNYGHSAPFYHPEVAGPMTCGDKLWSFRTPLLPFRHSRVQWHAETNYGHSAPFCHPEAAGSMTCGEKLWSFRTPLLPFRHSCVRWHAETNYGHSAPFYHPEVAGPMTCGDKLWSFRTPLLPFRHSRVRWHAETNYGHSAPFCHLEAVGPMTCGDKLWSFRTHLVSHTQS

SEQ ID NO: 124055 - protein, 69 aa, Glycine max
  Coding DNA Sequence Number=SeqID_7277
MEKRTERRRRQREGDETYLGMVAKEKKQRLVTMLECDEDDARVRQTRCSDADKDLEGRQRLEEEESAKA

SEQ ID NO: 124056 - protein, 61 aa, Glycine max
  Coding DNA Sequence Number=SeqID_7278
  Gene Ontology: Mol. function=DNA binding; Biological process=DNA integration
MATPMSIACYLDKNETGQSIDIKKYRGYSDSDFVGCKTDRKSTSGTYHFTGSALVSWHSKK

SEQ ID NO: 124057 - protein, 93 aa, Glycine max
  Coding DNA Sequence Number=SeqID_7279
  Subcellular localization annotation: CTP_CleavageSite=19; ConfidenceScore=5.50e-01
MARACSPLKVRTCGPLKVRACSPTKVRTCSPLMARACSPLKVRTCGPLKVRACSPTKIDCPFERGDSPCNLILSFANLSENSLRVCVLFDLVI

SEQ ID NO: 124058 - protein, 224 aa, Glycine max
  Coding DNA Sequence Number=SeqID_7280
  Homolog annotation: Hit_ID=Q8ZMU3; Match level="QueryCoverage=44%, HitCoverage=33%, E-value=8e-36, Identity=77%"; Hit description=Fels -2 prophage protein
WFQYEPESGQLLIRNIKAVLIEASDKIELNTAHFVVNADQTWLNSPTVITGDTAIHGGTVLNGGAKINGDVTQAGGQMSSNGVVVDDHNHGGVQRGGSRTDVIDLSQLPAPEIVEVPDFETLLAERKAALIALYPAEQQAAVRRVLALESDPMVKMLQESVYREILLRQRINEAAQAVMVAYALGSDLDQLAALNNVERLTVTPANPDAVPPVDAVMEADDALR

SEQ ID NO: 124059 - protein, 242 aa, Glycine max
  Coding DNA Sequence Number=SeqID_7281
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=41%, E-value=1e-120, Identity=70%"; Hit description =Photosystem I P700 chlorophyll a apoprotein A1
  Pfam annotation: Domain name=PsaA_PsaB; Domain location=1-242; Score=- 110.1; E_value=0.00011; Accession=PF00223.9; Description=Photosystem I psaApsaB protein
AWLSDPTHIRPSAQIWRASGITSELQLYCTAIGALVFAALMLFAGWFHYHKAAPKLAWFQDIPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFM

SEQ ID NO: 124060 - protein, 95 aa, Glycine max
  Coding DNA Sequence Number=SeqID_7282
MTHTKKTGQMTSEAAKEIADTITNIVSPVDYKIPWRSRPHREALSPMDIRMYRLLPLGDQSTLVVPMLLSRVTIKHYFGWLQGAPAPLRPWLLKT

SEQ ID NO: 124061 - protein, 45 aa, Glycine max
  Coding DNA Sequence Number=SeqID_7283
MGACHIVPILLQFMSKHALTKCSVKCPNDVQHRRFKIGAQMQFQA

SEQ ID NO: 124062 - protein, 55 aa, Glycine max
  Coding DNA Sequence Number=SeqID_7284
ALKGFNDSQGSKSKAATRWIVVKYFTDQIPLEPKRMKAICIQWARYYLKVKNQTL

SEQ ID NO: 124063 - protein, 358 aa, Glycine max
  Coding DNA Sequence Number=SeqID_7285
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=8e-50, Identity=32%"; Hit description= UPI00006A17C9 related cluster
MSSPSEGYTPSPSKDHTSSPSEDYTSSPSEGYTSSPSEGYTPLPLEDYTYTSSPSEDYTSSPSEDYTSSPSEGYMSSPSEGYTPSPSEDYTSSPSELHVLTFRGLHILTFRGLHVLTFRGLHVLTVRGLHALAFRGLHILAFKGLHVLPFRGLHVLAIRRLHVLTIRGIHALTVRGLHVLPFMGLHVLTFRGLHALTFRGLHVLAIKGLHALTFRGLYAFTFRGLHVLTFRELHVLAFRGLHSLAFRGLQVLTFKGLHVLPFRRLHVLAIRGLQVLTIGGLHALAFRGLHALAFRGLHVLPFRGLHVLAIRGLHALNFRGLHVLGFRGLHVLTFRGLHIFAFRGLHICAFRGLKVLCP

SEQ ID NO: 124064 - protein, 254 aa, Glycine max
  Coding DNA Sequence Number=SeqID_7286
  Gene Ontology: Mol. function=binding; Cellular component =intracellular; Biological process=regulation of Rab GTPase activity
  Homolog annotation: Hit_ID=A0CVN8; Match level="QueryCoverage=90%, HitCoverage=10%, E-value=4e-22, Identity=29%"; Hit description =Chromosome undetermined scaffold_29, whole genome shotgun sequence
MGGGGGGIVGFGAEQVILVRDDSARKEVLDYVEKQALVLTILECKGLEFQDVLLYNFFGSSPLKNRWRVIYEYMKEQEMLEPTELKSYPNFSDSKHNLLCSKLKQLYVAITRTRQRLWICENTEEYSRPLFDYWRKKGLVQFKELDDSLAQAMKVASSPEEWRSRGKKLYYQNNYEMATMCFERAGDSYWERKSKASGLRANANRLHDLNPEDSNAMLREAAEIFEGIGMAESVAQCFSDLGDYKRVGCRSELA

SEQ ID NO: 124065 - protein, 55 aa, Glycine max
  Coding DNA Sequence Number=SeqID_7287
VSSSSPSAAAATGCSDLGSWAAEAPPLPEGEGWAPGQATCTSNSSMLMMDGKPEP

SEQ ID NO: 124066 - protein, 263 aa, Glycine max
  Coding DNA Sequence Number=SeqID_7288
  Gene Ontology: Mol. function=nucleic acid binding; Cellular component= intracellular; Biological process=regulation of transcription, DNA -dependent
  Homolog annotation: Hit_ID=Q8LJS2; Match level="QueryCoverage=99%, HitCoverage=100%, E-value=5e-86, Identity=61%"; Hit description =Histone deacetylase 2a
  Pfam annotation: Domain name=Nucleoplasmin; Domain location=1-187; Score=-69.0; E_value=0.0056; Accession=PF03066.5; Description =Nucleoplasmin
  Pfam annotation: Domain name=S-antigen; Domain location=44-251; Score= -258.8; E_value=0.083; Accession=PF05756.2; Description=S-antigen protein
  Pfam annotation: Domain name=zf-C2H2; Domain location=237-260; Score =20.4; E_value=0.0065; Accession=PF00096.16; Description=Zinc finger, C2H2 type
  Pfam module annotation: Pfam domain module=Nucleoplasmin::S -antigen::zf-C2H2; Domain location=1-187::44-251::237-260
MEFWGVEVKVGQTVTVDPMDPVDSYIHISQVALGEAKKEKPNESVVLYLKVGEQKIVLGTLSRDGIPHLSLDLVLDSDSELSHTSKNSEEDEELALEGQDNDEGAKVTKPSKPVPKIGAPAKTADPKKDEGDDSDDESDDDLAGEDEFGSSDEMDDDSDSDEESDEETPAKKVDQGKKRPNESAAKTPVSAKKAKTATPEKTNGKKNVHVATPHPSKKGGKTPNSTKGQSPSSAGQLSCASCKKSFTNEVGLQQHKKAKHGGQ

SEQ ID NO: 124067 - protein, 176 aa, Glycine max
  Coding DNA Sequence Number=SeqID_7289
  Gene Ontology: Mol. function=DNA binding
  Homolog annotation: Hit_ID=Q1SP03; Match level="QueryCoverage=74%, HitCoverage=23%, E-value=2e-13, Identity=33%"; Hit description=IMP dehydrogenase/GMP reductase
MGTNQIGKRFYQVKVKSLDTTSIKELGRLMEPLQMQAFRKTYGKILELTIAEVSIEAIASLTQYYDQPLRCFTFGDFQLVPTIEEYEEILGCPLGGRKPYLSSGCLPSLSRIATVVKDSARGLDRVKQTRNGIAGLPRRYLEDKARGMANLMQSYSARALDRKTPSRLGQRCKRRP

SEQ ID NO: 124068 - protein, 397 aa, Glycine max
  Coding DNA Sequence Number=SeqID_7290
  Gene Ontology: Mol. function=thiamin pyrophosphate binding; Cellular component=membrane; Biological process=branched chain family amino acid biosynthetic process
  Homolog annotation: Hit_ID=Q13FJ5; Match level="QueryCoverage=98%, HitCoverage=62%, E-value=1e-149, Identity=64%"; Hit description =Putative thiamine pyrophosphate requiring enzyme
  Pfam annotation: Domain name=TPP_enzyme_C; Domain location=188-343; Score=104.1; E_value=4.1e-28; Accession=PF02775.11; Description =Thiamine pyrophosphate enzyme, C-term
  Pfam annotation: Domain name=TPP_enzyme_M; Domain location=1-129; Score=123.3; E_value=6.9e-34; Accession=PF00205.12; Description =Thiamine pyrophosphate enzyme, centra
  Pfam module annotation: Pfam domain module=TPP_enzyme_C::TPP_enzyme _M; Domain location=188-343::1-129
EAADIFNQGERVAILVGAGALAATDEVIAVADRLNAGVAKALLGKAALPDNLPWVTGSIGLLGTEPSWDLMRDCDTLLMIGSGFPYSEFLPEEGSVKAVQIDITPSMLSLRYPMDTNLQGDAAQTLKALLPHLRQKEGEWRKSIEAKVAKWWKTLEERAHADANPVNPQRVTWELSPRLPDGAIITSDSGSCANWYARDLKIRRGMMASLSGGLASMGAAVPYALAAKFAHPDRPVIGLVGDGAMQMNNMSELITIAKYWSSWDDPRCVICVFNNEDLNQVTWEQRVMEGDPKFEASQSIPNVPYHRFAEMIGLKGIYVDRPENVGPAWDEALSSDRPVLLEVKTDPEVPPLPPHLTFEQMKKITETLAKGDSREAGIVMGTMRQLLSSFWPGSLES

SEQ ID NO: 124069 - protein, 181 aa, Glycine max
  Coding DNA Sequence Number=SeqID_7291
HLTETCMRAGNSDIYGFLEPQSIQRSGQSQFESESYIKSWMQSSQRDVYLGAYLNGFHCSGHWQMVVILPKEHLVVWFCSLHNRPDNYLKGIINSAIKGLDDAPQPKSKAPARWIVVKCNRQKGTIECSNYVMHWMSTIILGSFRNNWEAYFNDPRPLEPERLKALRIQWAQFYLRVRDQA

SEQ ID NO: 124070 - protein, 260 aa, Glycine max
  Coding DNA Sequence Number=SeqID_7292
VVLNAEGHPGKMLEKRLTTLAQVWSVLSYSNLAPTSHTSDLTVDRARQIFGLVSQMDMNVGALISGVASDSLVFERLSPVINLAYIRKNCWNPDDLTVTIRGARRARTRPTEAPSTSTAPPPTRTLAAPSTSAPVDFRRLEAMLQSIHQGQIILLQNLQMVAPPDSIPSVEQFNESVAWPGTQSFLHREDEGSTAQVPQQMEDESSETTTPEPLATDPSTPEDQTTLVLSLNTSPTDTLVLHLTDEEDVQTQDTQDRSQD

SEQ ID NO: 124071 - protein, 110 aa, Glycine max
  Coding DNA Sequence Number=SeqID_7293
MGIVIIKKGEIVEQRIKLNVLMMPKDYMNHMLLKDLLKTKQLEIFKMDDQDSSRVLERILNRKGIPIGLAKGLAKNFKLKKCFSTNLLSGNRLPEDVIDYQWPKLIYNSY

SEQ ID NO: 124072 - protein, 110 aa, Glycine max
  Coding DNA Sequence Number=SeqID_7294
  Homolog annotation: Hit_ID=UPI00005F74E3; Match level="QueryCoverage =46%, HitCoverage=21%, E-value=2e-19, Identity=88%"; Hit description =COG0671: Membrane-associated phospholipid phosphatase
MYESGVKSGCKSVNGRRFNRSTIQSLQGVISTQLAPTSTTDSEPTAISGDGEGAAAEIAQHKAGKNNQHHAVVAGEAVAGSVLGGDAGQLADAIDIVEGQGGARMLHRQQ

SEQ ID NO: 124073 - protein, 77 aa, Glycine max
  Coding DNA Sequence Number=SeqID_7295
MPSFRDLEQKWALKAEALLGNNGGWEKRRRRLLPHVSLRLSRPVFESNQYIYQNAQNKTPSVVQRLVSLNFKSHAKQ

SEQ ID NO: 124074 - protein, 147 aa, Glycine max
  Coding DNA Sequence Number=SeqID_7296
MVIDQSLFYDLTQLSSDGVPFEGALDDDWKFDFSVHDARRLVCTNQADMTERLLAGSLALESRILHYLIARILLPRFSNLAQVSEEDLIVIAAVVASFGYRKERNGSWAKKGAQPNDDEGQIPVEGDSSLLQSILDRFDGLQTYVGE

SEQ ID NO: 124075 - protein, 60 aa, Glycine max
  Coding DNA Sequence Number=SeqID_7297
MVVVEDEPFLFFDVSAIRDHYAYSDQIGRRQGGREEEGAAQGERRCSIYRQGQAISITAH

SEQ ID NO: 124076 - protein, 120 aa, Glycine max
  Coding DNA Sequence Number=SeqID_7298
MGTSIDSAIGKVRHGITLRIFEDIGVGLFFAPRKSFVNLVISTGAGLRAESDLGEPGRVTYFIPWAFHPIMGLECGSLARDGDFPSESAGVQFGCVLSDLFPFLSVVAWLTVACLLVLSD

SEQ ID NO: 124077 - protein, 179 aa, Glycine max
  Coding DNA Sequence Number=SeqID_7299
  Gene Ontology: Mol. function=hydrolase activity
  Homolog annotation: Hit_ID=Q2I313; Match level="QueryCoverage=87%, HitCoverage=63%, E-value=5e-30, Identity=43%"; Hit description =Cyclase
  Pfam annotation: Domain name=Cyclase; Domain location=46-177; Score= -4.3; E_value=7.6e-05; Accession=PF04199.3; Description=Putative cyclase
MNCLSVFTILCAICVHSITVTFVAYPSILGMKTRECSLCGIGVGNGVLVPPRYVPEMPVGDSTEGLRHHFLWLEKSMKNGSRANNSNMKLGVHTGTHVDAPDHFYDNYYDASFDVDSLDLTLLNGLALLVDVPQDKNITAEVMKSLNIPRGVSRVLFRTLNTDRLLENGEGVATGGVYT

SEQ ID NO: 124078 - protein, 325 aa, Glycine max
  Coding DNA Sequence Number=SeqID_7300
  Gene Ontology: Mol. function=nucleic acid binding; Cellular component= beta-galactosidase complex; Biological process=DNA integration
ASLVVLLVYADDILLACPSAACAHSIQAKLQALFRLKILGSLQYFLGLEVAKSSKSIVLTQRKYALSLLEDIGFLGCKPSSLPMDPNLKFNMLSGDLLPDPSMYKRLLGRLMYLTISRSNITFAVNKLSQYMQHPRTPHLDVVHHLLQYIKGTPGQGLHFPARNSFNLSAYADADWGGCLDTRRSTSNSCVFLGDALISWKSKKQPTVSKSSAEAEYRALSSVSSEVIWLRRLLLHFEITIPSAMLFCDSKPAIDLASNPAHHERSKHIDIDYHFIRELVQSNILKLVHVKSQHQVVDVFTKPLMLLAFSSFIRKLGLINIYSPT

SEQ ID NO: 124079 - protein, 55 aa, Glycine max
  Coding DNA Sequence Number=SeqID_7301
MQVKLQPKLTKMNTSSVQHRSIANLTSPDGLLEFNELDGNRIEKYFIKTPTYHID

SEQ ID NO: 124080 - protein, 487 aa, Glycine max
  Coding DNA Sequence Number=SeqID_7302
  Gene Ontology: Mol. function=nucleic acid binding; Cellular component= beta-galactosidase complex; Biological process=DNA integration
  Homolog annotation: Hit_ID=Q2HT49; Match level="QueryCoverage=99%, HitCoverage=51%, E-value=9e-52, Identity=32%"; Hit description =Integrase, catalytic region
  Pfam annotation: Domain name=zf-CCHC; Domain location=191-208; Score =12.6; E_value=0.0083; Accession=PF00098.13; Description=Zinc knuckle
MDDSNPFLIQTSDNPGLSLVTCPLSGENYNSWKKAIKMALLGKNKFDFVDGSILGPPLEYSSHALWQPNDNIVASWLLNSLTKEIQLAHSCTCNGIHPWHDYAQVEYAIHFLMGLNESYSSIRGQILSMDPFPSLNRIFSLVVQEEKQREIGTFVSALHSTNDASQSHAFVVKDSRYQSDHKGSATSRNRPLCAHCGRLGHTQDKCFKLHGFSPNYKKNKPSSSYTKSKTVNQVSTSTSVPDFHLTAQQYSQLMSLLQAHTSNVVTPDIESSNTSMVLSASLTKFPQNCWIVDSGASTHIDLFDSYHYVSNRIVKLPNNAVVPVIAVGNVHLSPSLTLYNVSFIPNFTFNLLSVSALLTNSAYSICFSSNQFVIQEMPNCKKIGRGDLLHGLYVLNLKDTHSTCNVSDHNSYINVVSNTCIQAINWHNRFGHTIFASVNHVSAQPFDLIHCDIWGPYKHSTYANYRYFLTIVDDCSQFTWIFLLKQI

SEQ ID NO: 124081 - protein, 61 aa, Glycine max
  Coding DNA Sequence Number=SeqID_7303
MAVSDHRVLGKVSSRCIVEHSIIPVLNPMVISCGKFKLRALVTEKFMPELVDEDMITLKDY

SEQ ID NO: 124082 - protein, 217 aa, Glycine max
  Coding DNA Sequence Number=SeqID_7304
EIEAALCIPGRGFILNAKGHPGRILRKDLTTLAQVWSVLSYSNLAPTSYTSDLTVDRARLIFCLVSHMDMNIGALISGQMTSIAQSNSSRLGFPTLIIALCRARGVVSDSLTFERLCPIINLAYIRKNCWNPYDLTVFIRGARRASARPVELPSTSTAPTPASTSIAPSVPAQTDSQCFEAILQSIHQGQIILLQSLQVVAPLGSIPSVEQFLEKVA

SEQ ID NO: 124083 - protein, 350 aa, Glycine max
  Coding DNA Sequence Number=SeqID_7305
  Gene Ontology: Mol. function=two-component sensor activity; Cellular component=membrane; Biological process=two-component signal transduction system (phosphorelay)
  Homolog annotation: Hit_ID=Q478L4; Match level="QueryCoverage=94%, HitCoverage=20%, E-value=3e-65, Identity=39%"; Hit description =PAS:GGDEF
  Pfam annotation: Domain name=EAL; Domain location=258-350; Score= -88.7; E_value=9.4e-05; Accession=PF00563.11; Description=EAL domain
  Pfam annotation: Domain name=GGDEF; Domain location=83-244; Score =198.7; E_value=1.3e-56; Accession=PF00990.12; Description=GGDEF domain
  Pfam module annotation: Pfam domain module=EAL::GGDEF; Domain location=258-350::83-244
MPLAQLPATLGIAVSYRDFFQSLYTGPQAFQAWKGEVWNRHQQGHDYLVELELSPVLGQAGEFQYYVGLFSDITHAKAQQNMLEHLAYHDALTQLPNRVLFSSRLQQALLEAERQQSLVAICYIDLDDFKIVNDQYGHDYGDRLLLQLATRLLGILKPQDTLARIGGDEFAMLLCGGRTQAEYTRLLKKLLAAIEKPFTVDKFKFSISASIGYTLYPIDHNPPDTLLRHADHAMYHAKTHGGHQYHLFDLASAQQSQQQQVLLRDLLNAIKNNHIKLVYQPQICMQTGKLFCFEALLRWQHPIRGLLFPKDFLDAVEHTSLIIDIGNWVIEESLRQLTEWQDHGLRTQVS

SEQ ID NO: 124084 - protein, 78 aa, Glycine max
  Coding DNA Sequence Number=SeqID_7306
  Subcellular localization annotation: CTP_CleavageSite=53; ConfidenceScore=5.37e-01
MDMRGYHMVTRTFGQPGADVPVGARRLTSSFAPFVVLTREGYLMVTRTFRQPGANELVDARGLTSSSAPFVVLPREVK

SEQ ID NO: 124085 - protein, 134 aa, Glycine max
  Coding DNA Sequence Number=SeqID_7307
  Subcellular localization annotation: CTP_CleavageSite=63; ConfidenceScore=5.12e-01
TYQGNPCGVYPDLSSFIGSGVYPDLSSLTGSGVYPDLSSFTGSGVYPDLSSFTGSGVIQTFVVCIKRSAHTQVYHRGRLWYFVGTQPPLCFGRHWPALPTSAKKDYWSLYPKKNHRMKPIEHFLIDIIQKLFRD

SEQ ID NO: 124086 - protein, 93 aa, Glycine max
  Coding DNA Sequence Number=SeqID_7308
  Homolog annotation: Hit_ID=Q9FHJ4; Match level="QueryCoverage=85%, HitCoverage=22%, E-value=5e-07, Identity=39%"; Hit description =Arabidopsis thaliana genomic DNA, chromosome 5, P1 clone:MFC19
MVKNLVGKLGRWEAIAATFRGRHKVKSVIKKAKELREKKVDDSNMANSLSSLYAHQPSECDLGGKEGKNVGRTNRGRRYILLAKALKHRYVSQ

SEQ ID NO: 124087 - protein, 76 aa, Glycine max
  Coding DNA Sequence Number=SeqID_7309
  Gene Ontology: Mol. function=hydrolase activity, acting on ester bonds; Biological process=nucleobase, nucleoside, nucleotide and nucleic acid metabolic process
  Homolog annotation: Hit_ID=Q5H2Z1; Match level="QueryCoverage=99%, HitCoverage=48%, E-value=7e-17, Identity=81%"; Hit description =Putative Holliday junction resolvase
MEARRPGGRRPADPGRPGPAQPQACAGLRPPAAGTFQTAGGDDRRALQLGRGPPAASPSSAPKGRKRRRDAAALYA

SEQ ID NO: 124088 - protein, 242 aa, Glycine max
  Coding DNA Sequence Number=SeqID_7310
  Homolog annotation: Hit_ID=UPI00006B56D7; Match level="QueryCoverage =74%, HitCoverage=87%, E-value=7e-45, Identity=47%"; Hit description =Transcription regulator
MATPIRREPTSKPRTVPSRRIAGPAGTGAGATGSDMAAVIRQPEQVHADTRGSSLPALLQRQLEHQLGIGRHGQPAVLGQLAFQLPCAPTGTAEGDHSIGRAFAARHRFEDVARGGQVQAVAHGQAGIPRPRVVMDDEAALRMHRAAVEHHARLQVAITGGDVHLCKHFTQRVLGRLVDQHAHRPVLVVLADQRDAAGKGRVEQRRQRDEQVIGKGGRRYRHGPILPAGADMVARWARAAMG

SEQ ID NO: 124089 - protein, 50 aa, Glycine max
  Coding DNA Sequence Number=SeqID_7311
MSPPAIGGGDNNGSENHFGGGHDDNNGGDHDGDCDGYDSGDSRDELSIQQ

SEQ ID NO: 124090 - protein, 44 aa, Glycine max
  Coding DNA Sequence Number=SeqID_7312
  Gene Ontology: Mol. function=ER retention sequence binding; Cellular component=endoplasmic reticulum; Biological process=protein retention in ER
  Homolog annotation: Hit_ID=Q38JH5; Match level="QueryCoverage=93%, HitCoverage=15%, E-value=1e-11, Identity=69%"; Hit description=ER lumen retaining receptor family-like protein
MIYETRGGFLFLAGSGYFWFLAAFIAEIVQSFILADFCYYYIKR

SEQ ID NO: 124091 - protein, 44 aa, Glycine max
  Coding DNA Sequence Number=SeqID_7313
MDMGISCIDSLCGTVESMMMQLRGRLSCMWKKLTIKGEIVGLRM

SEQ ID NO: 124092 - protein, 138 aa, Glycine max
  Coding DNA Sequence Number=SeqID_7314
MSNFTSHLYSNSLPLKCEYLPHSSLPLERKLFLIHEYPMVESLELNCDFLNHLVIDANMRALVPCTTMLSLFHSHKTHRPSPPFMDSPARRLSIQEVPMPMDLPPPSYSSEPFTKLNLALIPIVVKSRGLNTGKIFTN

SEQ ID NO: 124093 - protein, 63 aa, Glycine max
  Coding DNA Sequence Number=SeqID_7315
MSVKNLVRRLEVHDKTNHAIVSQVTLTRLKGALKPGVLTSKAYTPKSSSGPLPPDSSPTRKIF

SEQ ID NO: 124094 - protein, 147 aa, Glycine max
  Coding DNA Sequence Number=SeqID_7316
GFPALITGLCQSFGVPVTPSKVIQPPITQAFIEKYCTPRQAHGDAPQAADASPPPHQADPAGSLGMERYLQHLVRQQAANHREQGQSFTPFVCPTPYQFRAEVALPGDGPEAQAGEAPVGAPGNAEEACMDEEMTNLLGFLGGSGAT

SEQ ID NO: 124095 - protein, 109 aa, Glycine max
  Coding DNA Sequence Number=SeqID_7317
  Gene Ontology: Mol. function=actin binding; Biological process =cytoskeleton organization and biogenesis
  Pfam annotation: Domain name=Transposase_21; Domain location=51-109; Score=-131.1; E_value=0.002; Accession=PF02992.5; Description =Transposase family tnp2
MQRLDMGGMIKASLHCFRCEVSWYKVKDDDECSSDESAKKDPQQRCYDNAKDLTWHVDGRNCNGMFRHSVDSSKWKKNNRLYPDFGKEARNIKLGLATDGMNPYDSLST

SEQ ID NO: 124096 - protein, 74 aa, Glycine max
  Coding DNA Sequence Number=SeqID_7318
  Subcellular localization annotation: CTP_CleavageSite=67; ConfidenceScore=5.05e-01
MTGAKLKSTYSRIRVDPGYRFYTPKTRRFAQNSRAHHSAYFGKRALEAARRAAFAEIPRFCNLVIVRGFSVMAC

SEQ ID NO: 124097 - protein, 323 aa, Glycine max
  Coding DNA Sequence Number=SeqID_7319
  Gene Ontology: Mol. function=transporter activity; Cellular component= membrane; Biological process=transport
  Homolog annotation: Hit_ID=Q13MQ2; Match level="QueryCoverage=66%, HitCoverage=39%, E-value=5e-61, Identity=55%"; Hit description=MFS efflux pump, outer membrane lipoprotein, NodT family
  Pfam annotation: Domain name=OEP; Domain location=27-213; Score =145.9; E_value=1.1e-40; Accession=PF02321.8; Description=Outer membrane efflux protein
AAGQTPGALDNELMSSKALPALPKLVAVGIPSTLARRRPDIRQAEANLHAQTANIGVSVANLFPSLSLTGQLGVRNTDASYLDDWSSHFFSVGPALSIPIFQGGRLVSSVKLARAQQASAALDYRQTVLTALQDVENALVSYRADQQQVTALDETTGALQRAFDLASDSYKQGISTFLEVLDAQRQLAQSQAQSTQARMQSALDLVALYKALGGGWEPYQQVTLPDYDVFGKELVMSRETWMTPNPASGPNSSTRTEPFVKVIALIATLGGLLFGYDTGVISGALLFMGDDLHLTPFTTGLVTSSLLFGAAFGALASGHFAAA

SEQ ID NO: 124098 - protein, 71 aa, Glycine max
  Coding DNA Sequence Number=SeqID_7320
MKKILGLQAPMELASGSGRTKFMIVEKYMNGELVRIDDVKGAMKALILVLVVISGGYKNEPIELMIGQIPR

SEQ ID NO: 124099 - protein, 118 aa, Glycine max
  Coding DNA Sequence Number=SeqID_7321
MVITYNSAVRSGASYIETPEIEQRKLMRYSNGHNFSLGGPIQAHHISRRPKLNNGSSEKFKWSLLFTRRSDSSASHIETLAVEQRKLSRYSNGHNFYLGGPIQAHNISRRRKLNNGSS

SEQ ID NO: 124100 - protein, 94 aa, Glycine max
  Coding DNA Sequence Number=SeqID_7322
GKKVASAQDFGWQSKGEDHFKSWRGWAFSPWVKVSGELGFWLRACRTAGHDICQSVGLASGSGIKGMLALGTKSILVFYFPRRRNCSNAKGGFP

SEQ ID NO: 124101 - protein, 133 aa, Glycine max
  Coding DNA Sequence Number=SeqID_7323
MAKFDPEVVLEFYANAWPTEEGVRDMQSWVRGQWIPFDVDALSQFLGDPLVLEEGQECEFSQRRNRADRFDEEAIAQLLCTPGQDFARIAAGRRVRIMHTSMTTLTQMWMTLLLSNVLPSDHNSDLPLLKCQL

SEQ ID NO: 124102 - protein, 448 aa, Glycine max
  Coding DNA Sequence Number=SeqID_7324
  Gene Ontology: Mol. function=endopeptidase inhibitor activity; Cellular component=membrane; Biological process=homophilic cell adhesion
  Homolog annotation: Hit_ID=Q8ZDJ2; Match level="QueryCoverage=99%, HitCoverage=21%, E-value=0.0, Identity=75%"; Hit description=UPF0192 protein YPO2573/y1143/YP1141 precursor
MPLRVAVDVAQIAVRLHPDQVIVRRNQRAGGRRHRAPAAGDERLRQQLQLISGVGVGFQIERDIGRAVLIGGAIFQLGFEPVAVLPIFIERIIREAIEARIHRPQRQPGAHAAILRRSTEQVLHIDAGLQLGRFDPALLTVRRQRQLHFQLIRFELLHIDRGMAEQRGGIVVFADQIQIDVPLAGRRVFIGGIAQLIETAGAQRQRHGGHQLVARIADFGAHRHAGQANAPVGGAGDQADVKGIPRPINAAIGEQVTAERARIGRRLFTGDVEAREVQPAIVIAAGRQEGDIPLLFHQEHHRLALVGVHVERRETHVAVGPGGLAEQRHAIFGHHRHVGAADRRAALNRLHKDVARLILRALGDDAQIGHHHKARIADVGLIFPSALVRFLFWLGARLFRRRFPVRLPFGQRQQEYSAMGTGVGGEIAGEIDALIVHFPRPLVVERRL

SEQ ID NO: 124103 - protein, 279 aa, Glycine max
  Coding DNA Sequence Number=SeqID_7325
  Gene Ontology: Mol. function=penicillin binding; Cellular component =peptidoglycan-based cell wall; Biological process=peptidoglycan -based cell wall biogenesis
  Homolog annotation: Hit_ID=Q8D135; Match level="QueryCoverage=100%, HitCoverage=33%, E-value=1e-128, Identity=80%"; Hit description =Putative penicillin-binding protein
  Pfam annotation: Domain name=Transpeptidase; Domain location=46-278; Score=4.3; E_value=3.4e-06; Accession=PF00905.13; Description =Penicillin binding protein transpeptidase domain
LRQQTQQLVQRDTRVDTTLDAGLQRLVERQVNAFIARNRSRGIQNAAVLLVDSRDMGVRALVGSADYYNRPIQGQVNGTNAKRSPGSTLKPFIYALGMEQGVLHPMTILKDVPSSFGAYAPENFDRRFLGPVTATDALNFSRNIPAVYVASQLRQPTFYQFLRLTGVANMANESHYGLSLVLGGGEVTAQELAKLYALLANRGELRPLRMQLNEAESTPVRLLSEEASFITLDMLRQHRRPGDTLAQRSSSLPVYWKTGTSWGFRDAWSVGIFGPYVLV

SEQ ID NO: 124104 - protein, 240 aa, Glycine max
  Coding DNA Sequence Number=SeqID_7326
  Gene Ontology: Mol. function=protein transporter activity; Cellular component=membrane; Biological process=transport
  Homolog annotation: Hit_ID=Q0GQU9; Match level="QueryCoverage=99%, HitCoverage=91%, E-value=1e-132, Identity=99%"; Hit description =Putative MotA/TolQ/ExbB proton channel
MAGRGAGAGRTHVALQDVGELFDEGFLLAGHAVDLVGVAVVGRDGRDGGEQAHGRGHQRLGNAGGHGGQRDLLHVGKAGEGVHHAPDGAEQAHVGRDRAHGAQEGQARFDLVHLALEAGAHGAAGAVHQLVHIGDAALAQLLVLAHAAGEDAFHGAALLGVVGRRGIEVVEAGARPEVLLEAVVERAHALQGLRLAEDGGPAGHRGAHKDQHDQLHDPAGLQHEAEYGHVMGVHESCSRM

SEQ ID NO: 124105 - protein, 52 aa, Glycine max
  Coding DNA Sequence Number=SeqID_7327
MESEFVALEIANTAKRWNNFHRLCKVRRKLSRSFDETLREEYDIRNIKWSGT

SEQ ID NO: 124106 - protein, 85 aa, Glycine max
  Coding DNA Sequence Number=SeqID_7328
AANHRAHAQTHDCLYQLSLSLQSQGFTSFPCPTPDQFRVEVAWPGDWPEARVGEAPAEAPDDADEAREDEEMTDLLDFLGGSGAT

SEQ ID NO: 124107 - protein, 78 aa, Glycine max
  Coding DNA Sequence Number=SeqID_7329
MVLGGCGSGVWVDDGIEWRPYLLGRNMDICVCAYLLGYKKKEKKEVQEIKGKYDKRKGTVIFWTSPTHLIILPKSLKV

SEQ ID NO: 124108 - protein, 259 aa, Glycine max
  Coding DNA Sequence Number=SeqID_7330
MDKARLVYGLVMKIDMDLGSIISGQISQMAQSYSSRLGFPALITALCIARGVVPDSLTFESLSPVINLAYIRKNCWNLDDPTITLPGTRKIRAQGPDASSSAPPASAPAPPIPTPAPPTPFGTSAQSTGAVVPILHSLHHGLCMHRSAWRISWPRWPGQESSLLLWGEVRLLQPRSCSQSRRQRPRLLRRRPQRSPLLLHHLWRLLRKRMALQTQIMQLIWRRHRAPGIPWPTPALDTSLPAQDAPFIPQDDPTQAQDD

SEQ ID NO: 124109 - protein, 69 aa, Glycine max
  Coding DNA Sequence Number=SeqID_7331
MGKGNLQMGIDDQKITFDLFDAEKHSLKPRLLQTLKGERVITLSATYSLAKLIYALSEMVSLSAMPAAS

SEQ ID NO: 124110 - protein, 72 aa, Glycine max
  Coding DNA Sequence Number=SeqID_7332
MHETQCGPLRVHRMNRKAWFEQNRGGGCRPARPGELSSPRRARLLPPEATAFWRNILEGPSGPGCYLHPHFY

SEQ ID NO: 124111 - protein, 68 aa, Glycine max
  Coding DNA Sequence Number=SeqID_7333
MEPCISEYGVMGMDDQRGSLFGSPIHIGALYIFKEDVYGFGVILLELVTAHFGSIQPNWWLDFYGFIG

SEQ ID NO: 124112 - protein, 60 aa, Glycine max
  Coding DNA Sequence Number=SeqID_7334
MEATWEELLIIPERLGCQARERWTSIIFMSFLLPIPLRVIFASVDPAVIAVSKSALALII

SEQ ID NO: 124113 - protein, 98 aa, Glycine max
  Coding DNA Sequence Number=SeqID_7335
  Homolog annotation: Hit_ID=P46278; Match level="QueryCoverage=36%, HitCoverage=8%, E-value=3e-09, Identity=80%"; Hit description =G2/mitotic-specific cyclin-2
  Subcellular localization annotation: CTP_CleavageSite=48; ConfidenceScore=5.05e-01
MALSISPPFILYSLKSLTQEKLMLNTLQFNMSVPTTYVFMKRFLKAAQADRKEHAASAVLNFSEDCTPHMLTPYLDGIVSKLLAHLPRFSHLCLLAGT

SEQ ID NO: 124114 - protein, 139 aa, Glycine max
  Coding DNA Sequence Number=SeqID_7336
  Gene Ontology: Mol. function=identical protein binding; Biological process=negative regulation of enzyme activity
  Homolog annotation: Hit_ID=Q1S4Q1; Match level="QueryCoverage=67%, HitCoverage=12%, E-value=5e-20, Identity=53%"; Hit description =Protease-associated PA; Proteinase inhibitor I9, subtilisin propeptide
  Pfam annotation: Domain name=Subtilisin_N; Domain location=70-139; Score=16.7; E_value=0.0034; Accession=PF05922.7; Description =Subtilisin N-terminal Region
MVFSTIVVVEEHGNYKNVTDKATTTGFEHRCRRCVDPTQATKQASSTSKLHLIFLFPLLNIENVYKFLMTSYIVYLGSHSFRPNPSSIDVESVTMSHYDLLESYVGSTEKAQEAIFYSYKRYINGFAAILNEDEAANVS

SEQ ID NO: 124115 - protein, 109 aa, Glycine max
  Coding DNA Sequence Number=SeqID_7337
MVGVFSKVGLVDELVKLLQDKKAEGTRLDQRLYQSALNAFKDARLQIQERHLRCTKISIIDIYHSKGTTVIKCICPGDTLRRNLPYIYSNTPDDSLQLNMRQNAAKWNL

SEQ ID NO: 124116 - protein, 129 aa, Glycine max
  Coding DNA Sequence Number=SeqID_7338
MTEVVVVDIHRHLEQRRCGARCRYRFSTDVEASFCSCDSFHRKELADGVCHSAVKPVMNGCRRGQTFCRDASAAPPCRESSPPAKAPEPPPMTSPSTAMATLRLYLDFELLMGRKRRRDREENWFDGTI

SEQ ID NO: 124117 - protein, 141 aa, Glycine max
  Coding DNA Sequence Number=SeqID_7339
  Gene Ontology: Biological process=ubiquitin cycle
  Homolog annotation: Hit_ID=Q1S9B4; Match level="QueryCoverage=72%, HitCoverage=34%, E-value=1e-17, Identity=38%"; Hit description =Cyclin-like F-box; Serine/threonine protein phosphatase, BSU1
MPPLLTTCIHFSRTSVKLSTLFHWLVVGSTSHDVHPLLIGPNASDAAAKDVDLAVEDSCGGEFTADAHGGTAEPTVEVAVNEPDVGGGEVVDGAAKDVDGGAEDGVGGADGGGGDRGKGSEEGVIRVCGVEREALEEKGVA

SEQ ID NO: 124118 - protein, 91 aa, Glycine max
  Coding DNA Sequence Number=SeqID_7340
  Gene Ontology: Mol. function=unfolded protein binding; Biological process=cellular protein metabolic process
  Homolog annotation: Hit_ID=Q70EL6; Match level="QueryCoverage=54%, HitCoverage=9%, E-value=1e-12, Identity=78%"; Hit description =Cytosolic chaperonin delta-subunit
ASPSAAVKLCLGDLLVMGSNPETASLHMQGKEWGVLANDFAIEGSAGGLHEGVAVRELDSNGHDGEKIHSLDGNLVEGVDREVALVPLVTV

SEQ ID NO: 124119 - protein, 75 aa, Glycine max
  Coding DNA Sequence Number=SeqID_7341
MSSATLEGVEVVFHMAAPNSSINNYQLHHSVNVQERCVPTSFSTIFLKAIHLVICSPEHKVQDHHRIKTQTTNWE

SEQ ID NO: 124120 - protein, 155 aa, Glycine max
  Coding DNA Sequence Number=SeqID_7342
  Homolog annotation: Hit_ID=Q10T54; Match level="QueryCoverage=31%, HitCoverage=15%, E-value=6e-14, Identity=69%"; Hit description =Palmitoyl protein thioesterase containing protein, expressed
MASNGINLFKELRHGPIYQKTIPSKTELYIEDWIGLRTLDETGKVHFISVLGNHLGISKEDMKKHVVPYLKDHIFVQDSINKARFRMQGVNQKVIQSNMMEQSQKEEVEPSSSPLLDGSLSYWWPTPWKLLQIQHNVVKEGCAKGFLLGAGIQSF

SEQ ID NO: 124121 - protein, 91 aa, Glycine max
  Coding DNA Sequence Number=SeqID_7343
MARCFLFPIWRSLCLQRETHTRWPLCLWRTCASGVERELSVRENDFVAEGGVQARAWSGKTYGHFMTNQTSPAFALSNRGINAPRAWNSPR

SEQ ID NO: 124122 - protein, 133 aa, Glycine max
  Coding DNA Sequence Number=SeqID_7344
  Gene Ontology: Mol. function=catalytic activity; Biological process =trehalose biosynthetic process
  Homolog annotation: Hit_ID=Q45RR4; Match level="QueryCoverage=55%, HitCoverage=55%, E-value=4e-27, Identity=76%"; Hit description =Trehalose-6-phosphate phosphatase
  Pfam annotation: Domain name=Trehalose_PPase; Domain location=1-131; Score=-49.1; E_value=0.001; Accession=PF02358.7; Description =Trehalose-phosphatase
MSHCFPFPPRGYTNKGYEKKATTEDMELLTKSWAALVEKVRLVLNEYPQLRLTQGRKVIEICLTIKWDKGKALEFLLESLGYENSNDVFPIYIGDDQTDEDAFRLTNAATPSQLVRGVHVKHIPTVKDDKYIL

SEQ ID NO: 124123 - protein, 95 aa, Glycine max
  Coding DNA Sequence Number=SeqID_7345
MSLANLFGKLQEHEMELMILNQQEENDKKKKGIALKAASSIQEESDKEDLNETEEDDDFSFFVKRFNKFLRNQGDRRRTNFNPKKRREDSSSVPK

SEQ ID NO: 124124 - protein, 122 aa, Glycine max
  Coding DNA Sequence Number=SeqID_7346
  Homolog annotation: Hit_ID=Q8H6Q8; Match level="QueryCoverage=85%, HitCoverage=3%, E-value=1e-12, Identity=34%"; Hit description=CTV.20
MTKTTTNPKGKLPLAKMEHEFWDKNPFKKTAKAFPSRFRYKPTTILKSRTFYELILVDSNSVSIKHFKDPKDQTLNTHSTIQILKVLQPRHFGSDLNRGKRFSVPFDPVGYTYWDYIDVWTK

SEQ ID NO: 124125 - protein, 379 aa, Glycine max
  Coding DNA Sequence Number=SeqID_7347
  Gene Ontology: Mol. function=RNA-directed DNA polymerase activity; Cellular component=intracellular; Biological process=RNA-dependent DNA replication
NGKLITVSGEEALLVSHLSAFSFIGADETEGTSFQGLTLEGKKPERNEVSFATWKSAQKVVQEGTGVGWGKVVQLLESKNREGLGFASSAGSATNSVGSSSITSTFCSAGFINNSPEANAVLEDAPEEIVLAFVTPGKLVRNWDAVDIPSVVHASKLGIYEPVEHNNPALSPNFESPVYEAEEEEDDEIPEELARLLEYEKKTIRPHEEVVEVINLGTEEDKKEVKIGASLEATVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGYNQIKMA

SEQ ID NO: 124126 - protein, 162 aa, Glycine max
  Coding DNA Sequence Number=SeqID_7348
MRDSKRAIVIHMLKIFKIYVVLVMGHFSLRKLRAILIHVVKRSDFNLRVIRNIPTNEDYNISLQMVLSENEKVVIVEISNLKIGDKEEFKRLGSDRMLPPKDVDLRDSSSSSASSTNLLPQTFKASFNYGSSSSLDSSPLDQGVKMRKIAKNVVDIEASKEP

SEQ ID NO: 124127 - protein, 98 aa, Glycine max
  Coding DNA Sequence Number=SeqID_7349
  Gene Ontology: Mol. function=transferase activity; Biological process= DNA integration
MEAEFTVVARGAVLWKSAKQSVVVASTMEAKFVACFKATIQPNWLWNYTLGLGIINNIARLLKMYCDNCATLFFSKNDKYSKGDKHMELKYFFMKEKV

SEQ ID NO: 124128 - protein, 332 aa, Glycine max
  Coding DNA Sequence Number=SeqID_7350
  Gene Ontology: Mol. function=sequence-specific DNA binding; Cellular component=endoplasmic reticulum; Biological process=lipid biosynthetic process
  Homolog annotation: Hit_ID=Q8W4Y5; Match level="QueryCoverage=67%, HitCoverage=73%, E-value=1e-102, Identity=77%"; Hit description=ASC1- like protein
  Pfam annotation: Domain name=LAG1; Domain location=94-271; Score =230.2; E_value=4.5e-66; Accession=PF03798.6; Description=Longevity -assurance protein (LAG1)
MTTMSSLSLSLDWHNESYPAYHDFYLLPIFALFFPSLRFFLDRFIFEKVARRLIFGKGHAALDYQTDERRKKISKFKESAWKCVYYLSAEILALSVTYDEPWFTNTINFWVGPGTQVWPDQKIKLKLKAVYMYAAGFYSYSIFALIFWETRRSDFGVSMSHHVATVILIVLSYIFRFARVGSVVLALHDASDVFLEIGKMSKYSGAETMASFAFILFVLSWIILRLIYYPFWILWSTRATTMIQCLIICRAVTNTDNNETQVLTAEETEEPELDGICQRSPILILVDSGANHTFISKRLVTALGIPIKATCLMRIKMGDGYKVIAPQRHDPP

SEQ ID NO: 124129 - protein, 108 aa, Glycine max
  Coding DNA Sequence Number=SeqID_7351
  Gene Ontology: Mol. function=protein serine/threonine kinase activity; Biological process=protein amino acid phosphorylation
  Homolog annotation: Hit_ID=Q9AR92; Match level="QueryCoverage=56%, HitCoverage=11%, E-value=6e-20, Identity=77%"; Hit description =Protein kinase
MGRCWGVGVGDWGDNTRSCPTSLPCLLTATLTLEDNQSVHVVMELCAGGELFDRIIAKGHYSERATASICSQVVKLVNTCHFMGVIHGISSQRISCYLVRMIRDFSRP

SEQ ID NO: 124130 - protein, 58 aa, Glycine max
  Coding DNA Sequence Number=SeqID_7352
  Gene Ontology: Mol. function=DNA binding; Biological process=DNA integration
MKDEMKSMQDNDVWNLVELPKGVKPIGCKWIFKTKRDSKGNVERYKAHLVAKATSNGC

SEQ ID NO: 124131 - protein, 35 aa, Glycine max
  Coding DNA Sequence Number=SeqID_7353
MKNWERGFRESNGGVRTRFNRLQHLVIDYTLPDLL

SEQ ID NO: 124132 - protein, 84 aa, Glycine max
  Coding DNA Sequence Number=SeqID_7354
MPKYDPEVIMEFYANAWPIEEGVMDKRSKVRGQWIPYDTDAINQFLGNPLILEKGKQCEYTTRRGQTTGFDEEAIGSAALLPRT

SEQ ID NO: 124133 - protein, 135 aa, Glycine max
  Coding DNA Sequence Number=SeqID_7355
  Gene Ontology: Mol. function=chitin binding; Cellular component =extracellular region; Biological process=chitin metabolic process
  Homolog annotation: Hit_ID=UPI0000612705; Match level="QueryCoverage =81%, HitCoverage=91%, E-value=8e-11, Identity=29%"; Hit description =UPI0000612705 related cluster
MTDPLDESISCFLIRVNPWVLVPITFRGLHAFTFRELHLLAIKGLRALAFVGLHALTFQGLHVLIFRGLHVLTFRGLHALAFIGGLHVLAFRGQHVLALTFRGLHVLTFRGLHVLTFKGLHVLTFSGLHALAFKG

SEQ ID NO: 124134 - protein, 85 aa, Glycine max
  Coding DNA Sequence Number=SeqID_7356
MVLPSLNMSDAILLRKGPVTRAMSKRLQEDWARATEEGSRVLMNLGVDFLAHGPRLGPIIFVHIRLGWNYIWSLYLGLHNVGRAP

SEQ ID NO: 124135 - protein, 173 aa, Glycine max
  Coding DNA Sequence Number=SeqID_7357
  Gene Ontology: Mol. function=DNA binding
  Homolog annotation: Hit_ID=Q1SP03; Match level="QueryCoverage=86%, HitCoverage=27%, E-value=2e-14, Identity=33%"; Hit description=IMP dehydrogenase/GMP reductase
MGTNQTGKRFYQVKVKSLDTTSIKELGRLMEPLQMQAFRKTYGKILELTLAEVSIEAVASLTQYYDQPLRCFTFGDFQLVPTIEEFEEILGCPLGGRKPYLSSGCLPSLSRIATVVKEGLDHIKQTRNGIAGLPRRYLEDKARGMANQGDWVPFMDVLALLIFGSSSFQTWMV

SEQ ID NO: 124136 - protein, 223 aa, Glycine max
  Coding DNA Sequence Number=SeqID_7358
MTEIGKLDHLEERLRVIEGGEDYALANLEELFLVPNIITPPKFKVSDFDKYKGTTCPKNHLKMYCRKMGAYGKDEELLIHFFQESLIGYNSDMAPDRMQLQNMCKKGNESFKEYTQRWRDLAAQVAPPMTEKEMITILVDTLPVFYYEKNGEKTGANEEDEDEEGTHVEAVIPTWPNFPPAQQCHYSANISSSHYPPPNHPQKSSLKSTTKPICRTSNNEHHL

SEQ ID NO: 124137 - protein, 221 aa, Glycine max
  Coding DNA Sequence Number=SeqID_7359
VRGHLIKFDEDTLNTFLKTPVVVEEGETLCAYSRFALLRPNPQDLAAKLCIPGRGFELNADGQPLKILRKNMTTLAQTWSVLSFSNLIHTSHTYYVTLDRAKLIYGIIMKMDMNVGYLISHQISLIAQHDTSRLGFPALNTALCKARGVQSDSRKARGKRSEVPTTSAPETPAPSSSTTPLPPTQIPSLQGLGLPSIMSMEEFDAQSLEENEHVIGNMSEN

SEQ ID NO: 124138 - protein, 139 aa, Glycine max
  Coding DNA Sequence Number=SeqID_7360
MTEAVCMDNRLGIFARHLTSRFRMTETVCTDNRLGISIRYLTSRVRMTETVCKDNRFGISIRHLTSRVRMTETVCTDNCLGISVRHLTSRVRMTEREEDDGAEDDVSLCMLPDFESNIYRKSVYMDNHLGISAYHLTSR

SEQ ID NO: 124139 - protein, 117 aa, Glycine max
  Coding DNA Sequence Number=SeqID_7361
  Gene Ontology: Mol. function=DNA binding; Biological process=DNA integration
  Homolog annotation: Hit_ID=Q1S1B7; Match level="QueryCoverage=99%, HitCoverage=18%, E-value=2e-28, Identity=54%"; Hit description =Integrase, catalytic region
MASIRHWPIHQLDNKNAFLHGDLEGIYMEQTPGFDAQGEWGNDAATIYRLKKHLFSHLQTNDLGCLKYLLGIEVTQSNGCIVISQRKYALNILKEAGMIKCRLIDSPIDPNQKLMAE

SEQ ID NO: 124140 - protein, 73 aa, Glycine max
  Coding DNA Sequence Number=SeqID_7362
MSGSNEEKETKLRVEIKELLKEASSLSQPSTFAQAAKLKRLAAAKERELAKWSHRDHAVVTTHKVRQVTSEAC

SEQ ID NO: 124141 - protein, 1401 aa, Glycine max
  Coding DNA Sequence Number=SeqID_7363
  Gene Ontology: Mol. function=RNA-directed DNA polymerase activity; Cellular component=nucleus; Biological process=RNA-dependent DNA replication
  Homolog annotation: Hit_ID=Q1SLB1; Match level="QueryCoverage=33%, HitCoverage=91%, E-value=3e-93, Identity=34%"; Hit description=RNA -directed DNA polymerase
MKMNLGLMSIHPTPLMRPISKCRTRVAVVVQEFGGEWINDKGEHGRDAGNRGNQGYFSYKLGGGGVQDVHQVEKKLDSMVFGGLKMYVNTPKFGRPSSKIAVRGRAEGKQYLEGSRNMYLSMKPGTKASVHQGSYTEAVRRQMPKTEQRRIPHKEELICLSSRSSLILDILVTWQQWLKGAWVGRLKNLALFDRLENGMLWDIGENISPKYIGDDMVLLLGLTEEKAKRVMEEEDGGWGEMFNSLQKWDSQLRLAYRLTWVHCWGIPLIAWDIHHIKQIVSSIGNMVDANDDVEEQRKLDMARILIKTPWKPLIQHMVNVQIQGEVYVVHIVEESGKSCVNCRRQQWNDHSSSEEICLEESEARMTWGDSPPTWWKCMLLQNRMAASGESSRGVTASGEENDEEHLAGAKEVRTAAAENNSVYGKWQAMSASPAQGKETTMEGKEAQSRWNDATQALTERPSEDGASVNIDVNQQKWETTPVQRSPKKLVNSSNRASEEADSWKGTIGSGDGLDLADMAITRWVHAQNDSDQSTEDDAQSYHREEAVLAQTDLHQKGDKGHKGRGASEDSREKFHGSGKMGADLNVEDIGNFKFDRDEPRDRQLKNQYPGGYWCLLGDFNNIRTTSERMGTCQRGLVDGSIKEFNEWIEELKVEEVSWVGKQFTWFRPNGTADRFLVSPKWLSKCPGSSQFTLRRNFSDHCPVMLRSNCVDWGPKPFRILDCWLPDNSFKKVKIKALKDKIKVWNREQFGDTYKKIEEDLNKMEEETTNRQLKNHERKVRNQLQQELWEAAQAYESLLRQKARSKHRSNCLNGVLTDGSWKDEPTIVKEETIDMQQNDMLVERFQEEEVKRAVWSCGSDKSPGPDGLNFKFIKQFWDIIKSDFLRFLDEFHLNEVFPRGLNASFIALIPKVADPQVLNEYRTISLIECTYKILAKILANRLKKVMHFLINERQSTFIEGRHMLHSVMIANEVVEEANRCQNPCFIFKVDYEKAYGSVSWEFLSYMMRKMGFCSKWIQWIEWCLKSASVLVLVNGSPSYEFIPQKGLRQGDLLSPMMFNIVAEGLNGLMTNAIYKRLYRGFLSGTNKVEISLLQYADDTIFFGEASMENVRAIKAILRAFELASGLKINFSKSSCGDFGVSEQVPKKVEDKLVRLQRNFLWGGASEQNKIAWIRWEMMCLPKEEEGLGVKDIRSFNTSLLGKWKWKLFQNQGEMDLKILSQYPQQGQRLNISIVWKVGRGDKFKFWEDTWTGGHIQLSEKYPRPLFNSEIDMAVSFIQEVEGFRIRSHIGDHWMWEAYSSGQYSVRSAYSLLRQQVVEEAQINGGDSWPFVLSLQQSSSGLMGIVVLVERPLSATGTSVAEQFCVAAGAVAIVTEAGVAIWAEENDVVLWNPNDAVATVAPE

SEQ ID NO: 124142 - protein, 72 aa, Glycine max
  Coding DNA Sequence Number=SeqID_7364
MATPTAKVMEYLYFTTSSLTHSKSAMARKNDEAEERKTTVIEIGSLVGESTEGSPMEARGSSTSTMQNPQPL

SEQ ID NO: 124143 - protein, 90 aa, Glycine max
  Coding DNA Sequence Number=SeqID_7365
MSRFKNEVRKAKQKRDKREGSTKADSHKSDKLQLLLKGPKYECYSPLTVNRTTIQHSPLSVLRCHEAWLKNPALLGYLKLMGYTPYTMET

SEQ ID NO: 124144 - protein, 229 aa, Glycine max
  Coding DNA Sequence Number=SeqID_7366
MKLTGKIGWVSLNNMSKKLFEFDSNGFHRFKDRFFKVLGTDVVDDGLTLMFNRDREPRFPSTENLIPLDPLAILSLSFMSDPLTALDDKYFTLSYFFVVELHLRLDPLVGLHHRLLSPPLLEKGGQLAGEIGLVVGVAEVAPSRKKSRAFLSLQALRQAARLTPSLVLHDVPPAPMIVKALASIVVVVVTPTSPSPSIVSAQEVLSTILVVARLVEPGPLIAIVVLIKE

SEQ ID NO: 124145 - protein, 800 aa, Glycine max
  Coding DNA Sequence Number=SeqID_7367
  Gene Ontology: Mol. function=RNA-directed DNA polymerase activity; Cellular component=mitochondrial respiratory chain; Biological process=RNA-dependent DNA replication
  Homolog annotation: Hit_ID=Q9LZA5; Match level="QueryCoverage=86%, HitCoverage=91%, E-value=0.0, Identity=52%"; Hit description =Maturase-like protein
  Pfam annotation: Domain name=Intron_maturas2; Domain location=499 -658; Score=92.9; E_value=9.4e-25; Accession=PF01348.12; Description =Type II intron maturase
  Pfam module annotation: Pfam domain module=Intron_maturas2::RVT_1; Domain location=499-658::75-331
MVASLHLHIRRIVFGNAHPRLHSTLTKPQLKALVLDHYSHGKFSNLIQNIVASPPVLHTACQNLSPSFPPPDCFSIPATCRELLENRFDVASCCLTLTPSFVLPNLKLKVVIEAIRMVLEIVYDDRFVTFCYGGRVGMGRHTAIRYLKNSLENPTWWFTVRFKPHRFQHFHVEKLCSVIESKVKDSIFIDLIKRLFQCKALVIELGADWLGRGLPHECGLCSILINVYFDAFDKEIQEMRLRENRENRELDPKIIASGLYSDVFYKPVKVYAVRYLDEILLATSGSKMLALELRMGVVKTLELGLGLRVDKVNTAIHSAVSEKIEFLGMELQAVPPSILRPPMSEKAIRARKKYLRQKEVRALELRNARARNRRKLGLKIFSHVYKKIKQSDGFKFDFSIENQVREIFRSWADEVVQEFLGNIDECQEWHRSLSAGDFLQLRHIRNQLPPELVDAYDKFQEQVDKHLNPIEARKAIEEEERRVKEEEEQNYSKGTVEDLTKLCMKVEAPEILIRKAVKLVGFTNHMGRPRPIEFLVALEDADIIKWYAGIARRWLDYFCCCHNFKTVKTIVTYHLRFSCILTLAEKHESTKREVIKHFSKDLRVYDMNGNHEVYFPTEREVKMMGDRNLSDPKPVDGALSLAVVRLASDEPPCHCIAHFCDKTTTVFYRVHLLQNRLNVSPLDKEKWVQGMGVIHESLNRSVIGVAAGLARNIMTGMVEGTVMMVGACEGAMSGVGFVGKIEVAGCIVYCCKYVQEASLDAADFVMEVVSLLTNLQYHDSKVLEHASVCLTRIAEAFASN

SEQ ID NO: 124146 - protein, 106 aa, Glycine max
  Coding DNA Sequence Number=SeqID_7368
MVWRLQSPILLLESVSIDLQEANDSIDEEDPRPTSSTWSYITLSTRFNLKKGNKIKNEWSKSVRRNIAFLFKVHDGPLTRIATPPTVAKPSSPHNTLNIIITCIPL

SEQ ID NO: 124147 - protein, 100 aa, Glycine max
  Coding DNA Sequence Number=SeqID_7369
MVLESILDPSLGHLHLTHSRLKVLGVSPPNLSQKNHDLELIHRWIVVKFDYHVRNPILSILTIGNCKNMSELREIPFTPYLSLFPQKPRMVSVKLQSRFR

SEQ ID NO: 124148 - protein, 128 aa, Glycine max
  Coding DNA Sequence Number=SeqID_7370
  Homolog annotation: Hit_ID=Q9SV02; Match level="QueryCoverage=58%, HitCoverage=15%, E-value=7e-08, Identity=43%"; Hit description =Serine-type carboxypeptidase like protein
ALGVAKPSVASYLSQEILAEQEADRVHGFPAQPQVQEYGGYITVNETQGTTLFYGFSRPLANQNKNPFSYGSMEAVAGLTQPNNAKPIVDSSFSKAKPEDSLDPQFKPPQASQLVSVFTILFLFGCSN

SEQ ID NO: 124149 - protein, 233 aa, Glycine max
  Coding DNA Sequence Number=SeqID_7371
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=8e-31, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGLHALPSRGGLHVLPCRGLHILHFRGLHVLAFRGVDVLTLRGLHALTFRRLYVLPFRGLHALTFRGLHALAFRGLHVLTFRGRHVLTIRGLHALAFRGLPVLTFRGLHVLLFRGLHVLLFRGLHTLAFRGMDIFTFRGLHALTFRGLHVLAFRGLHVLTIKGQHVLVIRGLHALVFRELHAHAFKGIHFLTFRGLHVLAFRGLHALPFRGGLHVLPCRGLDVLLF

SEQ ID NO: 124150 - protein, 112 aa, Glycine max
  Coding DNA Sequence Number=SeqID_7372
MYCTPLPFHQTFGQTCESVGVTSHEWMTNLFCIDLNTPNSMPSYLNSLQQFNAPHSFREQGQGSSAATTYTKYTNIEQQHHHHVREPVIQKRRNLQRNQRPPPYRTGHRLDH

SEQ ID NO: 124151 - protein, 156 aa, Glycine max
  Coding DNA Sequence Number=SeqID_7373
  Gene Ontology: Mol. function=phosphotransferase activity, alcohol group as acceptor; Biological process=carbohydrate metabolic process
  Homolog annotation: Hit_ID=Q2YBK8; Match level="QueryCoverage=92%, HitCoverage=38%, E-value=4e-39, Identity=57%"; Hit description =Anhydro-N-acetylmuramic acid kinase
  Pfam annotation: Domain name=UPF0075; Domain location=11-156; Score= -81.8; E_value=1.4e-11; Accession=PF03702.5; Description =Uncharacterised protein family (UPF0075)
MNSPALPTSTRLFIGLMSGTSLDGVDAVIVSQHGEQVTQPGHYFVPYPADLKQSLLDLHTPALDEIHQAAVISNRLAELYAQAVKGLLAESSLRASEVTAIGCHGQTIRHCPDLPNGQAYTLQLGNHARLVELTGITVVGDFRSRDIAAGGQGAPL

SEQ ID NO: 124152 - protein, 104 aa, Glycine max
  Coding DNA Sequence Number=SeqID_7374
MANQGDWVPFMDVLALLIFGVVLFPNVDGLVDLAAIDAFLAYHHSKESPVVAVLADLLDTFDRRIDWDQLLAGIGGRTISWFPRWKEGKEGVLFSCGGYPNIPL

SEQ ID NO: 124153 - protein, 199 aa, Glycine max
  Coding DNA Sequence Number=SeqID_7375
MGIRQVGPIYGNLELRNSNRNKYAVIVYEFGRILLDYSIRSWQNSEAKVDVISGERDTPKDAMDKAAGIFLREEINEGEIEAIELNASSSERSSYEDDAYQAIGDEYDYLVNNNDGYQGGFSGKSENLLDGNHYNVSGEEDMDIDDKVDYDDDDDRQIDLVVDDYTIGGDSDARDKKEENAEQNIDPDGVGSTSSYYSD

SEQ ID NO: 124154 - protein, 141 aa, Glycine max
  Coding DNA Sequence Number=SeqID_7376
  Gene Ontology: Mol. function=two-component response regulator activity; Cellular component=nucleus; Biological process=two -component signal transduction system (phosphorelay)
  Homolog annotation: Hit_ID=Q8L9Y3; Match level="QueryCoverage=64%, HitCoverage=23%, E-value=1e-15, Identity=50%"; Hit description=Two -component response regulator ARR14
MSLDDATSTVMKAIAYGALRDPKKNSSNSQESDPDVCYAPPGKKSRLVWQGELHHHQFVKAVNVMQVGLDKAQPKRTLEVMNIPGLTEEHVASRLQKYRLNLKKSNKEVVQQDEMSLPNCIESRGRVGPFGRFDLDRFWRN

SEQ ID NO: 124155 - protein, 193 aa, Glycine max
  Coding DNA Sequence Number=SeqID_7377
MPPKKREATVAALEQEVANLKVTLAEMQTKAEENQEKLVSLLTNKEAESPRKSNISTLQNRGSVTGGNPGSHVLHENSLEDFRQPTKKVEVSMFSDKDPVAGLHALKCTFSNFQLSNNREVWMITSANLNDSRWRCRVFQMNNILGIFHPWTPIEYPRKGEKHEGVGSSFSFQIVESDTSRIKGGARTKTSLE

SEQ ID NO: 124156 - protein, 178 aa, Glycine max
  Coding DNA Sequence Number=SeqID_7378
  Gene Ontology: Mol. function=nucleic acid binding; Cellular component= nucleus; Biological process=regulation of transcription, DNA-dependent
  Homolog annotation: Hit_ID=Q1RVR4; Match level="QueryCoverage=55%, HitCoverage=28%, E-value=1e-18, Identity=47%"; Hit description =Peptidase aspartic, active site; Aldehyde dehydrogenase
  Pfam annotation: Domain name=RVP_2; Domain location=59-160; Score= -37.4; E_value=0.00082; Accession=PF08284.2; Description=Retroviral aspartyl protease
MESTGAGANPRTEIKGHDICHFRNSPKGGRKCPERQLQIMMRDDEEDDEGEDGRQFRTMKSQGKIRGVPVLLLVDSGATHNFVFAQLAETMGWPITETKPMRIKLGDGYRAMSRGRNTGVKLELDASTIELDALLFDLEGIDVILWMAWLASLGGMGSGKSYMEPQRVAQSRWPYKVS

SEQ ID NO: 124157 - protein, 95 aa, Glycine max
  Coding DNA Sequence Number=SeqID_7379
MSCLWTRSLGVMREAPLTLYTEVGMILESYVVKKGNIEVIALVFARDRDRSLGTIRFHVALSNGVSTVGPIYKTTSVKSNNADCSTWLIARREGQ

SEQ ID NO: 124158 - protein, 69 aa, Glycine max
  Coding DNA Sequence Number=SeqID_7380
MGCSASREVGVWAMRGRRTSSDEGFRFFGGGIWSWGWWWRRGEGGDMEKGRGEKKKEKRTQRRMDASHI

SEQ ID NO: 124159 - protein, 458 aa, Glycine max
  Coding DNA Sequence Number=SeqID_7381
  Gene Ontology: Mol. function=DNA binding; Biological process=DNA integration
  Homolog annotation: Hit_ID=Q1SS72; Match level="QueryCoverage=86%, HitCoverage=47%, E-value=3e-38, Identity=36%"; Hit description =Integrase, catalytic region
VGCDNVERLGCEEEGSTGCSLSEGSCIVSCGGVVSIGESYWLLEKDPGKGVLGLRRFYTRSLMYDTFRGVEAMHEELRPVVTPYYFDFAIILGFDGCNETHDSVSGFCLSVHKMYPLEEKISAQLVEDTSLEMEIRLKVHDSRMGSMNMMAVRELYYDWVDAFIRMEIIQGAVVKDRDIPGLGGLSMVHDEMEATCLVCSDVVFPADGRWIKASRALYCSGFISRRIPMLPVANVDGVTYLTAVSACFPSASVLVPSFVIKRHTMLLVANAFRVTDSSTVIADGFSSINGNIFRYGIHEEHVRSNVGILFIQATQELHGSIFKLSLCNDGEGGARTPDVAMLLVSTLTLLAGDRKSSKDLPANISISGLAKFLQLCPSRVCFALWKLQWSGLSKIPPYYCTDAKLRTFCLFSRVQDWRNESSGWVFTWMKIQSSDTMLKIISGCAEGENIVFILKMYR

SEQ ID NO: 124160 - protein, 604 aa, Glycine max
  Coding DNA Sequence Number=SeqID_7382
  Gene Ontology: Mol. function=RNA-directed DNA polymerase activity; Cellular component=chromatin; Biological process=chromatin assembly or disassembly
  Pfam annotation: Domain name=Chromo; Domain location=529-583; Score =24.5; E_value=0.00038; Accession=PF00385.14; Description='chromo' (CHRromatin Organisation MOdifier
MPFRLMNALAMFQALMNTIFGDVMRKFILVFFDNILVYSPDWESHMRHLTMVLELLQTHQVANRKRSSFGQILVEYLGHIISLEGVAMDPSKFIDDNGKIAKPLTTLTKKEGFHWDNHAQEAFDKLKQKLTTGPTQALPDFSKDLGGRHVDYSMALADRDLAKSAYEKELITKTTVDQQNWATKLLGYQFDIVYKPGLEYKGVDALSRVHGEAELQPMIHYPHWPKGQEVIEEAHRDAELKEIIHAFRNNQPTKTGFSYQRGVLLYKGHLVLARASPWIQQLLQEFHATPLGGHLGFYRTYHHVAANLFWFGMKRVLFRSVTCQHQKYIAAAPGGLLPPLCIPELTWEEISMDFIKGLPKSKGFEAILVVVDRLSQYSHFIAFKHPYTAKIVVEVFTKNSTQDEHCLPPSNGWADRGGEPLFGNISSMLYGWLTSQSHGHNGGTTPFEADYGRPPPMVNCFLPGETRMEAAAQAAILGCLNLPQTLSKVLHPISDFGENWCGGLQAATVGKYTVKGTLPELESDTTNPITLVAVLITHVITKGCDSLKQFLVQWKDKPIEEASWEEEFNFRSQFPSFRLEDKSVIQGGETMTGLHPLIAAQMSY

SEQ ID NO: 124161 - protein, 138 aa, Glycine max
  Coding DNA Sequence Number=SeqID_7383
  Gene Ontology: Cellular component=chloroplast
  Homolog annotation: Hit_ID=P03938; Match level="QueryCoverage=43%, HitCoverage=45%, E-value=6e-11, Identity=86%"; Hit description =Hypothetical 14 kDa protein ycf68
MSPHGGDMDGGEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKNGAPHNVSSQTKNYEIAPFILG

SEQ ID NO: 124162 - protein, 51 aa, Glycine max
  Coding DNA Sequence Number=SeqID_7384
MSATVNEIVFGNLITIVRPIVKARQIVNARVTLIVRVPMVRSFSNTTVSRD

SEQ ID NO: 124163 - protein, 62 aa, Glycine max
  Coding DNA Sequence Number=SeqID_7385
MGDFPIDLYLTLSNHLRGLMDIHTTLITERRSCGGEQEGPAAQKRNRERKSEGEELKTREGS

SEQ ID NO: 124164 - protein, 71 aa, Glycine max
  Coding DNA Sequence Number=SeqID_7386
  Gene Ontology: Mol. function=iron-sulfur cluster binding; Cellular component=mitochondrion
  Homolog annotation: Hit_ID=Q2QQS4; Match level="QueryCoverage=54%, HitCoverage=29%, E-value=3e-12, Identity=87%"; Hit description =HesB/YadR/YfhF family protein, putative, expressed
MPLLLSMPCLYGEKGKFDELLEDKGVNILIDPKALMNVIGTKMDFVDDKLRIQTQVICLSTLLIKIHIHFL

SEQ ID NO: 124165 - protein, 45 aa, Glycine max
  Coding DNA Sequence Number=SeqID_7387
  Gene Ontology: Mol. function=sequence-specific DNA binding; Cellular component=nucleus; Biological process=regulation of transcription, DNA-dependent
  Homolog annotation: Hit_ID=Q533S3; Match level="QueryCoverage=91%, HitCoverage=24%, E-value=3e-12, Identity=71%"; Hit description=MADS box protein AP3
  Pfam annotation: Domain name=SRF-TF; Domain location=9-45; Score =31.6; E_value=2.8e-06; Accession=PF00319.9; Description=SRF-type transcription factor (DNA-binding and dimerisation domain)
MARGKIQIKRIENTTKKANELTILCDAKVSIIMFSSTGKLHKIEQ

SEQ ID NO: 124166 - protein, 278 aa, Glycine max
  Coding DNA Sequence Number=SeqID_7388
  Gene Ontology: Mol. function=oxidoreductase activity; Cellular component=peroxisome; Biological process=electron transport
  Homolog annotation: Hit_ID=Q76FS0; Match level="QueryCoverage=97%, HitCoverage=80%, E-value=5e-91, Identity=57%"; Hit description =Hypothetical protein PsOPR3
  Pfam annotation: Domain name=Oxidored_FMN; Domain location=1-253; Score=112.4; E_value=1.3e-30; Accession=PF00724.10; Description =NADH:flavin oxidoreductase  NADH oxid
MKIQLGLILASQRYPNTPGIWTREQVEAWKPIVSTVHEKGEFQPHGEAPISSTNKRPRKEIPKLVNEFVIAAKNAMEAGFDGIELHGANGYLLDQFLKDKVNDEDDEYGGTIENRCRFPLQVVKAVADEIGADKVGIRLSPFADCVGDDTNNDDPQALGIHMAESLNQLGILYIHLIEPRTMVTQFHKFDTKYLSLEPIRKAFKGTFIVAGGYDRSEGNLAISSSAADLVAYGRLFLANPDLPTRFQLDAQLNEPDATTFSTHDPVLGYTDYPFLQDI

SEQ ID NO: 124167 - protein, 106 aa, Glycine max
  Coding DNA Sequence Number=SeqID_7389
MEKKKVRTRTFDGEEQSMKNNLRWRTTVVIRTIIEEGGSSMTKFGMSSSVGMFATVGDEDDVDVDIWDGPYASIRDGDGLPSVGGGDGVGATSEDLIGIDTVDKDR

SEQ ID NO: 124168 - protein, 142 aa, Glycine max
  Coding DNA Sequence Number=SeqID_7390
MEAVDSSRWSLEGNGIFWVHLTYVALEDYTYVISKEPIWKKIWNINIPPKVNIFIWRLMRDRLPSRENLKGRNVVIKGYITCCLFCKQGCRPVWFLEMVVEKPHFRLKHVVIGIVPMEMSSSSYNLEPQSRMLVFLLCSRRM

SEQ ID NO: 124169 - protein, 608 aa, Glycine max
  Coding DNA Sequence Number=SeqID_7391
  Gene Ontology: Mol. function=RNA-directed DNA polymerase activity; Cellular component=chromatin; Biological process=chromatin assembly or disassembly
  Pfam annotation: Domain name=rve; Domain location=243-399; Score =95.3; E_value=1.8e-25; Accession=PF00665.16; Description=Integrase core domain
  Pfam annotation: Domain name=zf-H2C2; Domain location=184-225; Score =25.6; E_value=0.00014; Accession=PF09337.1; Description=His(2) -Cys(2) zinc finger
  Pfam module annotation: Pfam domain module=rve::zf-H2C2; Domain location=243-399::184-225
MGAVLSQKAHPIAFFSKPFTPKLMRASTYVRELAAITMAVKKWRQYLLGHHFTIVTDHHSLKELLNQVIQTPEQHMYLARLMGYDYDIQYRSGSHNQAADALSQLPESDSSTLMVISVHCYTFMKELRQQLQTHPQYQQQLTDVLRYAATHPGFSVSQGLLLHKGRIWLPQGLPIISTLLMEFHATPTGGHAGVAKTIARITETFTWPGLRHDVTQFVANCVECQVTKYETKKAAGLLCPLPIPHRPWEDLSLDFIVGLPPYKNYTVILVVVNHFSKGIHLGMLPSSHSAPLVASLFLDIVVKLHGLPRSLVSDHDPLFVSQFWQELFRASGTKLRMSLAYHPQSDGQTEVLNRIIEQYLRAFVHRHSRAWEKLLPWVELSHNTSWNEGTRMTPYEVKYGQKPLNLADQVAGDSKVDVVQEILTGRDDTFRTIRKKLFKAQTRMEQQADKKHREVNYQPGEWVYVKLRPRRQGSAKGVQVITDKLAKRYYGPFRVLERLGPVAYKFHLLEEARIHPMFHCSLFKPFHGSPETTPTEDWYQIGNDYHLEDKVDLQGPRDDTNTETTSEVHLAEDDTNIEPTSTESKTEVHLAEKPKRKLTKPAYLRDYV

SEQ ID NO: 124170 - protein, 178 aa, Glycine max
  Coding DNA Sequence Number=SeqID_7392
  Homolog annotation: Hit_ID=Q7XDI4; Match level="QueryCoverage=83%, HitCoverage=16%, E-value=1e-29, Identity=46%"; Hit description =Expressed protein
MMTAAECMLRDLGNKALKSINEIRSKWSRNSDRKSSSTGCEGSYEGLLRCIPHILLAGGTTRVFNESDHESIREDFDSLKQLFCSFGEELIAENEVEKAAEIVEGVMALMGMSTEQLMENLSTLSNETSGNGQKLPMPPTTGKWNRADPNTILRVLCYRNDRTASNFLKRTFQIAKRR

SEQ ID NO: 124171 - protein, 305 aa, Glycine max
  Coding DNA Sequence Number=SeqID_7393
  Gene Ontology: Mol. function=RNA-directed DNA polymerase activity; Cellular component=chromatin; Biological process=chromatin assembly or disassembly
MVGNGQQLECQWLCEAISIELQTISVTVDLYVLPIVDANVIIGVQWLKSLGPMLTNYAELTMQFFYNGALVELRGDKDTQMGLITPPQLRRLCRKPEGAICFHISVIAEDIPSSSSPTWPPELHALLLEFRQLFQNLQSLPPPRTTDHHIHLLPQATPVNPSTSPFSSPVLLVKKNDGSWRFCVDYRALNAFTMKDRFPIPMIDELLDELGGARCFSKLDLLQGYHQIRMHEADTPKIAFRTHHGHYEFKVIPFGLCNMPSSFQATMNMIFRPYLRHFIIVFFDDILIYSSSPEDHLQHLVTTFQ

SEQ ID NO: 124172 - protein, 242 aa, Glycine max
  Coding DNA Sequence Number=SeqID_7394
MLLDEIVGAPTVHKEEHSLPEDDARLFIKEEAGSLGSSSAAIRRNTLEGQRCPLWYCSSQVKQSPRSRREAISSGERRFRVGAAGLGGSGVGWVGGGRRGGSGVGRGGGSIGASGGRGKTCSLGQRQRLVSLHLPADVGGKSRDKATQKEGWPRGKLVVACHPLEPSKGPTLHLNGRNGQPIMLQGGTRGGVKGGVCGDELLIGKADQGILKSIRRTIGIAGISHGRSNESTNDSSLKMMLA

SEQ ID NO: 124173 - protein, 52 aa, Glycine max
  Coding DNA Sequence Number=SeqID_7395
MHMTQMQFTNTGARETVSFSDTTSRGSKVPQQGIKTEPMCDAYAKGATRECT

SEQ ID NO: 124174 - protein, 106 aa, Glycine max
  Coding DNA Sequence Number=SeqID_7396
  Gene Ontology: Mol. function=metal ion binding; Biological process =cellular biosynthetic process
  Homolog annotation: Hit_ID=Q6D1G1; Match level="QueryCoverage=87%, HitCoverage=45%, E-value=2e-40, Identity=82%"; Hit description =Probable aldolase
MQYRADMRRQAIEQRMQPGLRRRCAAARHMIVGNIHPQKIGGAQAALVFAGLGDQALTFVQAQRHVAAGRRAPAFVANPVAGRQQCGKLRILRHYYRFPFGKAAGR

SEQ ID NO: 124175 - protein, 824 aa, Glycine max
  Coding DNA Sequence Number=SeqID_7397
  Gene Ontology: Mol. function=solute:hydrogen antiporter activity; Cellular component=integral to membrane; Biological process =regulation of pH
  Homolog annotation: Hit_ID=Q2HVU5; Match level="QueryCoverage=97%, HitCoverage=97%, E-value=0.0, Identity=50%"; Hit description=Na+/H+ antiporter-like protein
  Pfam annotation: Domain name=Na_H_Exchanger; Domain location=33-428; Score=277.5; E_value=2.6e-80; Accession=PF00999.11; Description =Sodiumhydrogen exchanger family
MALNITSIKTSSNGLWQGDNPLDFAFPLLILQITLIILLSRSLAFLLKPIRQPKVIAQIIAGIVLGPSVLGRNKTFKHRLFPPWSTPLLESLASIGLLFFLFLVGLELDLVTIRRSGKRALSIAVAGMSLPFVSGIGLALILRKTVDGTDRVGFAQFLVFMGVAISITAFPVLARILTELKLLTTRVGCTAMAAAAFNDVAAWILLALAIALAGDGVNSHVHKSPLVSLWVLLSGVAFVAFMMILVKPAMRFVSGKCSPVTGAVDETYVCLTLLLVMVFGFVTDMIGIHSVFGAFVFGITVPKGAFAERLIERVEDFVVGLLLPLYFASSGLKTNVATISGAKGWGILALVIATACAGKIGGTFLTAVACKIPMREAMTLAVLMNTKGLVELIVLNIGKEKKVLNDEMFAILVLMALFTTFITTPIVLSIYKNTNDISFHQTLRKLGDLDTNDKATNEFRVLACVHGPNNAPSIINLIESIRSIQKSSIKLFIMHLVELTERSSSIILAQNTDNKSGSSHVEWLEQLYRAFQAHSQLGQVSVQSKTTISSLSTMHDDICHVADEKMVTMIILPFHKRWKKVEMENEEENSEVSQHQMEENIGHGWRGVNQSVLRNAPCTVAVLVDRGYGHGPQNLGLYTTVTQHVCVLFFGGPDDREALELGDRISNHPAVKVTVVRFIHKDVLEGNDMSHSSPSKTNGKSYNLAISKVYPPKEKELDDATMARFQRKWNGMVECFEKVASNIMEEVLALGRSKDYDLIIVGKGQFSLSLVADLVDRQHEELGPIGDILASSTHDVVSSVLVIQQHNALLNGETPLSMRNDNVI

SEQ ID NO: 124176 - protein, 210 aa, Glycine max
  Coding DNA Sequence Number=SeqID_7398
  Gene Ontology: Mol. function=pyridoxal phosphate binding; Cellular component=mitochondrion; Biological process=metabolic process
  Homolog annotation: Hit_ID=Q66E23; Match level="QueryCoverage=73%, HitCoverage=35%, E-value=9e-76, Identity=89%"; Hit description =Aminotransferase, class V
MLDISQFDQINPPARLLMGPGPINADPRVLRAMSSQLIGQYDPAMTGYMNQVMALYRALFRTENRWTMLVDGTSRAGIEALLVSAIRPGDKVLVPVFGRFGHLLCEIARRCRAEVHTIEAPWGEVFSADRIEDAIKRVHPRLLLTVQGDTSTTMLQPLHEIKLIDTVDLEGGPVGKPVVPAALLNRATRGERRYAYWGANGVYTGLLCWH

SEQ ID NO: 124177 - protein, 78 aa, Glycine max
  Coding DNA Sequence Number=SeqID_7399
  Gene Ontology: Mol. function=transcription factor activity; Biological process=regulation of transcription, DNA-dependent
  Homolog annotation: Hit_ID=UPI00005F9A09; Match level="QueryCoverage =83%, HitCoverage=23%, E-value=2e-11, Identity=54%"; Hit description =COG1737: Transcriptional regulators
MTKGNDLPRLTQLQFVQRLEQFGDVMNTLPPLRQPLMQQRIAEQAGQAHGGGIAVERRHAVERHGQVPVGQWEQRLRL

SEQ ID NO: 124178 - protein, 212 aa, Glycine max
  Coding DNA Sequence Number=SeqID_7400
  Homolog annotation: Hit_ID=Q9LTV8; Match level="QueryCoverage=52%, HitCoverage=14%, E-value=3e-11, Identity=36%"; Hit description =Selenium-binding protein-like
MHRSPQLQPHHSGAGLENERERELVGRNSVPSHGVVKTQGVGLGVRRLGEGPDERVEEEGVVGRGRGGLVIWEEDGGGVVDGVEVGGGGGELCEDEWVVVEAEFEDEGMDLREGGERVAGGEEGQDGRWTWKNVVVVIADDDSFVNCIASFFCSKWKSSTTPSAETEPQYVSVHFPLFFLSDSTVRRLKTLNSTSLAANNILSVFHSLFPMA

SEQ ID NO: 124179 - protein, 185 aa, Glycine max
  Coding DNA Sequence Number=SeqID_7401
  Gene Ontology: Mol. function=polygalacturonase activity; Cellular component=cellulose and pectin-containing cell wall; Biological process=carbohydrate metabolic process
  Homolog annotation: Hit_ID=Q1S5D1; Match level="QueryCoverage=81%, HitCoverage=38%, E-value=2e-56, Identity=69%"; Hit description =Polygalacturonase
  Pfam annotation: Domain name=Glyco_hydro_28; Domain location=1-181; Score=-104.0; E_value=0.00055; Accession=PF00295.8; Description =Glycosyl hydrolases family 28
MYQAEFERDELRDQIHVLYIGILSSRMHLIVITTHYWRVGSIGQGGQEEFVENVNVSNCIFNGASSAARIKTWPGGKGYAKNIAFQNISVNQTDYPIYLSQHYMGTPEKKDAVKVSDVTFSNIHGTCISENAVVLDCAKIGCDNIALKQINITSIDPKKPASAKCNDVHGKATDIVSPPVHCLHR

SEQ ID NO: 124180 - protein, 453 aa, Glycine max
  Coding DNA Sequence Number=SeqID_7402
  Gene Ontology: Mol. function=binding; Cellular component =intracellular; Biological process=protein kinase C activation
  Homolog annotation: Hit_ID=Q1SD65; Match level="QueryCoverage=99%, HitCoverage=99%, E-value=0.0, Identity=66%"; Hit description =Tetratricopeptide-like helical
  Pfam annotation: Domain name=PPR; Domain location=148-182; Score =44.6; E_value=3.4e-10; Accession=PF01535.11; Description=PPR repeat
  Pfam annotation: Domain name=PPR; Domain location=183-217; Score=2.8; E_value=3.5; Accession=PF01535.11; Description=PPR repeat
  Pfam annotation: Domain name=PPR; Domain location=219-253; Score =14.9; E_value=0.13; Accession=PF01535.11; Description=PPR repeat
  Pfam annotation: Domain name=PPR; Domain location=47-81; Score=46.1; E_value=1.2e-10; Accession=PF01535.11; Description=PPR repeat
  Pfam annotation: Domain name=PPR; Domain location=82-116; Score=2.0; E_value=4.3; Accession=PF01535.11; Description=PPR repeat
  Pfam module annotation: Pfam domain module=PPR::PPR::PPR::PPR::PPR; Domain location=148-182::183-217::219-253::47-81::82-116
MVKFGFEEDPHVRNTLVHMYCCCCQDGSSGPVSAKKVFDESPVKDSVTWSAMIGGYARAGNSARAVTLFREMQVTGVCPDEITMVSVLSACADLGALELGKWLESYIERKNIMRSVELCNALIDMFAKCGDVDRAVKVFREMKVRTIVSWTSMIVGLAMHGRGLEAVLVFDEMMEQGVDPDDVAFIGVLSACSHSGLVDKGHYYFNTMENMFSIVPKIEHYGCMVDMLSRAGRVNEALEFVRAMPVEPNQVIWRSIVTACHARGELKLGESVAKELIRREPSHESNYVLLSNIYAKLLRWEKKTKVREMMDVKGMRKIPGSTMIEMNNEIYEFVAGDKSHDQYKEIYEMVEEMGREIKRAGYVPTTSQVLLDIDEEDKEDALYRHSEKLAIAFALLSTPPGTPIRIVKNLRVCEDCHSATKFISKVYNREIVVRDRNRFHHFKNGLCSCGDFW

SEQ ID NO: 124181 - protein, 165 aa, Glycine max
  Coding DNA Sequence Number=SeqID_7403
  Gene Ontology: Mol. function=hydrolase activity, acting on carbon -nitrogen (but not peptide) bonds, in linear amidines; Cellular component=nucleus; Biological process=metabolic process
  Homolog annotation: Hit_ID=Q1CLF4; Match level="QueryCoverage=99%, HitCoverage=38%, E-value=4e-56, Identity=66%"; Hit description=Amino acid hydrolase
MADAAGATHEQHADRPVRRHGDGVVPGAARQRQAPPLYLLDGRLPALPQIAIAGGGVNAVKLLAGEAHAAARADRLRLRQQRRQQRRQLCILRAAHVERQSHFAGDHVDRARQAFNTPHGGHQMRIGGAGQSFDRRYPFRRGRQRVFALHHRHRAGVARFTAESA

SEQ ID NO: 124182 - protein, 409 aa, Glycine max
  Coding DNA Sequence Number=SeqID_7404
  Gene Ontology: Mol. function=nucleotide binding; Cellular component =mitochondrion; Biological process=translation
  Homolog annotation: Hit_ID=Q1SD66; Match level="QueryCoverage=91%, HitCoverage=55%, E-value=1e-148, Identity=71%"; Hit description=AAA ATPase; AFG1-like ATPase
  Pfam annotation: Domain name=AFG1_ATPase; Domain location=129-402; Score=-131.5; E_value=6.9e-06; Accession=PF03969.6; Description=AFG1- like ATPase
MRRISNLLSKSKQLAAFASLETKLRANALRSYCDQSHLRRQNRPGPLVQYRSLVDQGKLRHDPFQESVASELENLLARLEQYEKDMEEYHVNLANWEKQRENERRRLLMEEVELHQKDEYWWKRLNNKLTERWESRKRPKNMESGVGKWVSYLKREKKLDSLVGHRPTAPPAPKGLYIYGNVGSGKTMLMDMFYSATKGIVKHRRRYHFHEAMLRINEQMHKIWKNQIEEKPLQSTIAGWIMSLPFDTKAKEWLAAEERYKQEVQMKNILPAVADMFFLDGEENEKGASILCFDEIQTVDVFAIVALSGILSRLLSSGTIIVATSNRAPKDLNEAGMQKEIFQKLVSKLEEHCEKVLIGSEIDYRRFIAQKSENQDKMTSRFNLESLLVVTMGIQKIILTCGYYEKFMK

SEQ ID NO: 124183 - protein, 91 aa, Glycine max
  Coding DNA Sequence Number=SeqID_7405
  Gene Ontology: Mol. function=nucleoside-triphosphatase activity; Cellular component=membrane
  Homolog annotation: Hit_ID=Q10AH7; Match level="QueryCoverage=88%, HitCoverage=13%, E-value=8e-29, Identity=71%"; Hit description=AFG1 -like ATPase family protein, putative, expressed
MNEFEKKWHDVTGRFGGRIISNTISVMFGRTLEVPQSFDGVARFTFEYLCGRPLGAADYIAVAENFHTVFISDIPVMSMRIRDKIFLKRNA

SEQ ID NO: 124184 - protein, 122 aa, Glycine max
  Coding DNA Sequence Number=SeqID_7406
MKKQKSSILHGTVEEKGRGKEHGGRYEEKAFKSRPFTTNDEGEEKMTSFWRFIFLGLLQNDAILEPFLSGKPNLGFENQLGHLVYTKSVRFDWAISRQMHGWFNNQTNPIISLGPGWTSPTD

SEQ ID NO: 124185 - protein, 944 aa, Glycine max
  Coding DNA Sequence Number=SeqID_7407
  Gene Ontology: Mol. function=DNA binding; Cellular component=beta -galactosidase complex; Biological process=DNA integration
  Pfam annotation: Domain name=rve; Domain location=419-560; Score=5.7; E_value=0.002; Accession=PF00665.16; Description=Integrase core domain
  Pfam annotation: Domain name=zf-CCHC; Domain location=226-243; Score =9.0; E_value=0.032; Accession=PF00098.13; Description=Zinc knuckle
  Pfam module annotation: Pfam domain module=RVT_2::Retrotrans _gag::rve::zf-CCHC; Domain location=728-944::43-160::419-560::226-243
LQPFELSAMDDPYDPYIINNADSPGLILVSKPLTLENWNSWKRAMLMALGGRNKLGFVDGTIPPPDPKDPLHHAWLSIWKDLQDRFQQNNRPHILQMKHDLSNCLQGSLSVLQYYTKMKSIWEEFSEYKPVHHCHCGGVQPLLDHFHFEYVLTFLLGLNESYNQIRGQILSLDPFPSIQHAFSLVIQEEKQREVGNVQTSLDSQLACVVQGSQNSKSGNKKDKDHPLCAHCGLLGHTKDKCFKIIGYPPGHKKHKSPVNLVNDNQGESSNSFNIAQCQQLLNLIHSQMAQAMVSETSQSDQSNLGMIFSTPGQSSSINSSSWIIDLGATSHICHDLKLFDQYTLLSNRTVTLPNNYKINVKAIGSVTLTPSIKLSNVLYIPQFHDKQQNRVIGKGNLHQGLYHFQPHSEYACSSLHTTVLSQCNNVVAANGPFPHDTHDGKKYFLTIADDNSRYNWVHLMRNKSEAPHLLQAFFKLVQTQFSKNIKAMRSDNAKELALTEFLQNARCVSTTAYIINRTPSLNLQNQSPYKLLYGKIPAYDLMKVFGCLCYAATVPAQRHKFTPRATKCVFLGYPFGYKGYKLYDLDNHKFLISRDVTFQENSIPFATSTYTASDPFPNFVVPRPLPDMLPDPNPTPQPPPKPKPQLEIEPNLAQPDVQPNAHVRRSTRVTRPPTHLHNYVFNVTYPIHNHLMYDNLSPTYRDYVFKVSEIYEPQFYHQAVRFPKWHQAMNEEIQALEMNNTWVVQPLPPGKRTIGCRWLYKVKYRADDSLDRYKARLVVKGYTQQAGIDFLDTFSPVAKLTTEIYMDMPLGYPVKNDNMVCKLTKSLYGLRQASRQWFHKFSTTILDQGFQQCPADHSLFTRGSGATLVTLLVYVDDIIIVGPNQKLIAKTQQMLAKHFKIKVIGDLKYFLVLEIAKSPRGIHLCQRKYTLQLLTDTGFAASKP

SEQ ID NO: 124186 - protein, 312 aa, Glycine max
  Coding DNA Sequence Number=SeqID_7408
  Gene Ontology: Mol. function=nucleic acid binding; Cellular component= intracellular; Biological process=DNA integration
ASVPSHFWVEALTIVVYLINHLPSQVLGFDSPFFQLYNIQPSYDDLHPFGCVCFVHLPPLERHKLGAQSVQCAFMGYGTTQKGFLCYDVVAQHFRISQNVVFFYHQDFFPFVSLDANGFATLPSFPKVSHATKWFKPGYVYARRPLAPPFPDSELSPKRTPIAPRRSSCISRTPDRYAMQEELQALQENYNWDIVPCPPNEYGVDYDETFAPVAKMTTIRTVLSIAASKGWSLHQMDVKNVFLHGDLAEDIYMTPPQGLQSAAPVDTILEVNVKYLRDEGDILPNPLLYHQLVGSLNYLTITRPDISFAVQQ

SEQ ID NO: 124187 - protein, 210 aa, Glycine max
  Coding DNA Sequence Number=SeqID_7409
  Gene Ontology: Mol. function=nucleic acid binding; Biological process= DNA integration
ARLYWQTSVESGVRKSHVICLNSWGATYISVGQHYLMSIGFKLKSNKFKMFVKGKGMWGHIDGSSSKPTAMAELAAWETQDAQIISWLLGSIEPLMLELDIANYALSRDSSVSEAIVVAYIAQDEGKVNSMTETPTSVPTNVDALTPEKVQQMVLSALSALGIQASNHMTGTLEHLNNVRTYNGTQNIQIVNGNTLSITIVGDITPSFGD

SEQ ID NO: 124188 - protein, 250 aa, Glycine max
  Coding DNA Sequence Number=SeqID_7410
  Gene Ontology: Mol. function=DNA binding
  Homolog annotation: Hit_ID=Q1SDS1; Match level="QueryCoverage=87%, HitCoverage=40%, E-value=6e-28, Identity=36%"; Hit description=IMP dehydrogenase/GMP reductase
KGEWAPFIDILALLIFGGVLFPNVDGLVDLAAIDAFLAYHDHKESPVVAMLADLYDTFDRRCEKSSTRIVCCTPALYVWLVSHLFHQEVRHACPLESHRSCTEKGGANWDQLLASKEGASVNWFPRWKEGRVGVLISCRGFPNVPLMGTRGCISYNPILAIRQLGYPMRGAPLEEELVPVISRGFNKTNMETLQKVRKAWEVVQKKDKELRGSNNGPIGGYRKWLKAHVQGLDWLPSLRNAKREEVEAEC

SEQ ID NO: 124189 - protein, 97 aa, Glycine max
  Coding DNA Sequence Number=SeqID_7411
MAHREEHGQNKFRGALWGSNSELKLRREERDQSRVNSLILKDELKACSRSKRSLSQRLCETETNMLAIITKYQEELNLATTHEHRVADEYAQVYAEK

SEQ ID NO: 124190 - protein, 223 aa, Glycine max
  Coding DNA Sequence Number=SeqID_7412
  Gene Ontology: Mol. function=ATPase activity, coupled to transmembrane movement of substances; Cellular component=integral to membrane; Biological process=proteolysis
  Homolog annotation: Hit_ID=Q0BAW8; Match level="QueryCoverage=81%, HitCoverage=23%, E-value=1e-60, Identity=63%"; Hit description=ABC transporter related
  Pfam annotation: Domain name=ABC_tran; Domain location=1-165; Score =141.6; E_value=2.1e-39; Accession=PF00005.17; Description=ABC transporter
MARLYQPVKGQISADGLDVNQIDPADWRKAVGFVSQDARLFYGTLRENVMIGRPDATANELLRVLNLTGLDHVAARHPSGINLSVGEGGEGLSGGQRQLVSLARTLLTRPKVLLMDEPTSAMDSMTESQFLAHLRRASEGHTLIVVTHRPSILALVDRIIVVEEGKIVADGPKEQVLAALEGKGKTRQPPRQAVEQAARAPAPANDASATSEPAVAAAEEAAV

SEQ ID NO: 124191 - protein, 46 aa, Glycine max
  Coding DNA Sequence Number=SeqID_7413
  Gene Ontology: Mol. function=oxidoreductase activity; Biological process=metabolic process
  Homolog annotation: Hit_ID=Q2HVU1; Match level="QueryCoverage=85%, HitCoverage=23%, E-value=2e-09, Identity=80%"; Hit description =Glucose/ribitol dehydrogenase
MVGIFSLITGRPGCSGFGSSSTAEQVIEGIDASNLTAIITVHTSLR

SEQ ID NO: 124192 - protein, 57 aa, Glycine max
  Coding DNA Sequence Number=SeqID_7414
  Subcellular localization annotation: CTP_CleavageSite=33; ConfidenceScore=5.01e-01
MTWAFRIARTRAVSNPMPLAPPAFGHNISVYIVSYSISSLPVSFNTTCPRPEIMPSI

SEQ ID NO: 124193 - protein, 102 aa, Glycine max
  Coding DNA Sequence Number=SeqID_7415
LSRRNFVTYFLGIDDSAPSALSSRNFGTYFPSIGRWAPSALSHCDKAQVDALHGARCENMSYYGRLKRVKVKRGDVLAAINYLQGKGDNNAIFLQDTWLQRM

SEQ ID NO: 124194 - protein, 162 aa, Glycine max
  Coding DNA Sequence Number=SeqID_7416
  Gene Ontology: Mol. function=actin binding; Cellular component =intracellular; Biological process=cell division
  Homolog annotation: Hit_ID=Q208T5; Match level="QueryCoverage=84%, HitCoverage=99%, E-value=1e-66, Identity=89%"; Hit description=Actin depolymerizing factor 2
  Pfam annotation: Domain name=Cofilin_ADF; Domain location=35-162; Score=198.1; E_value=2.1e-56; Accession=PF00241.10; Description =Cofilintropomyosin-type actin-binding pr
MSLDTPRNSKPSRRAEATSKLKSNANAASGMAVHDDCKLKFLELKAKRTYRFIVFKIEEKQKQVIVEKLGEPANGYDDFAASLPADECRYAVYDFDFVTEENCQKSRIFFIAWSPDTSRVRSKMIYASSKDRFKRELDGIQIELQATDPTEMGLDVFKSRAN

SEQ ID NO: 124195 - protein, 191 aa, Glycine max
  Coding DNA Sequence Number=SeqID_7417
MFESSGIPCSHIMWAMRLEHIHAFPSSLICGFGALSGGCNKLCELGSKDVDNFKFVRDELCKLTERLQKRVDLGGDPVRHSSGMVDDMKNPNVIKTKDDLSCGEDFNVNDPSVNNTEGANVSFSQDVALVGRIEMPNAVPKKADNDTEKREVTQNLKNGSWPWMNNPSTLEHKSDVRGILFLTQKSFCGNQ

SEQ ID NO: 124196 - protein, 162 aa, Glycine max
  Coding DNA Sequence Number=SeqID_7418
MKNSISDFSILRAFHISLAIFPRHPVSSKSPGILPWQAGFPAIAACGGIYRDYRGSFMGCFSFSLGVASSPVAELTSAMEAMKSLLKRVASLVDLLPSSIQEPFFRDNIRWCNLVGIRAQTPHIVDPSIAELELAYYLSHSNGGFAYFDCRCMSMLGTTIEL

SEQ ID NO: 124197 - protein, 756 aa, Glycine max
  Coding DNA Sequence Number=SeqID_7419
  Gene Ontology: Mol. function=helicase activity; Cellular component =mitochondrion; Biological process=metabolic process
  Homolog annotation: Hit_ID=Q84TY4; Match level="QueryCoverage=91%, HitCoverage=93%, E-value=0.0, Identity=49%"; Hit description =Putative pentatricopeptide repeat protein
  Pfam annotation: Domain name=PPR; Domain location=165-199; Score =17.6; E_value=0.047; Accession=PF01535.11; Description=PPR repeat
  Pfam annotation: Domain name=PPR; Domain location=200-234; Score =33.3; E_value=8.7e-07; Accession=PF01535.11; Description=PPR repeat
  Pfam annotation: Domain name=PPR; Domain location=235-269; Score =25.8; E_value=0.00015; Accession=PF01535.11; Description=PPR repeat
  Pfam annotation: Domain name=PPR; Domain location=303-337; Score =41.0; E_value=4.1e-09; Accession=PF01535.11; Description=PPR repeat
  Pfam annotation: Domain name=PPR; Domain location=338-372; Score =52.7; E_value=1.2e-12; Accession=PF01535.11; Description=PPR repeat
  Pfam annotation: Domain name=PPR; Domain location=373-407; Score =30.2; E_value=7.3e-06; Accession=PF01535.11; Description=PPR repeat
  Pfam annotation: Domain name=PPR; Domain location=408-442; Score =43.6; E_value=6.7e-10; Accession=PF01535.11; Description=PPR repeat
  Pfam annotation: Domain name=PPR; Domain location=443-477; Score =40.1; E_value=7.4e-09; Accession=PF01535.11; Description=PPR repeat
  Pfam annotation: Domain name=PPR; Domain location=478-512; Score =43.9; E_value=5.5e-10; Accession=PF01535.11; Description=PPR repeat
  Pfam annotation: Domain name=PPR; Domain location=513-547; Score =52.8; E_value=1.2e-12; Accession=PF01535.11; Description=PPR repeat
  Pfam annotation: Domain name=PPR; Domain location=548-582; Score =34.8; E_value=3.1e-07; Accession=PF01535.11; Description=PPR repeat
  Pfam annotation: Domain name=PPR; Domain location=583-617; Score =33.5; E_value=7.4e-07; Accession=PF01535.11; Description=PPR repeat
  Pfam annotation: Domain name=PPR; Domain location=618-652; Score =41.3; E_value=3.2e-09; Accession=PF01535.11; Description=PPR repeat
  Pfam annotation: Domain name=PPR; Domain location=93-127; Score=14.8; E_value=0.13; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=165 -199::200-234::235-269::303-337::338-372::373-407::408-442::443 -477::478-512::513-547::...
  Pfam module annotation: Domain location=548-582::583-617::618-652::93- 127
  Subcellular localization annotation: CTP_CleavageSite=100; ConfidenceScore=5.81e-01
MALSSLHFHPLPLAYTVITQRHTTPFSFSLSSTFRFSSSSALSSSTSATHHPLPPDFSPSQLLDLLRRQPDSSSALSLFQWASAQPNYSAHPSVFHELLRQLARAGSFDSMLTLLRQMHSSKIPVDESTFLIFLETYATSHHLHAEINPLFLLMERDFAVKPDTRFYNVALSLLVKANKLKLVETLHSKMVADAVPPDVSTFNILIRALCKAHQLRPAILMLEDMPNYGLRPDEKTFTTLMQGFIEEADVEGALRIKELMVESGCELTSVSVNVLVNGLCKEGRIEEALRFIYEEEGFCPDQVTFNALVNGLCRTGHIKQGLEMMDFMLEKGFELDVYTYNSLISGLCKLGEIDEAVEILHHMVSRDCEPNTVTYNTLIGTLCKENHVEAATELARVLTSKGVLPDVCTFNSLIQGLCLTSNREIAMELFEEMKEKGCDPDEFTYSILIESLCSERRLKEALMLLKEMELSGCARNVVVYNTLIDGLCKNNRVGDAEDIFDQMEMLGVSRSSVTYNTLINGLCKSKRVEEAAQLMDQMIMEGLKPDKFTYTTMLKYFCQQGDIKRAADIVQNMTLNGCEPDIVTYGTLIGGLCKAGRVDVASKLLRSVQMKGMVLTPQAYNPVIQALCKRKRTKEAMRLFREMMEKGDPPDVITYKIVFRGLCNGGGPIQEAVDFTVEMLEKGILPEFPSFGFLAEGLCSLSMEDTLIQLINMVMEKGRFSQSETSIIRGFLKIQKFNDALANLGAILDRKKPRRF

SEQ ID NO: 124198 - protein, 43 aa, Glycine max
  Coding DNA Sequence Number=SeqID_7420
MRASGNRLPRGCNRLPGLKRGLEHCGGLCGYEMHLCGGIDRFL

SEQ ID NO: 124199 - protein, 60 aa, Glycine max
  Coding DNA Sequence Number=SeqID_7421
  Homolog annotation: Hit_ID=Q84ZM5; Match level="QueryCoverage=93%, HitCoverage=8%, E-value=1e-07, Identity=56%"; Hit description =Putative pentatricopeptide (PPR) repeat-containing protein
MKLTGYVPDLAFVLHDVGEELKGQLFLWHSEKLKIAFGLPKDIPFYSKSNAGMRLRLTLI

SEQ ID NO: 124200 - protein, 199 aa, Glycine max
  Coding DNA Sequence Number=SeqID_7422
  Gene Ontology: Mol. function=inorganic diphosphatase activity; Cellular component=cytoplasm; Biological process=phosphate metabolic process
  Homolog annotation: Hit_ID=Q6KBB0; Match level="QueryCoverage=67%, HitCoverage=62%, E-value=1e-63, Identity=86%"; Hit description =Putative inorganic pyrophosphatase
  Pfam annotation: Domain name=Pyrophosphatase; Domain location=54-195; Score=110.6; E_value=4.7e-30; Accession=PF00719.9; Description =Inorganic pyrophosphatase
MAPPIETPNKVSSYQQSPNPRLNERILSSISRRHVAAHPWHDLEIGPEAPKIFNCVVEIGKGSKVKYELDKRTGLIMVDRILYSSVVYPHNYGFIPRTICEDGDPMDVLVIMQEPVLPGCFLRAKAIGLMPMIDQTHFALQPAREGLDPTLEVEKWKKENSNILPQVLQMRIFWLLQLEGATVGKIEIMIKYNNKVGAS

SEQ ID NO: 124201 - protein, 166 aa, Glycine max
  Coding DNA Sequence Number=SeqID_7423
YLRKNLIIVLFLNNVINNSLNIVFYYWSCFLNNNKYEDLNTVNNRFFLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 124202 - protein, 118 aa, Glycine max
  Coding DNA Sequence Number=SeqID_7424
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=99%, HitCoverage=5%, E-value=9e-44, Identity=70%"; Hit description=RNase H, putative
MPGLNPDIVQHRLPLNLGCSPVKQKLWRMKPEMSLEIKEEVKKQFNASFLVVARYPEWVANIVLVPKKDGKVRMCVDYRDPNRASLKDNFPLPHIDVLVDNTTNFALFSILEGFSGNN

SEQ ID NO: 124203 - protein, 87 aa, Glycine max
  Coding DNA Sequence Number=SeqID_7425
MTRSKRIQEDTEKKEGFFPKVADDVLTKKDNTPKKYEVPIDENSMLKKKEKATRPQEKEALTKEIQYAYKEGGKEVLTPPQICKLWG

SEQ ID NO: 124204 - protein, 175 aa, Glycine max [sequence omitted]

SEQ ID NO: 124205 - protein, 94 aa, Glycine max
  Coding DNA Sequence Number=SeqID_7427
MEGSQQNTHYPKEKLPKIITHKWKFGNLLEAPNTLPMKGLFVTKLESNKVLLSPIALKVVGPLLLDSNSSRDGTNPPSNSLYGNPQTRKQRDKQ

SEQ ID NO: 124206 - protein, 88 aa, Glycine max
  Coding DNA Sequence Number=SeqID_7428
MADNTRMKELATNVKKNVDDIKKLYDEVQIQFERFGAVTDARFQTMEDLQSSTDGKLDKINEALSMLLRKLLSDLFPWCYELKQSSVS

SEQ ID NO: 124207 - protein, 107 aa, Glycine max
  Coding DNA Sequence Number=SeqID_7429
MVAQWRFGDIRKGWRWRFKEECIPASDDNVESQRHLTTINRVIYRRSVIRQIKEKEIDVAESSIQVCKGPHGMQEDNSVMHDPELQGMRKSTRARKANNQLKDFVTS

SEQ ID NO: 124208 - protein, 274 aa, Glycine max
  Coding DNA Sequence Number=SeqID_7430
  Gene Ontology: Mol. function=transporter activity; Cellular component= membrane; Biological process=transport
  Homolog annotation: Hit_ID=Q1XQ62; Match level="QueryCoverage=88%, HitCoverage=35%, E-value=6e-11, Identity=28%"; Hit description=TonB -dependent receptor precursor
MAAEHRTELSGNNYTDSNGFADLPYIPVKDSIREGYFHAFDAAYTNNLRQEAVVTYQKRFSDKSQKLDFQFGYTKSTSKFDQNNIFRDISYINPNENLPRFSDGLLLNNESDMRIANFKVDYSQPIKILDGGKVSFGGLYEKQNFDTQSRGLTNLDYQRQTASTYLEFQAKLKKFDFTLGSRAENYDISGITRVIDSTGAIVQKNLIPFNKFKLFPNASVQYSFMNQVSVSANYNKKISLPSISALNPNNTTFQGPNTQVTGNPNLQPTIFDEL

SEQ ID NO: 124209 - protein, 486 aa, Glycine max
  Coding DNA Sequence Number=SeqID_7431
  Homolog annotation: Hit_ID=Q9FNA6; Match level="QueryCoverage=89%, HitCoverage=92%, E-value=8e-45, Identity=30%"; Hit description =Arabidopsis thaliana genomic DNA, chromosome 5, P1 clone:MSH12
MGKSPGGLNDGDMTNDNSSRIESKRAHQWFMDDPEVDMFPNKKQAVEAPNNLLSGMLNSNISSWGNSSGFHSLNGHFTEQLFAPDAVTMGFEDTNTPSVSIDDKLSVERKDNMDPFGSESSFGLSISTALEDPHLVFNYDGTRKVKVNEVRESENAMPVATNNPYERGVSDSVSNPCLYKEDDNSISTSLAYNEEVANIITMDGTYDRTDNNFTSIIQSYNKGNDSLSIHPTFNEMDLGFSKVDSNVTSIAQGYNKAYNNSVLTNHLYSKVDNDTLSLHHTYHKQGNDVPFVSHSYNNGESTIISFGGCDDDATPTHLFISDYESIYHLLPSTAQTSEPETENVPKTKGEIKMCRKATSNNFPSNVRSLLSTGMLDGLSVKYKAWSREVINAFEFERHAGCKTKHPNNHIYFDNGKTIYGVVQELRSTPQSMLFEVIQTITGSPIDQKSFCIWKDAPSHIWTLSSSSTESFLPTAGNSSAYGQNKK

SEQ ID NO: 124210 - protein, 79 aa, Glycine max
  Coding DNA Sequence Number=SeqID_7432
  Homolog annotation: Hit_ID=UPI0000612705; Match level="QueryCoverage =93%, HitCoverage=92%, E-value=1e-07, Identity=31%"; Hit description =UPI0000612705 related cluster
  Subcellular localization annotation: CTP_CleavageSite=18; ConfidenceScore=5.11e-01
WWRCVYCPLPAIPMLHVACSPLKARMCSPLEVRACTPLMARTCGPLKVRACSPLLARMCSPLKVRACSPLLARTCSPLK

SEQ ID NO: 124211 - protein, 261 aa, Glycine max
  Coding DNA Sequence Number=SeqID_7433
  Gene Ontology: Mol. function=inositol or phosphatidylinositol phosphatase activity; Cellular component=intracellular; Biological process=abscisic acid mediated signaling
  Homolog annotation: Hit_ID=Q1SU89; Match level="QueryCoverage=98%, HitCoverage=46%, E-value=6e-92, Identity=67%"; Hit description =Inositol polyphosphate related phosphatase
  Pfam annotation: Domain name=Exo_endo_phos; Domain location=10-251; Score=0.1; E_value=0.012; Accession=PF03372.13; Description =EndonucleaseExonucleasephosphatase family
  Subcellular localization annotation: CTP_CleavageSite=67; ConfidenceScore=5.20e-01
MSMFQEIIPLNAGNVLGPEDSGPASKWLNLIRQALNSNTSSSGENSPTSSFNSRRQCCPNEQHYYCLAASKQMVGIFLCVWVRADLYKHVSKLKVSCVGRGIMGYLGNKGSISISMTLYHTTFCFVCTHLASGEKDGDEVRRNLDVSEILKKTKFSHSFKALGQPLPPESILEHDKIIWLGDLNYRLAAAYDDTLGLLKKNDWQALLEKDQLRIEQRAGRVFKEWKEGKIYFAPTYKYLFDSDQYVAQTNKSKEKRRTPAW

SEQ ID NO: 124212 - protein, 248 aa, Glycine max
  Coding DNA Sequence Number=SeqID_7434
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=9e-40, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=8; ConfidenceScore=5.63e-01
MRTPLKARACSPVKFRTCRPLKARACSPLKARTCSPLKVRTCSPLKARTCSPLKARTCSPLKARTCSPLKARTCSPLKARMCSPLKARTCSPLKGRACSPLKVRMCSPLKMMTCSPLKMKMFGPLKVRTCSPLKARACSPLKVRTCSPLKARTCSTLKVRACSPTKAKARTCYPLQARTCSPLKVRTCSPRKVRACSPMKVRTCSPLKVRACSPTKAKVRTCSPLKVRTCSPRKVRACSPMKVIGTST

SEQ ID NO: 124213 - protein, 116 aa, Glycine max
  Coding DNA Sequence Number=SeqID_7435
MACVNGRKHINLIAGPGIRVVKTKGGTPNPKPFWKTRKEQKAKTERRKEKEKHSRDRSRTRAWNKEKVEHYSEVVLCREGKVETGRERERERDADDVLFWGLFSERGYLILKNKMN

SEQ ID NO: 124214 - protein, 66 aa, Glycine max
  Coding DNA Sequence Number=SeqID_7436
MRTELKKKISKSSWPKFNVRKWLNIRSNDDKFHSDASYYSLPGENVYFLSGNLRDRLVVHGYDGLA

SEQ ID NO: 124215 - protein, 72 aa, Glycine max
  Coding DNA Sequence Number=SeqID_7437
  Subcellular localization annotation: CTP_CleavageSite=34; ConfidenceScore=5.29e-01
MVVDDMTLCIIVGYGGSSSSRFSDAYPKRVFGVTSNRVKHNSPLAFSKSLPLLQRLKRYITVSLSLLYNIDR

SEQ ID NO: 124216 - protein, 147 aa, Glycine max
  Coding DNA Sequence Number=SeqID_7438
  Gene Ontology: Mol. function=RNA-directed DNA polymerase activity; Biological process=RNA-dependent DNA replication
MATWFRWIRGPPFSIQPLEGCDRIKVTIKVVMRIFFKEWRKKSFEWEREMLLQLTNLLENVRVHNVDLDLWIWLDSHSGAYSRNSAYVHQFQEVESEPLCNTLAETWRFKIPSKVAFLIWRVIRDRLLRKENLLKRGIMVEEWCCDE

SEQ ID NO: 124217 - protein, 149 aa, Glycine max
  Coding DNA Sequence Number=SeqID_7439
  Homolog annotation: Hit_ID=O80926; Match level="QueryCoverage=59%, HitCoverage=18%, E-value=2e-40, Identity=88%"; Hit description =Expressed protein
MSTSRKPLIKRHDRTFKLTDPSSEHCPPGEFVREIPLSTRIPEDANIEAYYDGPGSVLEILVPKHRVGPEEHEVRVCLRPHLGGNDLKLMGGILTESQKPLSDNLRTFYNRNFNSMDPTFLDYVGILVKRTKSTPTIILIILKNLLPVE

SEQ ID NO: 124218 - protein, 230 aa, Glycine max
  Coding DNA Sequence Number=SeqID_7440
MPSPSEYCTSSPAEGCTPWPLEGYASSFSTCAPGYGGHGFLSTVPGLPPDIGRRPTVRAHPEREAITHLLCIPGQDFPRAAAKRRVRTMRTNMTIPYVDDVAIWQHSAQRPQCQSPLADGSRPQDTQWTQRSSTGPWGFQLWLRASVSPTGCPFPQQGHAIVTYEWHPQRHPVDPEKSNRPLGFPALVTGLYSPTGCPFPPARSRHHRDRTCKTPSGPEEVQQGLGVVKL

SEQ ID NO: 124219 - protein, 89 aa, Glycine max
  Coding DNA Sequence Number=SeqID_7441
  Subcellular localization annotation: CTP_CleavageSite=81; ConfidenceScore=5.40e-01
MVRTRLFAAARGKSCPGMHSRCVIASLSGCARTVGRRPISGGSPGTVERKPWPPTLKMRTHSPLKARACSPLQARMCSTLMARAYGPLK

SEQ ID NO: 124220 - protein, 52 aa, Glycine max
  Coding DNA Sequence Number=SeqID_7442
MSVKNHIGRLGVHDKTNHTLFISSPLKGLSINLSPLKGISINSSPLKGLIVV

SEQ ID NO: 124221 - protein, 78 aa, Glycine max
  Coding DNA Sequence Number=SeqID_7443
KCLCIARYGKGSTYWVLDVFLQIPTLGGVDGDLVLRGTRIRATWGYVSSVEGGQLGMVGSCLICGCGRVDLHHRPIAT

SEQ ID NO: 124222 - protein, 81 aa, Glycine max
  Coding DNA Sequence Number=SeqID_7444
MKWIFGRIKSKRLPSIKAPLPSKGTTLSEAEQQQSKHALTVGIASIAVVEAVVTAAHRLTGQCKETSKDYQHVKTSNGALT

SEQ ID NO: 124223 - protein, 79 aa, Glycine max
  Coding DNA Sequence Number=SeqID_7445
  Subcellular localization annotation: CTP_CleavageSite=37; ConfidenceScore=5.12e-01
MHETQCGPLRVHRMNRKAWFEGRWLPPSSPRRAQLAQASRVASSRSNRLLEESSGGPKWAWVLFAPPFLLSTPPSTVFW

SEQ ID NO: 124224 - protein, 118 aa, Glycine max
  Coding DNA Sequence Number=SeqID_7446
MAQVVEGKVEAQHPKFGQTQVVVGGSSMMDKRSSVTRDDLGRNISRDGDGDNIECVEHCGGDGLLVSHTTSAKGCDVDHGYRKYLIFISCMMSDKWVCGGVQNLATKQWMCVGVSAFT

SEQ ID NO: 124225 - protein, 554 aa, Glycine max
  Coding DNA Sequence Number=SeqID_7447
  Pfam annotation: Domain name=SANTA; Domain location=23-120; Score =107.7; E_value=3.5e-29; Accession=PF09133.1; Description=SANTA (SANT Associated)
MADSTPTATPSNDIVSSSFRRTVTLYDWWLVIAKNDFQGKRLAVAGVSSRKDEATRVFVSAAVIKRYDVFSLETADGICVIIRGFINEQRTLENGFSAEVFHHFLFGFPPDWERYALDCFKEEPTTDADLGSVVPDNAPASCPKILSDGVEKSIPTCLVSPEEASGDHEMSFPENECNVSKEMGGVHVACSSGGKSHSFKLHNIKVCQQKKQPASECLPNHPDNENSSSVALENCNVERLESPTTPIQPQLWSEYSNDACVENAIPTSLASEEAPGDHEKSFPENESNVSKEINGVNVACSSGGKSRSARLHDIKVYQQKKPASGGSLKHPNNENSTSVALENCDVKGLKSPATPIQSQSSRQLSTSPGQGKLNKSASALKNPREKDLSPLAKGSQQKISTFTPESLSFRKSRSGRLLLPPLEFWRNQIPIYNADHEITEIRDGASLISPCRGFSPSLSSTVTLPASEVRMFEQGMDPLGFAYIPRFSRKVLWVDEKLLKEKSFEREYSGLLVHFLVHFLMATGGVGHFQQFRGKRCDAPDIVLTKYIVGSRGM

SEQ ID NO: 124226 - protein, 251 aa, Glycine max
  Coding DNA Sequence Number=SeqID_7448
  Gene Ontology: Mol. function=nucleotide binding; Cellular component =chloroplast; Biological process=response to heat
  Homolog annotation: Hit_ID=P09189; Match level="QueryCoverage=99%, HitCoverage=40%, E-value=1e-124, Identity=91%"; Hit description=Heat shock cognate 70 kDa protein
  Pfam annotation: Domain name=HSP70; Domain location=9-251; Score =51.8; E_value=1.6e-17; Accession=PF00012.10; Description=Hsp70 protein
MAGKGEGPAIGIDLGTTYSCVGVWQHDRVEIIANDQGNRTTPSYVGFTDTERLIGDAAKNQVAMNPINTVFDAKRLIGRRFSDASVQSDIKLWPFKVLSGPAEKPMIQVSYKGEDKQFAAEEISSMVLMKMREIAEAYLGSSIKNAVVTVPAYFNDSQRQATKDAGVIAGLNVMRIINEPTAAAIAYGLDKKATSVGEKNVLIFDLGGGTFDVSLLTIEEGIFEVKATAGDTHLEEFRERQERYQWHSQST

SEQ ID NO: 124227 - protein, 52 aa, Glycine max
  Coding DNA Sequence Number=SeqID_7449
MAGDASKFIHISPGNSEHVTSGNNNKVYQVFINYVIKAFCYHSIFIIAFDED

SEQ ID NO: 124228 - protein, 226 aa, Glycine max
  Coding DNA Sequence Number=SeqID_7450
MDPVKYIFEKPALTGRIARCQLVYAILTRMSIHVAQVIADAIYLFAGMAPTRHSLDPEKSNRALGFPALITGLCQSFEAQVTPSKVIRPPITRAFIEKYCTPRQAQGDAPQGVGAPPPPRQADLAEPLGVERYLQHLVRQQAANHREQVQIHEYLYRFNHSQKRQGSTPFVCPTPEQFAAKVAWPGDWPDAQVGEEPVGSPSGMDEPRMDEDMTDLFDFLGGSEAT

SEQ ID NO: 124229 - protein, 90 aa, Glycine max
  Coding DNA Sequence Number=SeqID_7451
MKIANTTANGTNNQATPKWIEVKSHVQSGGYECGYCMMHWMWNIVSGGLKNDWSMWFLDGTTLDKETNVQHIFLKFKAINMEGYQVREYP

SEQ ID NO: 124230 - protein, 69 aa, Glycine max
  Coding DNA Sequence Number=SeqID_7452
  Pfam annotation: Domain name=TPR_1; Domain location=14-47; Score =20.0; E_value=0.0083; Accession=PF00515.18; Description =Tetratricopeptide repeat
  Pfam annotation: Domain name=TPR_2; Domain location=14-47; Score =19.6; E_value=0.011; Accession=PF07719.7; Description=Tetratricopepti de repeat
  Pfam module annotation: Pfam domain module=TPR_1::TPR_2; Domain location=14-47::14-47
MTFRHMTKAHPHSAVAYNNLANVLLAQKKVVQAEAVAQHGLALASEDEKLTVQLKQTLGEIRQAKKQML

SEQ ID NO: 124231 - protein, 235 aa, Glycine max
  Coding DNA Sequence Number=SeqID_7453
  Gene Ontology: Mol. function=two-component sensor activity; Cellular component=integral to membrane; Biological process=two-component signal transduction system (phosphorelay)
  Homolog annotation: Hit_ID=Q7WHU0; Match level="QueryCoverage=90%, HitCoverage=40%, E-value=4e-57, Identity=52%"; Hit description =Putative membrane protein
  Pfam annotation: Domain name=EAL; Domain location=1-215; Score=237.7; E_value=2.4e-68; Accession=PF00563.11; Description=EAL domain
MNLHHNTCVGAEALIRWRTADNHLISPDIFIPAAEASGVICQITQRVFELVARDMRNAFKKHQNFYVGINISSHDIRAGNLLSLIKNLEKLTGATGNQILIEVTERGFLDDEEALTMIRNIRDCGVRVAIDDFGTGYSSLSYLTKFQLDYLKIDKTFVDSVGTDAVTSHVAFHIIEMAKTLNLNMVAEGVETHDQAQILQDRGVTYVQGWLFSKSLKVNDFYHYLEKHTAPPLNP

SEQ ID NO: 124232 - protein, 119 aa, Glycine max
  Coding DNA Sequence Number=SeqID_7454
MYVFKTVTQTLRWFVYRGDQDRTHVRCICERHNTGMYIVRQYSQTNISKKSPVESPTVATYPSAGGRRGTRGMRVPRKEYARSRHQRLFEENVGKTEKDAIYELLSERLGSCIYAWGRY

SEQ ID NO: 124233 - protein, 53 aa, Glycine max
  Coding DNA Sequence Number=SeqID_7455
MEFFLKEETLVLSHSYLRLRFEEKWILWIKGFLESSRVLMLVNGSPDNRIPGV

SEQ ID NO: 124234 - protein, 144 aa, Glycine max
  Coding DNA Sequence Number=SeqID_7456
MVIGSRTQGAPAFSGRYSAEVSMPYSQEKLERPSTNGYLYPKPTQCRKVKEVGDLMTGEPTTEAPVNGGRNYNGPKVAKFLVGLGEIDMSVKMRTTCTWTERPYEASLFPGIGFGLFLRSLGGGQRRPPSGGARAISEIPLWKS

SEQ ID NO: 124235 - protein, 105 aa, Glycine max
  Coding DNA Sequence Number=SeqID_7457
MDISEDTDIPVILGRPFMLTTSCIVDMGKRKLELGFEDQKIDFDLFVEDKPAPEHNVFLQVMEGCQEVLKLHAKHIFGHALSRKSQALSVQPLHLRLIGSAKLAK

SEQ ID NO: 124236 - protein, 150 aa, Glycine max
  Coding DNA Sequence Number=SeqID_7458
  Gene Ontology: Mol. function=two-component response regulator activity; Cellular component=intracellular; Biological process=two -component signal transduction system (phosphorelay)
  Homolog annotation: Hit_ID=Q1XW86; Match level="QueryCoverage=97%, HitCoverage=66%, E-value=2e-34, Identity=45%"; Hit description =Response regulator receiver
  Pfam annotation: Domain name=GerE; Domain location=87-144; Score =52.3; E_value=1.7e-12; Accession=PF00196.10; Description=Bacterial regulatory proteins, luxR family
MDGFETVLWLKENHPDIKVMALSMQGDDKSVIKMIKNGAKGYLLKNTHPKELETALVKLNTEGFFYPEWASRIIFSNLNNETESKDTVRISEREKEFLKYTVTELSYKEIADKMCCSPRTVESYRDQLCEKLDLKTRVGLAVFAMKNGFD

SEQ ID NO: 124237 - protein, 97 aa, Glycine max
  Coding DNA Sequence Number=SeqID_7459
MKKLLFGILALGFMSACNSDNVSNQGEETANKSATASDLANRRSCPSEEIRKQTLQNNPELRQKYAAIEANTERFANAIKMGKVLADGTVEIPVVVN

SEQ ID NO: 124238 - protein, 77 aa, Glycine max
  Coding DNA Sequence Number=SeqID_7460
  Subcellular localization annotation: CTP_CleavageSite=53; ConfidenceScore=5.33e-01
MVLIAAIATILTSIIFFMLTMAFIIVAIFSFMASMSTSICSCTSSTLPITLALAQVRNGFMIPTWLAHGTSHMQLRM

SEQ ID NO: 124239 - protein, 142 aa, Glycine max
  Coding DNA Sequence Number=SeqID_7461
  Subcellular localization annotation: CTP_CleavageSite=22; ConfidenceScore=5.23e-01
MASRKRDRTDGIPSSSTPSPPSATIGPDVQSSQTLVPMLESLFRGQFIIMHSLRELAHNRPIIPMEHLLEQVAWPGAQPPLVRPNEAAPLEPTSARVEPVPADPYVRQVASDILRRGVELRYCKLFPQLKFYFNFNASSKFP

SEQ ID NO: 124240 - protein, 405 aa, Glycine max
  Coding DNA Sequence Number=SeqID_7462
  Gene Ontology: Mol. function=thiamin-phosphate diphosphorylase activity; Biological process=thiamin biosynthetic process
  Homolog annotation: Hit_ID=Q8UCU5; Match level="QueryCoverage=42%, HitCoverage=70%, E-value=3e-77, Identity=88%"; Hit description=ABC transporter, nucleotide binding/ATPase protein
  Pfam annotation: Domain name=Phos_pyr_kin; Domain location=1-163; Score=110.2; E_value=6.2e-30; Accession=PF08543.2; Description =Phosphomethylpyrimidine kinase
ATTAGGADPVRVATSGDRLLQKEAIETLRRELLPLATIVTQNLPEAALVTGTPIATTEKEITRQADAILKAGAKAVLIKGGHGEGPQSTDYLFADGNMQALSAPRVETKNDHGTGCTLAAAITAHLPKGCELREAVGLAKEYLNGALDAGRGLAVGNGRGPSAGLIPLCPAGHLPLKGGDRLAVGSRPSQRLRMERWVPPHPALYATFSPAGRRNAWQPLAIWVNLAKDLTPHNYAPPSAPHAPDAQSPEIPRRCDHIRNPARPRRHDDDFGREIDGFRDGMGDETDGLAGPVPQLQQLFVQVIADDLIQRPERLVHQQQVGIEGERAGDGGALLHAARELPGVFLAETVEVDEIERAVDALALFRLAIAHDFKRKGDVLFDAAPWIKRGGLKDIAIGAVLAGVS

SEQ ID NO: 124241 - protein, 114 aa, Glycine max
  Coding DNA Sequence Number=SeqID_7463
MPIHTRTQDKPIAIPYSPPIQGNNAWIHTYIASRNLQKPSSQNTKILQWKAKNQRKVALTCRGLMAHQNPPYLAFCTPGQNETKNKIQGYQRETNKNIHIFLNEHQGMKGMGNI

SEQ ID NO: 124242 - protein, 113 aa, Glycine max
  Coding DNA Sequence Number=SeqID_7464
MSLERCEGSWLTLIHVTWWVVRWHRGGRFGAMWRWPWCWVEVGCGGDEGLGGEVTTVLLGKGRVKKGISGILGVHQEKIWDALNNCYDEADMRICYGPINLDKPTNIFRRLVA

SEQ ID NO: 124243 - protein, 339 aa, Glycine max
  Coding DNA Sequence Number=SeqID_7465
  Gene Ontology: Mol. function=protein serine/threonine kinase activity; Cellular component=cytoplasm; Biological process=protein amino acid phosphorylation
  Homolog annotation: Hit_ID=O22981; Match level="QueryCoverage=62%, HitCoverage=37%, E-value=1e-100, Identity=80%"; Hit description =Ser/Thr protein kinase isolog
  Pfam annotation: Domain name=Pkinase; Domain location=142-339; Score =121.2; E_value=2.9e-33; Accession=PF00069.15; Description=Protein kinase domain
  Pfam annotation: Domain name=Pkinase_Tyr; Domain location=142-337; Score=16.1; E_value=1.9e-13; Accession=PF07714.7; Description =Protein tyrosine kinase
  Pfam module annotation: Pfam domain module=Pkinase::Pkinase_Tyr; Domain location=142-339::142-337
MPIYFRKIQNHLGSFLSATTFWFYGSLTPQEAGAMALITAINWVQSMNISNIIFKLDFNLEVCSGLSHCKKDHVNRVGRNCYKAVESEKRVEKRVPLEESEAEGRGEEEGTCQALEMGVVVVGLPFSMGSGSRSYSANPADYKLLEEVGYGASATVYRAIYLPYNEEVAVKCLDLDRCNSNLDDIRREAQTMSLIEHPNVVRAFCSFVVERSLWVVMGFMAQGSCLHLMKAAYPEGFEEAAIGSILKETLKALEYLHRHGHIHRDVKAGNILLDDNGLVKLADFGVSACMFDTGDRQRSRNTFVGTPCWMAPEVLQPGTGYNFKADIWSFGITALELAH

SEQ ID NO: 124244 - protein, 270 aa, Glycine max
  Coding DNA Sequence Number=SeqID_7466
  Homolog annotation: Hit_ID=Q5DJV4; Match level="QueryCoverage=42%, HitCoverage=33%, E-value=4e-50, Identity=81%"; Hit description=Fas -associated factor-like protein
MDFVAAFERDYGSFGPNFVGEGFMDALQRSRNSFKLLFVYLHSPDHPDTPSFCQRTLCSETIAAFVNENFVCWGGSIRASEGFKMSNSLKASRFPFCALVMAATNQRIALLQQLLVSAIVSLTAIAAAIGVVVAVSALAERPPSATDTSIAERFRFAVGAAAIAVALGGAAQFLEQFFAPLLRSLHLFLLLLLLCHSPSSSPSRASAHHSVEDVFSREEVGAVGEDDVVFEGSEGAMEGALEVVPWWRLLIMGRVMDLVGGFGTFRREKL

SEQ ID NO: 124245 - protein, 69 aa, Glycine max
  Coding DNA Sequence Number=SeqID_7467
  Gene Ontology: Mol. function=nucleic acid binding
MTIKGSFVQLAIPRFNGHYDHWSMLMENFLRTKEYWELIEPGYVEPASGATQIEAQQKKNNELKLKDLK

SEQ ID NO: 124246 - protein, 157 aa, Glycine max
  Coding DNA Sequence Number=SeqID_7468
  Gene Ontology: Mol. function=nucleic acid binding; Cellular component= endoplasmic reticulum membrane; Biological process=DNA integration
MRFFLGIEVPQKSDGIYICQNKYALEILRRFGTVNYGIHYKKGGNGELLAFTDSDYVGDVEDRKSTSGYVFLMSSVCACQGVWMKRILEKLGQSHEGCITIMCDNSSTIKLSKSPIMHGRNKHIDVRFHFLRNLSKEGTIELVHCGSQGQVADIMNH

SEQ ID NO: 124247 - protein, 188 aa, Glycine max
  Coding DNA Sequence Number=SeqID_7469
  Gene Ontology: Mol. function=nucleic acid binding; Biological process= DNA integration
  Homolog annotation: Hit_ID=Q1S9A7; Match level="QueryCoverage=86%, HitCoverage=73%, E-value=3e-42, Identity=51%"; Hit description =Peptidase S8 and S53, subtilisin, kexin, sedolisin; Zinc finger, CCHC- type
  Pfam annotation: Domain name=zf-CCHC; Domain location=65-82; Score =11.5; E_value=0.013; Accession=PF00098.13; Description=Zinc knuckle
MDIDALTVDELQSSLIVHEQKFQRRNGGQEQVLQVSIEGGRGRGRVAYRGRGRGRGRTTFNKATVECYQFHQLGHFRYECPQNKEANYAEVDEAEEMLLMSYVELYEAKREDAWLLDSGCSNHMCGDQTMSSQLDEKFWHSIKLGNNTKMNVLGKGSVKLLLNGVNFVFLEVYYVPELNNNLLSIGQL

SEQ ID NO: 124248 - protein, 251 aa, Glycine max
  Coding DNA Sequence Number=SeqID_7470
  Gene Ontology: Mol. function=malate transporter activity; Biological process=response to aluminum ion
  Homolog annotation: Hit_ID=Q6EPG5; Match level="QueryCoverage=83%, HitCoverage=39%, E-value=1e-40, Identity=40%"; Hit description =Aluminum-activated malate transporter-like
  Pfam annotation: Domain name=UPF0005; Domain location=2-212; Score= -1.4; E_value=6.1e-06; Accession=PF01027.11; Description =Uncharacterised protein family UPF0005
CVVQYFGGSEASEAESDEVSDKKLLGYKCVLSSKATEETMANFARWEPAHGRFNFRHPWRQYVKIGASMRSCASCLDALIGCINSDNQASDDMKKNMSSISMKVGANCASVIRELATTIRKMKKSSKLDILVTQMNSAAQELRSLLNSCPYLVNPPHNSKRSTRTETASPDDLAPKIEIPLMEIIQVVTVASLLIEIVARVEDIVENVEELSDLANFQPEMNVKSKQHTSDSKVSPDQQNDGEPVRTLQMV

SEQ ID NO: 124249 - protein, 477 aa, Glycine max
  Coding DNA Sequence Number=SeqID_7471
  Gene Ontology: Mol. function=nucleic acid binding; Cellular component= intracellular; Biological process=DNA integration
  Homolog annotation: Hit_ID=Q1RWN2; Match level="QueryCoverage=98%, HitCoverage=38%, E-value=1e-134, Identity=51%"; Hit description =Peptidase S8 and S53, subtilisin, kexin, sedolisin; Integrase, catalytic region; Zinc finger, CCHC-type
  Pfam annotation: Domain name=rve; Domain location=15-165; Score=55.6; E_value=1.6e-13; Accession=PF00665.16; Description=Integrase core domain
  Pfam module annotation: Pfam domain module=RVT_2::rve; Domain location=337-477::15-165
MGSNTVIHPKEEYLESNSEASTYSCRYMCPSTPASNSNKSYILLFIDDYSRKTWVHFLVEKSEALNSFKYFKTMVEKEADMFIKCLRTDRGGEFNSNEFNHFCKESGIKRQLTTAFTPQQNDVTERKNRIVMAPCCLIRIFQKPFGLKWCPTLAVKDITPEKAWSGVKPSIDHLRVFGCIAHAHVPEAKRTKLDNKSLTCVLLGVNEESKGYKLFDPIARRVVVSRDVIFEEEKRWDWDGKQIAIDIKWDESENENGENNDREIGETCDEGVGDVSSESEVRVRELRQPLERQPPTWMGDYVSGEGLSNDEVHMELMVSTGPLCFEEAVKSANWRLAIDNEIKSIEKNQTWTFTELPVGAKRIGVKWVYKTKNNEHGKIDKYKVRLVAKGYSQKHGVNYTEVFAPVARMDTVRMIIALAAHKNWRIFQLDVKSAFLHGQLSEDVYVEHPRGYEKENSEHLVYKLHKALYGLKQAPRA

SEQ ID NO: 124250 - protein, 135 aa, Glycine max
  Coding DNA Sequence Number=SeqID_7472
  Gene Ontology: Mol. function=diacylglycerol kinase activity; Cellular component=integral to membrane; Biological process=intracellular signaling cascade
  Homolog annotation: Hit_ID=Q39017; Match level="QueryCoverage=91%, HitCoverage=17%, E-value=3e-45, Identity=71%"; Hit description =Diacylglycerol kinase 1
  Pfam annotation: Domain name=DAGK_cat; Domain location=1-100; Score =25.9; E_value=3.3e-06; Accession=PF00781.14; Description =Diacylglycerol kinase catalytic domain
VIELSSTQGLEMGLYLFRMVSHFRVLVCGGDGTVGWVLNAIDKQNFVSLPPVAILPASIGNDLARVLSWGGDLGPVERQAGLTTFLQHIEYAVVMVLDHWKVTISNPQGKQQLQPTKFLNNYLGLKYLESQLVKL

SEQ ID NO: 124251 - protein, 140 aa, Glycine max
  Coding DNA Sequence Number=SeqID_7473
  Gene Ontology: Mol. function=alcohol dehydrogenase activity
  Homolog annotation: Hit_ID=P39451; Match level="QueryCoverage=95%, HitCoverage=40%, E-value=2e-41, Identity=65%"; Hit description =Alcohol dehydrogenase, propanol-preferring
  Pfam annotation: Domain name=ADH_zinc_N; Domain location=1-101; Score= 21.2; E_value=0.00025; Accession=PF00107.16; Description=Zinc-binding dehydrogenase
  Subcellular localization annotation: CTP_CleavageSite=52; ConfidenceScore=5.00e-01
LEFAKQIGADLAINSKTQNAEEIIQQQSGGAHASVVTSVAKAAFSSAVNAVRAGGKVVAVGLPPESMDLSIPRLVLDGIQVVGSLVGTREDLKEALQFAAEGKVTPKVTKRPLGDINAIFDEMKAGTIRGRMVIDLGMAK

SEQ ID NO: 124252 - protein, 50 aa, Glycine max
  Coding DNA Sequence Number=SeqID_7474
MEVEEPWQGLWLPLHYQVVFGHWSCGEKAGLVADLGMAFVDDWVRGTVIG

SEQ ID NO: 124253 - protein, 98 aa, Glycine max
  Coding DNA Sequence Number=SeqID_7475
MVVLWASQVDLIITFVMHGISMPKSFISMICCRSIDTQFLFLGLWGRTKHMLLRKGFHQVKVKYGSNQLAKVGAEDGSSLHRFFGYCQHMIELNNLQN

SEQ ID NO: 124254 - protein, 51 aa, Glycine max
  Coding DNA Sequence Number=SeqID_7476
YPNLKFEVPQRRGALHDSENGFLSRFGAEMVSKGWSFDGASMVEEKGRKKQ

SEQ ID NO: 124255 - protein, 120 aa, Glycine max
  Coding DNA Sequence Number=SeqID_7477
METNAVAVAATRAVAKVNPMPPSDLKPNESSNLRYATEGQVIGDIPLQNTLEGPQYHPQPHPLHSTAIKNPHAMAEMGKVDHLKERLRAIEGGKDYAFANLEKLFLVPKHGHSQVQGVGL

SEQ ID NO: 124256 - protein, 52 aa, Glycine max
  Coding DNA Sequence Number=SeqID_7478
LFVGDAGGFQSPTREPLNVGGLVPPHCSLKSVVSDDACPGACFVQRDATTLS

SEQ ID NO: 124257 - protein, 89 aa, Glycine max
  Coding DNA Sequence Number=SeqID_7479
MKRKKNPPKASEEKKKEKRPPDFTRKAQKKNPLGFALAHMRRKLIRPGVRGKCPKTIVIDQPMSSSFSEIDRPLASLYQESFTWSHTKV

SEQ ID NO: 124258 - protein, 41 aa, Glycine max
  Coding DNA Sequence Number=SeqID_7480
MLLNKHILYARTKGHYDLPNDASSVPNTPLDARGSSGASNP

SEQ ID NO: 124259 - protein, 201 aa, Glycine max
  Coding DNA Sequence Number=SeqID_7481
  Gene Ontology: Mol. function=electron carrier activity; Cellular component=membrane; Biological process=electron transport
  Homolog annotation: Hit_ID=Q6EPG5; Match level="QueryCoverage=99%, HitCoverage=42%, E-value=7e-56, Identity=53%"; Hit description =Aluminum-activated malate transporter-like
  Pfam annotation: Domain name=UPF0005; Domain location=51-201; Score =101.5; E_value=2.5e-27; Accession=PF01027.11; Description =Uncharacterised protein family UPF0005
MARGNDMAKEVEWRIKVEEDDDTLQKTIVGCMWAVTAGLALKLCKFVKKAWEVGVNDPRKFIHCLKVGIALSAVSLFYYWKPLYDGVGGNAMWAVMTVVVVFEYTAGATICKTVNRMCGTSLAGFLGIGVHWVASRAGEQWEPVIAGVSVFLLASAATFSRFIPSLKARFDYGILIFILTFSLVSISGYRVDELLVMAQYR

SEQ ID NO: 124260 - protein, 100 aa, Glycine max
  Coding DNA Sequence Number=SeqID_7482
MTMAMTMPLTLRNKLKTLCTCGDGWSYAIFWRFHPRNSLLLTVEEAYYEEHLGEEIANMHPQDDSEFQQQFSSGIKTIVVVPVKAWGVVQFGSRKKQACS

SEQ ID NO: 124261 - protein, 716 aa, Glycine max
  Coding DNA Sequence Number=SeqID_7483
  Gene Ontology: Mol. function=transcription regulator activity; Cellular component=nucleus; Biological process=regulation of transcription
  Homolog annotation: Hit_ID=Q6EPG4; Match level="QueryCoverage=55%, HitCoverage=51%, E-value=2e-60, Identity=37%"; Hit description =Transcription factor-like
  Pfam annotation: Domain name=HLH; Domain location=518-570; Score=5.3; E_value=0.039; Accession=PF00010.16; Description=Helix-loop-helix DNA- binding domain
MSRLDLIVDWHKVVEFPLISVALYLKDWRVEVYTHVSSGRILEKVEFLEQTQSVLTDMDDDMGMFDMPGNSVLPLDCENNDLNGLWDSISSANPNNSFPSQYMTYDKAMVSLQEDSSYFSDQLKGTMEAQIVLSDRDSADVLLKPNSSTNKLIAENPYFGVCGSELSSFNLLEQQLVSCVSAQEDADACFTNQNDFAASKLLVQDSALTSLCSMDRGSFQGKLQNSLDNQYPTQSGVVIDVDFSSSSNALHGLSENLEPVDMSEEILNFSPMEDLCQWFGPSPEDSICEAVIALDNNFSESTEFNPTSFDLVGSSSLNDISVTCLAEHNSNSNGKEASVVMQSTEKGLFDSMEFDFSYDQGDEWWGNMLSPVVSGVTDTGFSECVSELNTTDALTGTRKRLFSELGIEELLRGGANYNPFNSSELEYELSPNKSETVESSSVNRNPIHFTNFHWPGARADLTQRLCDLDNTNNLPTKKDKFPKLQTGMWIDDSHSINIGKAVPVHPQKPEEPRKPSKKRARPGESTRPRPKDRQQIQDCIKELRRIIPNDGKCSIDSLLDRTIRYMLFLQSVLKYSDKLQEPNEPKAKEVVLKDSGAADSKNGGITWAYEVAHQTMLYPVIVEDMSLPGQMLIEMLCEEQGFFLEIIDKIQRFGLNILKAKMERRKTKLWARFIVEANRPVTRIEVFLYLIHLLQETNTSGIDSSNKHCDVIEANI

SEQ ID NO: 124262 - protein, 353 aa, Glycine max
  Coding DNA Sequence Number=SeqID_7484
  Gene Ontology: Mol. function=zinc ion binding
  Homolog annotation: Hit_ID=Q9MAQ7; Match level="QueryCoverage=69%, HitCoverage=19%, E-value=2e-56, Identity=48%"; Hit description =Location of EST 206I21T7, gb|N37185
  Pfam annotation: Domain name=PHD; Domain location=123-168; Score =33.4; E_value=8.1e-07; Accession=PF00628.19; Description=PHD-finger
  Subcellular localization annotation: CTP_CleavageSite=56; ConfidenceScore=5.21e-01
MDQSSMDSNNGPVSTGSESSGSDSYESDPSPNVIYTQPRISPSFFPPSPSPSVVFPAATESGDSSPPSVTFPTPYQSQKPHRLKSLPISVPSITARIMKGGRSHRPQSSDPPDEWVDGSWTVDCICGVTFDDGEEMVKCDECGVWVHTRCSRYVKGDDTFACDKCKARHNSNSNNTTTTTTNTTNPMETEVAQFLVELPTKTISMDNKKALPSRPRLWTDKPIEERVHVQGPPGGDPSIFAGQSASSIFTPQLWKACGYVPKKFSFKYNEFPFLNNDNDNEGGPAKDDSNDNGAGAGALVSLSKEGNNIASAAPVLNTSSPVGASVETRSGQGKGADTGKFGSEDVPPRVPSD

SEQ ID NO: 124263 - protein, 192 aa, Glycine max
  Coding DNA Sequence Number=SeqID_7485
  Homolog annotation: Hit_ID=Q8Z104; Match level="QueryCoverage=45%, HitCoverage=68%, E-value=6e-20, Identity=58%"; Hit description=Phage immunity repressor protein
MPFQVQGNRHLQFVQRVPESHPVKGAGIQIGLRHGATENGGVDDVSELVSQHGNDRRKGSFLNGVRTLAGRFERVQHVEEQHAGSPNARWRNGFHCGNGQPVCSCHLLYGQTTGKRQNVVTRQQTSGAVLRVGHGAQHARGCRQRRAAHGRKQKAECRMSRDEGRSHGGSLLEVKVIATTEVPTLMGGSPNG

SEQ ID NO: 124264 - protein, 904 aa, Glycine max
  Coding DNA Sequence Number=SeqID_7486
  Gene Ontology: Mol. function=zinc ion binding
  Homolog annotation: Hit_ID=Q9MAQ7; Match level="QueryCoverage=94%, HitCoverage=74%, E-value=4e-74, Identity=31%"; Hit description =Location of EST 206I21T7, gb|N37185
DVKKERTLLRPPVVHNSQRSKGDFVGNSSSKERSGKKRLRTSDREVDPRKKTLHSSKTVVTPTADGKQLEFCEDRGSKIFKADTRSIKNKNLKDMVVQEHVSDDHVAVDTTMEEPNNNLTTTEDSSEPLYPDMTKHGVSVGDVVAEEKASHKTPTLVEMSSKTDDAVTSSLKQNYVGNASVKEKDGDCLVADNADDTLVVRSAASPRTEGHCGSAPELVDNQVSQDLDRNMRSSSTKCKVKMRRDDVDNFRKPSNFHSSPMSDLKNNDKPSDHTSDIVKVNDAPVPSLPSCESKVGGFDISSEPIPADHTNKPNELSGDFCQRKQEPVGSEGSFETQKGFTETKDSLDAAKDPSKSEAIGCLPKVGKSSPTSSTMNSKSLGHDIKSEDTEIPNSFTKHGVMADSNIHTKNENCPSDAARDENQKKSVKERPKSSLNSNSKGLQSSRSMQNSVPKQVNSDARDSVHVSSSKPLIHQTASILGSSESNASLHHQKVLQVQNKISSSAPQKVEKLNQTNIHTSSKLNQSHVSSVNPSPISNSSMLSDEELALLLHQELNSSPRVPRVPRARHAGSLPQLTSASATSMLMKRTSGGGKDHYLVSRRKHKDASRPGSGSSRELEDEAKKIEKEKGPSSSDQRKLDMSYVEDAPAREEGLASMAVTNSITNNTVSSTSGVANSDASSPPEDQNLSSMRNSPRNVSDDDTATAGRPVHRTLPGLINDIMSKGRRMTYEELCNAVLPHWHNLRKHNGERYAYSSHSQAVLDCLRNRHEWARLVDRGPKTNSNRKRRKLDAEESDDNGYGKGRTAKDVEGKNFELQKEEFPKGKRKARKRRRLALQGRAVKDVRRRQKVSSLTDEDLGPFSNSSEESMFSEDEIQAGRICPAGSSSDEAVFASLLSGGWIAGA

SEQ ID NO: 124265 - protein, 123 aa, Glycine max
  Coding DNA Sequence Number=SeqID_7487
MGAKLAYDTGIWGMAFVDKWAVGKEKGWVMTLLGWMTKFAFFQTHIDPFTGKDQILKALKVRSPPFSIVEYWCHFELPGSPPLGKEASLTQEPIHPLERGLSRGVRKDQTVPHEPSRAYAAGA

SEQ ID NO: 124266 - protein, 130 aa, Glycine max
  Coding DNA Sequence Number=SeqID_7488
MKARNLVVASSLALERQNLNSMHLIKRDTYGLCFGRGVPKPGAGSVGSCGGDRNSLAYSLYAPTVAFLKIKHKLSCNFFVSITKCTVRDPLSSGSWPTEHAPSTHVHNGCYSVFIDRYYYKVARRLQNRR

SEQ ID NO: 124267 - protein, 213 aa, Glycine max
  Coding DNA Sequence Number=SeqID_7489
FCLANLPGDAFSLWGNFFEAKKQMMADAKFAGLLGLAICLSFSMCPVVGFGPWLGLGKPLVEILPPGQLRGFCPLLAWLGSAVLGYGPVLSFGLVGPLLPPVISFVARILPTLACAPLAKSVPRWWIIMQNEREPTNGSLFWPNIVEEERDTGLIGEGRIKATRAESQWIVAARPLCHLQYPVAYLSRLQRILPAARWELRFKASRRANPPHE

SEQ ID NO: 124268 - protein, 253 aa, Glycine max
  Coding DNA Sequence Number=SeqID_7490
  Gene Ontology: Mol. function=binding
  Homolog annotation: Hit_ID=Q10SR2; Match level="QueryCoverage=74%, HitCoverage=41%, E-value=2e-38, Identity=48%"; Hit description =Expressed protein
MPEPESQNGHEPAPEPEPEPQPQPETKPEPTEQTQPHLEPKSESVPELEPNPQPESEPVPTEQTQAPLEPKSGSEADPVVNDADRRETTIHSNEANANPSPTPKLRKDEGSRTFTMRELLNGLKTGSEPEKEDANSPYSPEQQQHQADQNNAAMDLINSVVGVDDEGRSRQRILTFAARRYATAIERNPEDYDALYNWALVLQESADNVIPDSTSPSKDALLEEACKKYDEATRLCPTLHDVRKDILLYDVLD

SEQ ID NO: 124269 - protein, 66 aa, Glycine max
  Coding DNA Sequence Number=SeqID_7491
MEHETFLATWLVEIDLSPNGLRFSNLQPQPRLINHEKPMLCRWHKLNPLKIEGRRFTLDSAKDYFP

SEQ ID NO: 124270 - protein, 84 aa, Glycine max
  Coding DNA Sequence Number=SeqID_7492
MSPHVMQDGGSSQYCIIIVILQRIFLGERAVYAMMLVFPPEFSPLKTILFGNPSQDSVEPLMEALEEDYKDGNEINESRQFIGG

SEQ ID NO: 124271 - protein, 228 aa, Glycine max
  Coding DNA Sequence Number=SeqID_7493
  Homolog annotation: Hit_ID=Q10SR2; Match level="QueryCoverage=29%, HitCoverage=14%, E-value=8e-23, Identity=75%"; Hit description =Expressed protein
MSQTRPTKDSEYQDKSFLITTQELPSCAAVQFTREPGDLITSRAVVMMLCFMAKNSETNRALEKHESAHIFVFDAGEVKVNFGLQWSGWLGHDASNNWKNGVGFFQLPVVSTYSFLWILEFPGHACFTKYKYPYLGGSSHLCYLAITAVLIANLSAFYNWAIAISDRAKMRGRTKEAEELWKQATSNYEKAVQLNWNSPQALNNWGLALQVYLTCQYSSISLLHTNCN

SEQ ID NO: 124272 - protein, 665 aa, Glycine max
  Coding DNA Sequence Number=SeqID_7494
  Gene Ontology: Mol. function=nucleotidyltransferase activity; Cellular component=integral to membrane; Biological process=aromatic amino acid family biosynthetic process
  Homolog annotation: Hit_ID=Q6R3L0; Match level="QueryCoverage=99%, HitCoverage=97%, E-value=0.0, Identity=70%"; Hit description=Metal -nicotianamine transporter YSL1
  Pfam annotation: Domain name=OPT; Domain location=36-650; Score =489.8; E_value=3.3e-144; Accession=PF03169.6; Description=OPT oligopeptide transporter protein
MEEEKKQEIVERDQDLEDQLPAAAAEVHESQPWTEQITVRGIFVSMIIGITFSIIVMKLNLTTGMVPNCNVSAALLAFVFVRTWTKLLHKAGFVAKPFSRQENTIIQTCAVACYSIAVGGGFASYLLGLNRTTYELSGVGNEGNNPGAIKEPGFGWMTGFLFVVCFVGLFVLIPLRKIMIVDLKLTYPSGLATAVLINGFHTQGDKMAKKQVRGFTKYFCISFLWGLFKWFFSGIEDCGFEQFPTFGLQAWKQTFYFDFSTTFVGAGMICSHPVNCSLLLGAVLSFGVMYPLIDRLKGDWFPDNLEETNMKGLYGYKVFVSIALILGDGIYNFTKILISTVFNVHERMRSKNNKNVAAAVRHENPSEDHKQTDEFLRENIPMRIGVIGYAVFTLISIIIIPRMFPQLKWYYVVVAYIFAPSLAFCNAFGAGLTDINMAYNYGKVALFTLAAVTGKENGVVAGLVGCGLIKSVISVSCILMQDFKTAHYTRTSPRAMFICQVIGIAMGCVTAPLSFFLYYKAFDVGNPHGEFKAPYALIYRNMAIIGVQGFSALPLHCLKLCFGFFAFAIGVNMIRDFAPQKIGKWMPLPMVMAVPFLVGAYFAIDMFIGTVVVFAWQKLDSKKAELMVPAAASGLICGEGLWTLPAAILALARIKPPICMKFVPT

SEQ ID NO: 124273 - protein, 1446 aa, Glycine max
  Coding DNA Sequence Number=SeqID_7495
  Gene Ontology: Mol. function=DNA binding; Cellular component=oxygen evolving complex; Biological process=DNA integration
  Homolog annotation: Hit_ID=Q1SS72; Match level="QueryCoverage=99%, HitCoverage=98%, E-value=0.0, Identity=46%"; Hit description =Integrase, catalytic region
  Pfam annotation: Domain name=rve; Domain location=584-744; Score =150.0; E_value=6.3e-42; Accession=PF00665.16; Description=Integrase core domain
  Pfam annotation: Domain name=zf-CCHC; Domain location=246-263; Score =11.3; E_value=0.013; Accession=PF00098.13; Description=Zinc knuckle
  Pfam annotation: Domain name=zf-CCHC; Domain location=281-298; Score =12.0; E_value=0.01; Accession=PF00098.13; Description=Zinc knuckle
  Pfam module annotation: Pfam domain module=RVT_2::Retrotrans _gag::rve::zf-CCHC::zf-CCHC; Domain location=946-1201::77-192::584 -744::246-263::281-298
MNESSASNMESYLYLHPSENPAIALVSPVLDSTNYHSWSRSMVTALSAKNKVEFIDGSAPEPLKTDRMHGAWRRCNNMVVSWIVHSVAISIRQSILWMDKAEEIWRDLKSRYSQGDLLRISDLQQEASTMKQGTLTVTEYFTRLRVIWDEIENFRPDPICSCNIRCSCNAFTIIAQRKLEDRAMQFLRGLNEQYGNIRSHVLLMDPIPAISKIFSYVAQQERQLLGNAGPGIHFEPKEISINAAKTVCDFCGRVGHLESTCYKKHGMPSNHDTRNKNSGRKACTHCGKMGHTVDVCYRKHGYPPGYTPGYKPYGGRTTVNNLVAVENKANEDQAQHHEAHDSVRFSPEQYKALLALIQEPSAGNTTISQSKQMASISSCINTPTNPGMSLSLRTPCVSWILDSGATDHATYSLRNLHSYKQIDPITVKLPNGQCVCATHSGIVKLSSNIILQDVLYIPSFTFNIISISKLVSSVNCELIFSSTSCVLQEVNSHMRIGIVEAKHGLYHLIPAQLTTKTVNSTITHPRCNVIPIDLWHFRLGHPSTERIQCMKAYYPLLKNNKDFVCNTCHHAKQKKLPFSLSHSHASHFFDLLHMDIWGPCSKPSMHGHKYFLTIVDDCSRFTWVHLMKSKAETRQIIMNFITFIETQYDGKVKIIRSDNGIEFSMHHYYASKGIIHQTTCIETPEQNGIVERKHQHLLNVTRALLFQASLPPSFWCYALPHATYLINCIPTPFLHNVSPYEKLHKHPCDISNLRVFGCLCYINTLKANRQKLDARAHPCIFIGFKMHTKGYLVYDLHSNDVSISRNITFYEDHFPYLSETQHTHLEYPAPSPESFSDRNDDPQTESLSSPPMISIPSSNEPEHNHPPSHLRRSTRTKNTPTYLRDYHREFSSSTPSTSMAVRYPLSSVLSYSRLSPAHRNFVMNISSVTEPTSYVDASRHDCWIKAMEAELRALQSNQTWRLTPLPSHKTAIGCRWVYKIKYRADGSIERHKARLVAKGYTQMEGLDYLDTFSPVAKLTTVRLLLAIAALNQWHLRQLDVNNAFLHGELDEEVYMQIPPGLSVDNPKLVCRLQKSLYGLKQASRQWFVKLSSFLTSHGFHQSTADHSLFLRFTGNITTILLVYVDDIILTGNSMTEIQTIVTLLDSEFKIKDLGDLKFFLGLEIARSSKGIHLCQRKYTLDILNASGMLGCKPNSTPIDYSTKLQADSGSPLSAESSSSYRRLIGKLIYLTNTRPDITYAVQQLSQYMAAPTNAHLQAAFRILRYLKSSPGSGIFFTAAGTAQLRAFSDSDWAGCKDSRKSTTGYLVYFGSSLVSWQSKKQPTVSRSSSEAEYRALASTTCELQWLTFLLQDFRISFVQPANLYCDNQSAIQIATNPVFHERTKHIEIDCHIVRQKLNSGLLKLLPVSSALQLADIFTKALAPAVFRHLCNKLGMMNIHSQLEGGS

SEQ ID NO: 124274 - protein, 130 aa, Glycine max
  Coding DNA Sequence Number=SeqID_7496
MHDMNAFYGHESPENYLSPPPPRLVAAERVYEGSTTVPNISLGNDQVKDKQVVKGPTKLVHMPNPDEDPLYLMTLTIPQLFIKPLQVSWDASVFEVYNDNFPLYVKHEDLAEIAHGGQCISISVIQFWIL

SEQ ID NO: 124275 - protein, 100 aa, Glycine max
  Coding DNA Sequence Number=SeqID_7497
MEANVVVVAATSAVAKVSPTSPSGINQMNHPTSDMVGKDLGSTGGPHDVQIQNEHAFPPYGLPLNYTPPNVAYTPNKNVNNSTPIPIRSQQPQTDHAHVS

SEQ ID NO: 124276 - protein, 101 aa, Glycine max
  Coding DNA Sequence Number=SeqID_7498
MAFGGPAARPGELRLSHEVASSPRRVGYLTWKSFGGPSEQEASMGELGCHTLISSGDHPLLGCDPRSTTSRYLALVVRRFVKFRDMPKVKRKHCRTIREIS

SEQ ID NO: 124277 - protein, 54 aa, Glycine max
  Coding DNA Sequence Number=SeqID_7499
MKNEWLWLETEVFSASSAYRVRLEDIGQTEDLIVFQDLWKEHSFGGGTHIIPIL

SEQ ID NO: 124278 - protein, 188 aa, Glycine max
  Coding DNA Sequence Number=SeqID_7500
  Homolog annotation: Hit_ID=Q1SXQ3; Match level="QueryCoverage=28%, HitCoverage=5%, E-value=2e-08, Identity=53%"; Hit description =Integrase, catalytic region
MDIKERNMIMMKEAIRVRFNDTKPDTEMSRLDESCRHKTRRRHWTTDRTIYRNKHVQLDPSTKVQTRGSLEQQGYTTLISKVEPKHIISHARGTSTTPKNDVWKLVVLPQGKKTISAKWVFRNKLDEAGLQIKQTNIDIYMHQTKYVKGLLKKLKMEDAKEMKTLMHPTTCLGLDKESNKVDTHNTKQ

SEQ ID NO: 124279 - protein, 258 aa, Glycine max
  Coding DNA Sequence Number=SeqID_7501
  Gene Ontology: Mol. function=nucleic acid binding; Biological process= DNA integration
  Homolog annotation: Hit_ID=Q1SDG1; Match level="QueryCoverage=45%, HitCoverage=10%, E-value=3e-21, Identity=42%"; Hit description =Integrase, catalytic region; Zinc finger, CCHC-type
MEEGYSTNKLPLFKGIKYDYWKEHMIAHFKSIHIDLWDVVEHGNYVPLDDQLNEVSRTSWIDAQRQRFMLNSKARNTLLCTLSKEEYTKVHNYKSANQMWETLALMDEGSSQVTTLRTMKNLNSVSIEDLIGTLKVHEQELQQDEGFKRGRSLALPAQKTSSTCKESSSRSTSKSTSKAVNFDTPYDDESNDEGSDEDDQLSFISRKIRIIWKKMRNQIGKDPRNHIEKEKIRRKASSYSMSARNQGISSQNVHILIN

SEQ ID NO: 124280 - protein, 92 aa, Glycine max
  Coding DNA Sequence Number=SeqID_7502
MICRQPNLITSLESPSDSVCVFISVWHEMKCKGVVALSRPFGLSALSVAKESGRVQESRPHVKCVINSLSARVVLSQAQYMTGAKLKTTYSR

SEQ ID NO: 124281 - protein, 60 aa, Glycine max
  Coding DNA Sequence Number=SeqID_7503
MGSVAREREWGWSRRVVTVVRMDDDPRSFPPGVARAPRLGLRSKAEALEPPGKIKANFAS

SEQ ID NO: 124282 - protein, 147 aa, Glycine max
  Coding DNA Sequence Number=SeqID_7504
IQRTNRLRILCPNTFEGTSFVVQVEGTSTWVVILRTREGTSLVDQFKWRVHPLGCSKRTREATSLVDLWLVKDFTRLKEISRTVGCLGTGCRHGLLPNQLIRQALKNVVFHFLAKPIHWLSERPLSARKNREEDELYMCSKCTASSY

SEQ ID NO: 124283 - protein, 72 aa, Glycine max
  Coding DNA Sequence Number=SeqID_7505
  Gene Ontology: Mol. function=hydrolase activity, acting on glycosyl bonds
  Homolog annotation: Hit_ID=Q2RGQ9; Match level="QueryCoverage=87%, HitCoverage=32%, E-value=3e-10, Identity=43%"; Hit description =Peptidase C56, PfpI
MGTPLFGTVSGRKCSAYPAVKLNVVLSGAAWLEPESISRCFTDGNLVTGAAWPGHPEFIAQLMALLGIQVSF

SEQ ID NO: 124284 - protein, 170 aa, Glycine max
  Coding DNA Sequence Number=SeqID_7506
MASGNRIPMSITQGDRALVIDYHLVIAMAAQFIHDRVVMECLEGVWETLEGNERCRFRGTIRLTATSLVHPEEPARTLQQLVESILPTPTPYRLVELVQVIEVSSSEEDLEEDPEELSPEPAMDALDLPEDDEDPLIDVDSPEDIMSAFEVDSTEESGPGGTANSDDSSL

SEQ ID NO: 124285 - protein, 91 aa, Glycine max
  Coding DNA Sequence Number=SeqID_7507
MGAKYLEVVKRKLHSTKQWSPDEIRLLSSRRHPGALAIESLHSTTLTPRTLDAIIFLWTNSTFLQKVLMSSGLGYLSSKGVRGGHYIEFES

SEQ ID NO: 124286 - protein, 139 aa, Glycine max
  Coding DNA Sequence Number=SeqID_7508
MKNLVGHLGVHDKTCLTMDCLHMYVSYPTFVRGQLFVNMRTLADQFEMLTPHPGVIQKGGVPSPGPSGIFWREVASGGSYLARLGKLGGNHLPHFCYKMAFGAEGKGFSTLGIQNSLKISEKKKKEGENQSRGASGTFP

SEQ ID NO: 124287 - protein, 277 aa, Glycine max
  Coding DNA Sequence Number=SeqID_7509
  Gene Ontology: Mol. function=oxidoreductase activity; Cellular component=integral to membrane; Biological process=electron transport
  Homolog annotation: Hit_ID=Q1SIX3; Match level="QueryCoverage=54%, HitCoverage=24%, E-value=9e-52, Identity=50%"; Hit description =Ferric reductase-like transmembrane component; EF-Hand type
MAGSNTHLIAANTSKNNTVHANKNVKMLALEYVPLPTRSVHDPGLPYEQEASGGSGDNPIKEAKEQDRGRECRMDFVPDVFAINTDHIEVDKETLDMLHSLGINDIPGITQVDPVPVQQSFPFTRSATTNKLANIQKQAEEYATLVMEELDPEDTRFIMVNYLEMLLLHGPSHSTRGDSKYLSQMLSLKLKPIDEDNPIKRWYKNTKRKAAYEVMGHCVCMAKGAAKTLKLKCIAVAVTIEVGIHGIYHLACDFPRLLDASSEKYKLMEPFFGDQPS

SEQ ID NO: 124288 - protein, 159 aa, Glycine max
  Coding DNA Sequence Number=SeqID_7510
MEKTPFGPIFLRETVTHRGFVLGTRETESDSAARKLGIRAMAEDLVLDTAIRDWGLIPLSVVMEKSDQGTNQANYWAFQSWATAIAQHFLLNPSSKGEKLKAELEDAWTFLHEALNGNITLTGDNSKLKGKLATLGDKVKDLQAKVSDVEVGDKVKHLG

SEQ ID NO: 124289 - protein, 153 aa, Glycine max
  Coding DNA Sequence Number=SeqID_7511
  Gene Ontology: Mol. function=nucleic acid binding; Biological process= DNA integration
MDAGTSTREIYFAFLNCKRRSTCLSREISQLQKLNNLRPIPSCTCEVPCVCELVPKIRRYRENHQVIRLLKGLNEQYSAQETQLCGPIDGSLMEVEKGPKVEEAEIIVSSMEVEAITCEEAKVQKFAHTVKTCYKKHGYPSSIQKGECSEQFC

SEQ ID NO: 124290 - protein, 74 aa, Glycine max
  Coding DNA Sequence Number=SeqID_7512
  Gene Ontology: Biological process=cell redox homeostasis
  Homolog annotation: Hit_ID=Q6PV94; Match level="QueryCoverage=77%, HitCoverage=56%, E-value=2e-12, Identity=60%"; Hit description =Thioredoxin
MIAPLQQISRCHGAILEGSQSHAIHAMFEELTDVDFVKIDVNELPKGKEVDKVVGAKKDELERRVRNMIAILVL

SEQ ID NO: 124291 - protein, 77 aa, Glycine max
  Coding DNA Sequence Number=SeqID_7513
MDRATGLRAENALDADDIMSKETNEEEAIHSVSFDLEGSSSATRKAFAQKRCEGILVLKQMQLENLELFWKLDLFCD

SEQ ID NO: 124292 - protein, 50 aa, Glycine max
  Coding DNA Sequence Number=SeqID_7514
MSLVNLTGYNKNVLAELRKDIYMTGIYVILGLSNNSMELSHALAFIISNV

SEQ ID NO: 124293 - protein, 148 aa, Glycine max
  Coding DNA Sequence Number=SeqID_7515
  Homolog annotation: Hit_ID=A0CF75; Match level="QueryCoverage=89%, HitCoverage=44%, E-value=9e-14, Identity=30%"; Hit description =Chromosome undetermined scaffold_174, whole genome shotgun sequence
MALNPQLFPNGMPVPFVNEMFVLARDGVEFEVDKIPASGNHGGNLKTKGIVYLSNIRMVFVAKSPVGHFTAFDMPLLYIHGEKFNQPIFHCNNLSGHVEPASQTPVDEMMRHAYVDPNDPTKIFLQQPNSDSQLRRRTYQPQADGGHV

SEQ ID NO: 124294 - protein, 586 aa, Glycine max
  Coding DNA Sequence Number=SeqID_7516
  Gene Ontology: Mol. function=actin binding
  Homolog annotation: Hit_ID=Q1RYE3; Match level="QueryCoverage=98%, HitCoverage=68%, E-value=1e-100, Identity=37%"; Hit description=IMP dehydrogenase/GMP reductase
  Pfam annotation: Domain name=DUF827; Domain location=2-490; Score =347.8; E_value=1.8e-101; Accession=PF05701.2; Description=Plant protein of unknown function (DUF827)
MESTFKDAVSKFGGRIDWKSRRTQSLVEERNKLAEDFRKEEIAEELENTKKLIEELKNSLEKVEKDELEAKKEVEHVILKIEEMEQDIASEASIEAKAKLEAKKSMLTEALLEFEFVERELDSVRKEYASMASGRDIAINNAEETIATSKQIEKAVEDLTTELIATKEELNSTRTAHLEAEEQRLGVVDQDSHNLKLELEGVEKELQRVNEQVLSARVLKSKLESASSLLHDLKAELATYMESKVNEECYKEQKEKLKELKLNIEKTTSDVNSLRAASVSLKSKLEKEKSILTSLKKNEEKALAVVANLQDELEKSRLATTFIQMKENEARKMMTELPKKVQKAAQEADEAKSLAKAAQEEMIEAQEELEQAKAQSSTLESSLLAKHKEIEAAKVVEMLARDAIITLEKSKSAEGNKNDKDSSSMVTLTLEEYHELSRRAYKAEEQANMRIEAANSQIQIARESELRSLEKLKELNEELSVRRESLSIATENFKKANEGKLAVEHELRTWRAEQEKQKKPGELNDEQTSTPTKPAHDSSSPKGKVPSNNIEVGSASDKNKKKKKKKSLFPSKVVMFFAKKKTHPTK

SEQ ID NO: 124295 - protein, 47 aa, Glycine max
  Coding DNA Sequence Number=SeqID_7517
MEDWGNFLHRILEEDSALIKMFLLVWGFDDKQRQLVAATGGRGWWRR

SEQ ID NO: 124296 - protein, 64 aa, Glycine max
  Coding DNA Sequence Number=SeqID_7518
  Gene Ontology: Mol. function=oxidoreductase activity; Biological process=metabolic process
  Homolog annotation: Hit_ID=Q1SMR0; Match level="QueryCoverage=86%, HitCoverage=18%, E-value=3e-20, Identity=87%"; Hit description=Short- chain dehydrogenase/reductase SDR
MVIKFQWWWSKETVAVVTGGNRGIGFEICRQLAGHGVIVVLTSRDESVGVESAKVLQEGGLSST

SEQ ID NO: 124297 - protein, 955 aa, Glycine max
  Coding DNA Sequence Number=SeqID_7519
  Gene Ontology: Mol. function=helicase activity; Biological process =proteolysis
  Homolog annotation: Hit_ID=Q9FHU7; Match level="QueryCoverage=90%, HitCoverage=95%, E-value=1e-167, Identity=39%"; Hit description =Similarity to nonsense-mediated mRNA decay trans-acting factors
  Pfam annotation: Domain name=UvrD-helicase; Domain location=254-878; Score=-214.4; E_value=0.015; Accession=PF00580.11; Description =UvrDREP helicase
MERSCIAKDNEEGLDLVETVFNWSLKDVLNDNLCKHKVLKIPQTFLSTTDYLNSFIPSLIEETRSDLCSNLKGVSRASFCEISSIELERSRSFIPTKSLFYQISVNRSSNDVNGKYEPEVGDLIAFTDIKPKTVDDLINRPKRNYHIGYVHGIKESIDKISILSSKSFDMDIQFALRSKSDAPKLYAFHLLNLTTNVRIWKALKSQLEGASLSMMKKVLQADINNGENCQLCFSGENHSVACSSVQNIIRSQNLNQSQKEAVVSCVTSRECHHNDTIKLIWGPPGTGKTKTVASLLFSLLKLKARTLACAPTNTAVLEVAARLQNLVMETLECDTFGFGDIVVFGNKSRMKVDSYRCLNDVFLDYRVDNLLKCSGWKHSLESMIKLIEYPKQQYDSYKREEENSLKSLEEFAKQKYFNEKHDDHLTLEQFLKKESTCIEEQYLLYKDHKRKNIKTMEQYFMQRLRSNREQLEEYMRTLHTHLPTSLIPLEEIKKMPVALDLLSSLENSLSKDKFKQTSDGCEDGESILDCLGRLSIKNEECLVKLRSLSQTISLPNITDKYEMAKFCLMSARLIFCTAASSTKLFADGMTPVEFLVIDEAAQLKECESTIPLQLPGLHHVILIGDEKQLPAVVKSQVSQEAEYGRSLFERLVSLGHKKHLLNVQYRMHPSISLFPNKEFYEKQLSDSPFVREVSYNRHFLEGKMYDSYSFINIAKGKEKMPRGGHGWKNMVEAAAVCKIIESLENGKKVSIGIISPYNAQVYEIQERITRQNLVSDPNFSVSVRSVDGFQGGEEDIIIISTVRSNKNGKIGFLDNRQRANVALTRARYCLWILGNENTLSSDYSLWRNLVNDAKERGCFHNADDDKKLAKAIEEESLLIELLDEYESPFKKLSLGSTSRTRTTATTFRTNHLTYIPEGLSGAGQGHQGGDDVPSYLEYLHCRRVNEKGRQGVPVP

SEQ ID NO: 124298 - protein, 81 aa, Glycine max
  Coding DNA Sequence Number=SeqID_7520
MGGANSNFDILKLGLREYFRSWIASGGSNPARLGELGGNLLPLFPINRLKGAVLRVSDPPGGVFQLFWVKKIVYVKKIEAE

SEQ ID NO: 124299 - protein, 405 aa, Glycine max
  Coding DNA Sequence Number=SeqID_7521
  Gene Ontology: Mol. function=mannose-1-phosphate guanylyltransferase (GDP) activity; Biological process=lipopolysaccharide biosynthetic process
  Homolog annotation: Hit_ID=P29956; Match level="QueryCoverage=87%, HitCoverage=76%, E-value=1e-149, Identity=72%"; Hit description =Xanthan biosynthesis protein xanB [Includes: Mannose-6-phosphate isomerase (EC 5.3.1.8) ...
  Homolog annotation: Hit description=(Phosphomannose isomerase) (PMI) (Phosphohexomutase); Mannose-1-phosphate guanylyl transferase [GDP] (EC 2.7.7.22) (GDP-mannose pyrophosphorylase) (GMP)]
MPGGLAAAFGLQLGDNGLDLLHAVCLADQHRVVGLDDDHVIQADQCHQALCIGIGVAAVDGDHIALVGVAVAVLLRDIAQRRPRADIVPAGVQRNHHGVCGFFHHRVVDGVGRNRSEGVLVQTGEIRIATGLLPGLAAAGQHVGLEVLQFLQVARGLEQEHAAVPVILAAADVAGAGVQVGLFDKALDRAQPLAIGGLDIAVAGFRAGRHDAEGHQLSSFGSSGSGLDGAAECSLVGDHMIGGQHQQQGVGAVAGGFQRGHRDRRGGVATNRLKDDRGWLGADLLQLLGGDETVLFVGDHQRSTCGNRGDALPGGLQHRQFTRQGQELLRIRLARKRPQAGTGSTGQDDGLDAAHAFLGYCWMRREMSSVRACISAASPRASTFRRSSGSVLELRRLSASRRSRH

SEQ ID NO: 124300 - protein, 476 aa, Glycine max
  Coding DNA Sequence Number=SeqID_7522
  Homolog annotation: Hit_ID=Q3R6N5; Match level="QueryCoverage=45%, HitCoverage=89%, E-value=5e-69, Identity=60%"; Hit description =Rhomboid-like protein
QLGLDAVVAANPVAVVFGLEAERHGQRSTEVHVVVLAERHVEVRGRYRGDHAGVAAVATGIGAPLPYWPWPRNLAPKLMALTSPWTRVPSSRRMEAGLVAMTEASPSVEVEPANARPRPLALFSFSWKAAALASAAASAPATPTASRVSRAMVEAVCIVVLSPVSGDGALSAPAPAGSWDPSERAGFPSRHTTPYATQAVFSSQKLNRTVATESGRTLGYWHVRLAPVPQEGGPALGHARAVCGTMAGVPVPLAGLGRPVHRPDPPAGLVGDPAGRQRAAPVHRPVPARGLVTPAGQSGVPADLQPARRTGAGPVAPAAAVPGRRCGVQSGGHLHHGQPGPDHHRCQRCGVSAHRRLSGPVPGRPAGRGDPAGPVPGVRARPGLPADRRLGGAAGGVRPYRPQLRHGGLVGAHRWLPVRPAVRRVRARRDRTPPAQAARLLNPWWCRPLAGVTLTRSFVDHSSTARRYRIRAWPEP

SEQ ID NO: 124301 - protein, 288 aa, Glycine max
  Coding DNA Sequence Number=SeqID_7523
  Gene Ontology: Mol. function=oxidoreductase activity; Biological process=electron transport
  Homolog annotation: Hit_ID=Q5PCW7; Match level="QueryCoverage=100%, HitCoverage=49%, E-value=1e-100, Identity=67%"; Hit description =UPF0209 protein yfcK
  Pfam annotation: Domain name=DUF752; Domain location=1-192; Score =170.3; E_value=4.7e-48; Accession=PF05430.2; Description=Protein of unknown function (DUF752)
MSLSREGTPVSRAFDDVYFSNDNGLEETRYVFLDGNHLPQRFAAHPRDLFIVAESGVRSLPRRPSASQLAPPALHQLRKIPADPRRSGERARALAGTGPVGRTATAAVAAGPARLSAPAVQWRRDGFAPAKNPEMWTPSLFAAMARLARPGGTFATFTSAGFVRRGLQQAGFSVAKRKGFGHKREMLTGVLDSAPGQRPAQPWYARPQATSREVALIGGGVASAVLALALLRRGWQVTLYCADAAPALGASGNRQGALYPLLNQHDPALATFFPAAFSFARRLYDALP

SEQ ID NO: 124302 - protein, 142 aa, Glycine max
  Coding DNA Sequence Number=SeqID_7524
MCQGPKWGRVQWCFELATHVDDMAVFGDDDREFGIGNKRRKYGWTRHHMSEQWGRSNAVWHAKEGHMRERQSSDEWNGDKRLRLNCGSPILPYLRPLSELLELQPRGWRFSPTSTSDMAKLKNISGGKPHFTSRFCRDELGL

SEQ ID NO: 124303 - protein, 125 aa, Glycine max
  Coding DNA Sequence Number=SeqID_7525
  Subcellular localization annotation: CTP_CleavageSite=51; ConfidenceScore=5.03e-01
MRQSTTVAVDVRRAAVACGSRVHRVSVIGRRSLACVVCWSAAVALENVVCSCRTAAGHAAEEEKLGRHKKPATPPLFGGVFPKFRDAIPPWCRHGLILELWDIRMQIELALPLIGDPPLDILHIS

SEQ ID NO: 124304 - protein, 256 aa, Glycine max
  Coding DNA Sequence Number=SeqID_7526
  Gene Ontology: Mol. function=protein serine/threonine kinase activity; Cellular component=spindle pole body; Biological process =protein amino acid phosphorylation
  Homolog annotation: Hit_ID=Q9FGC1; Match level="QueryCoverage=96%, HitCoverage=31%, E-value=1e-112, Identity=80%"; Hit description =Protein kinase-like
  Pfam annotation: Domain name=Pkinase; Domain location=74-254; Score =29.5; E_value=2.6e-10; Accession=PF00069.15; Description=Protein kinase domain
  Pfam annotation: Domain name=Pkinase_Tyr; Domain location=74-250; Score=-141.0; E_value=0.00081; Accession=PF07714.7; Description =Protein tyrosine kinase
  Pfam module annotation: Pfam domain module=Pkinase::Pkinase_Tyr; Domain location=74-254::74-250
MYVCMHLVARLTKEIVETYQICNPQFKYSEDLNPKRFLTSPSVGVLNDGYDNVNSDLILTVNFVLIHLEKNKRYIVKDLLGHGTFGQVAKCWDSDTNSFVAVKIIKNQPAYYQQALVEVTILTTLNKKYDPEDKHHIVRIYDYFVYQRHLCICFELLDTNLYELIKMNHFRGLSLGIVQLFSKQILYGLALLKEAGIIHCDLKPENILLCTSTVKPAEIKIIDFGSACMENRTVYSYIQSRYYRSPEVLLGCQYPN

SEQ ID NO: 124305 - protein, 158 aa, Glycine max
  Coding DNA Sequence Number=SeqID_7527
MGSDGCDISRVGMTGRGDHRAESAARTTAGHTGKCLVQKLFGMAKISVWESEWEVEAVTLGIDTLEDSDPDDGGFTGKLIGDIEAGICSAICLLRRSFFTILASKIADIAVIAKCDAMAFGLQGVMTRCVRIAQFACKMQFTNSFAIHTTRVIQAQKL

SEQ ID NO: 124306 - protein, 1450 aa, Glycine max
  Coding DNA Sequence Number=SeqID_7528
  Gene Ontology: Mol. function=RNA-directed DNA polymerase activity; Biological process=RNA-dependent DNA replication
  Homolog annotation: Hit_ID=Q1T5K4; Match level="QueryCoverage=50%, HitCoverage=87%, E-value=1e-102, Identity=29%"; Hit description=RNA -directed DNA polymerase
  Pfam annotation: Domain name=RRM_1; Domain location=87-157; Score =28.5; E_value=2.4e-05; Accession=PF00076.12; Description=RNA recognition motif. (a.k.a. RRM, R
  Pfam module annotation: Pfam domain module=RRM_1::RVT_1; Domain location=87-157::1001-1211
MVLNCRGEVIYNDGIEEMRESGRESGWETHRERENQWTTVRNRKRGKWRVNTTERADPRHSYEGKRFGQHSNYQYANWRDRTDITSFYFTRFPEDATKKELWTQFKKWGDVREIFISKQRNKGGRRYGFVRFKGVADENRLERQLDNIIVGGLKLNVNIPRYGRGKASQGKPIVNQSRQGGGAKQTRTKERQQFKTQKHIPRYLKGHTRRQLLYAQTRLDKEGKQSSPNLKKQETFERVEEEIPWNLGSDVIPKYLGDNMVLLLGLTDTKTEDMITKETKHGASLFHSVEKWNPQMRPENRMQWVTWWTLMMMWKNDEGWTGQGSLSEPLGDRQSTIRSSGSSEEIVSDDSDFDTPLTRSNGSSPRLLAAKSMAGSDVRQVEKVPNGLPGNKHPTGNEGSSTTHCPIPERRVIESDKGKLIALEAGPMSKEIAISGEGAGWNVKSTANSGEKKESEMNKLARCTESSSEKAKKVMEYGQKEANTQNHNGSQEPLFKNSRDLHMEPTGPNSKWGLTIHTYRAVSHCECEKHQEQITEIWSALKVYSRARGCRKKAAQPSRRENLPVKTKFMHSQKQPRQELQTANRGNEGYTASSDLDSDSDSMDLNSQPEQRKTLQSRNQCSNNFLEEATTQWEMEKDLGMTWGSKQPEIIEKIASMEIRDRKERVRERGAVDNYQKIGDSEMSWESQPAINTIGGLLCVWNEQIFKVERRVSVEEVPCVGRRFTWFRPNEAAKRKLDIFFVSDEWIPKWTGFTQFILNRNFSDHCPILLRAKYVDWGPKPFRVMDCWLKDKAFQNLVKETWSNTQLRRWGGYSLKEKIKTLKRKIQQWNKKQFGDTFKKVQQIESTLNKLEVGGNDRQLSSQELTLRKKLQEDLWAASQSHESLLRQKARTRWIRERGCNSKYFHMLMNSNRRRSTVKGMLIEGSWIEEPNRVKEEQNDMLVGRFQKDEIKSAMRDCGTEKSLGPDGLNFKFIKFFWELLKPDFIRFLDEFHVNGIFPKGCNASFIALIPKVKDPQSLNEYITISLIGCVYKIVAKILANRLKKVLPDIIDERLTTFIRGRHLLHGVVIANEVVEEARRRKKPCLVFKVDYEKAYDCFMGIPNIHDEEIGFLHQMDTLDQGLPSFSIGVYSSQWRQGDPLAPMLFNIAAEGLTGLMREATMENVKVIKKILRCFELASGLKINFAKSRFRVIGKPEQWGKDVVEFLNYTLILVGWRNGAKENCVGQLGNNMSPKSEKRFRHKRSPSVQHNIVWQVEMGNISAQRGNVDQNSTFKDTWATEDKPLMVKYHNMYQISNQQQQTINLMGSHTKVEWEWKFSWRKTLFDNEVVMAADFLEESAQLIIQQNGEDSWIWKADPSGNYSTTTTYELLLEATRGENEDGTLVELWKLKIPLKAAVFAWRLFRDRLPTKVNLRRGQVELNDSLCSLCNTKKEDAAHLFFNCSHTLPLW

SEQ ID NO: 124307 - protein, 105 aa, Glycine max
  Coding DNA Sequence Number=SeqID_7529
  Gene Ontology: Cellular component=cytoskeleton; Biological process =phagocytosis
  Homolog annotation: Hit_ID=O80516; Match level="QueryCoverage=96%, HitCoverage=27%, E-value=1e-23, Identity=72%"; Hit description =Expressed protein
MAWQRRSAYRGYRIALIFHVMVLSLSTSLSKTLSHVHITLCAAFVLPCVQSLSLKNDALRALWSAAFPKEELHGLISEQWKDMGWKGKDPSIDFRGGGFISLENL

SEQ ID NO: 124308 - protein, 209 aa, Glycine max
  Coding DNA Sequence Number=SeqID_7530
  Homolog annotation: Hit_ID=Q45RR6; Match level="QueryCoverage=26%, HitCoverage=16%, E-value=8e-16, Identity=74%"; Hit description =Plastid division regulator MinD
  Pfam annotation: Domain name=UPF0287; Domain location=132-203; Score =20.1; E_value=1.2e-05; Accession=PF08583.1; Description =Uncharacterised protein family (UPF0287)
MKRKKYSADKPLPDSLSQSRYIALKVGLALVADEGLAEAAITVEDLDDGVVDVVLEFEDEVKVVKASVGINGSHREAQTVGGLGFLGVRVLTVPLEDRRMGAEEECGVGGGGRVGEKVERGKREEERRRKRTLSEKKRNEHKIIEQFQKCHIEHPIAKFFGECTDLKIKLDRCFREEKALKRKANFEESKKLKEQLRALRKENATSSGQ

SEQ ID NO: 124309 - protein, 203 aa, Glycine max
  Coding DNA Sequence Number=SeqID_7531
  Gene Ontology: Mol. function=protein binding; Biological process =primary shoot apical meristem specification
  Homolog annotation: Hit_ID=Q2HW32; Match level="QueryCoverage=69%, HitCoverage=12%, E-value=1e-71, Identity=87%"; Hit description =Lissencephaly type-1-like homology motif; CTLH, C-terminal to LisH motif; Nitrous oxide ...
  Homolog annotation: Hit description=reductase, N-terminal; WD40-like; Quinonprotein alcohol dehydrogenase-like
  Pfam annotation: Domain name=WD40; Domain location=127-166; Score =13.5; E_value=0.79; Accession=PF00400.22; Description=WD domain, G -beta repeat
  Pfam annotation: Domain name=WD40; Domain location=37-77; Score=21.9; E_value=0.0023; Accession=PF00400.22; Description=WD domain, G-beta repeat
  Pfam module annotation: Pfam domain module=WD40::WD40; Domain location=127-166::37-77
MKPHPLHYRNPTIPYPISVSAHSKSFPKTTIELEKNEDKNDIFEGHEAAVYSVCPHHKESIQFIFSTAIDGKIKAWLYDNMGSRVDYDAPGHWCTTVLHSVDGSRPFSCGISKDGESFLVEWNESEGAIKRTYNGFRKKSTSVVQFDTTQNQFLAAGEDGQIKFWDMDNINLLTSTNAEGGLQNEVNTTSQDAEKTRELWKME

SEQ ID NO: 124310 - protein, 344 aa, Glycine max
  Coding DNA Sequence Number=SeqID_7532
  Gene Ontology: Mol. function=hydrolase activity
  Homolog annotation: Hit_ID=Q5XM22; Match level="QueryCoverage=40%, HitCoverage=94%, E-value=1e-23, Identity=40%"; Hit description =Resistance-like protein HAAS-2
  Pfam annotation: Domain name=DUF1723; Domain location=13-57; Score =10.5; E_value=0.029; Accession=PF08330.1; Description=Protein of unknown function (DUF1723)
MTIEPVSSAEALIPDDVNLTGQNETSSFHLPIGDVTITFDDVAPLLHLSITNAFHSFEGLHMDEVVFLLVELLEVSADEARVETVQCHGAYVQLLWLRDIYHSECDAAQWTVAAQVYLLHMVGCTLFANKSDTHVHVVFLDDIHDLTQSGSYTWGATTLVHMYDNLNDASKSNAKQLAGYNTLSHCWIYEHFPFVAESIVAAYDQRKPHACHWKSGKTLPVSTYRKRLHRLMSDVGPSIVIHRPERVVRQFRYVQTIPPLPITSMLCIEDIDDKWIQFSEYLTPVDPPRHPLVVHDDTFVEPDIPQHLMATPAMDEALAYAPVHVEHPQHAVYDHVVDDFPNTT

SEQ ID NO: 124311 - protein, 67 aa, Glycine max
  Coding DNA Sequence Number=SeqID_7533
  Subcellular localization annotation: CTP_CleavageSite=52; ConfidenceScore=5.53e-01
MEINIFISWTSFILTTTKAAYYVSNSTTVSKKRRRSSTGGISVIKGFRTTTFAATRRRHPAVVAIRI

SEQ ID NO: 124312 - protein, 40 aa, Glycine max
  Coding DNA Sequence Number=SeqID_7534
MDEASCGGVKIAIMLQGCDKAEMADCLVGVWTNVGKLVLY

SEQ ID NO: 124313 - protein, 131 aa, Glycine max
  Coding DNA Sequence Number=SeqID_7535
MWNFLTSPIQSNADLTLCFAFATCSVKLLYKIFCQEQVQQQGVQELKHAIKDFPSRGVVDYIVSNNAIILLALSFVYYKQSRIEMQEPFEAENFCAGAGVVWPKWGRLRARFWRRKGHQVKRTIANWQQVF

SEQ ID NO: 124314 - protein, 309 aa, Glycine max
  Coding DNA Sequence Number=SeqID_7536
MASLDSSQTGGEKPLSNKVQHVYTRRKLQQKKVQPIIPTLEQIDFLISSEIVPGNTEPPYSNSNSNTPIAFRKGPKFAVKENQDDTAFPVASVENLFADTSSQDKGTSQRNLPQSASKARQDGPEATHFEELINPAKQDDPEATLFEELSNPAKYGLCQPRNTESGSVIINGRNLSGTGYAEQIIKEKQSIPVVSVNDKQDMGISAIPVEEQEISISTTNVIVLSDDDEQEANAADNSMGRKVVESPENSIWYCVGPYGKKGGPFSMSALKRWSDSASHPLEFKVWKTGQSETEAIPLTVALNRIFSSM

SEQ ID NO: 124315 - protein, 471 aa, Glycine max
  Coding DNA Sequence Number=SeqID_7537
  Gene Ontology: Mol. function=zinc ion binding; Cellular component =nucleus
  Homolog annotation: Hit_ID=Q5N7H4; Match level="QueryCoverage=93%, HitCoverage=49%, E-value=3e-56, Identity=31%"; Hit description=Zinc finger (CCCH-type) protein-like
  Pfam annotation: Domain name=Plus-3; Domain location=335-438; Score =108.9; E_value=1.5e-29; Accession=PF03126.8; Description=Plus-3 domain
  Pfam annotation: Domain name=SWIB; Domain location=206-279; Score =58.5; E_value=2.2e-14; Accession=PF02201.9; Description=SWIBMDM2 domain
  Pfam module annotation: Pfam domain module=Plus-3::SWIB; Domain location=335-438::206-279
MGDCLKAYHPRCMAEDDSFLDNECKWTCDSHSCSLCRKPSKFKCFCCPKAVCGKCFSDAEFAIVKGNKGFCTHCSKLAFLIEENADVDSDGEKVDFKDRDTYECLFSEYYEIIKKEEGLNSQHAYQAHKFLKNGKNKCDLDPDEIGEGEDDTGDSEDVSNFIVSDCDDLNDTAGSKSARKKKGMGKLKSMKGKVKDKKEFIGWGSRMLIEFLKYIGKDTSKEFSEHDVTSIIIEYCRENNLFDPKKKRKILCDEQLRSLIGRKSVNKNSIQNLLAPHFAENSEEMDDISSSSEDRDCNEPVNFSRKRKSISCTESQHPNLVSEERQSCFAAIVSSNLKLVYLKRSLVDELSKQPETFDGKVLGSYVRVKSDPYDYLQKNSHLLVQVVGINRSLNNGEINKEIMLQLSNVPKAVPICKISDVDFSEEECQDLYQRMRNGLLKQPTVYSSTASMEAFGRESLNMASQLLAPFN

SEQ ID NO: 124316 - protein, 95 aa, Glycine max
  Coding DNA Sequence Number=SeqID_7538
MKELRSISICQPKKQKFRDCSELKNLRNMSFEGSCIHLCCCDVFGGGGGEWRAMSGGVTVTDTFPNKTHGGNGHENRRLPESDFGGTQYPIYLYI

SEQ ID NO: 124317 - protein, 108 aa, Glycine max
  Coding DNA Sequence Number=SeqID_7539
MDSLKFASLTLPPCSRRSGMLGKRLNSPLLIIDSSAQFCYCKGKIESGFVKSLEWMLISKRWVVIRNWGFSCSVISNNDYVSLFIVHNPSSWLNDGRLNVFGWLCKNA

SEQ ID NO: 124318 - protein, 172 aa, Glycine max
  Coding DNA Sequence Number=SeqID_7540
  Homolog annotation: Hit_ID=Q93XN3; Match level="QueryCoverage=52%, HitCoverage=53%, E-value=3e-23, Identity=56%"; Hit description =Salicylic acid-induced 1 protein
  Pfam annotation: Domain name=DUF588; Domain location=7-138; Score =2.3; E_value=0.0028; Accession=PF04535.3; Description=Domain of unknown function (DUF588)
MAPHDNSKRCDGGPSGFINGVATISAMPCARGVLIEFGRRETHRTTPVSQGNNRHYPSRDGGACRRGGSGLCLMSLTGCCGRVLTYIILAAGAVSTEVLYLAENGDAATTWSSACGSFGRFCHKVTASVAITFVAVFCYVLLSLVSSYKLFTKYDAPASRPTEAIEVAAFPG

SEQ ID NO: 124319 - protein, 84 aa, Glycine max
  Coding DNA Sequence Number=SeqID_7541
MDNNIIVWRLEDDGEYSVRSVYKIIMENLMDYGVVRRGDEFFQEWAHVKEKHNSSTNKDNISNSDSWEPPKPRTLKCNVDASFR

SEQ ID NO: 124320 - protein, 45 aa, Glycine max
  Coding DNA Sequence Number=SeqID_7542
MRRKKAEQNGDKSESARMEAERIVRVRGREAWMQELKTEVKTRLR

SEQ ID NO: 124321 - protein, 96 aa, Glycine max
  Coding DNA Sequence Number=SeqID_7543
MRMMCDFGLGLWGGLGAGFCVGESFSSTAAQRYACCSLHIKNEVHSSIMKAKMHGRSLSLPGLHIASGLIRASHFYDSYFSNSGVDTMSHERVLHN

SEQ ID NO: 124322 - protein, 163 aa, Glycine max
  Coding DNA Sequence Number=SeqID_7544
MDTEDFSFPKIGGTCAYSIDLPPLWNISPKDPSNPNQVPREGSKGDEKDCFEAKLISKGHRKSFSCVEDGKKITRVGHEAAPMDLLWEVFNEELSSATEFSSTSSREMVEFRCATTALTVAKTNKGLLQTKNRPEIAFDKVLQKPYSVGYSGNGLSAASNLNG

SEQ ID NO: 124323 - protein, 326 aa, Glycine max
  Coding DNA Sequence Number=SeqID_7545
  Gene Ontology: Mol. function=binding; Cellular component=membrane; Biological process=photosynthesis
  Homolog annotation: Hit_ID=Q337M8; Match level="QueryCoverage=59%, HitCoverage=51%, E-value=6e-72, Identity=73%"; Hit description =Tetratricopeptide repeat, putative, expressed
  Pfam annotation: Domain name=TPR_1; Domain location=185-218; Score =23.3; E_value=0.00087; Accession=PF00515.18; Description =Tetratricopeptide repeat
  Pfam annotation: Domain name=TPR_1; Domain location=219-252; Score =39.0; E_value=1.6e-08; Accession=PF00515.18; Description =Tetratricopeptide repeat
  Pfam annotation: Domain name=TPR_2; Domain location=147-180; Score =5.5; E_value=7.5; Accession=PF07719.7; Description=Tetratricopeptide repeat
  Pfam annotation: Domain name=TPR_2; Domain location=185-218; Score =27.1; E_value=6.4e-05; Accession=PF07719.7; Description =Tetratricopeptide repeat
  Pfam annotation: Domain name=TPR_2; Domain location=219-252; Score =34.5; E_value=3.8e-07; Accession=PF07719.7; Description =Tetratricopeptide repeat
  Pfam module annotation: Pfam domain module=TPR_1::TPR_1::TPR_2::TPR _2::TPR_2; Domain location=185-218::219-252::147-180::185-218::219-252
MEMIMKFVGTWDEPHDKLYHSQPTCGLREVGNNLWIEPVFKKVSDFTTKDIVDGERSSKWVSAFLFGQTISVISPDVSYASSSARINEIYEVGELFDLSIQLIYLVLLLGLLGTGTFFVIRQVLVRRELDLSAKELQEQVRSGDAGATELFELGAVMLRRKFYPAATKFLLQAIEKWDGDNPDLAQVYNALGVSYVRDGKVDKGIAQFETAVKLQPGYVTAWNNLGDAFESKKDYKSALKAFEEVLLFDPNNKVARPRRDSLKGLVDATKGVTVIKSTEKKRNKATFVGSYVPSWEAHRFQLPLQEPASTSYLNHYYDLQHTLSFF

SEQ ID NO: 124324 - protein, 136 aa, Glycine max
  Coding DNA Sequence Number=SeqID_7546
MANFYRNNSMQENLISAKLYTLYHYKTCHFSIKYMTPTHSCYGRTLKHVKAEQPPANSCSSLHQDKREGNGFIDGFGGEFGWEESGKRERRRGRENEEVSENGTTHLRFCFCSGLGYPAPASNATSDGNIVVTLPS

SEQ ID NO: 124325 - protein, 120 aa, Glycine max
  Coding DNA Sequence Number=SeqID_7547
  Subcellular localization annotation: CTP_CleavageSite=70; ConfidenceScore=5.53e-01
MDKNASALNLKTKTRTQPLLRFFFFFFAVVFSFVALLQASSSPSFGAIDDLHFGAAPPSRLEDLVYRYGRSSSVLGRLGIGFRFLHTDIMVRTRGLGRALGRVIGRALGREDHHDSDDVP

SEQ ID NO: 124326 - protein, 166 aa, Glycine max
  Coding DNA Sequence Number=SeqID_7548
  Gene Ontology: Mol. function=inositol oxygenase activity; Cellular component=inclusion body; Biological process=L-ascorbic acid biosynthetic process
  Homolog annotation: Hit_ID=O82200; Match level="QueryCoverage=95%, HitCoverage=50%, E-value=5e-52, Identity=62%"; Hit description =Inositol oxygenase 2
  Pfam annotation: Domain name=DUF706; Domain location=60-166; Score =1.4; E_value=2e-15; Accession=PF05153.6; Description=Family of unknown function (DUF706)
MSVSVEGSAFGALFEEKNVHSEDSNELVLHGAFPLAKHERQNGFNATDMNAFGNSFRNYDAESERQRMVEELYRMQHINQTYDYGKRMREEYGKLDKLEMGIWECCELLNEVTDDSDPDLDEPQIQHLLQSAEAIRKDYPNEDWLHLTALIHGMCSMFLEILLSSK

SEQ ID NO: 124327 - protein, 166 aa, Glycine max
  Coding DNA Sequence Number=SeqID_7549
LTKEQLLTQVRLNWVTELSLPFAPFLVGGDTCFLSLKDGSPTSIVLSCPPRALEESRATLFVLLRRRCGAERQKGSQKGGHTGAKKAKITSSTKETQVKGPEQARDSDEAQTQRAQANKQRAIAALPRGNLSLSFLLPGVIVLMERIENEVRGYQTSRSQGLDYAH

SEQ ID NO: 124328 - protein, 371 aa, Glycine max
  Coding DNA Sequence Number=SeqID_7550
  Gene Ontology: Mol. function=receptor activity; Cellular component =outer membrane-bounded periplasmic space
  Homolog annotation: Hit_ID=UPI00005FA3FA; Match level="QueryCoverage =76%, HitCoverage=87%, E-value=1e-134, Identity=81%"; Hit description= COG3181: Uncharacterized protein conserved in bacteria
  Pfam annotation: Domain name=Bug; Domain location=53-317; Score= -60.2; E_value=3.8e-07; Accession=PF03401.5; Description=Bordetella uptake gene (bug) product
MERQMKKTMRTAFATTLLAFSLSAAQAAAPERTECIAPAKPGGGFDLTCKLIQVSLQETGQITTPMRVTYMPGGVGAVAYNAIIAQRPAEAGTLVAFSGGSLLNLSQGKFGRYSVDDVKWLAAIGTDYGMVAVRADAPWKTLGELLEAMKNDPTKVVVGAGASIGSQDWMKTALLAREAGIDPRKMRYVAFEGGGEPVTALLGNHIQVVSGDMSEMVPHLQGGKMRVLAVMSDKRLPGELADIPTAKEQGFNVEWPIIRGYYLGPKVSDADYQWWEQTFKKLVTTKEFQQQRDLRGLFEFNLFGSELDAYVKKQLRAGWSTPFPAAAARSDGDLRGDDAAAQAGRRTVAGGGNAEKAAGAVRDADGVRLAV

SEQ ID NO: 124329 - protein, 351 aa, Glycine max
  Coding DNA Sequence Number=SeqID_7551
  Homolog annotation: Hit_ID=Q7BVH5; Match level="QueryCoverage=44%, HitCoverage=47%, E-value=3e-63, Identity=75%"; Hit description=TctC
MSPDTTWMWLPSSAVTVLAADGGAGANHHFGRIVLHRLQQFAQRFPRRVSAHGDHAVVRANGRQPLHVIHRVTAKLALRQVQQRPAGEGHQRACFGGPLRNDGVVSHGTDAARHVGHAHRRGDLPGFLQRNLDQFTGQIKTAAGFGRGDTFGPLGCRSLCRRKRKSQQGRGEGGAHCFFHLSLHCFFQSVIATEHSGYRRAGQLAAESADAKRIRRGLGGRRRGGGSCAAKRRLCAGGAGCVAAAAGWPGGAGAPAPAWATRAGAVADRTERAAAAPGRAVARAAAPQPGPGNADAKPRPAGARCGRLFPAESQAAAADAARGQRAVDADAASGTAGVAPASVRANFHTGG

SEQ ID NO: 124330 - protein, 100 aa, Glycine max
  Coding DNA Sequence Number=SeqID_7552
  Gene Ontology: Mol. function=inositol oxygenase activity; Biological process=L-ascorbic acid biosynthetic process
  Homolog annotation: Hit_ID=Q9FJU4; Match level="QueryCoverage=57%, HitCoverage=18%, E-value=4e-20, Identity=77%"; Hit description =Inositol oxygenase 5
  Pfam annotation: Domain name=DUF706; Domain location=2-65; Score= -152.8; E_value=0.0002; Accession=PF05153.6; Description=Family of unknown function (DUF706)
MTSTHNLAALHRAGAYTHLMNEEDIENLKWLKIFSKYDLYSKSKVLVDIEKVKPYYMSLIEKVNGMTTDRIEMGLILHVSIPAQDGTSMGTGKTKTGLEF

SEQ ID NO: 124331 - protein, 132 aa, Glycine max
  Coding DNA Sequence Number=SeqID_7553
  Gene Ontology: Mol. function=RNA-directed DNA polymerase activity; Biological process=RNA-dependent DNA replication
  Homolog annotation: Hit_ID=Q1S5T5; Match level="QueryCoverage=87%, HitCoverage=34%, E-value=8e-10, Identity=36%"; Hit description =Multicopper oxidase, copper-binding site
MATTSISSKDVGRWFTDESGCKENDHMAISDRQDEEEANTLEEETFVIQRENLLGGYPIKGSRWWCDILKSCELLENGLGWFQKNISRVIGDGREVSFWRAKWVSGETLCRSFNRVFLISEQKDSMIAEVGT

SEQ ID NO: 124332 - protein, 123 aa, Glycine max
  Coding DNA Sequence Number=SeqID_7554
MGEVEEIQEKMKADMEAIKEKMATMMEAMMSVKKIMEANAVTIAATSVVGKTHEIPHHNLADFEPWLGYATEGLAVGGIPLENTPEGPQAIEGGEDYAFANLKELFLEPNIITPPKFKVLDFD

SEQ ID NO: 124333 - protein, 72 aa, Glycine max
  Coding DNA Sequence Number=SeqID_7555
MIKIICPELHAINTETCVPMSHPIRALCHDVLQHKVSQNNPPSHLLSQTQGSRSSRDSNTNSTQGVSDHIPN

SEQ ID NO: 124334 - protein, 202 aa, Glycine max
  Coding DNA Sequence Number=SeqID_7556
MASRKHKSIGARPTTQYDTRRFHSLDAWNRYTYNVLGRSIFPERKVEIYHTEFDDFKTELERSNLHKCLTYLANGTIDLALVKEFYANLYSSEGPSPKQARVKGHLVKIDADNLNAFLETPVVLREGETLPTHSRYYRLPIDYREIEAALCIPGRGFILNVEGHPGRILRKDFTTLAQVWSVLSYSNLAFTSHTSDLTVDRA

SEQ ID NO: 124335 - protein, 129 aa, Glycine max
  Coding DNA Sequence Number=SeqID_7557
MPGLSLKIETLIKAQTQVPITTPSFLTYDKCGIMHGLGECIIDDKLVAVMDEINFVEGRDNFSNQYPSNFNQGQGFRIEQPMKKLKKKEKATPTPKREALTEESQEKNKEDEKVMQSYPARALDREDSK

SEQ ID NO: 124336 - protein, 75 aa, Glycine max
  Coding DNA Sequence Number=SeqID_7558
MVKSTTTVVGKCDAGALGSYGMTTTAWCGIRPWLEGSYFSKGSHHIDMVILLTMIVMNLQRLWSSDKVLKYSKEM

SEQ ID NO: 124337 - protein, 178 aa, Glycine max
  Coding DNA Sequence Number=SeqID_7559
MHYILCRVLLPRSTNLAQAFEEDLILLWALQTGRQIDWIHLVRYLMHKALRANAPLPYPHLITLILQHFNIPPVNEPFVKVKRSFAIGATAVASFRYRKDLDGQWVLKQDLLPNAPDECTPSPPPRDPSSSLLNDVLNKLRDVRVFFGDRFDSMDSRVTRLEDDMSFICRCFDPLADH

SEQ ID NO: 124338 - protein, 84 aa, Glycine max
  Coding DNA Sequence Number=SeqID_7560
MSFWDGDGEPDLKKDGDSGCELQCKHDLPLLLDAGNGGGLALRDGGLATVEGFEGFFGEGIKILGFLDNGVLEGGEVGGEGGEE

SEQ ID NO: 124339 - protein, 605 aa, Glycine max
  Coding DNA Sequence Number=SeqID_7561
  Homolog annotation: Hit_ID=Q53P84; Match level="QueryCoverage=93%, HitCoverage=56%, E-value=1e-28, Identity=26%"; Hit description=FHA domain, putative
DEDIPDSEFHQMEVVEEVSVDSVPGGEKQDELHWSSSPTNLDHASLDEKFVAAVAIIPTESEFGCTHGANDKVEDILTTGSRIFNSENTCLIVDKDIPDSEFHQMEVEEISVDSVPDGEKQDECKEEDLNAKSCREEGYSLDEVVEDNGNKCIKTIDPASFDGKGLATVTVIPTESEFGWTLGDNERIEDILEMESRTINSENTSLLDEEAIPVDKFQLINIIEEVAMDSISDGEKEDKCGMELESKLPASLNEKSCHEQGNSVTEIAGDTGKKCASSISLPHHFKCKPASAPQVRARKSRFVSTAKVGTEVKRSNVKNVVINKSMPKDLSSVFDEKEAFTPNNENLCPKYLSLAVYEKESIYSAKNISSVSNKVNQTPKVAQEWKSQRKPLQCRINLVHEQDLMQLKKNRVERVPPFQSLMNSRGNHKSVTVSAAKSIDDAHICGQISNKCTKPSQYTSREQKRSWDMVVDTASLLNKESRKALQLLQGLKGTRLTIPSLVIRELGSMKQQFRILRTTSEASLALEWIEECLEKTRWWIHIQSSMEEFRLTALTPPASPQTRFIEESWALPGFNTSKKCASPKVEDHILDCALPLFHHDFGSRN

SEQ ID NO: 124340 - protein, 284 aa, Glycine max
  Coding DNA Sequence Number=SeqID_7562
  Homolog annotation: Hit_ID=Q53P84; Match level="QueryCoverage=47%, HitCoverage=12%, E-value=1e-20, Identity=37%"; Hit description=FHA domain, putative
  Pfam annotation: Domain name=FHA; Domain location=49-117; Score=56.8; E_value=7.2e-14; Accession=PF00498.16; Description=FHA domain
MASIAAMAENKNPEQEDQARFPILTVLKNNAIVKSIFIVLDDHNEDQMVLIGRHPNCNIVLTHPSVSRFHLRIRSNHSSRTLSLFDLASVHGTWVRGRKLEPGVSAELKEGDTFTVGISTRIYRLSWAPLTQLDDENLELRAEEEIPMPEDIVSLCCDEERKSHAEDEALGVLNGTETSCAPTNSGGENIICDCQLSPPYIQSPPYAQPVDELHNTKKIEACVEVEIPRETNLLCTLREYLKHNIYVCQLWKQSRGPRYSNFKPHMILLLDNHLPWKCIGPASQ

SEQ ID NO: 124341 - protein, 78 aa, Glycine max
  Coding DNA Sequence Number=SeqID_7563
MTSTELCDMAKKSHIFLDLEKLAWMGNGTRVKDKVELKGSMFPFFMVNVPCVTLCHVGLCVKCMSEWATLMRFVWDTG

SEQ ID NO: 124342 - protein, 192 aa, Glycine max
  Coding DNA Sequence Number=SeqID_7564
  Gene Ontology: Mol. function=oxidoreductase activity; Cellular component=membrane fraction; Biological process=negative regulation of transcription
  Homolog annotation: Hit_ID=Q9LSQ5; Match level="QueryCoverage=82%, HitCoverage=90%, E-value=2e-39, Identity=49%"; Hit description=1,4 -benzoquinone reductase-like; Trp repressor binding protein-like
MLNWGLNYYRNLNLYYSMYGHVEKLAEEIKKGASSVEGVGANLLEQNCASKFILTKFEKKCKHFPVPKTLLNEVFGKMSAPPKSNVPVITPNELSETDGFMTRFGMMAAHYKAFLDATGGLRRAQQLAGKSIELFYNTGSQGESPYGVETYVVDESRQPSELELQQAFHQGSTLSASQRSSSELHNVVLPSY

SEQ ID NO: 124343 - protein, 116 aa, Glycine max
  Coding DNA Sequence Number=SeqID_7565
  Gene Ontology: Mol. function=translation initiation factor activity; Cellular component=nucleus; Biological process=translation
  Homolog annotation: Hit_ID=O65879; Match level="QueryCoverage=71%, HitCoverage=20%, E-value=2e-29, Identity=78%"; Hit description =Translation initiation factor
  Pfam annotation: Domain name=DEAD; Domain location=3-116; Score= -31.4; E_value=0.0025; Accession=PF00270.19; Description=DEADDEAH box helicase
  Subcellular localization annotation: CTP_CleavageSite=33; ConfidenceScore=5.44e-01
MEWKSFWSPMRLAGSSPISITLSMRLTPNSKPSLARVQALILSPMRELTSQIEMVILAAGDFINIQAHACVRGKSVGEDIRKLEYGVHVVFGTPGQVCDMIKRRTLRTRAIWMLVL

SEQ ID NO: 124344 - protein, 106 aa, Glycine max
  Coding DNA Sequence Number=SeqID_7566
  Gene Ontology: Mol. function=serine carboxypeptidase activity; Cellular component=cellulose and pectin-containing cell wall; Biological process=proteolysis
  Homolog annotation: Hit_ID=Q5ZA19; Match level="QueryCoverage=67%, HitCoverage=16%, E-value=6e-23, Identity=68%"; Hit description =Putative serine carboxylase II-2
VRHVLAWVFHSAATFSFLGPSVHRNLAIVCVGLHRQPQGYITVNENHGRALFYWFFEAQSEPSKKPLLLWLNGGPRFSSIGYGAVVEIGPLIVNKNREGLHFNTHS

SEQ ID NO: 124345 - protein, 168 aa, Glycine max
  Coding DNA Sequence Number=SeqID_7567
  Gene Ontology: Mol. function=RNA-directed DNA polymerase activity; Biological process=RNA-dependent DNA replication
  Pfam annotation: Domain name=AT_hook; Domain location=119-131; Score =14.9; E_value=0.061; Accession=PF02178.9; Description=AT hook motif
MKWRKASGVLCDAKVPIKLKGKFYRTAVRPAILYGTECWAVKSQHENKVGVAEMRMLRWLCGKTRQDKIRNEAIRERVGVAPIVEKMVENRLRWFGHVERKPVDSVVRRVDQMERRQTIRGRGRPKKTIREVIKKDLEINGLDRSMITANHQKNEVVVNGGWQRHPRF

SEQ ID NO: 124346 - protein, 107 aa, Glycine max
  Coding DNA Sequence Number=SeqID_7568
MAMEGIKLEVGGRWRNSLSLDLDHLPLPTHFNAFADLVHAPSFAYRRVERQLENELRLQSLSDRVAELEILGLFIFVHIRFYYLQNRDRRVTDGEGGDELSRAGTLL

SEQ ID NO: 124347 - protein, 111 aa, Glycine max
  Coding DNA Sequence Number=SeqID_7569
MIPKTQVKNQDSSKFQESKIQVKIQEKTQDMQEPQEKHQEAGFASWLITRLKRLTAFGFIARSGYNFLVVIIGLKRLTAFGFIARSGYNFLVIIIGHKGPTFLGVHCKKWA

SEQ ID NO: 124348 - protein, 80 aa, Glycine max
  Coding DNA Sequence Number=SeqID_7570
MVRRKATAARGGHQWSVVVEEELGGVGGGFRGREGGRKWLFYTVGRNFTALIVGNGLLNIQTKLQDDPTVNESRIAILLK

SEQ ID NO: 124349 - protein, 49 aa, Glycine max
  Coding DNA Sequence Number=SeqID_7571
MGQKTEGGSESPVNANYRSRDPVKERQREDAWTYKGTKKRKIQGHRYRP

SEQ ID NO: 124350 - protein, 317 aa, Glycine max
  Coding DNA Sequence Number=SeqID_7572
  Gene Ontology: Mol. function=receptor activity; Biological process =protein amino acid phosphorylation
  Homolog annotation: Hit_ID=Q6H663; Match level="QueryCoverage=81%, HitCoverage=79%, E-value=1e-56, Identity=50%"; Hit description =Receptor-like protein kinase-like
  Pfam annotation: Domain name=DUF26; Domain location=196-250; Score =52.5; E_value=1.4e-12; Accession=PF01657.8; Description=Domain of unknown function DUF26
  Pfam annotation: Domain name=DUF26; Domain location=95-150; Score =51.3; E_value=3.2e-12; Accession=PF01657.8; Description=Domain of unknown function DUF26
  Pfam module annotation: Pfam domain module=DUF26::DUF26; Domain location=196-250::95-150
MLRSLQLESGYRIILALRLSSLLIFFSSVLSARGYPSRAHIFIYAVCSQEKYQPNSPFEGNLNSFLSSVVSSSSDITYNSFAVGNGSLTPQEGSVYGLYQCRGDLHPIDCSKCVGRLVNQIGLVCPYALGASLQLEGCLVRYEHAGDFLGKLDTSLRYKKCSKAATSDVEFFHRRDDVLADLQTANGFRVSSSGIVEGFAQCLGDLSVSDCSSCIADAVGKLKSLCGSAAAADLFLGQCYARYWASGYYHESGGRSMNSYAINDPFVEKRSENEEEAEIPPTMIKWGNRLPLLWECLQVKREVLKGVIITKGPQMFV

SEQ ID NO: 124351 - protein, 263 aa, Glycine max
  Coding DNA Sequence Number=SeqID_7573
MPTDIREIEAALCIPGRGFILNAEGHPGKILRKDLTTLAQVWSVPSYSNLAPTSHASDLTVDRARLIFGLVTQLDINVGALISGKIISMAQSNSSRLEFPAHITTLYFQRFEAMLRSIHQGQIILLESLQLVAPPDSIPTVEQFNEWVAWPGTQPPLHREDEDPAAQVPHQSEDESSNSTTPEPLIRKMRVVVTQEAAATSEKSLEATLELPAPVADTTSPQQAAYPSTLEDQTTLVLSPNTSLVASLVLHLSEEEEGQTQDT

SEQ ID NO: 124352 - protein, 255 aa, Glycine max
  Coding DNA Sequence Number=SeqID_7574
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=98%, E-value=3e-19, Identity=29%"; Hit description =UPI00006A17C9 related cluster
GLHVLAFRGLHVHAFRGLHILPYRGLHVLAVRGLHVLAFKGLHVLNFRGQHVLAFRGLHVLIFRGLHDYKASPSEGYTSSPKEDYTSSPLESYMPLAFRGLHVLAFRGLHGYTSSPSKDYTSSPLESYMSSPSEHYTSSPSEDYTSSPLEGYTSSPSEDNTPSPLKDYTSSPSEDYKSSPSEDYTSSPSEGYAKRPHHQRTTRPRHERARLNVLTFEDFTSLPSEDYTSLPSEDYTSSPLEEYTSSPLERYTSSP

SEQ ID NO: 124353 - protein, 219 aa, Glycine max
  Coding DNA Sequence Number=SeqID_7575
  Gene Ontology: Mol. function=nucleotide binding; Cellular component =membrane; Biological process=small GTPase mediated signal transduction
  Homolog annotation: Hit_ID=Q9SBU1; Match level="QueryCoverage=89%, HitCoverage=87%, E-value=4e-79, Identity=80%"; Hit description=GTP binding protein
  Pfam annotation: Domain name=Arf; Domain location=1-190; Score=-98.0; E_value=0.034; Accession=PF00025.11; Description=ADP-ribosylation factor family
  Pfam annotation: Domain name=Miro; Domain location=12-150; Score =40.1; E_value=7.6e-09; Accession=PF08477.3; Description=Miro-like protein
  Pfam annotation: Domain name=Ras; Domain location=12-188; Score =235.7; E_value=1e-67; Accession=PF00071.12; Description=Ras family
  Pfam module annotation: Pfam domain module=Arf::Miro::Ras; Domain location=1-190::12-150::12-188
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSLSWDMEKIAACLYWLLGLKIMMGMDSFTRAKKWVQELQKQGNPNMVMALAGNKADLEDKRKVTAEEARVYAEENGLFFMETSAKTASNNKVKRDISPKRRKAFKLFEKLSLPPLYWPSCYYIHC

SEQ ID NO: 124354 - protein, 620 aa, Glycine max
  Coding DNA Sequence Number=SeqID_7576
  Gene Ontology: Mol. function=catalytic activity; Cellular component =nucleus; Biological process=metabolic process
  Homolog annotation: Hit_ID=Q9SNJ6; Match level="QueryCoverage=99%, HitCoverage=100%, E-value=0.0, Identity=57%"; Hit description=EST AU070346(S12172) corresponds to a region of the predicted gene
  Pfam annotation: Domain name=AMP-binding; Domain location=41-498; Score=351.1; E_value=1.8e-102; Accession=PF00501.18; Description=AMP- binding enzyme
MDNLQKCKANYTALTPLTFLMRAAACYANRTSVIHEGTHFTWAQTYERCCRLAFSLRALNVARNDVVSVLAPNIPAMYEMHFAVPMAGAVLNTINTRLDAKNIATILRHSEAKVFFVDYEYVSKAKDALRLLMDNNNNNNNKGVPKPTTINQQNSTFSLPLVIVIDDINTPTGIRLGELEYEQMVHHGNPNYVPEEIQDEWTPIALNYTSGTTSEPKGVVYSHRGAYLSTLSLILGWEMGSEPVYLWTLPMFHCNGWTFTWGLAARGGTNVCLRTTAARDIYSNIVLHNVTHMCCAPIVFNIILEAKQSEKIDIKLKRNSPVEILTGGAPPPASLLEQIESLGFHVTHAYGLTEATGPALVCEWQKEWNMLPKKEQAQLKARQGVSVLTMAGVDVKNLDTMESVPKDGRTMGEIVLKGSGIMMGYFKDHEATSKAFFGSNNSKGDWFRTGDVGVIHPDGYLEIKDRSKDVIISGGENISSVEVESLLYRHPRVLEAAVVAMPHPRWGESPCAFVSLRKNNNNNNSSKKIDHVTEAEIIAYCRKNLPHFMVPKVVKFMEELPKTSTGKIQKFELRVMAKAFMVSENNVQTKNNINKKSSQVSQNSIVGGYNNEQVLALSRL

SEQ ID NO: 124355 - protein, 149 aa, Glycine max
  Coding DNA Sequence Number=SeqID_7577
  Gene Ontology: Cellular component=nucleus
  Homolog annotation: Hit_ID=Q6K882; Match level="QueryCoverage=96%, HitCoverage=53%, E-value=9e-09, Identity=30%"; Hit description =Putative nucleolar essential protein
  Pfam annotation: Domain name=Nep1; Domain location=1-144; Score= -63.8; E_value=0.022; Accession=PF03587.5; Description=Nep1 ribosome biogenesis protein
PLEQILSSRLNAASFIRAIYVNFGPMGSYELNYVSGELLKAGIISNPDNNEVIWRITTNLSSIVSTLPANCKAIGCTHGAGSHSQGSMNFGDYIRAASDEQIYVFVVGQIDTQSQSYIDDFVKVSDYDLVASQCLSRVISAMETKWGIS

SEQ ID NO: 124356 - protein, 50 aa, Glycine max
  Coding DNA Sequence Number=SeqID_7578
MQNSKVARVGASIVKHLCTRNCTSLCGVGYIRSARYHYKQPLSFKIGDIG

SEQ ID NO: 124357 - protein, 141 aa, Glycine max
  Coding DNA Sequence Number=SeqID_7579
  Gene Ontology: Mol. function=electron carrier activity; Cellular component=nucleus; Biological process=electron transport
  Homolog annotation: Hit_ID=Q6K882; Match level="QueryCoverage=82%, HitCoverage=54%, E-value=8e-23, Identity=40%"; Hit description =Putative nucleolar essential protein
  Pfam annotation: Domain name=Nep1; Domain location=42-141; Score= -46.1; E_value=0.00085; Accession=PF03587.5; Description=Nep1 ribosome biogenesis protein
MGAASRESLFVGRCKGCLRVQLLRKWKILNSDEDAQFLLKQKKNLNDYRPDIIHEALRCILDSPLNKAGMVGAIYVKIDQGGMFEVKPHVQLPQTCSRFCGVISLSSTSEKSVDIEEYVSLWSNDLSLVFVYPDSFSCVFR

SEQ ID NO: 124358 - protein, 107 aa, Glycine max
  Coding DNA Sequence Number=SeqID_7580
  Subcellular localization annotation: CTP_CleavageSite=64; ConfidenceScore=5.10e-01
MAGAVSTVSGELKPSILDRVRAAPPPPDSSLLLATRPPRHLSPSLSFCFAPNLTLYHFTCSFILGQAVSYLTCSKLCAICFVAGAIFGYSLRGRVKRWASKILKKLS

SEQ ID NO: 124359 - protein, 102 aa, Glycine max
  Coding DNA Sequence Number=SeqID_7581
MYLIFEHARIGIKNDPTFIHGTIEASHCPCLRKKRSARVGSNDDEVHEQPEEAVVDDVVIDVEGFSGRPYDTLILMDYVYHVVLRDTHIFHYQYMFLSNLSS

SEQ ID NO: 124360 - protein, 489 aa, Glycine max
  Coding DNA Sequence Number=SeqID_7582
  Gene Ontology: Mol. function=dimethylaniline monooxygenase (N-oxide -forming) activity; Cellular component=intrinsic to endoplasmic reticulum membrane; Biological process=electron transport
  Homolog annotation: Hit_ID=Q9LMA1; Match level="QueryCoverage=92%, HitCoverage=92%, E-value=1e-166, Identity=58%"; Hit description =Probable flavin-containing monooxygenase 1
  Pfam annotation: Domain name=FMO-like; Domain location=14-486; Score=- 356.9; E_value=2.3e-07; Accession=PF00743.9; Description=Flavin -binding monooxygenase-like
MANRAKNHPILVSKIGIIGAGVSGIAAAKQLSHHNPIVFEASDSIGGVWSHCSYNSTKLQSHRRDYEFTDFPWPQRDNPDFPTYLEILNYLHSYAEHFDVLKNIRFNSKVVEIRYTGNREVTGFGSLLPGLPMWEVAVQTNHLDTIQWYGFELVVVCVGKYGDIARIPTFPQKKGAEVFKGKVMHTLDYCKLDQEAATQLLKGKKVVVVGFKKSGLDLAMECAEANQGPEGQPCTMVVRTLHWTVPHYWIWGLPFFLFFSTRSSQFIHERPNQGLLRTLLCLMCSPLLLQRRGISKFIESYLLWKLPLDKYGLKPEHPFVEDYASCQMAIMPENFFSEAEKGKIVFKKASKWWFWNGGIELEDNTKLNADVVVLATGFDGKKKLKTILPEPFCSLLEYPSGIMPLYRGTIHPLIPNMAFVGFVESVSNLHSSELRSMWLSGLVDEKFKLPSIETMLSQTLKEIEVMKRKKDWISEVFGPYNIEEYAKED

SEQ ID NO: 124361 - protein, 88 aa, Glycine max
  Coding DNA Sequence Number=SeqID_7583
MAQEEGTSIDQILKPSPAPVPEETQPSTPVTEPEQPIQDSSAAPTLDHNEDQPQDEQDESIIHRKCGSKKICPKFGGVIIKELMKNWA

SEQ ID NO: 124362 - protein, 78 aa, Glycine max
  Coding DNA Sequence Number=SeqID_7584
MADVTSSPGRARLLLEEAPARLGELLCNLHPSFPINRHEGAEEMCKVLKRGAKWSLWGHFPTPRLTRKLRDEATSSPR

SEQ ID NO: 124363 - protein, 54 aa, Glycine max
  Coding DNA Sequence Number=SeqID_7585
MAFHWKQFCLRIVSVLLGTLNEATRKNHSLGTNMSLHSSSSVNGEGSTPKDPLY

SEQ ID NO: 124364 - protein, 56 aa, Glycine max
  Coding DNA Sequence Number=SeqID_7586
MQLSAITISETSRGRDSMAFRQWDWQNRHGISPLGLAKQAPITSWQQWVSPVVLAK

SEQ ID NO: 124365 - protein, 109 aa, Glycine max
  Coding DNA Sequence Number=SeqID_7587
MENFYKQFHSPGDIIVPRKIPKDDEQEKNDEVESHQSKGTKMKASTKPTSGTANKATICFTQSTKTTPSMVKSKKIILMMPKTQVKNQESSKFQESKSCSIKASFKNQD

SEQ ID NO: 124366 - protein, 276 aa, Glycine max
  Coding DNA Sequence Number=SeqID_7588
  Gene Ontology: Mol. function=protein kinase activity; Cellular component=membrane; Biological process=protein amino acid phosphorylation
  Homolog annotation: Hit_ID=Q9M7J5; Match level="QueryCoverage=53%, HitCoverage=35%, E-value=3e-49, Identity=64%"; Hit description =Protein serine/threonine kinase
  Pfam annotation: Domain name=Pkinase; Domain location=90-263; Score= -86.4; E_value=0.0021; Accession=PF00069.15; Description=Protein kinase domain
  Pfam annotation: Domain name=Pkinase_Tyr; Domain location=90-265; Score=-86.8; E_value=3.8e-07; Accession=PF07714.7; Description =Protein tyrosine kinase
  Pfam module annotation: Pfam domain module=Pkinase::Pkinase_Tyr; Domain location=90-263::90-265
  Subcellular localization annotation: CTP_CleavageSite=43; ConfidenceScore=5.23e-01
MKCFYFSNGEDEDSVGGGAAASSRGGSTSRVSWARSLSLMDTRSSSRSHFDSESTEFSDTVDFHHFLAQRRANDLRLFSFSDLKSATRAFSRALLVGEGGFGSVYRGFLDQNDVAIKQLNRNGHQGHKEWINEVNLLGVMKHPNLVKLVGYCAEDDERGIQRLLVYEFMPNKSLEDHLLARVPSTIIPWGTRLRIAQDAARGLAYLHEEMDFQKKGCVQLSSLAPSRTKEPLRIKFERWFRCGIKRERSKSKGTIIRWGNLHLGVPNVQPNWAANH

SEQ ID NO: 124367 - protein, 90 aa, Glycine max
  Coding DNA Sequence Number=SeqID_7589
MTTNSNLGSYWRFSLPWMRFALPNWSLQEGLSQEKGNTKELGYEFWMYISHVALEGLHRNLGAQRRWSGASRKEQIVQGARYGFHSVEDV

SEQ ID NO: 124368 - protein, 605 aa, Glycine max
  Coding DNA Sequence Number=SeqID_7590
  Gene Ontology: Mol. function=metal ion binding; Cellular component =integral to membrane; Biological process=defense response to bacterium
  Homolog annotation: Hit_ID=Q94B55; Match level="QueryCoverage=73%, HitCoverage=99%, E-value=1e-178, Identity=68%"; Hit description =Putative RING zinc finger ankyrin protein
  Pfam annotation: Domain name=Ank; Domain location=168-201; Score=5.4; E_value=5.2; Accession=PF00023.20; Description=Ankyrin repeat
  Pfam annotation: Domain name=Ank; Domain location=203-235; Score =28.3; E_value=2.6e-05; Accession=PF00023.20; Description=Ankyrin repeat
  Pfam annotation: Domain name=Ank; Domain location=236-268; Score =32.1; E_value=2e-06; Accession=PF00023.20; Description=Ankyrin repeat
  Pfam annotation: Domain name=Ank; Domain location=270-303; Score =23.3; E_value=0.00084; Accession=PF00023.20; Description=Ankyrin repeat
  Pfam annotation: Domain name=Ank; Domain location=315-347; Score =30.9; E_value=4.5e-06; Accession=PF00023.20; Description=Ankyrin repeat
  Pfam annotation: Domain name=Ank; Domain location=352-384; Score =35.7; E_value=1.6e-07; Accession=PF00023.20; Description=Ankyrin repeat
  Pfam module annotation: Pfam domain module=Ank::Ank::Ank::Ank::Ank::An k; Domain location=168-201::203-235::236-268::270-303::315-347::352 -384
MDVALVTVKCFTKHINDPRRKVTVLTNVEFFPSEQNERSNTTIGVPVNWGVRIAKLETPNFKFEHETLDLKEQKVDISLQSLGLPFCGNLSDATSQVSLSNCSTLTHSATTLLSLASVTSLPFCSNSKLNKCANFELKTWRNQSRWRKERRRGGREKVMGQGLSCRGSHEHGLFRAVQHGDLDTVAALLQTHPSLMNHTTVYDHHSPLHIAAANGQIQVLSWLLDGSVNPDVLNRQKQTPLMLAAMHGKIACVEKLLEAGANVLMFDACYGRTCLHYAAYYGHSSCLKAILSAAQSSPVAASWGFARFVNIRDGRGATPLHLAARQRRPECVHILLYSGALVSASTGRYGCPGSTPLHLAAKGGSLDCIRELLAWGADRLQRDASGRIPYVVALKHRHGACAALLNLSSAEPLVWPSSLKIISELNPDAKELLERALMDANREREKNILKGSDYSLPSPSHSDGVDDNISEVSETELCCICFEQVCTIEVQDCGHQMCAQCTLALCCHNKPNPCTSRVIPPVCPFCRSTIARLVVVKKESPDDIDQDGVDITCSKHSKSRKSRNSNEGGSSSIKGLSNVNSFGKMGGRSSGKIAAENEWEDDKQQ

SEQ ID NO: 124369 - protein, 35 aa, Glycine max
  Coding DNA Sequence Number=SeqID_7591
MAQQALIDIYLRPQNTNTNDPVLCLRTYRLLRDVM

SEQ ID NO: 124370 - protein, 706 aa, Glycine max
  Coding DNA Sequence Number=SeqID_7592
  Gene Ontology: Mol. function=protein serine/threonine kinase activity; Cellular component=ubiquitin ligase complex; Biological process=protein amino acid phosphorylation
  Homolog annotation: Hit_ID=Q33BK6; Match level="QueryCoverage=99%, HitCoverage=82%, E-value=1e-120, Identity=37%"; Hit description=U -box domain containing protein, expressed
  Pfam annotation: Domain name=Pkinase; Domain location=362-629; Score =54.5; E_value=3.5e-13; Accession=PF00069.15; Description=Protein kinase domain
  Pfam annotation: Domain name=Pkinase_Tyr; Domain location=362-625; Score=46.4; E_value=2.5e-15; Accession=PF07714.7; Description =Protein tyrosine kinase
  Pfam annotation: Domain name=U-box; Domain location=635-706; Score =71.9; E_value=2e-18; Accession=PF04564.6; Description=U-box domain
  Pfam module annotation: Pfam domain module=Pkinase::Pkinase_Tyr::U -box; Domain location=362-629::362-625::635-706
IGEADQVQKGIVDLVTVHNVRKLVIGAIPENCMKIKRNSSKANYAAKNAPPFCEIWFVYNGKHIWTREASETPRSLSSRAQPETTTAESLSCRSFHDGTKELLHSECLQLNSTKTTRSMVQSEIIEAEATFSSKSSSCNSHCSPQHSAGWYLDTHSEFEEETIDSQLIETKREAKAATDKALAELLKSKRLEVKAIEAISKSFAVFSQDFCSNTSNMYFLQVNFFESAHAHEVKLRKEAEDALRATIQEQQMFLDEKEEIARELERTVRSISLLGNCAHETNHKRDEAENELSLIQASISNLWHEKQQIRQQKMEALHWLERWKSCGQVGADHCNGVIGFAEEFPELAEFSLSDLQNATCNFSESFKVMEGGYGSIYKGEMLGRTVAIRKLHPHNMQGSSEFHQEAQILGSLQHPHLVTLLGVCPEAWSFVYEYLPSGSLQDYLFRKSSFLPLTRNIRAQWIAEIATALCFLHSSKPETIIHGGLTLETVLLDSALSCKICEFGFSRLVKEESVYLPNFHFSTEPKGSFTYTDPEFQRTGVLTPKSDIYSFGIIILQLLTGRTPVGLVGEVRRAVSCGKLYPILDSSAGEWNSTMATRLAELGLQCCQLNSRVRPELTPSLVRELKQLLVLEERPVPSFFLCPIFQEIMHDPQVAADGFTYEGKAISEWLENGHETSPMTNLKLTHLNLTPNHALRLAIQGWLCKS

SEQ ID NO: 124371 - protein, 56 aa, Glycine max
  Coding DNA Sequence Number=SeqID_7593
MSIALNKTNSSKMSTPLFHEFKKQASFFFKEKIKTARLALTDVTPAELDHPSIFVS

SEQ ID NO: 124372 - protein, 110 aa, Glycine max
  Coding DNA Sequence Number=SeqID_7594
  Gene Ontology: Mol. function=RNA-directed DNA polymerase activity; Biological process=RNA-dependent DNA replication
MIVNQQVKVPFSIGTYKDEVNCDIVPMEAGHILLGRPWQFDRKIIYNGLTNEITLTHLGTKFVLHPQTPSQVARDQLTMKDKRDEEEKNMKIQKKSPYYKDYSKCPEIQG

SEQ ID NO: 124373 - protein, 437 aa, Glycine max
  Coding DNA Sequence Number=SeqID_7595
  Gene Ontology: Mol. function=zinc ion binding
  Homolog annotation: Hit_ID=UPI000034F516; Match level="QueryCoverage =92%, HitCoverage=71%, E-value=1e-113, Identity=53%"; Hit description= metal ion binding
  Pfam annotation: Domain name=zf-DHHC; Domain location=2-48; Score =47.7; E_value=4e-11; Accession=PF01529.11; Description=DHHC zinc finger domain
MVFKYSKHCRVCDKCVDHFDHHCRWLNNCIGKKNYRQFFTLMVAAMLLFILQWLTGILVLICCFVKRKQFSVDISSKLGTSFSMVPFVIVVSICTILAMIATLPVVQLFFFHILLIKKGLSTYDYIIAMREQEQEQLGNGGQQSPQMSTVSSFTGLSSASSFTTLHRGAWCTPPRLLLEDQFDVVPPETGSVSSLGKKTTREDPLKKKNPGTVKISPWTLARLNAEEISKAASEARKKSKVLQPVTRHGEAISLELENSFGSSGRRMVPRIEGNKKRASKRVHHPADLSMESLTKVSSSNTDKALSGMSRLAPLPIEACSTFQTSQAMSSSAGIVPSSPESSLDSPDIHPFGVSSSSAEKARQLAGPSAAGAATLKEIPLSSSTSDGYEASGGEDSDRVDPSRIVQRSTNWTNLLFRADQDDKAFKMSLSSTSVGYR

SEQ ID NO: 124374 - protein, 69 aa, Glycine max
  Coding DNA Sequence Number=SeqID_7596
  Gene Ontology: Mol. function=zinc ion binding
  Homolog annotation: Hit_ID=Q9C533; Match level="QueryCoverage=75%, HitCoverage=10%, E-value=7e-09, Identity=50%"; Hit description=DHHC -type zinc finger protein, putative
MRKHGWQLPYHPLQVVAAAVFLALGFAFYVFFAPFVGEKMYQYIVIGLYSPLIHEFDFFFVNLSFVSSS

SEQ ID NO: 124375 - protein, 718 aa, Glycine max
  Coding DNA Sequence Number=SeqID_7597
  Gene Ontology: Mol. function=protein phosphatase type 2C activity
  Homolog annotation: Hit_ID=Q10NB9; Match level="QueryCoverage=63%, HitCoverage=64%, E-value=1e-90, Identity=62%"; Hit description =Protein phosphatase 2C containing protein, expressed
  Pfam annotation: Domain name=PP2C; Domain location=363-683; Score =64.5; E_value=3.4e-16; Accession=PF00481.12; Description=Protein phosphatase 2C
MGNGIGKLTVCFTGNGGGGRRKQDISILITEPLDEGLGHSFCYVRPDPTRISSSKVHSEETTTFRTISGASVSANTSTPLSTAFVDLYSYGCIDRAAAFESSTSFAALPLQPIPRTLVNSGPFSGNLNGGGFPGSGPLERGFMSGPIERGFMSGPIDRGLFSGPIEREGNGIGNGSDHFQRSFSHGGLGLGLGMRVGTRKGKWIRVLQRAISKTLSRGHNSIVAPIKGVVVKEPEWMVAAAAAAAEKHNENLSVNLSSEGSLEDYDSMESQNLQWAQGKAGEDRVHVVVSEEHGWVFVGIYDGFSGPDAPDYLLSNLYTAVHKELKGLLWDDGSAPENSTIKEDMLRDVTADVTVTDEDDACSHCVEQDNNDNNRKSSNKRGRNSRNKFKGAAKKWEENQRRWKCEWDRERLELDRRLKEQLNLSRSGSGGAASSINHSDVLEALSRALKKTEESYLDVADKMVMENPELALMGSCVLVMLMKGEDVYVMNVGDSRAVLAQKAEPDYWLGKIRQDLERINEETMNDLESWDVDTSNLVPSLSAIQLTKDHSTSVEEEIQRIKKEHPDDPFAVVNDRVKGSLKVTRAFGAGFLKQPKWNNALLEMFRIDYVGNSPYISCLPYLKHHRLGPKDKFLILCSDGLYQYLSNEEAVAEVELFITLQPEGDPAQHLVEEVLFRAAKKAGLDFHELLEIPQGDRRRYHDDVSIIVISLEGRIWRF

SEQ ID NO: 124376 - protein, 131 aa, Glycine max
  Coding DNA Sequence Number=SeqID_7598
  Gene Ontology: Mol. function=metal ion binding; Cellular component =mitochondrial intermembrane space protein transporter complex; Biological process=protein import into mitochondrial inner membrane
  Homolog annotation: Hit_ID=Q9XGX7; Match level="QueryCoverage=99%, HitCoverage=100%, E-value=4e-34, Identity=59%"; Hit description =Mitochondrial import inner membrane translocase subunit Tim9
  Pfam annotation: Domain name=zf-Tim10_DDP; Domain location=61-123; Score=62.9; E_value=1e-15; Accession=PF02953.6; Description=Tim10DDP family zinc finger
MDKSMLADLDSLPEADKQRMTVMIDQLQIRDRFRGFILSHIVKFPLKPAQHLNVASGRFGNNILLKEKPSLRMYNSLVERCFSDCVDTFKHKSLQKQEETCVRRCAEKFLKHSMRVGMRFAELNQGAATQD

SEQ ID NO: 124377 - protein, 293 aa, Glycine max
  Coding DNA Sequence Number=SeqID_7599
  Gene Ontology: Mol. function=protein kinase activity; Cellular component=membrane; Biological process=protein amino acid phosphorylation
  Homolog annotation: Hit_ID=Q9LZF8; Match level="QueryCoverage=57%, HitCoverage=39%, E-value=1e-41, Identity=52%"; Hit description =Protein kinase-like
MTYFFSKVVGTIGYAAPEYVQTGKLTAKSDVWSFGVVLYELITGRRAVERNLPKNEQKLLEWVRPYVSDPRKFYRIVDPRLEGQYCIKSAHKLAILANKCIMKQPKSRPKMSEVVESLGSIINEIVPQDEQIPQAAVVAIGEEKEEKLSVENTKPEPSAKQGNYYLKKVFELKDIVSLRNKSIGRLDWKSWAPGLFSVSEINIVRHTVNNKLLYSLESFNLQHLKHRVVVDALADELGGAAVIGDDGGGEILPLRTLRCIWSAALRALWRDTNSIKKVTLRLRHTPLETQNPF

SEQ ID NO: 124378 - protein, 447 aa, Glycine max
  Coding DNA Sequence Number=SeqID_7600
  Gene Ontology: Mol. function=protein serine/threonine kinase activity; Cellular component=chloroplast; Biological process=protein amino acid phosphorylation
  Homolog annotation: Hit_ID=Q06548; Match level="QueryCoverage=75%, HitCoverage=90%, E-value=1e-115, Identity=60%"; Hit description =Protein kinase APK1A, chloroplast precursor
  Pfam annotation: Domain name=Pkinase; Domain location=68-322; Score =71.8; E_value=2.1e-18; Accession=PF00069.15; Description=Protein kinase domain
  Pfam annotation: Domain name=Pkinase_Tyr; Domain location=68-322; Score=4.0; E_value=1e-12; Accession=PF07714.7; Description=Protein tyrosine kinase
  Pfam module annotation: Pfam domain module=Pkinase::Pkinase_Tyr; Domain location=68-322::68-322
  Subcellular localization annotation: CTP_CleavageSite=31; ConfidenceScore=5.19e-01
LNSKHVSADAKDHSSPISNKITKDVSTPISKVSEVSVPQTPRIEGEILQSSNLKNFSLTELTAATRNFRKDSVLGGEGDFGSVFKGWIDNQSLAAAKPGTGVVVAVKRLSLDSFQDEDRLLVYEFMPRGSLEYHLFMRGSYFQPLSWGLRLKVALGAAKGLAFLHSAETKVIYRDFKTSNVLLDSNYNAKLADLGLAKDRPTREKSHVSTRVMGTYGYAAPEYQTTGNLSAKSDVFSFGVVLLEMLSGRRAVDKNRPSGQHNLVEWAKPYLANKHKLLRVLDNRLEGQYALDEACKVATLSLRCLATESKLRPTMDEVVTDLEQLQVPHVNQNRSVNASRGRRKSADDFTHGRIATASVSPLSHDIANTRCVPQPQCDLFDRVCVPPQCPQRRGPDAPQGPQRQDLTATIVADNGCASEFIRKRIDNNTVLQVLQLRQNAYNEIDAA

SEQ ID NO: 124379 - protein, 132 aa, Glycine max
  Coding DNA Sequence Number=SeqID_7601
MDTEFKTIEASIMSMLGQLQSEGGILQRMVYKNKNQHRRGSYFQRLLKVRRDLRLLQLANLEELVTSCLLVIKEDRPKQKLHLLESLKRRKCHNEKHNFMERLLGVAHLLVEMVEPILKAASYPSASANSLI

SEQ ID NO: 124380 - protein, 359 aa, Glycine max
  Coding DNA Sequence Number=SeqID_7602
  Homolog annotation: Hit_ID=Q3LHL2; Match level="QueryCoverage=54%, HitCoverage=37%, E-value=4e-62, Identity=57%"; Hit description =Hypothetical protein PPS5
  Pfam annotation: Domain name=DUF292; Domain location=23-144; Score =217.1; E_value=3.9e-62; Accession=PF03398.5; Description=Eukaryotic protein of unknown function, DUF292
  Pfam annotation: Domain name=TrpBP; Domain location=286-359; Score =9.8; E_value=0.049; Accession=PF02081.6; Description=Tryptophan RNA -binding attenuator protein
  Pfam module annotation: Pfam domain module=DUF292::TrpBP; Domain location=23-144::286-359
MSLLNQLFNRGVFGTRCKTCLNLAISRIKLLQNKRDMQLKQMCKEISQFLQAGQEAIARIRVEHIIREQNTWAAYEILELFCEFVLARVPIIENQRECPTELREAIASIIFAAPRCSDVPDLLHIKNLFTTKYGKEFVSAVSELRPDSGVNRTIIEKLSVSAPSGEVKLKVLREIAEEYNIAWDSSKTEAEFRKNHEDLLIFNKVYIGCRLPTQPSPFIWARDYVKIFNKEQHRQGGAKQVSAGATLSHTPSRNGSNNPSPCITEPSIKPVQDKQEYKHLEAPSPSNNNSSLDTNEIEQSHKNNNVPAGDAKSETRFQSSDVLEKARAAIASADRASAAARAAAALVQSNFGSLKLEGK

SEQ ID NO: 124381 - protein, 124 aa, Glycine max
  Coding DNA Sequence Number=SeqID_7603
  Homolog annotation: Hit_ID=Q1S316; Match level="QueryCoverage=81%, HitCoverage=18%, E-value=6e-18, Identity=45%"; Hit description =Pentatricopeptide repeat
MIFPVTARSASSPSSQHCACKVDGYGEEIDWKEEGLSDGSVVETLRLLLMGGESLILGSKLVLVAFRSDLMLNNKVIEMYGNCKSTIDAHRVFDHMPNRNMDYWHLMMHDFANNTNGDDALYSC

SEQ ID NO: 124382 - protein, 1032 aa, Glycine max
  Coding DNA Sequence Number=SeqID_7604
  Homolog annotation: Hit_ID=UPI00004BF617; Match level="QueryCoverage =14%, HitCoverage=23%, E-value=4e-15, Identity=31%"; Hit description =bromodomain containing 9 isoform 1
  Pfam annotation: Domain name=Bromodomain; Domain location=199-285; Score=86.5; E_value=8e-23; Accession=PF00439.15; Description =Bromodomain
MVQIARRKKGRPSKADLARRSGESQSDPRRSLRRRSVRYNIIDYDGDYLDDDDEDERRREKKKLKLMAKLNQDGGEEEEEEEREEEENETAPHHTRAESREEHAPVEEYDDDEKEQEEENENEQEEENEEDEESVVKGRKVESKGLHSVSASGAPVILQSGIPLPDKRTLELILDKLQNLTVYGDEQEGECFCVLFCFLTWDYCGGVDDGRKDTYGVFADPVDPEELPDYHDVIEHPMDFATVRKNLANGSYTTLEQFESDVFLICSNAMQYNAPETIYHKQARSIQELGRKKFEKLRIGFEHSQIELKSEQKAGSNYLVKKQPKKPLARASQEPVGSDFSSGATLATIADVQPTSHLMQGGRCERSGNLDGILEANAFWIDANQEKAEDVLLGKGLLSKWGRKSFALDESRRASYNMSNQPIVKPDSIFMTFERGMKHLVTVGLHAEYSYARSLARFSASLGPIAWKIASHRIQHALPAGCKFGRGWVGEYEPLSTPILMVNNRVQKENSLVMKLHSTTELPKGNQNCKNVESSIMHPVNGQMLEGKRPSMPDFKGKPLFGSAGVRLSAPVNILNQEQNAQSRKLGKCENKGLKQLELNSLTSSNQNNNGLVAKFTSNASTANAPAVESKPREMVPRNMFKQPDTNGVISGELPNGKVTNTSLNRQVTGSSSPESTSNQSRRAAPGVVHGQEQGLSDPGQLMRMFAERAQKQHTSNHSHVDTPPVTLSGPSGQRNDSGNASATAAHAWMSVGAGGFKQGPDNSSSPKNQISADSLYNSTRELHQQISKIQGEFPPGEMPFQPFQAVAPQPIHTGAVSQFPNRPMVFPQLESADQASFQMRMFAERAQKQHTSSNHSLVDTLPVTLSGPSEQRNDSGNASATAAHAWMSVGAGGFKQGPDNSSSPKNKISVESLYNSTRELHQHISRIRGEFPSGGMPFQPFQAVAPQPIQTGTVSQFPNRPMVFPQLASADQSRFQMQPPWRGLSPRSQSRQKQETLPPDLNIDFESPGSPVKQSSGVLVDSQQPDLALQL

SEQ ID NO: 124383 - protein, 199 aa, Glycine max
  Coding DNA Sequence Number=SeqID_7605
  Homolog annotation: Hit_ID=Q9SZ30; Match level="QueryCoverage=45%, HitCoverage=12%, E-value=6e-20, Identity=73%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
  Pfam annotation: Domain name=His_biosynth; Domain location=13-161; Score=-125.6; E_value=0.045; Accession=PF00977.11; Description =Histidine biosynthesis protein
MEIFSLLFERINLLRHNQGLHGRASITERDKSRYVDITEADDLPRNEFANIALYVQAVSESSYFIYEIETREKNQVIHMDEAHYFSSDRKFGFSMKNNEAYSSGQGKGFDEDLIKLISDAVSIPVIASSGAGAPQHFSEVFYKTNETVALAAGIFHRESGIASVLAVKSSFLLIASAYSVGKRAFVEGRHRSWNLIMSI

SEQ ID NO: 124384 - protein, 794 aa, Glycine max
  Coding DNA Sequence Number=SeqID_7606
  Gene Ontology: Mol. function=protein binding; Cellular component =membrane; Biological process=defense response
  Homolog annotation: Hit_ID=Q1SW19; Match level="QueryCoverage=97%, HitCoverage=83%, E-value=1e-163, Identity=42%"; Hit description =Disease resistance protein
  Pfam annotation: Domain name=LRR_1; Domain location=601-622; Score =6.9; E_value=15; Accession=PF00560.23; Description=Leucine Rich Repeat
  Pfam annotation: Domain name=LRR_1; Domain location=624-645; Score =8.9; E_value=6.1; Accession=PF00560.23; Description=Leucine Rich Repeat
  Pfam annotation: Domain name=LRR_1; Domain location=672-695; Score =1.9; E_value=1.3e+02; Accession=PF00560.23; Description=Leucine Rich Repeat
  Pfam annotation: Domain name=LRR_1; Domain location=766-788; Score =10.1; E_value=3.7; Accession=PF00560.23; Description=Leucine Rich Repeat
  Pfam annotation: Domain name=NACHT; Domain location=195-344; Score= -30.5; E_value=0.014; Accession=PF05729.3; Description=NACHT domain
  Pfam annotation: Domain name=NB-ARC; Domain location=157-460; Score =274.2; E_value=2.5e-79; Accession=PF00931.13; Description=NB-ARC domain
  Pfam module annotation: Pfam domain module=LRR_1::LRR_1::LRR_1::LRR _1::NACHT::NB-ARC; Domain location=601-622::624-645::672-695::766 -788::195-344::157-460
MQKLQEIAVSLAVDYLLPPLKKAVNSVMEVPKDAADMNDKLDGIQAMIHDVDKMAAAEEGNSRDGLKAKVKQLVETSFCMEDIVDEYIIHEERQLADDPGCASLPCKAIDFVKTTASRLQFAYMNQDVKSEFRGIKERNKTEDCSQIQSSGGNQNITFDNLRMAPLFLKEAEVVGFDRPRHTLERWLKEGRKKLTVVSVVGMGGSGKTTLAKKVFDKVQTHFPRHVWITVSQSYTIEGLLLKFLEAEKREDSTMDKASLIREVRNHLSHNRYVVVFDDVWNENFWEEMKFALVDVENGSRIIITTRHREVAESCRTSSLVQVHQLQPLTDDKSFELFCKTAFGSELDGHCPNNLKGISTEIVKKCEGLPLAIVATGGLLSRKSRDAREWQRFSENLSSELGKHPKLTPVTKILGLSYYDLPYHLKPCFLYFGIYPEDYEVECGRLILQWVAEGFVKSDEAAQTLEEVAEKYLNELIQRSLVQVSSFTKFGKIKRCRVHDVVREMIREKNQDLSFCHSASERGNLSRSGMIRRLTIASGSNNLTGSVESSNIRSLHVFSDEELSESLVKSMPTKYRLLRVLQFAGAPMDDFPRIESLGDLSFLRYLSFRRSSIVHLPKLIGELHNLETLDLRETYVRVMPREIYKLKKLRHLLRDFEGFEMDGGIGDLTSLQTLRRVNISHNTEEVVKGLEKLTQLRVLGLTQVEPRFKSFLCSLINKMQHLEKLYITASHSGNMDLHFDVFAPVLQKVRLMGRLKKFPNWVAKLQNLVTLSLSFTELTHDPLPLLKDLPNLTHL

SEQ ID NO: 124385 - protein, 210 aa, Glycine max
  Coding DNA Sequence Number=SeqID_7607
  Homolog annotation: Hit_ID=Q8GW30; Match level="QueryCoverage=19%, HitCoverage=11%, E-value=3e-10, Identity=71%"; Hit description =Putative nodulin
MMKRKPNYIKALSKRTLSYSGPVQGVWRCFRIIRTDEGDCVEGKVVFGEDKIGWVAEEEELDTMCMDSLHGATRSWSQPWLLFIIQFNLELLLSYPEFFLEVQFTWEGSSKVSVAIGASIGAVVALVVILGCVYFVVQRRRKTAYNKQRSMELFIAPSNGDTFASTTNTSQSLSSYQSSNTDPMPPSSDYLGVQVFTYEELEEATKNFDS

SEQ ID NO: 124386 - protein, 90 aa, Glycine max
  Coding DNA Sequence Number=SeqID_7608
MVLTTTSCLYTWLVAASMFITEGFKNFSLVKGVVVEVNHGGGERRRSLRYDSSGLEMYGDYSKELSMTTLDFSEIIGFNHQIEESKESGE

SEQ ID NO: 124387 - protein, 173 aa, Glycine max
  Coding DNA Sequence Number=SeqID_7609
MAKCNIHGRGEACYSKMLEKAKEKITKLKVKDNGSEEGGLARLSLGVKGNGSDEGRLARLSAGSEKGYFDDAKESRVKQRFNNQVSSFKIQDSRFKNQGTSFVVQVEGTSTWVVVIENKRWYISCGSVQVEGTSTWLFKENKGRYIPCGSLHVKAFTRLKRNLKDRRSLGDWM

SEQ ID NO: 124388 - protein, 125 aa, Glycine max
  Coding DNA Sequence Number=SeqID_7610
MASGNRLPRECNRLPGLKNEIRKLRGLLIVMAAHVIHDRVEMECLEGAWETLEGNARCRFRGTIRFTATSLVHPEEPARMLQCTVEWILPTPTPYRLVETVQVIEVSSSEEDPEEDPEELPPEPA

SEQ ID NO: 124389 - protein, 107 aa, Glycine max
  Coding DNA Sequence Number=SeqID_7611
MYAAGNSDIYGFLEPLVHSEVPLQRTLADGGHLAQGTLSCLGLNDAPHPKSKAPARWIVIKMSTIILGTFRNNWEAYFNDPRPLEPERIKALRIQLTQFYLRVRDQA

SEQ ID NO: 124390 - protein, 407 aa, Glycine max
  Coding DNA Sequence Number=SeqID_7612
  Homolog annotation: Hit_ID=Q8W1W5; Match level="QueryCoverage=22%, HitCoverage=18%, E-value=2e-40, Identity=79%"; Hit description =Putative transcription factor MYB101
  Pfam annotation: Domain name=Myb_DNA-binding; Domain location=85-130; Score=44.3; E_value=4.2e-10; Accession=PF00249.21; Description=Myb -like DNA-binding domain
MEGMAISDDASNGENGFLAMFGGDESGGGGSGGVGSGGDQGGGNVEDVALKKGNWNAVQRNTGLNRCGKSCRLRWANHLRPNLKKGAFSPEEEKLIVDLHAQFGNKWARMAALLPGRTNNEIKNYWNTGIKRRQRQGLPLYSDEHDQHNRSTTPTPPTTPFPCLTPTGSNPDIATSFELFNQNQQQHHQQQQQYQYQQQQQYQQHPLSPTASHHSPLSSPLQHRQPFTSSSPHNFLDHSPLPLSSSYSPSPLSFTFQRPAPMLSTPLRFKRYCASPSYNNNNNNNNLSDPPLTTQFPHLDGFRFPVSSGFSQFFQPSLLDSDRGVSSSSSSLAFQPKLELPLSQYYKPSQEQDIKLDIEFNDPSFQSSSSGLMGDLLFEAQAMASGKNSKKRGYLSLNEGNNVFNAC

SEQ ID NO: 124391 - protein, 113 aa, Glycine max
  Coding DNA Sequence Number=SeqID_7613
  Gene Ontology: Mol. function=transferase activity, transferring pentosyl groups; Cellular component=imidazoleglycerol-phosphate synthase complex; Biological process=amino acid biosynthetic process
  Homolog annotation: Hit_ID=Q9SZ30; Match level="QueryCoverage=96%, HitCoverage=18%, E-value=5e-45, Identity=80%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
  Pfam annotation: Domain name=His_biosynth; Domain location=2-96; Score=-93.1; E_value=0.00022; Accession=PF00977.11; Description =Histidine biosynthesis protein
MKIVNGKREGRPVGAYELAKAVEEFGAGEILRNCIDCDGQGKGFDVDLIKLISDAVSIPVIASSGAGAPQHFSEVFYKTNETVALAAGIFHRKAVPIQSVKEHLLKEGIEVQI

SEQ ID NO: 124392 - protein, 72 aa, Glycine max
  Coding DNA Sequence Number=SeqID_7614
MVYMEDDYVRKMSDEVDIEVFATRDELLKWAWDVAFEMDFVVVILRSDTSKGQLGRKTFVVSVKGVKSIGDT

SEQ ID NO: 124393 - protein, 352 aa, Glycine max
  Coding DNA Sequence Number=SeqID_7615
  Gene Ontology: Mol. function=protein binding; Cellular component =membrane; Biological process=defense response
  Homolog annotation: Hit_ID=Q1SW19; Match level="QueryCoverage=71%, HitCoverage=27%, E-value=6e-44, Identity=40%"; Hit description =Disease resistance protein
  Pfam annotation: Domain name=LRR_1; Domain location=163-185; Score =9.6; E_value=4.7; Accession=PF00560.23; Description=Leucine Rich Repeat
  Pfam annotation: Domain name=LRR_1; Domain location=20-41; Score=6.9; E_value=15; Accession=PF00560.23; Description=Leucine Rich Repeat
  Pfam annotation: Domain name=LRR_1; Domain location=236-258; Score =3.2; E_value=73; Accession=PF00560.23; Description=Leucine Rich Repeat
  Pfam annotation: Domain name=LRR_1; Domain location=68-91; Score=1.9; E_value=1.3e+02; Accession=PF00560.23; Description=Leucine Rich Repeat
  Pfam module annotation: Pfam domain module=LRR_1::LRR_1::LRR_1::LRR _1; Domain location=163-185::20-41::236-258::68-91
YLSLCSKIVHLPKLIGELHNLETLDLRETYVHVMPREIYKLKKLRHLLSDFEGLKMDGGIGDLTSLQTLRRVNISHNTEEVVKGLEKLTQLRVLGLTQVEPRFKSFLCSLINKMQHLEKLYITTTSYRTKMDLHFDVLAPVLQKVRLMGRLKKFPNWVAKLQNLVTLSLSFTDLTHDPLPLLKDLPNLTHLSILLHAYNSEVVQFPNRGFPNLKQILLADLYQLKSIVIEDGALPSLEKLKLFRIRELTEVPRGIDKLPKLKESWSLMEGMANISDDASNGENGFLAMFGGDESGGGGSGGVGSGGDQGGGNVEDVALKKGPWTTAEDVILMDYVTKNGEGNWMQFRGNRVE

SEQ ID NO: 124394 - protein, 91 aa, Glycine max
  Coding DNA Sequence Number=SeqID_7616
MGDVQPVIPNMGDVQSVIPDMGDVSESRHLCRTVEPLQEMIYLKMVVEGTMQWEKVEATLLLLSKGTHGRNISRGQGGRRVRGSWGGRGRP

SEQ ID NO: 124395 - protein, 78 aa, Glycine max
  Coding DNA Sequence Number=SeqID_7617
  Gene Ontology: Mol. function=transferase activity, transferring pentosyl groups; Cellular component=imidazoleglycerol-phosphate synthase complex; Biological process=histidine biosynthetic process
  Homolog annotation: Hit_ID=Q9SZ30; Match level="QueryCoverage=68%, HitCoverage=9%, E-value=3e-19, Identity=81%"; Hit description =Imidazole glycerol phosphate synthase hisHF, chloroplast precursor (IGP synthase) (ImGP ...
  Homolog annotation: Hit description=synthase) (IGPS) [Includes: Glutamine amidotransferase (EC 2.4.2.-); Cyclase (EC 4.1.3.-)]
MKIVSHLTSYFLQYLFYYLITYVYCKVNGGPEGQPIGAYELAKAVEELGAGEILLNCIDCHGQGKGVDVDLIKLISDA

SEQ ID NO: 124396 - protein, 304 aa, Glycine max
  Coding DNA Sequence Number=SeqID_7618
  Gene Ontology: Mol. function=DNA binding; Cellular component=nucleus; Biological process=regulation of transcription, DNA-dependent
  Homolog annotation: Hit_ID=Q9S773; Match level="QueryCoverage=45%, HitCoverage=38%, E-value=3e-42, Identity=56%"; Hit description =Putative myb-related protein
  Pfam annotation: Domain name=Myb_DNA-binding; Domain location=30-75; Score=40.5; E_value=5.9e-09; Accession=PF00249.21; Description=Myb -like DNA-binding domain
DAVQRKTGLNRCGKSCRLRWANHLRPNLKKGAFSPEEEKLIVDLHAQFGNKWTRMAALLPGRTDNEIKNCWNTRIKRRQRQGLPLYSDEHDQHHRSTTPTPSNHTFPMPHPNRIKPQHCHNSPLQHRQPFTSSSPHNFLDHSPLPLSSSSSPSPLSFTFQRSAPMLSTTLRFKHYCASPSYNNLSDPPLTTQFPHLDGFRFPVSSGFSQFFQPSLLDSDRGVSSSSSSLAFQPKLELPLSQYYKPPEEQDIKLDIEFNDPSFQSSSSGLMGDLLFEAQAMALGKNSKKRGYLSLNEGNNVFNAC

SEQ ID NO: 124397 - protein, 428 aa, Glycine max
  Coding DNA Sequence Number=SeqID_7619
  Gene Ontology: Mol. function=prephenate dehydratase activity; Cellular component=cytoplasm; Biological process=L-phenylalanine biosynthetic process
  Homolog annotation: Hit_ID=Q6JJ29; Match level="QueryCoverage=89%, HitCoverage=84%, E-value=1e-163, Identity=76%"; Hit description =Prephenate dehydratase
  Pfam annotation: Domain name=PDT; Domain location=133-312; Score =314.6; E_value=1.8e-91; Accession=PF00800.9; Description=Prephenate dehydratase
  Subcellular localization annotation: CTP_CleavageSite=33; ConfidenceScore=5.18e-01
MGTLNQPCPNPLNYLTRARHSAIRFAPTRFTVKCGYGFESASFSQGVGASRADWQSSCAILASKVVSQREDSPAHGGDNNNNVGAVNGHNAAVTNINLVPVKADDENIKPIPPKPLTISDLLPAPMHGSQLRVAYQGVPGAYSEAAAGKAYPNGEAIPCDQFEVAFQAVELWIADRAVLPVENSFGGSIHRNYDLLLRHRLHIVGEVQLPVHHCLLALPGVRKEFLERVISHPQALAQCEHSLTKLGLTVAREAVDDTAGAAEFVAKNDLRSTAAIASARAAELYGLQILADGIQDDPNNVTRFVMLAREPIIPRTDRPFKTSIVFAHDKGTSVLFKVLSAFAFRNISLTKIESRPHRSRPIRVVDDESEGTAKHFEYLFYIDFEASMAEVRAQNALAEVQEFTSFLRVLGSYPIDMSPWTPSCPRQN

SEQ ID NO: 124398 - protein, 627 aa, Glycine max
  Coding DNA Sequence Number=SeqID_7620
  Gene Ontology: Mol. function=protein binding; Cellular component =membrane; Biological process=defense response
  Homolog annotation: Hit_ID=Q1SW19; Match level="QueryCoverage=98%, HitCoverage=66%, E-value=1e-137, Identity=43%"; Hit description =Disease resistance protein
  Pfam annotation: Domain name=LRR_1; Domain location=332-353; Score =7.3; E_value=12; Accession=PF00560.23; Description=Leucine Rich Repeat
  Pfam annotation: Domain name=LRR_1; Domain location=355-376; Score =2.1; E_value=1.2e+02; Accession=PF00560.23; Description=Leucine Rich Repeat
  Pfam annotation: Domain name=LRR_1; Domain location=403-423; Score =2.1; E_value=1.2e+02; Accession=PF00560.23; Description=Leucine Rich Repeat
  Pfam annotation: Domain name=LRR_1; Domain location=497-519; Score =9.2; E_value=5.5; Accession=PF00560.23; Description=Leucine Rich Repeat
  Pfam annotation: Domain name=LRR_1; Domain location=569-591; Score =2.7; E_value=88; Accession=PF00560.23; Description=Leucine Rich Repeat
  Pfam annotation: Domain name=NB-ARC; Domain location=1-190; Score= -8.6; E_value=9.7e-10; Accession=PF00931.13; Description=NB-ARC domain
  Pfam module annotation: Pfam domain module=LRR_1::LRR_1::LRR_1::LRR _1::LRR_1::NB-ARC; Domain location=332-353::355-376::403-423::497 -519::569-591::1-190
MYVVVFDDVWNESFWEEMKFALVDVENGSRIIITTRHREVAESCRTSSLVQVHELQPLTDDKSFELFCKTAFRSELDGHCPHNLKGISTEIVKKCEGLPLAIVATGGLLSRKSRNAREWQRFSENLSSELGKHPKLTPVTKILGLSYYDLPYHLKPCFLYFGIYPEDYEVECKGLILQWVAAGFVKSDEAAQTLEEVAEKYLNELIQRSLVQVSSFTWSGKIKRCRVHDVVREMIREKNQDLSFCHSASERGNLSKSGMIRHLTIASGSNNLTGSVESSNIRSLHVFGDEELSESLVKSMPTKYRLLRVLQFEDARRFYVPGIVECLGDLSFLRYLSFRNSTIDHLPKLIGELHSLETLDLRQTYECMMPREIYKLKKLRHLLSGDSGFQMDSGIGDLTSLQTLRKVDISYNTEEVLKGLEKLTQLRELGLREVEPRCKTFLCPLINKMQHLEKLYIAIRHDSIMDLHFDVFAPVLQKLHLVGRLNEFPNWVGKLQNLVALSLSFTQLTPDPLPLLKDLPNLTHLKIDVAYKGDVLQFANRGFPNLKQILLLDLFELKSIVIEDGALPSLEKLVLKRIDELTEVPRGIDKLPKLKVFHCFGMSDEFKENFNLNRGQRSQWIIKGPWE

SEQ ID NO: 124399 - protein, 78 aa, Glycine max
  Coding DNA Sequence Number=SeqID_7621
  Subcellular localization annotation: CTP_CleavageSite=6; ConfidenceScore=5.01e-01
MTVVVVAATGGGRTMAAKSGGVVAKFAVPNNSKSQWFLLSPTCYDIVEIEQKGQAFWATRVGAQNSKSITQHLGDEEL

SEQ ID NO: 124400 - protein, 265 aa, Glycine max
  Coding DNA Sequence Number=SeqID_7622
  Homolog annotation: Hit_ID=Q9XFN2; Match level="QueryCoverage=31%, HitCoverage=15%, E-value=3e-36, Identity=81%"; Hit description=Myb protein
  Pfam annotation: Domain name=Myb_DNA-bind_2; Domain location=186-239; Score=-8.7; E_value=0.09; Accession=PF08914.1; Description=Rap1 Myb domain
  Pfam annotation: Domain name=Myb_DNA-binding; Domain location=184 -231; Score=34.5; E_value=3.7e-07; Accession=PF00249.21; Description =Myb-like DNA-binding domain
  Pfam module annotation: Pfam domain module=Myb_DNA-bind_2::Myb_DNA -binding; Domain location=186-239::184-231
MTLTLSCRPTSNIMGCACRYRGLGGGAMRGHDDVGGRGELWLDEKFKESEEMVGWGGIKSLRRSGRGRFWRKERLERKVNAGLRRNHWLLELFGTANLATTPPLFAAIVRPPPVAATTTTVINYFLVTTRLMEGMANISDDASNGENGFLAMFGGDESGGGGSGGVGSSGDQGGGNVEDVALKKGPWTTAEDVILMDYVTKNGEGNWNAVQRNTGLNRCGKSCRHRWANHLRPNLKKGAFSPEEEKLIVDLHAQFGNKWARMAAL

SEQ ID NO: 124401 - protein, 92 aa, Glycine max
  Coding DNA Sequence Number=SeqID_7623
PSLLDSDRGVSSSSSSLAFQPKLELPLSQYYKPPEEQDIKLDIEFNDPSFQSSSSGLMGDLLFEAQAMASGKNSKKRGYLSLNEGNNVFNAC

SEQ ID NO: 124402 - protein, 102 aa, Glycine max
  Coding DNA Sequence Number=SeqID_7624
MASSCRGYSKAQMCFFKILRIISSTPPSKQEEEEPFPSKGVGIDLNLRFCSVTETPESESSRSDENNNEEEEPLLKPTATKGFRRRALKFRRNWTTNTIITK

SEQ ID NO: 124403 - protein, 318 aa, Glycine max
  Coding DNA Sequence Number=SeqID_7625
  Gene Ontology: Mol. function=intramolecular transferase activity, phosphotransferases; Cellular component=cytosol; Biological process =metabolic process
  Homolog annotation: Hit_ID=Q6Z8J0; Match level="QueryCoverage=99%, HitCoverage=95%, E-value=7e-97, Identity=60%"; Hit description =Putative phosphoglycerate mutase
  Pfam annotation: Domain name=PGAM; Domain location=87-261; Score =130.7; E_value=4e-36; Accession=PF00300.12; Description =Phosphoglycerate mutase family
  Subcellular localization annotation: CTP_CleavageSite=62; ConfidenceScore=5.50e-01
MAAGVYNQPIVAFQSHSHINNFNHQQKFNNLVRLVTKDFIGSNFLSRRDCRVIQSLASQTSVVDTVSSPSKSKTSDRDTHKKSNEASLILIRHGESLWNEKNLFTGCVDVPLSKRGIDEAIEAGKRISSIPVDLIFTSALIRAQMTAMLAMTQHRRRKEFEPTTSSFNHQGNLITPMKEGMFNCYRYGELQGLNKQETADRYGKEQVHEWRRSYDIPPPNGESLEMCAERAVSYFRDQIEPQLLSGKNVMISAHGNSLRSIIMYLDKLTSQEVIDQVISLELSTGIPMLYIFKEGRFVRRGSPIGPTEAGVYAYTRMK

SEQ ID NO: 124404 - protein, 587 aa, Glycine max
  Coding DNA Sequence Number=SeqID_7626
  Gene Ontology: Mol. function=RNA-directed DNA polymerase activity; Biological process=RNA-dependent DNA replication
MEPCQAEELRKLKVNDDQLEVRFKRPQGDKHYAHTLPKRTQGESHPQCIVNTQDDPSLSHIHHPARRITRPHSFVDHIMEADIPLGWKPLNLEWYDGTTDPDEHLDVFLTQENLYTNDNSIMCHVFPTSLKRAALTWYGGPPPKSIDSFNTLVKHFNARIVVQINNLNPDIALHCMLLALRLGDIQMEEKSRFRNEVRQAGKNPNKYEHYTPLKANHTTILEEAFNLEVPIKLPPSCPPRPRLDATKYYRYHCSIGHNTKDCWALKRVETRGYVDLMTTFGQGQLSKIFTIGYLIVNANISYFVLIGGKTLNKLEAIVSTPHLKMKFPTLIGETVTVKLDQKQARQCYTKSLKVAPYPPTKEPTKPHPTTNGTTQVMSMDEGSPVQALTIFQVSLDDEFDVDPRDDTFDRVPKPIESLSSYSLNPILSNLCNSGIHPNIICHKLIICPQAKLKRWTSSSMPTSSEKPDILPSSPMSSWACPKDAYLLPNIDRLVNGVSEFQVLSFLDAYSEYKQIRMHIPDEEKMTFITEVVNFSIAQHVPDLEEAFGELRKYDMHLNPEKCTFGVGGGNPIIVQEVHKLNGRLASL

SEQ ID NO: 124405 - protein, 75 aa, Glycine max
  Coding DNA Sequence Number=SeqID_7627
  Gene Ontology: Mol. function=DNA binding; Cellular component =mitochondrion; Biological process=DNA integration
MASLPYALRLVESSAQGHKDDSVGYLCLTIGLRMFDRVTMASGRPYLHIRCFQMNFSTSLAIISRSGLASIHLVK

SEQ ID NO: 124406 - protein, 106 aa, Glycine max
  Coding DNA Sequence Number=SeqID_7628
  Gene Ontology: Mol. function=ribonuclease H activity; Cellular component=mitochondrion; Biological process=RNA-dependent DNA replication
MVAWSLELLEFDIQYKPCSPMKTQFMADFLTKFTGNDQTTPNWWSLYIDDSSNMKGSGVGIILEGPDNVTLEQALKLNFKASNNQAKYEALIVGLKLAKEVGAKKL

SEQ ID NO: 124407 - protein, 644 aa, Glycine max
  Coding DNA Sequence Number=SeqID_7629
MEKCRSVSRVVASIRVRVAGLSSLSSPPDWTSVVWDAFAKLSEVYILLALQARHVQCTRNTLAYMSLVEWARTRDLMHGHLSPHKRARLFAAFSIREHVPVTVTLRSSTFRGSRRSGGDIRASPHMRLIHNAGDDVLKYKSFLTSVVSVTALQHQVKLANPEDCRKVAIQACRSDDFSLLKVLSLVLPLIAFQCALLEHLNMAPSQLHPNSWAMLTDKIGWVSLNSMSKNLFELDSNAFFRFKDRFFKVLATDIVADGFSLMFNRDGEPYFPFYWQSDPAKFKSFDKDLFTLIMRVDKAILDNIMGDFTWRPLVKHGGFAGGTVPPSAVVAPTVIEGGLTLPSSAKASAPTTTVVATVTSTSPPPPVVPIREATLAAGVGMLAAFNYASVVTSSAHVMLPPSSLTPSIPPSIVLVAASPSLSSRPHVSLDQLYTSSDADSLWGAHYRLKQKTSTEFVLAFDKKLIQSVGENGQRHQESIRKVVSLETEVAEWRATACMVKKVKCPKVANTTVAFPKVIRLNPQLSSKGEPAKVVVELDARLKDSESKLEESVLRVAKEKKTSKELEEELGIYKKEAVGFFVKDLDLGLFYPFKDVKDSVMLDEEDIATKEKAGDYEEWYDFCLLVILTYGASPLMVVRSGMTFA

SEQ ID NO: 124408 - protein, 740 aa, Glycine max
  Coding DNA Sequence Number=SeqID_7630
  Gene Ontology: Mol. function=chitin binding; Cellular component =extracellular region; Biological process=chitin metabolic process
  Homolog annotation: Hit_ID=UPI00006A17C9; Match level="QueryCoverage =50%, HitCoverage=100%, E-value=7e-57, Identity=35%"; Hit description= UPI00006A17C9 related cluster
MRGTMHEPQGNLGANQKFSPVDGEPFGTSTLTFRGLHVLAFKGLHALTFRGLHVLAFRGLHGYTPSPSEDYTGPHALAFRGLHALAFKGLHALAFRGLHDLTFRGLHVLAFKGLHAFAFRGLHVLAFRGLHALAFRGLHVLAFKGLHVFTLGTSTLPFRGLHILAFRGLHALAFKGLHALAIRGLHTLPFRVLRALTFRGLHLLAFRGLNALAFKGLHVLAFKGLHAFAFKGLHALTFRGLHVLTFRGLHALASRWLHVLASRGLHVLAFRGLQILTFRGLHVLAFRGLQAVAFRGLHALAFIGLHILTFRRLHALAFIGLHVLAIRGLHVLAFKGLHALAFRGLHVLTFRGLHVLPLRGLHALAFKVLHVLTFRGLHVLAFRGMHVFTFRGLHICVFRELKFLGHPLILEGDQLCKYNQRRRQGKISLRPLQGDEYGSAYHHNSDLLLPKRIAPTRHSVGPEKSNRVLGFPALITSLCQFYGVLVTPSAGRGITVAGSRRIATTSRVHLSSSTKRLERCLRHMADQQATKSKAKDVKEALLGGNLELAKKKLPAKRSRKGTIEEDSKASEPIDTQRLTSSSATFPEMSASSGRDCEKVLFVIRQTQGDSKSDDMRRYLMVIRTFCQLEASEPVDTQRLTSSSAPLSSRDGKSDDMRRYLMANEPVDTKRLTSSSATFPEMSASSGRDCEKVSFAIRQTQGSGSASMRRYLRVIRTFRQLEVSEPVDTQKPMWSSAPFPE

SEQ ID NO: 124409 - protein, 216 aa, Glycine max
  Coding DNA Sequence Number=SeqID_7631
MEGTNYRNRMEKQFQEHGTPPTRSSTSVDLMQDQMLYTFSYSNKYIHGRSSASLSNPRSALGSQNLRFILGESYMSILQSLVNPRLFPPKGSQNLRSALGESYRSFLQRTREAQGPPLVSPTGRFSKGSSNPRAHKTQGSLLVSPTGSMNASLVGSPKAHQTQGPPSVSLTGLQDPRPILGKPQRNSTGLLEPRANTSLVQGSLNLRFTLGEPLFC

SEQ ID NO: 124410 - protein, 227 aa, Glycine max
  Coding DNA Sequence Number=SeqID_7632
AITVENYHERNPCAYRWTSTKALPVSMYRKRLDQLTTSDVGWMPYGDHRAVREFMLISFFLLNISDGIFLMPRQCTPYYMKWFYMISHPFMRPVQLGDPVRYPPIVQDDTYVELDMPQYLVAAAAMEEAPVNASSHAKQPRHAVDVCQAISERLERLLNLRIATESTKTYDVMQDYLRIARDHFASSLSKWLLTNDHESSPIVNKAAIARYPQLSSALTSTIFSMES

SEQ ID NO: 124411 - protein, 162 aa, Glycine max
  Coding DNA Sequence Number=SeqID_7633
  Gene Ontology: Mol. function=intramolecular transferase activity, phosphotransferases; Biological process=metabolic process
  Homolog annotation: Hit_ID=Q9SZY5; Match level="QueryCoverage=94%, HitCoverage=96%, E-value=1e-40, Identity=51%"; Hit description=SAH7 protein
  Pfam annotation: Domain name=Pollen_Ole_e_I; Domain location=30-150; Score=106.8; E_value=6.3e-29; Accession=PF01190.8; Description =Pollen proteins Ole e I family
MGVRIAFMVVLCVFPAMVSAIRPHLTPFYVKGRVFCDPCRAGFETPLTTYIAGAEVTLQCKDRITNNNVYSKQVKTDSTGSFTIFVDANQANQNCDASLVTSPLRDCKEPTPGRDHTRVNLNRFNGIATNDRFVNNLGFMKEIVASSCAKIFKSYQELGNGN

SEQ ID NO: 124412 - protein, 461 aa, Glycine max
  Coding DNA Sequence Number=SeqID_7634
  Gene Ontology: Mol. function=hydrolase activity, hydrolyzing O -glycosyl compounds; Cellular component=chitin- and beta-glucan -containing cell wall; Biological process=carbohydrate metabolic process
  Homolog annotation: Hit_ID=Q8RU06; Match level="QueryCoverage=90%, HitCoverage=79%, E-value=1e-150, Identity=64%"; Hit description =Putative Glucan 1,3-beta-glucosidase
  Pfam annotation: Domain name=Cellulase; Domain location=225-460; Score=-63.1; E_value=0.002; Accession=PF00150.8; Description =Cellulase (glycosyl hydrolase family 5
  Pfam annotation: Domain name=Fascin; Domain location=77-194; Score= -6.8; E_value=0.028; Accession=PF06268.3; Description=Fascin protein
  Pfam module annotation: Pfam domain module=Cellulase::Fascin; Domain location=225-460::77-194
  Subcellular localization annotation: CTP_CleavageSite=37; ConfidenceScore=5.20e-01
MMTSYVNLKIWLLNFVTLFSILSLSHGRRANANFRVRAVNLGGWLVTEGWMKPSLFDGIPNKDFLDGTGLQFKSVTTRKYLCAESGGGTIIVANRTSASGWETFALWRLNEDTFRFRVFNKQFVGLDGINVVAVSNISTDSLTFHVVKESDNSNRVRIKASNGYFLQAKTEDLVTADGSEVNGWGDDDPSVFVMTIGKRMQGEYQVTSGYGPTKAHQVMKLLCFLHLCTHEKEHWKTFIVEDDFKFIASNGLNAVRIPIGWWIASDPTPPPPYVGGSLNALDKAFLWAQKYGLKIILDLHAAPGSQNGFEHSSSRDGSQEWGKTDETIQQTVHVIDFLTARYAKCQSLYAVELINEPLSPGVTLEALNKYYKAGYEAVRKHSSTAYVVLSNRIGPSNPRELFPLANGLMRSVIDVHYYNLFQDVFNDMTVQQNIDFIYNNRSSQLSFVTTSNGPLTFVEKK

SEQ ID NO: 124413 - protein, 97 aa, Glycine max
  Coding DNA Sequence Number=SeqID_7635
MEEIFSSNWKNLTMEKYDGTTDLDDHVDVYITQECFRKVALNIQNLDPAVAIHHLITVLRPRPFANRLYKKPTSDLDELWTRATKYMQMEELAKYRN

SEQ ID NO: 124414 - protein, 173 aa, Glycine max
  Coding DNA Sequence Number=SeqID_7636
MLRKPELVERMMTWSIELSEYDMAYELRGTIWAQSPILKQFQSHHQEDKQGVFDLRPQLLKYYHVFEKLKGEIKEVQVAEALFWIQKEILKYLRHEILPVDKDRARKIRTQASRLLELCEEVPLVPKTWKSDTSADQRAASNGLPLVVRYLGNGHSRTFSYSFGAKEIPTSGS

SEQ ID NO: 124415 - protein, 110 aa, Glycine max
  Coding DNA Sequence Number=SeqID_7637
MVIIIIIIDAILPRKVLVTRAMSKRLHEDWARVVEEGLRVCRVPYKLRASYPTTIRGYVFPWGELNYWRGVTLASQGSFLRKLSSILACDELSYWRDVTLASQGSFRKLT

SEQ ID NO: 124416 - protein, 109 aa, Glycine max
  Coding DNA Sequence Number=SeqID_7638
MVRGPLKYVSKLNCDGFMEKSTSKALAWGILRDHCGHAGIQIAWNRGSKKLIVESDYLISISLLMHECPTFHNCFSLIHNIHEFVLDRGEVQWSHTLREGNQVADIFCC

SEQ ID NO: 124417 - protein, 53 aa, Glycine max
  Coding DNA Sequence Number=SeqID_7639
MGLLQIMVRIKGLGCALGRAIGKTHGGDKSDDDNDVPNGEGLPHLPTGSDSLV

SEQ ID NO: 124418 - protein, 223 aa, Glycine max
  Coding DNA Sequence Number=SeqID_7640
  Gene Ontology: Mol. function=hydrolase activity, hydrolyzing O -glycosyl compounds; Biological process=carbohydrate metabolic process
  Homolog annotation: Hit_ID=Q8RU06; Match level="QueryCoverage=92%, HitCoverage=42%, E-value=9e-59, Identity=57%"; Hit description =Putative Glucan 1,3-beta-glucosidase
  Pfam annotation: Domain name=Fascin; Domain location=77-186; Score= -1.8; E_value=0.0096; Accession=PF06268.3; Description=Fascin protein
MTMTSCVNLKIWLLNFVILFSMVSLSHGRLNAQFQVKAVNLGGWLVTEGWMKPSLFDGIPNKDFLDGTGLQFKSVMTGKYLCAESGGGTILVANCTDASGWETFRLWRINEDTFRLRVFNKQFVGLDGINVVAVSNICTYSETFHIVKESDNSSRIRIKASNGYFLQAKTQELVTADVSEVREWEDDDPTIFVMTIAARLQGEFQVTNGYGPTKAPQVMKVKI

SEQ ID NO: 124419 - protein, 92 aa, Glycine max
  Coding DNA Sequence Number=SeqID_7641
LGGELKTRRASEEKRREKWVVVDLYGDVLEETEPVVRSKRGRNQALPYRFRDSVVEPLKRATRSQRPSSTAHLSKRLLGPRPQRKTELLITH

SEQ ID NO: 124420 - protein, 92 aa, Glycine max
  Coding DNA Sequence Number=SeqID_7642
MFDIPLRFYEAEGTPQELHNNSKAPRGKNKTDLNSASAPRDPLNDGSLHKWWYRYIHCLENGRLRDKEWLLSGKQTKCQSFQRKNTNAMQYL

SEQ ID NO: 124421 - protein, 104 aa, Glycine max
  Coding DNA Sequence Number=SeqID_7643
MEKYSTNMQGCKIIFLAELIVKGHRGFQYKNLNKSKELQIGLVHKYIKRWSAAATCDLCILLDQHEVMPCIFYPRVLVDLTSSHQVQPFLFFVNKVQPNNADSL

SEQ ID NO: 124422 - protein, 148 aa, Glycine max
  Coding DNA Sequence Number=SeqID_7644
MKKSQRYSNSNATKEYLSVVKPELCFSLILIEDPRRLQDLQVAKSKLYLQGQIIVEEPYPNCQVANQNQGMWTVEGPKFCSDPTSFLENTDQMPWFCFDLLSLGPLQLDFIQPRSKLLNLALLNKHGEGKGDAQSRFQIERNLAGQAW

SEQ ID NO: 124423 - protein, 175 aa, Glycine max
  Coding DNA Sequence Number=SeqID_7645
  Gene Ontology: Mol. function=NADH dehydrogenase (ubiquinone) activity; Cellular component=membrane; Biological process=electron transport
MRRLLGKISGFLSNRTTVGVDKTGNKYFTRNEEVDGINVVMNQKGLVLAKGVGLVVTKLVCRIRMCIGVEYKVGLVVKGGELVQTPSGIFPKEATCGLYIKRKVKSRSLRLIEVGANCAIAIVKEKRWVIFKGEEDPTSIPVEWICWLNGQRKKAPTPEIMARLDNIMLLTMVFL

SEQ ID NO: 124424 - protein, 342 aa, Glycine max
  Coding DNA Sequence Number=SeqID_7646
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1SIC7; Match level="QueryCoverage=96%, HitCoverage=96%, E-value=1e-110, Identity=64%"; Hit description=ATP synthase F1, gamma subunit
  Pfam annotation: Domain name=ATP-synt; Domain location=21-338; Score =468.6; E_value=7.7e-138; Accession=PF00231.9; Description=ATP synthase
  Subcellular localization annotation: CTP_CleavageSite=47; ConfidenceScore=5.08e-01
MFSLSKPILSPVRPTLPPVRCGSRELRERIKTVQTTQKITEAMKLISAARVRRAQEAVVSGRPFSSNLAAMLNDITQRLQNDDVSTPLTHARPVRTVALVVVTADRGLCGGFNKSVIRKALVRIEELEKLNLGCVVISVGKKGNSFFTHSINKKHPFVKVDSFIEIGGFPTAKEAQVIADDVFSLFVSEEVDKVELVYAKFVSLVRFEPVIQNLLPLGEVCDVKDEIFRLSSKEGKLAVERDVVKLKKEGEMCFPLMEFEQDPVMILDAMLPLYLNSQVLRGLQESMASELAARMVAMSNATDNAVDLSKRLSVEYNRERQAKITGELLEIVAGAEALAEND

SEQ ID NO: 124425 - protein, 165 aa, Glycine max
  Coding DNA Sequence Number=SeqID_7647
  Gene Ontology: Mol. function=translation initiation factor activity; Cellular component=cytoplasm; Biological process=translational initiation
  Homolog annotation: Hit_ID=Q9FFT6; Match level="QueryCoverage=67%, HitCoverage=100%, E-value=1e-50, Identity=83%"; Hit description =Translation initiation factor-like protein
  Pfam annotation: Domain name=SUI1; Domain location=77-158; Score =144.4; E_value=3e-40; Accession=PF01253.13; Description=Translation initiation factor SUI1
MKRTNSKYGYGRRITASSQHLTREELPNYTFPLIPDSGSYPCYLFPSLQQAKYMVDLEIQVPSAFDPFAEARESDAPGAKEYVHIRIQQRNGKKSLTTVQGLKKEFSYEKILKDLKKDFCCNGTVVQDKELGKIIQLQGDQRKNVSHFLVQAGLVRKDQVKIHGF

SEQ ID NO: 124426 - protein, 242 aa, Glycine max
  Coding DNA Sequence Number=SeqID_7648
  Gene Ontology: Mol. function=protein transporter activity; Cellular component=membrane; Biological process=intracellular protein transport
  Homolog annotation: Hit_ID=Q1SID8; Match level="QueryCoverage=71%, HitCoverage=69%, E-value=1e-54, Identity=66%"; Hit description=SNARE domain, putative
  Pfam annotation: Domain name=SNARE; Domain location=155-217; Score =54.6; E_value=3.3e-13; Accession=PF05739.9; Description=SNARE domain
  Pfam annotation: Domain name=Syntaxin-6_N; Domain location=5-94; Score=14.9; E_value=0.002; Accession=PF09177.1; Description=Syntaxin 6, N-terminal
  Pfam module annotation: Pfam domain module=SNARE::Syntaxin-6_N; Domain location=155-217::5-94
MKLHLLIKGIIGKKYKKLRGMNRKKWGGGAKSNPLKIELDGKILIFTHLCLVDELDKAIAVASRDPSWYGIDEAEVESRRRWASSARSQVGTMKKAMESGKGSSTTSHASVNGMRRELMRLPNSHQTDSSNQYAARDNDDFIQSESDRQTLLIKRQDEELDELSESVRRIGGVGLTIHDELTAQEKILDELGSEMDSTTNRLDFVQKKVAMVMKKASAKGQIMMILGLLALFIFLFILVFFT

SEQ ID NO: 124427 - protein, 487 aa, Glycine max
  Coding DNA Sequence Number=SeqID_7649
MVKGLHGQNLPAHVAQLVDQLERHCFAPDGSLISKPLFNDLQLAREEMCRERLRYLEAMAIYSEAIAMVEEYQQAISVSNLGGIRDTGNLYPQLGLKNSPQVYQTLEHQMVVAEAAQRLRLPLISKDGEVHDEDIEKLSVVSRSSLDSTVSGANSSNYNTPSSSVSGANTALAASDPVEVGVGGVANRFLGITPSYLWQTQHQKAPLSVDMTEYRLSVSREVEARLKMKCEKLSDAFVLDDNDSSSSGSHSSSSRLPERVKLLIEEIEREETALRDDLYSADRKFAEYYNVLEQILAVLIKLVKDLKLEHQHKYDEMQKTWLCKRCETMSAKLRRWRWVEAISWLMRGRERPVSRIPESERQSTFYNTIIFSPAKLGFSVDPNGPSLYFIEDKRKNVLEHVLLLETYTKDSIPALHKIRKYLVEATEEASIAYNKAVTRLREYQGVDPHFDNIARQYHDIVQKLENMQWTIHQVEMDLKRLPDKPST

SEQ ID NO: 124428 - protein, 115 aa, Glycine max
  Coding DNA Sequence Number=SeqID_7650
  Gene Ontology: Mol. function=NADH dehydrogenase (ubiquinone) activity; Cellular component=membrane; Biological process=electron transport
MKQHYWPSLVLYRDLNTNSFFSHKVLKKEEERIAKEGSKGKRVSTGKVSGPDLKSFIQQFPVPSEGKEVEESPSAMDGLRNPQDGLAEKEKDESESSEPTGSGASFRPGTWQPPT

SEQ ID NO: 124429 - protein, 56 aa, Glycine max
  Coding DNA Sequence Number=SeqID_7651
MTTEMIPIPILEKLYGWKSWVSQEATGHKKDREASLAAANDRMKDCTKFKYCQHDL

SEQ ID NO: 124430 - protein, 243 aa, Glycine max
  Coding DNA Sequence Number=SeqID_7652
  Gene Ontology: Mol. function=nucleic acid binding; Biological process= DNA integration
MDKDPPIITETNTDVDKSLKEAWEWSNRLVLNMMRLIMATNVKPYMPKIDNAREFMKLVKDYSLSDITDKSIVGNLSNTMEMEGSESFLVQFIWNYLPTKFSQFQVNYNTLKEKWNFQEIKVMLIQEEGGLKKMKDNSISLTTHDGASTSKSKSSRKGKGKFNLKVKDGGVCKEKKCYFCKERGFLSIQTIKGTKKFLYIGNRMKARIEGIGTYRLILDTGCHVDLKGCLYVPRWARNLVYVA

SEQ ID NO: 124431 - protein, 125 aa, Glycine max
  Coding DNA Sequence Number=SeqID_7653
  Gene Ontology: Mol. function=nucleic acid binding; Cellular component= endoplasmic reticulum membrane; Biological process=DNA integration
MKGNRAYPLCISGWELEKVLRYLQGTKDYMLTYRRPDHIEVIGDSDLVYVGCVDSRKSTFWYIFLLAEGAMSWKSAKQSMIATSTMEVEFVACFEATIQALWLRNFTSRFSIVDSIYSQTAEDLL

SEQ ID NO: 124432 - protein, 85 aa, Glycine max
  Coding DNA Sequence Number=SeqID_7654
  Gene Ontology: Mol. function=protein serine/threonine kinase activity; Cellular component=membrane; Biological process=protein amino acid phosphorylation
  Homolog annotation: Hit_ID=Q70I30; Match level="QueryCoverage=98%, HitCoverage=12%, E-value=4e-33, Identity=80%"; Hit description=S -receptor kinase-like protein 1
  Pfam annotation: Domain name=B_lectin; Domain location=21-85; Score= -0.1; E_value=0.0024; Accession=PF01453.15; Description=D-mannose binding lectin
FFNFGNSQGQYFGIWYKNISPRTIVWVANRDAPVKNSTAFLTLTHQGNPVILDGSKGIVWFSNSSRIAEKPIMQLLDSGNLVVKD

SEQ ID NO: 124433 - protein, 231 aa, Glycine max
  Coding DNA Sequence Number=SeqID_7655
  Gene Ontology: Mol. function=zinc ion binding; Cellular component =integral to membrane; Biological process=ubiquitin cycle
  Homolog annotation: Hit_ID=Q8GT74; Match level="QueryCoverage=68%, HitCoverage=67%, E-value=4e-20, Identity=33%"; Hit description=RING -H2 finger protein ATL2B
  Pfam annotation: Domain name=zf-C3HC4; Domain location=183-224; Score= 28.7; E_value=2.1e-05; Accession=PF00097.15; Description=Zinc finger, C3HC4 type (RING finger)
MTKWFSGIMGATTWCKEVFSLRVLAGSVGYAVDLFIKVVIAEFTCILALGGSIMGIIAGAIKGHTRGAGFLDGACKGAVTGAIAALELPNIAACDEPLSKVALLRSLLNGKIFVEWICPAVAQAYQCHISAHATSYGEESDIYNDDIVRGITVKGMAWNIIQKLPVQQFNSSKMFKLYNDSCCSICFQDFEYEEFVRTLPKCGHFFHSVCIDKWLVQQGSCPMCRIFVSDL

SEQ ID NO: 124434 - protein, 72 aa, Glycine max
  Coding DNA Sequence Number=SeqID_7656
  Subcellular localization annotation: CTP_CleavageSite=43; ConfidenceScore=5.53e-01
MASFCAARTFNIPAMNAGVLRRRASWAAGIVGASVAGAALLRSCSSKRSAPFACMSLSTDTRSFSGGTALLS

SEQ ID NO: 124435 - protein, 128 aa, Glycine max
  Coding DNA Sequence Number=SeqID_7657
MYERDQATAYPFGLHISRVINVKIIVDKNQILWTDTKKASTYGYDGRYNVEDHDVMQVLCPVRKYHYDDAYVCFTKDADNNSFFQRILQLPTIQYEGTYNLKKMTKEQMIAHVTQLHKAQQNKKVEEE

SEQ ID NO: 124436 - protein, 124 aa, Glycine max
  Coding DNA Sequence Number=SeqID_7658
  Homolog annotation: Hit_ID=Q5F2M8; Match level="QueryCoverage=48%, HitCoverage=14%, E-value=3e-21, Identity=81%"; Hit description =Glutamate dehydrogenase 2
  Pfam annotation: Domain name=ELFV_dehydrog_N; Domain location=29-122; Score=-6.4; E_value=4.7e-06; Accession=PF02812.8; Description =GluLeuPheVal dehydrogenase, dimeri
MKNDATFAATNLRADHYVAQTKLLLYFVADKILYIWSAPMQDNSGTDHVIACAVFLYTCPSKCEVDLDEVNALAELMTWKTVVADIPYGGAKGGIGCNPKELSVSELGSLTCVFFQKIDDLIGI

SEQ ID NO: 124437 - protein, 102 aa, Glycine max
  Coding DNA Sequence Number=SeqID_7659
MFHLHNRVHLHPHPFKEIQKSCSKGTLTDAQRFPVAFINGNLASKSPYSEFISIEPVERETISVQAPTWTKYDYEHTSSEAFKALPTDVIVYLPLPQWTCQV

SEQ ID NO: 124438 - protein, 272 aa, Glycine max
  Coding DNA Sequence Number=SeqID_7660
  Gene Ontology: Mol. function=nucleic acid binding; Cellular component= nucleus; Biological process=regulation of alternative nuclear mRNA splicing, via spliceosome
  Homolog annotation: Hit_ID=Q9LTV5; Match level="QueryCoverage=92%, HitCoverage=12%, E-value=3e-66, Identity=54%"; Hit description =Helicase-like protein
  Pfam annotation: Domain name=Apc13p; Domain location=124-270; Score= -28.4; E_value=0.03; Accession=PF05839.2; Description=Apc13p protein
  Pfam annotation: Domain name=HSA; Domain location=1-53; Score=43.9; E_ value=5.3e-10; Accession=PF07529.4; Description=HSA
  Pfam module annotation: Pfam domain module=Apc13p::HSA; Domain location=124-270::1-53
MVWLSKDFESERKWKLAQAKKVALRASKGMLDQATRGEKKMKEEEQRLRKVALNISKDVKKFWTKIEKLVLYKHQMELDEKKKKALDKQLEFLLGQTERYSTMLAENLGDPYKSAENNSAEHRKSIHCKDVHDVINEPKEADVVEYQSDAADNDEEYDVQSDDELEDDERTIEQDEALITKEERQEELAALRDEMDLPIQELLKRYAGEKGESVMKGSSPEHSEDGGKIVRAGDGKKGLGSENRDDLLSVSKVDTSNSSMVSGRRCTNMYPL

SEQ ID NO: 124439 - protein, 1040 aa, Glycine max
  Coding DNA Sequence Number=SeqID_7661
  Gene Ontology: Mol. function=nucleic acid binding; Cellular component= nucleus; Biological process=regulation of transcription, DNA-dependent
  Homolog annotation: Hit_ID=Q9LTV5; Match level="QueryCoverage=97%, HitCoverage=50%, E-value=0.0, Identity=67%"; Hit description =Helicase-like protein
  Pfam annotation: Domain name=DEAD; Domain location=145-311; Score= -26.4; E_value=0.00096; Accession=PF00270.19; Description=DEADDEAH box helicase
  Pfam annotation: Domain name=Helicase_C; Domain location=693-771; Score=99.4; E_value=1.1e-26; Accession=PF00271.21; Description =Helicase conserved C-terminal domain
  Pfam annotation: Domain name=ResIII; Domain location=141-305; Score =6.2; E_value=1.4e-05; Accession=PF04851.6; Description=Type III restriction enzyme, res subunit
  Pfam annotation: Domain name=SNF2_N; Domain location=147-434; Score =367.3; E_value=2.5e-107; Accession=PF00176.13; Description=SNF2 family N-terminal domain
  Pfam module annotation: Pfam domain module=DEAD::Helicase _C::ResIII::SNF2_N; Domain location=145-311::693-771::141-305::147-434
MERVDTIDPKDEIALLQKESDMPVEELLARYKRDPSDDEDGEYESDYASALSEKHSDSPVHQDAGQKDPAIPMDEDIKSGEHLAATIQFQEEQRESPRENLEKRESEDIIADAAAAARSAQPTGNTFSTTNVRTKFPFLLKYSLREYQHIGLDWLVTMYEKRLNGILADEMGLGKTIMTISLLAHLACDKGIWGPHLIVVPTSVMLNWETEFLKWCPAFKILTYFGSAKERKLKRQGWLKPNSFHVCITTYRLVIQDSKVFKRKKWKYLILDEAHLIKNWKSQRWQTLLNFNSKRRILLTGTPLQNDLMELWSLMHFLMPHVFQSHQEFKDWFSNPISGMVDGEEKINKEVVDRLHNVLRPFLLRRLKRDVEKQLPMKHEHVIYCRLSKRQRNLYEDFIASSETQATLASANFFGMISIIMQLRKLSSSVCSILLPSPFSTVDLRGLGLLFTHLDSMAAWESDEVQTIETPATLIMERTDMTELEVIRPQKCQKKLQGTNIFEEIQRAIWEERLKEAKERAAAIAWWNSLRCKRRPIYSTTLRDLVTLRHPVYDIHQVKADPVSYLYSSKLADIVLSPVERFQKMTDVVESFMFSIPAARAPSPVCWCSTSETNVFLHPSYKQKCSEVLLPLLAPIRPAIVRRQVYFPDRRLIQFDCGKLQELAILLRKLKSEGHRALIFTQMTKMLDILEAFINLYGYTYMRLDGSTQPEERQTLMQRFNTNPKYFLFILSTRSGGVGINLVGADTVIFYDSDWNPAMDQQAQDRCHRIGQTREVHIYRLISESTIEENILKKANQKRALDNLVIQSGGYNTEFFKKLDPMELFSGHRTLSIKNIVKEKDQNNGEVSVTNDDVEAALKCVEDEADYMALKKVELEEAVDNQEFTEEAIGRLEEDEYVNEDDDTAELGESVSNLNKENVLMLNGTDHKEDRPTHSVPVKEDDPDMLADVKQMAAAAAAAGQAISAFENELRPIDQYAIRFLELWDPIIDKTALESEVRIEDTEWELDRIEKYKEEMEAEIDEDEEPLVYESMHHITPFAS

SEQ ID NO: 124440 - protein, 134 aa, Glycine max
  Coding DNA Sequence Number=SeqID_7662
  Gene Ontology: Mol. function=chromatin binding; Cellular component =chromatin; Biological process=chromatin assembly or disassembly
  Homolog annotation: Hit_ID=Q1SAV4; Match level="QueryCoverage=72%, HitCoverage=24%, E-value=3e-15, Identity=47%"; Hit description =Integrase, catalytic region
  Pfam annotation: Domain name=Chromo; Domain location=46-97; Score =16.2; E_value=0.012; Accession=PF00385.14; Description='chromo' (CHRromatin Organisation MOdifier
MYRLKLTAHSRIHPVFHVSLLKAFVGDPEAAHADPLTVIRTEEATNTPLTIIDSKLVPADNGTRRMVLVQWLGSSRQDTSWEDWQVLREHYNLEDKVLFVERGDDTDVEDEAMLQRRSARTKNLPKHWDIYQLG

SEQ ID NO: 124441 - protein, 47 aa, Glycine max
  Coding DNA Sequence Number=SeqID_7663
MEKGTSLPMEKGFKILLFPIIDSLGNPLRLFTCGIRACVMKFMILQE

SEQ ID NO: 124442 - protein, 214 aa, Glycine max
  Coding DNA Sequence Number=SeqID_7664
  Gene Ontology: Mol. function=calcium ion binding
  Homolog annotation: Hit_ID=Q9STP7; Match level="QueryCoverage=99%, HitCoverage=51%, E-value=1e-39, Identity=40%"; Hit description =Putative calcium binding protein
  Pfam annotation: Domain name=efhand; Domain location=47-75; Score =13.7; E_value=0.4; Accession=PF00036.22; Description=EF hand
  Pfam annotation: Domain name=efhand; Domain location=8-36; Score =12.3; E_value=0.6; Accession=PF00036.22; Description=EF hand
  Pfam annotation: Domain name=efhand; Domain location=91-119; Score =6.9; E_value=2.4; Accession=PF00036.22; Description=EF hand
  Pfam module annotation: Pfam domain module=efhand::efhand::efhand; Domain location=47-75::8-36::91-119
MGYGEAGWWMERFEVADIDHNRLLNFTELKDFLHPEDSKNQEMLKWMLKDRLMRMDNGNDGKLNFNEFEGRLYSTYESYMNFEINGGHVPSPKDKFVKLDVNKDKFLSPEELIPILSYLYPGEEAYAKYFTCYLMNEIVSTNKALLQDFFKIKSCLKTKGFKVIQGSGNRLPFLADDNGDGKLTLQEMLDHEFTFYNTVHADGHQESDDDHDEL

SEQ ID NO: 124443 - protein, 157 aa, Glycine max
  Coding DNA Sequence Number=SeqID_7665
  Gene Ontology: Mol. function=calcium ion binding
  Homolog annotation: Hit_ID=Q9STP7; Match level="QueryCoverage=96%, HitCoverage=46%, E-value=5e-13, Identity=30%"; Hit description =Putative calcium binding protein
MSKAVVYILIATAVLFFIFMSPLNLQKPKGRPNRRFGYKLLERAPNLDPLVTNIEKEIEKKMYHEPAPRMLSNLDSTTSVSDVIETYQYLTSGDREPKDGVIGFNELEAWITQRAIERLDYLTQVELDSKDKNGDLAISFKEYLPQFSEKDMGNMFT

SEQ ID NO: 124444 - protein, 488 aa, Glycine max
  Coding DNA Sequence Number=SeqID_7666
  Gene Ontology: Mol. function=nucleic acid binding; Cellular component= nucleus
  Homolog annotation: Hit_ID=Q9LTV5; Match level="QueryCoverage=75%, HitCoverage=19%, E-value=1e-61, Identity=39%"; Hit description =Helicase-like protein
MEAGARKSRHTKDLQLLFTVPFSWLYLLLGLTQPHKLAQLVRTPTPGDSKPKSKKKPKKAKFKSLKKGSLTSGLRPVKEESQAQPMNIDDENVPGLDFQSPNSTMQKKRKKSKLTTDGEEEKRLKKSKKSKRDSPDIYASDLESNSLVVQDEHAESKTCESLVDLEQKTASRSKMGGKISITPIPLKQVWMIKPEKLKKGNHWSKDCIPPADFWLPQEDAILCAVVHEYGPNWSLVSETLYGMSGGGSYRGRYRHPVQCCERFRELFQKYVLLSMDNANHEKINSPGSGKALLKVTEDNIRMLLDVASEQSFYTSIGQPSQNSLKKSSERMAFANLAPSKNLVAAALDDITTRQVNDKVILSNQGEDMPVSADQLDITLEFAKEDSDVLSSFPSVINLSIHGTEPTPSLNKLTGEDDLKVAAYDVFSFFPHPSGRLQEFVEKTALDGHHLHSQPTIQGLDLDPGYNPPESGSLLYLTLLSLLAFSPLT

SEQ ID NO: 124445 - protein, 86 aa, Glycine max
  Coding DNA Sequence Number=SeqID_7667
MVLLLYESNEKFNDRLIVVINKMNQSGAFAFRALVVILIDHHIHKATKEPTSTMEMTSGLLEYSRLLLLLLPSWCMIKCLPLGQKL

SEQ ID NO: 124446 - protein, 86 aa, Glycine max
  Coding DNA Sequence Number=SeqID_7668
MEEVVVLGLRCSNNSKHGHLNLLNVLEKNDTKIGELSGDCILHGEPELLILLMLSFGKGFHGLPYHILHLIPGNSGRLCIVKRNEA

SEQ ID NO: 124447 - protein, 91 aa, Glycine max
  Coding DNA Sequence Number=SeqID_7669
MVLKAVQLIVGHVTATLEGVTAFFSLEFGDKNDVSCDTTNNNIRATDASGSVGGGVVVTFGGRVHNNDGAQVLGGGVPRGAAEHKGLLLEA

SEQ ID NO: 124448 - protein, 84 aa, Glycine max
  Coding DNA Sequence Number=SeqID_7670
PVQVIEVTSSEEDPEEDLEELPPEPAVDALDFLEGDEDPLLEVDSPEEVMSASEADSTEDSGPREMAISGGSSSYHHYGHLCSG

SEQ ID NO: 124449 - protein, 2187 aa, Glycine max
  Coding DNA Sequence Number=SeqID_7671
  Gene Ontology: Mol. function=DNA-directed RNA polymerase activity; Cellular component=mitochondrion; Biological process=electron transport
  Homolog annotation: Hit_ID=Q01H01; Match level="QueryCoverage=93%, HitCoverage=83%, E-value=2e-30, Identity=25%"; Hit description=[S] KOG1791 Uncharacterized conserved protein
MAEPAAVPNLQPKVSHEAKLKELLHRITSLEIKLCSDGAKEFAKLLRSETGADLLREYVRGSPKCSELLEAWKLREGKQGMHYVFDLISAILSHREGKHNPSDIESVNITNDLDKFARLLISERLSDIHKEVNSKEWRRQKAALLLMASIARRGASLASEVAKSFDFKLAEFGRIASANRRRKPEARVGLLRKPFVGFAMSFLEVGKPWLLRWVLQQREMYSGVLRGLGSDDDETVVFVLTVLRDRVLVEESLVQPWLRSVLFGSATLEQLVEVCAREGGGDAAEVAFGVLFRVCTDPSNGLMPDSKMRLKGNTKRILDLMKKLRVTEVQYHKDLLLAIVEAKASFGLSYLKEFPYNIDNFKSSSWISAISVAAQLVSLVGNGISKESVNFRSNGPHLFDNMDLHSIVKCLFPRPFSRSLFNKGMPHIEPYVKHGTLRLLLELLKLLDSIFGGLNRNSNTNNPFMQHMMSIKDEIQNYVQAFIPDLQVLLNLLSSLDVNSEACNSSLKRNACHHEHNSSSRKKLKLDISESGDIDIVVAGISSTPDIDLTGNSGTVDGGPRADALDDEEDLMNSIGEIWGVDLRSMEINTFEDVESYLLSKLLDALRYYRRALPFSLDNSFETFKGLLKSPLELTSHLQVSVLSLLVEYIEWCPDDEIPIRTPPMLYKYLQPFIKLLMFSPYNETRELAYKLALAAMFSTGAFDGNLHEIEAWFLFLPGYHGKKPPVKISEVDVLQSLTLFVISFFCDAVSTLGNNLIKYWDILKSHAHCLEGGEDLSPQFSPFIICVLEKCLKVIRPKTGSCSLPKKSMVLLYTCNTVKYLLQTQVNAGLLSALVHADLTERLGGSYECDEVFPEWKPLKDLLDFVESILHQRNYCIFSKNEESVLPDSSLGSALGSVNRLLNCGSGHGIAETTIAFISSIILEGTNKILTNLPSHVVIPRDLVGVPFSLLLSVLFLDYSVLHHASKLWPVMFYAALDMAMSDLGIDGQNAAPVETSDLTLHPDSLTCSQLLDASEVDAVTFSIFLKQAPFHVIFPAMMCMNGPYISKLSKIQEFLLHKLSESNDSLLLTNLQLILFWTHRIQLCYEVNPIAEVEQLLNLCVILVGSLLAQLLVPESGSDWSINSAFYSLRHNIQEVIKTIFCHPCVLISLSFSLGSCQNLSNGNVENDINMLNVVSNEGFHNFGNPVLKILTMTLESMWSLSGAHLCVSTAEDVANNIVKAFKRLQQKLFLDVRNRFELYIRTEDVMPLLPTLYALHSLHRFLSPFQLLELVNWMFSRDEFDDLPIKKSSIFVGCSLAADAFSALSIYFQQSTENRAPYDLFWEMGEKNMKADIFEQIYLKVVDFSVCYEIDSADRCLLEAVNLLYKQKHLQQETFHPLLLVMWKIIMVTPLKVLSHCIYKTNAKKATFLHILSELSSLHSLIFGHLFLGTVNRSLHHGIGVMEHTFDPTLSEDQFLLLLPASLSYFSLISKRLREQSHRDFEHLPYFYSKILLKGFSQWKRFSSKDIFQEQYGEFFPSSAQELLCLTDLSLLGKSIHMLKYHFAHNGDMMKLKKRLNLFKSIFPKFDSHDDLMNCDCQVIDSYSLRQSLNIINCVVAKISLCKILLFHEAGGDFKDVAVKMQSKLGRCRIHFINILVDIWQFIVKKFSLASYQCRTAKGTNISLLYNHLEGFLLKSILELAGEMQNDLIQLQAISFLEQLIRSALLYRFGDFTTMKTVRVILSQLSEGRLSYDLYLQLLLAHSQFAPTLHSVRKQAGSLLKPVSSILKCLVIPSLDHCENDVKHRGLTTELSSGPLEIVKILWILLLVKARQIDSDNGNDIDVNLKELHALLRHSYGATVNWIDLEIYNLMQQIESMSGLLSQNAKLDSETIEEWYKSQHRDNFPIDPDICVSTVLYFPYDRTFSDELPSINKIEPDTPRKKVLYSHVEDKERYDPVFILRFSIHSLSKAYVAPVEFAGSGLLAIAFVSLSSPDQGIRRLAYGTLDKFKNAVEKCQKRKDVMGLRLLLNSVQNSIEEPWQRIPSVIALFAAEASCVLLDPAHDHYAAISTFFIHSSKLNMRVMFDNFFWSTSVNFKAERSWMLRLVYAGMNSDDDAAIYIRNSILEKLMSFYVSSLSDFESKNLIIEVINKSVKLHKITRHLVKHCSLFSWFSSLISVARQRLNGNENKLFLKHVLVALKEGPL

SEQ ID NO: 124450 - protein, 79 aa, Glycine max
  Coding DNA Sequence Number=SeqID_7672
METGGAFISMASSASSGHKTRGISFWLNTLWGQGFGESTEEREEEGHMAEEAVMQSGDSVAAEAMIEKGIFGRGDIQKL

SEQ ID NO: 124451 - protein, 62 aa, Glycine max
  Coding DNA Sequence Number=SeqID_7673
MTAEDGGIGGVMRLDTMVTSSDGVELAIMMKKNERRGKSLGQRGRGGMLCQRREGKERSTTK

SEQ ID NO: 124452 - protein, 499 aa, Glycine max
  Coding DNA Sequence Number=SeqID_7674
  Gene Ontology: Mol. function=binding; Cellular component=ubiquitin ligase complex; Biological process=protein ubiquitination
  Homolog annotation: Hit_ID=Q8GSZ9; Match level="QueryCoverage=75%, HitCoverage=60%, E-value=2e-96, Identity=50%"; Hit description =Armadillo repeat-containing protein-like
MEIIEERKFSKLLSELIVLSDEIASLAKNSEIEVHIFAEIAMLVEKFPPIFNDLREKNTVLDKPPIRKSLESLENELRPSLEVSTDFREKIGTLQRQLMNVRFSGSAMKLTGEIEEEIVNVSIDDVVLQLKNGKDEEFAVALLRLKEFMRSERLDGGLIDEEATLSILFNRLGSCKADNRLTIIRLLRSIALGNDEKKEKMVEIEFLSAVVKSLTRDSEERKEAVGLLLDLSDIQAVRRRIGRIQGCIVMLVAILNGDDPDASHDAAKLLDILSSNTQNALHMAEAGYFRPLVQYLKEGSDMNKILMAKALSRLELTDHSKLSLGEAGAIEPLANMFSTGSGIAGTLLQLLFSVTSVLMTLREPASAILARIAQSESILVNDDVAQQMLSLLNFSSPIIQGHLLEALNNIASHPGASKVRSKMKEKGALQLLLPFLKENTTKVRSKVLQLLYSLSKDLTDELTEHLNETHLFNIVNIISTSTLESERAAAVGILSNLPT

SEQ ID NO: 124453 - protein, 89 aa, Glycine max
  Coding DNA Sequence Number=SeqID_7675
  Homolog annotation: Hit_ID=Q8W4L5; Match level="QueryCoverage=63%, HitCoverage=7%, E-value=5e-10, Identity=46%"; Hit description =Putative VP1/ABI3 family regulatory protein
MAGVGSSSYKGNDNILFCFHSKSKTTTFINGWQLQSGGLALLCQNCGSLYENGTFCKAFHKESDGWRDCVACYKTCIVYATDYKLNSMI

SEQ ID NO: 124454 - protein, 105 aa, Glycine max
  Coding DNA Sequence Number=SeqID_7676
MAPAQPIDMARHLPMMQDDTYVEPHIPEVPVTPAHAPSNVEQPKHAVEACQAITERLEHFLNLRIVTAGIEIHEVMEDCLRITRGVTTEGNVYVRSRQRRRTDQR

SEQ ID NO: 124455 - protein, 148 aa, Glycine max
  Coding DNA Sequence Number=SeqID_7677
  Gene Ontology: Mol. function=protein binding; Biological process =defense response
  Homolog annotation: Hit_ID=Q1SW19; Match level="QueryCoverage=93%, HitCoverage=20%, E-value=7e-14, Identity=30%"; Hit description =Disease resistance protein
MPLKVLDFEQAPMLLDRVPENLGNLIHLKYLSLSNTWIESLRKSIVKDGLGDMTSLQKLPLLEIVDDGVVIRELGKLKQLRGLVIIITNVKGELGNALCSSINEMQLLEKLHIDTTDKNEVIELQFMSTPSALRKEALPQWEVKEVAN

SEQ ID NO: 124456 - protein, 515 aa, Glycine max
  Coding DNA Sequence Number=SeqID_7678
  Gene Ontology: Mol. function=serine-type peptidase activity; Biological process=proteolysis
  Homolog annotation: Hit_ID=Q9FG66; Match level="QueryCoverage=84%, HitCoverage=64%, E-value=1e-171, Identity=66%"; Hit description=Acyl- peptide hydrolase-like
MASSAATTIPSLSERITAPYGSWKSPITTDVVSGASKRLGGTAVDGRGRLIWLESRPAESGRGVLVVEPENPGGEAVDITPKEFGVRTVAQEYGGGAFTVSGDVVFFANYKDQRLYKQSISSLDVPPIPLTPDYGGPVVSYADGILDVRFNRFISVREDRCESSQNPTTTIVSIALGSKDAQEPQVLVGGSDFYAFPRLDPKSERMAWIQWSHPNMPWDKSELWVGYISENGEIYKRVCVAGNNPSLVESPTEPKWSSDGELFFITDRENGFWNLHKWIESENKVLPVYSLEAEFARPLWIFGMNSYEFLQSHTRKNLIACSYRQQGKSYLGIIDDVKGSKLTVLDIPFTDIDNITSSNNYLFVEGASAVHPSSVAKVTLDNDKSKAVDFNIIWSSSPDSLKYSSYFSKPELIEFPTEVPGQNAYAYFYPPTNPDFQASEEEKPPLLLKSHGKSGVGTTRSNPPHMAAVDALEVDLITLFGSIHLYQDRSMCAFLLKVQEIADVLVSVGSLISPQ

SEQ ID NO: 124457 - protein, 769 aa, Glycine max
  Coding DNA Sequence Number=SeqID_7679
  Gene Ontology: Mol. function=nucleotide binding; Cellular component =cytoplasm; Biological process=response to unfolded protein
  Homolog annotation: Hit_ID=Q655N4; Match level="QueryCoverage=98%, HitCoverage=98%, E-value=0.0, Identity=53%"; Hit description =Putative heat-shock protein
  Pfam annotation: Domain name=HSP70; Domain location=3-667; Score =479.9; E_value=3.1e-141; Accession=PF00012.10; Description=Hsp70 protein
MSVVGFDIGNENCVIAVVRQRGIDVLLNYESKRETPAVVCFSEKQRILGSAGAASAMMHIKSTISQIKRLIGRKFADPDVKKELKMLPGKTSEGQDGGILIHLKYSGEIHVFTPVQFLSMLFAHLKTMTENDLEMPISDCVIGIPSYFTDLQRRAYLDAAKIAGLQPLRLIHDCTATALSYGMYKTDFGSAGPAYVAFIDIGHCDTQVCIASFEFGKMEILSHAFDRSLGGRDFDEVIFSHFAAKFKEEYHIDVYSKTKACFRLRAACEKLKKVLSANLEAPLNIECLMDGKDVKGFITREEFEKLASGLLERVSIPCRRALTDANLTAEKISSVELVGSGSRIPAISTSLTSLFKREPSRQLNASECVARGCALQCAMLSPVYRVREYEVKDVIPFSIGLSSDEGPVAVRSNGVLFPRGQPFPSVKVITFQRSNLFHLEAFYANPDELPPRTSPKISCVTIGPFHGSHGSKIRVKVRVPLDLHGIVSIESATLIKDDMDDLVMAGDYHSNSDAMDIDPISETVTNGFEDDTNKKLEFPCSSADGTRKDNRRLNVPVNENVYGGMTKAEISEALEKELQLAQQDRIVEQTKEKKNSLESFVYDMRSKLFHTYRSFASEQEKDGISRSLQETEEWLYEDGVDETEHAYSSKLEDLKKLVDPIENRYKDDKERVHATRDLSKCILKHRASADSLPPQDKELIINECNKVEQWLKEKIQQQESFPKNTDPILWSSDIKSKTEELNLKCQQILGSKASPSPEDKDKPDTFNDP

SEQ ID NO: 124458 - protein, 194 aa, Glycine max
  Coding DNA Sequence Number=SeqID_7680
  Homolog annotation: Hit_ID=Q9FG66; Match level="QueryCoverage=36%, HitCoverage=11%, E-value=1e-13, Identity=57%"; Hit description=Acyl -peptide hydrolase-like
  Subcellular localization annotation: CTP_CleavageSite=52; ConfidenceScore=5.76e-01
MATLAIAVLTLTARVSSSSSPYYYSNFFFTRSFNIFTTKITAPYGSWKSPITAGVVSGASKRLGGTAFDGCGRLIWLESRPAESGNTELTALAMKFKRMEANKLTQKKCECSLFLPTVPSSAFLLFLLLYGRDANGGAEADGALPMQDLSLFDFFRLWFLYCFGRKKDVVMFDFEAVTFMFVTITQPVCLAFSV

SEQ ID NO: 124459 - protein, 154 aa, Glycine max
  Coding DNA Sequence Number=SeqID_7681
  Gene Ontology: Mol. function=RNA-directed DNA polymerase activity; Cellular component=chromatin; Biological process=RNA-dependent DNA replication
MCIDYHKLNESTRKNHFPLPLMDHMLERLARQAYYGFLDGYSGYNQIVVDPKDQEKMAFTCPFGVFAYRRMPFGLCNALAIFQRCMLAIFADMVEKSIEVFMDNFSMFGTSFESCLKNLEMVLQRCIETNLVLNWEKCHFMVRKGIVLGHKNLA

SEQ ID NO: 124460 - protein, 103 aa, Glycine max
  Coding DNA Sequence Number=SeqID_7682
MPIMEFRNGHSISTKYKLDFQNTYSGYGSHYFSSKIDVVQLHVDNAFAASLMEENHCVQRRDGKEARGVKCKGGRRTSWSSMLRSWWHLLVVKRKLVGGEVER

SEQ ID NO: 124461 - protein, 91 aa, Glycine max
  Coding DNA Sequence Number=SeqID_7683
  Gene Ontology: Mol. function=DNA binding; Biological process=DNA integration
  Homolog annotation: Hit_ID=Q1SQ35; Match level="QueryCoverage=80%, HitCoverage=70%, E-value=1e-20, Identity=64%"; Hit description=Pol -related
MRMNAYESSIIYKQKMKVYYDKKIQRQDFQLGQQVLLFNSRLRLFLGKLESNWSWPFMIKEVRPHVAVELMDPTMGNPEKRWIPKGSTTSS

SEQ ID NO: 124462 - protein, 87 aa, Glycine max
  Coding DNA Sequence Number=SeqID_7684
MKSGAVIDLIEVVGFKNRYGLQELPPNQPDLTGPLWAKCITGLITKLARLCHWVPVGSSNWVFELWCERCWGPKCRHRLAAASLAVR

SEQ ID NO: 124463 - protein, 76 aa, Glycine max
  Coding DNA Sequence Number=SeqID_7685
MLKGGSIDSDLQEAIARKVGEVEFFLEVEIEVLEMQRFWREETVQGRGGGVVGEPDAIEEPSRLRGVFVAEGRRIS

SEQ ID NO: 124464 - protein, 321 aa, Glycine max
  Coding DNA Sequence Number=SeqID_7686
MYDPEDGAPKYCRVQGQVIRFDAKTINDFLDTPVILADGEDYSAYSQYLHTYPDHQAIAATLCTPGGGFVLNVDGAPWKLLGKDLTTLTQTWSILSYFNLAPTSHTSDLNVDKARLIYGLVMKMDMDLGSFISGQITQIAQSSTSRLGFLALMTTLCDAQGVISDSLTFESLSPVINLAYIKKNCWNPTDPSITFLGPHRTRTRAAAPNTLPLAQPPPQVARHQKPSTSAPPDLHSQMLRSIYQGQQIIVRDLHRLSVHMKMDPPLMTPEAFIQQVAWPGVQPSTDGRGEPSKVRETMAGAKDDIIANLTATDLGPWPDLG

SEQ ID NO: 124465 - protein, 63 aa, Glycine max
  Coding DNA Sequence Number=SeqID_7687
MVTESGMRTLLRVVPEDMSWGSGDLGDVRWGAIAQNQAWPIPTQPGHSQPVRTCDVPKQASSW

SEQ ID NO: 124466 - protein, 67 aa, Glycine max
  Coding DNA Sequence Number=SeqID_7688
MGDGCIYEEAERDRSRGFMWSVGAKGHGGNQTTGLHCSMLVLPMPTLTWTLSHTLTHNYINYIHSPL

SEQ ID NO: 124467 - protein, 97 aa, Glycine max
  Coding DNA Sequence Number=SeqID_7689
  Gene Ontology: Mol. function=nucleic acid binding
  Homolog annotation: Hit_ID=Q8S8M1; Match level="QueryCoverage=54%, HitCoverage=4%, E-value=3e-14, Identity=64%"; Hit description =Putative retroelement integrase
MKTVMRRRFVPSHYHRDLHRKLQTLTQGSMSVEDYYKKMEIAMVRTNVEENREKTMTRSKTKRMKQALQALILKIKKKEDQCELRAAPNWVTLLQIF

SEQ ID NO: 124468 - protein, 466 aa, Glycine max
  Coding DNA Sequence Number=SeqID_7690
  Gene Ontology: Mol. function=oxidoreductase activity, acting on paired donors, with oxidation of a pair of donors resulting in the reduction of molecular oxygen to two molecules of water; Cellular component=membrane; ...
  Gene Ontology: Cellular component=Biological process=fatty acid biosynthetic process
  Homolog annotation: Hit_ID=Q6QUM6; Match level="QueryCoverage=80%, HitCoverage=97%, E-value=1e-159, Identity=71%"; Hit description =Omega-6 fatty acid desaturase
  Pfam annotation: Domain name=FA_desaturase; Domain location=92-343; Score=352.3; E_value=7.7e-103; Accession=PF00487.14; Description =Fatty acid desaturase
  Subcellular localization annotation: CTP_CleavageSite=45; ConfidenceScore=5.51e-01
MGGGGRSSATLKHQNSIKNHSKKKRVPHAKPPFTLSQLKKAISPHCFHRSTFRSFSYVLYDLTIASCLFYAAVNYIPTLPHENLSLLAWPLYWFIQGSILTGVWVIAHECGHHAFSDHQWLDDLVGLILHSLLLVPYFSWKYSHRRHHSNTGSLERDEVFVPKTKSSMGWYSKYLNNSPGRVLTLAITLTLGWPLYLAFNVSGRSYERFACHYDPYGPIYSNRERLQIYVSDAGILAVCFGLYKAVLAKGLVWVVCVYGVPLLVVNGFLVLITFLQHTHPAVPHYDSSEWDWLRGALATVDRDYGILNKVLHNITDTHVAHHLFSTMPHYHAMEATKAIKPILGEYYHFDETPIYKAMWREAKECMYVEPDKGSNGKVINSATLNLHKIKNKKNTENTAKQYTTEQEPKDLRGSAMCLHPRENAAHHHLHIDHEITSSIQAAASFDLSWFLFQQNLSQSPSSLPPF

SEQ ID NO: 124469 - protein, 164 aa, Glycine max
  Coding DNA Sequence Number=SeqID_7691
MSEKNNNADVGDCMILDDHEGEEHCCGKGTNARSVSFLPISQEKIGDSTKVVIKQDMKGGEHKYGFNNNKREKPEKVRVVDDETGDKHELYEVLRMPSRTKNRCLKFFTEDRRGIINIVLYIYQTPNPKEIVQIKIVSYHSCSYVLCDCSVALDLHGIHVKFSV

SEQ ID NO: 124470 - protein, 94 aa, Glycine max
  Coding DNA Sequence Number=SeqID_7692
  Subcellular localization annotation: CTP_CleavageSite=62; ConfidenceScore=5.63e-01
MARNFKLSSTLVPSGGVYVGFSSSHSSKSSVGGSVGSSEGFPAVLKTMWDNVGVERAVADFRREEKEKSDFRQEEKEKSECKVFKHAGCEMSTF

SEQ ID NO: 124471 - protein, 110 aa, Glycine max
  Coding DNA Sequence Number=SeqID_7693
MEQPQDIVVPFHHQPTIQDYIMLLGELLDTWFALKQTLVDRKKAKEEAMYQAKKMMHLEERQQANDEVYRLKTILTTRVHVPTQSSTPVPVESLDSFSDSFERKFLDMAK

SEQ ID NO: 124472 - protein, 77 aa, Glycine max
  Coding DNA Sequence Number=SeqID_7694
MEVLGACSHELVVVKVFVDLLGEIDLVTPVVSVDELEDDPSSNSCFLDQEELEQFLLLVPSMVDKGAALAPTYPQVR

SEQ ID NO: 124473 - protein, 81 aa, Glycine max
  Coding DNA Sequence Number=SeqID_7695
  Subcellular localization annotation: CTP_CleavageSite=7; ConfidenceScore=5.05e-01
MDSSGVLSGMTPHSTNMHSSSFFHILSRAQRMEWSLIQFTQVLYTKVIHIHRLTTPPNLQFCLSSSKYRTAHWSPSDKNMQ

SEQ ID NO: 124474 - protein, 35 aa, Glycine max
  Coding DNA Sequence Number=SeqID_7696
MAGTRMPPLAAAGWGMTQLKPPASSHAPTSCFRGE

SEQ ID NO: 124475 - protein, 58 aa, Glycine max
  Coding DNA Sequence Number=SeqID_7697
  Subcellular localization annotation: CTP_CleavageSite=34; ConfidenceScore=5.01e-01
MASSTCFQQISSHLTIMKQKPSKTTHHISQNPIPTNIKRERSLPKPEISRSGHQRLEL

SEQ ID NO: 124476 - protein, 79 aa, Glycine max
  Coding DNA Sequence Number=SeqID_7698
METGERGRGDEGGSDTDLSRRFVEVREGGQGSNARQHSRLHDEEGIARRRESRARARARARARARARARAIQRTSGFFL

SEQ ID NO: 124477 - protein, 96 aa, Glycine max
  Coding DNA Sequence Number=SeqID_7699
  Homolog annotation: Hit_ID=Q40983; Match level="QueryCoverage=47%, HitCoverage=3%, E-value=3e-11, Identity=91%"; Hit description =Metalloendopeptidase
  Subcellular localization annotation: CTP_CleavageSite=50; ConfidenceScore=5.10e-01
MGLKAISDGKLAVLLLSGGQVHRTRWTGDASSSPKLPSKLHKKQSSCTTSVAIVACVPKKVHIEGAGETGFKISSIEITDAIKAVDWMNLFSQSLS

SEQ ID NO: 124478 - protein, 69 aa, Glycine max
  Coding DNA Sequence Number=SeqID_7700
  Homolog annotation: Hit_ID=Q1RWX0; Match level="QueryCoverage=87%, HitCoverage=9%, E-value=2e-11, Identity=84%"; Hit description=SBP
MRVNSGNTSNSPSYCNNKNAYSSVVGCPFCLLLNVLGNRDIPMVGKYACRIGRIYPPWVYDPDSFYCNA

SEQ ID NO: 124479 - protein, 69 aa, Glycine max
  Coding DNA Sequence Number=SeqID_7701
MSLLLSPSPAMLPSSLPISEQHYCFISGLLSLKSLPDPPSVLGNELTNVSEHIRGHEIALPGLLLIYSF

SEQ ID NO: 124480 - protein, 96 aa, Glycine max
  Coding DNA Sequence Number=SeqID_7702
  Subcellular localization annotation: CTP_CleavageSite=33; ConfidenceScore=5.47e-01
MRTLRPSLSALAQSLCSLLVMALLRLTHPWAKRASTAKRNFSVLSTTEEFGRASSSRLRAKHEISAPSATIVFSQAQRTTGAKLKSTYSHLARGWR

SEQ ID NO: 124481 - protein, 189 aa, Glycine max
  Coding DNA Sequence Number=SeqID_7703
CAGLREENATTARALEQEAKRARKEEYGRNKFRGALWGSNNELKLRREERDQSRAHSMVLKEELVACSRSKRSLSQRLCETETNMLAINAKYQEELGLAMAHEHRVADEYAQVYAEKEARGRVIDSLHQEATMWMDRFALTLNGSQELPRLLAKAKAMADTYSAPEEIHGLLGYCQHMIDLMAHIIRNR

SEQ ID NO: 124482 - protein, 133 aa, Glycine max
  Coding DNA Sequence Number=SeqID_7704
MGKVEEAQEQMKVDMLAMKEQMATMMEAMMSMKKIMEANAVIVAATSAVAKVNRMPPSSLNQMNHPTSAMVGKDLGSTGGPPIMRNSKQACLLTIWLASQLYTTPMWHTFPMRMSITPLPYSLKCLSTHGGGT

SEQ ID NO: 124483 - protein, 68 aa, Glycine max
  Coding DNA Sequence Number=SeqID_7705
ISKTKRVVVRNWKDNIMVDICEFYLKNDKQLPSRKGIVRVLDCLVHCSGYFSSVMLGKLRLFRFVKLR

SEQ ID NO: 124484 - protein, 41 aa, Glycine max
  Coding DNA Sequence Number=SeqID_7706
AWLSARIRPLSKLAELSLGQLSGPNQPPMQGLGAKHLRLAA

SEQ ID NO: 124485 - protein, 292 aa, Glycine max
  Coding DNA Sequence Number=SeqID_7707
  Gene Ontology: Cellular component=integral to membrane
  Homolog annotation: Hit_ID=Q3K7S3; Match level="QueryCoverage=92%, HitCoverage=67%, E-value=2e-54, Identity=46%"; Hit description =Hypothetical protein precursor
  Pfam annotation: Domain name=DUF58; Domain location=52-163; Score= -2.7; E_value=0.0078; Accession=PF01882.8; Description=Protein of unknown function DUF58
  Subcellular localization annotation: CTP_CleavageSite=38; ConfidenceScore=5.44e-01
STLEDPTVAAVAASVTAGAARTARSAGTGRAPRGCTAVAGRRVDDGAGVRPGARRLAVGVAATARAPAGGHRCHPALPSAAAAARAFPLRGRAPAHALAVAPVVAATHAAPRAGRACLSELRAAHPLRVVQCRPGLAAGRLRQLDWKATARARKLISREYQDEKNQQLLLMLDSGRRMLASEGGLSHFDHALNASLVVAYLALRQGDAAGLFAAGGERRWVAPQRGMGTVEHLLRASYDLQPRAVATDYLAAATEVSLRQRRRALVMLVSNVRDEDIEDLLAAVRLLQKRHL

SEQ ID NO: 124486 - protein, 251 aa, Glycine max
  Coding DNA Sequence Number=SeqID_7708
  Gene Ontology: Cellular component=integral to membrane
  Homolog annotation: Hit_ID=UPI00005F8711; Match level="QueryCoverage =64%, HitCoverage=85%, E-value=2e-58, Identity=66%"; Hit description =COG0004: Ammonia permease
  Pfam annotation: Domain name=DUF1097; Domain location=83-234; Score =231.7; E_value=1.6e-66; Accession=PF06496.2; Description=Protein of unknown function (DUF1097)
MAFTVVGGCGPGGGRLCLRRHFRRQRDPGKPDFAAGQPCAFAFTVLRYRLYRQLGADLVGDRGRPCRSAAGNPCAIPEQHHGMPVVGMDDVTTGILSGVWGWVAVSLGLIGWAGFLDCTAYFACPQGGLKGLLIGPMTCCNGVFWAMAIIHGNELAPQWELLGYLLTGVVAFLMCIQAKQQWLGFVPGTFIGACATFAGGGYWPLVTLSLLVGLLFGYAMKNSGLWWAARIEKARAAQTVNPNAGSNGAAE

SEQ ID NO: 124487 - protein, 154 aa, Glycine max
  Coding DNA Sequence Number=SeqID_7709
MSEIKEVQEQMKADMEVMKEKMTTMMEAMMSIRKMMEVNTTTVITASTTIEVDPTHPSSLNQVNGPTLDMVGQEGKALGSAGDPHFVQVQSKHSFPPYGLPPNYTPPNIAHALDENVDNSTPILTKNVDNNPNLVRHRSLNPWGRHMKYPETTL

SEQ ID NO: 124488 - protein, 175 aa, Glycine max
  Coding DNA Sequence Number=SeqID_7710
MTLLLSNILLSDRIANLPLQKYQLGSHPQRHPVDLKKSNRALGFPALVTGLYQSYRVPVPPRQGHVIIGIAPARHPVDPKKSNRVLELSSSNYGSLKGIRPPTNRAFIKKYCAPRQAQGETPQQPGDGRQRATDAPPSPLEFTSAHPRKGLSIAYTTWPTNRRPSPKPKDAPSCS

SEQ ID NO: 124489 - protein, 59 aa, Glycine max
  Coding DNA Sequence Number=SeqID_7711
MPYFGIKLCLISKFPEFGKLDQKVTAGEIQHLYDVITRMEKVFEQGNAIVAGVEGVECH

SEQ ID NO: 124490 - protein, 92 aa, Glycine max
  Coding DNA Sequence Number=SeqID_7712
  Gene Ontology: Mol. function=RNA-directed DNA polymerase activity; Cellular component=chromatin; Biological process=chromatin assembly or disassembly
  Homolog annotation: Hit_ID=Q2HRM7; Match level="QueryCoverage=84%, HitCoverage=12%, E-value=1e-23, Identity=64%"; Hit description =Polynucleotidyl transferase, Ribonuclease H fold
MRWVVTFLVPKKDDKCTFCVDSVVFLAFVVSKNGVHVDAEKIKAIQEWTTPKSVGDIRSLHGLTSFYRWLVPNFSTLASPLNELVKKNVAFT

SEQ ID NO: 124491 - protein, 187 aa, Glycine max
  Coding DNA Sequence Number=SeqID_7713
  Homolog annotation: Hit_ID=Q1SKD7; Match level="QueryCoverage=72%, HitCoverage=36%, E-value=1e-13, Identity=33%"; Hit description =Ankyrin
MAPRKLASKRSRKDKAAEGTSSAPEYDSHRFRSAVHQQRFEAIKGWSFLRERRVQLRDDEYTDFQEEIGRRRWAPLVTPMAKFDPEIVLEFYANAWPTEEGVRDMRSWVRGQWIPFDADAIGQLLGYPLVLEEGQEWEASANHAHQHDHPDPDMDDGCSSATSCPPIIIPTFPCRSGQLGVRHPDTG

SEQ ID NO: 124492 - protein, 72 aa, Glycine max
  Coding DNA Sequence Number=SeqID_7714
MSSIFGPDVLDIVSDIVDPAASILHLTFILPSSIFGQDVLDIVSDIVDPAASMLLAIPVFSSRMSWTLYPTS

SEQ ID NO: 124493 - protein, 70 aa, Glycine max
  Coding DNA Sequence Number=SeqID_7715
IMAHSPDKIKSIDGSKETLKLSVRISDLWFIGTPNKSEQAEMVFVDFDEVVFRQVSGKGRRVVFKLKDLR

SEQ ID NO: 124494 - protein, 70 aa, Glycine max
  Coding DNA Sequence Number=SeqID_7716
  Homolog annotation: Hit_ID=Q6K4D4; Match level="QueryCoverage=66%, HitCoverage=5%, E-value=2e-10, Identity=65%"; Hit description =Proliferating-cell nucleolar protein-like
MREGSFAPCVFWISSEGLPLILSYITKQILHASPADFKQLLQNREVKFEDFTDVAGIARLIKTLHPDWSP

SEQ ID NO: 124495 - protein, 372 aa, Glycine max
  Coding DNA Sequence Number=SeqID_7717
METENCETFGTTSLDTTSVGIVGHYKFENGSSQFAFMKVENERGVSLDHSLSFSTENFVQTLAFCNSLILMSGFSGDKSCYHVLNPFTKHNVMIPQTSIQGGVVRVGLAYDGDQFFDVVLVEAGSSNSNGLKLHVFSSETGQWRCHYPINLAAAPSLPEHEFQELGTPPLYANGAIHWEIDGYLLVYQVQGSQCALYELPNYFEGWSWQSTLPYRRCLCESGGKVYYCYSDFDGFHIWNLLNEQDHLEFFNYYDYKRFPWKLVHSVMHEVLMPKNQNFFGSFFDWEPYKVAPIAYIEEAQIIYLQLPGTVVAYNFDTGTMESICNYSYPGLNFSCCSFFSSTTTLPHNAQRDNTDGELELNLPIAEMEKLTL

SEQ ID NO: 124496 - protein, 121 aa, Glycine max
  Coding DNA Sequence Number=SeqID_7718
  Gene Ontology: Cellular component=membrane
  Homolog annotation: Hit_ID=P0AFV4; Match level="QueryCoverage=98%, HitCoverage=63%, E-value=7e-38, Identity=68%"; Hit description =Lipoprotein spr precursor
MVKSQPILRYLRRIIPAVALATLLSACSSTHNGQNANNENHEVNNQNGFLLQASQDEFEQMVQNVDVKSRIMEQYSDWKGVRYRLGGDTKRGIDCSAFVQRTFREQFGLELPRSTSEQQDS

SEQ ID NO: 124497 - protein, 126 aa, Glycine max
  Coding DNA Sequence Number=SeqID_7719
MAAEWRSKRERRRHFKEKMSLEEAHHHRRPWIRAWRKKEMNEGRGREEHKILCSKRALKSKIIGPNLGPWAQKSTLRFMRTLGPSSAALAQSFWSLLLMALVTSPFLGRIASIRRSEGNTLVDSKG

SEQ ID NO: 124498 - protein, 114 aa, Glycine max
  Coding DNA Sequence Number=SeqID_7720
MEPHVAQPHPRTPNAAPTRPMPDYTSHIQDREVATKESSYLLELPQNPLWDQITSTNINHLQMIRLLPNRINRANTPQRLPPSCKLCGSHMTIDHKEMSVQLLPRRTPCSDLDH

SEQ ID NO: 124499 - protein, 1069 aa, Glycine max
  Coding DNA Sequence Number=SeqID_7721
  Gene Ontology: Mol. function=metalloexopeptidase activity; Cellular component=chromosome; Biological process=proteolysis
  Homolog annotation: Hit_ID=Q1S4Z9; Match level="QueryCoverage=98%, HitCoverage=98%, E-value=0.0, Identity=79%"; Hit description =Peptidase M24
  Pfam annotation: Domain name=Peptidase_M24; Domain location=205-446; Score=-17.8; E_value=9.6e-07; Accession=PF00557.14; Description =metallopeptidase family M24
  Pfam annotation: Domain name=Rtt106; Domain location=849-1007; Score =95.5; E_value=1.6e-25; Accession=PF08512.2; Description=Histone chaperone Rttp106-like
  Pfam annotation: Domain name=SPT16; Domain location=555-709; Score =262.5; E_value=8.6e-76; Accession=PF08644.1; Description=FACT complex subunit (SPT16CDC68)
  Pfam module annotation: Pfam domain module=Peptidase_M24::Rtt106::SPT1 6; Domain location=205-446::849-1007::555-709
MADHRNGSTQPPNGKASAAGSAYSIDLNAFQSRLKYFYKHWDDHKTDLWGSSDAIAIACPPPSEDLRYLKSTALNLWLLGFEFPETIMVFMKKQIHILCSQKKASILESVKKSAKEAVGADLVLHVKPKNDDGTALMDAIFRAIRALPKSDGHDSSTVGYISREAPEGKLLETWTEKLKNTKFQLTDVANGLSYLFAAKSNEELTSIKRAAYLTTSVMKNFVVTKLENVIDEEKKISHSTLMEETEKVILEPSKVNCKLKADNVDICYPPIFQSGGEFDLKPSAVSNDELLHYDSASVIICAVGARYKSYCSNIARTFLIDADPLQSRAYEVLLKAHEAVIGSMKPGNKLSVAYQAAVSVVERDAPDLISYLTKSAGTGIGIEFRESGLNLNAKNEQIIREGMVFNVSLGFQNLQCEKSKSKNKQFSLLLADTVIITKDKTEIVTATSSKALKDVAYSFNEDEEEERPSTKPDAKKAEPFMSKTTLRSDNHEVSKEELRRQHQAELARQKNEETARRLAGGGSETGESRSSARTSAELMAYKNINDLPPPREMMIQIDQKNEAVLLPINGSMVPFHVAFIRTVSSQQDTNRNCYVRIIFNVPGTPFSPHDANSMKFPGSIYLKEASFRSKDSRHISEVVQSIKTLRRQVVARESERAERATLVTQEKLQLANNRFKPIRLSDLWIRPAFGGRGRKIPGTLEAHVNGFRYSTTRQDERVDIMFPNIKHAFFQPAENEMITLLHFHLHNHIMVGNKKTKDVQFYVEVMDMVQNVGGGKRSTYDPDELEEEQRERQRKNKINVEFQTFVNRVNDLWGQPQFNGLDLEFDQPLRELGFPGVPHKSSVFIVPTSACLVELIETPFLVVTLSEIEIVNLERVGLGQKNFDMTVVFKDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDDDDEDSEEDSEEEKGKTWEELEREASNADREKGNESDSEEDRKRRKAKSFVQLFYAVAAVSSFLCLDFGA

SEQ ID NO: 124500 - protein, 129 aa, Glycine max
  Coding DNA Sequence Number=SeqID_7722
MASLGLSQQFTVVEPVIPYESTKRSCVAANPSGDDMAIGKVYNLGSTIHHKKIEDNNVRVVVEEVRDVDALVPFLTDEVETMGHAPNHFIQWLRSLVKSISAKCMEECSKDVSHKRLKPQVDPLDIYSW

SEQ ID NO: 124501 - protein, 79 aa, Glycine max
  Coding DNA Sequence Number=SeqID_7723
MTLGRVRTVRVRVRDKVFGGSVAMEGFRSTCNDLIHVVTEKRECHRRGFDSRCHGERETPAMKIQKLKSQKEFEGFARN

SEQ ID NO: 124502 - protein, 195 aa, Glycine max
  Coding DNA Sequence Number=SeqID_7724
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q9I2U4; Match level="QueryCoverage=99%, HitCoverage=45%, E-value=6e-46, Identity=55%"; Hit description =Probable two-component sensor
MAGGQAAARAVIRPVGGGRGVFGAGPAAVRLHAGVGAADLARPGSPQDGGVAHGAGRPAGPGPPVATFQHRQPGGHFQPDVRAHRRADQQPARTDQRGLARAAHADRAPVVRTGHDRPGGRAARAQAPDRRHEKRRRRTGQHGFRTADVRPPGAQGRRRHPAAAGRPQLARFGLCSTPRSRPEQSGVRCEVVLCQ

SEQ ID NO: 124503 - protein, 269 aa, Glycine max
  Coding DNA Sequence Number=SeqID_7725
MVIDQSLFYDLTQLSSDGVSFEGALDDDWKFDFSVHDACRLVCTNQTDMTGRLLASSLALESCILHYLIVRILLPRSSNLAQVSKEDLIVMWAIHTGRQIDWAHLVRYHMHKALRLNAPLPYPQLVTLSLQHFNIPLDSEPYVPIKRSFLIGAAMVASFGYRKERDGSWVKKDAQPNDDEGHLPAEGDSSLLQSILYKFDGLQTYVCERFVIIKKGEIVEASFMMMNQAILMMPKAQVIDSRLQDQESRIQSKIQDSREEIKKQQIKTS

SEQ ID NO: 124504 - protein, 280 aa, Glycine max
  Coding DNA Sequence Number=SeqID_7726
  Gene Ontology: Mol. function=oxidoreductase activity; Cellular component=membrane; Biological process=metabolic process
  Homolog annotation: Hit_ID=Q7NZ76; Match level="QueryCoverage=89%, HitCoverage=99%, E-value=2e-71, Identity=57%"; Hit description =Oxidoreductase ucpA
  Pfam annotation: Domain name=KR; Domain location=36-205; Score=-32.8; E_value=1.9e-05; Accession=PF08659.1; Description=KR domain
  Pfam annotation: Domain name=adh_short; Domain location=33-202; Score= 130.0; E_value=6.7e-36; Accession=PF00106.15; Description=short chain dehydrogenase
  Pfam module annotation: Pfam domain module=KR::adh_short; Domain location=36-205::33-202
MGQARKRSAGRREARHRGGHFTTGTTTMRLNNKIALITGASAGIGRASALRFAAEGAKLVLNARRPEPLQALAEQIRAAGGEAVVHAADVADPGTAQALVDLAQQSFGGLDIALNNAGMLGPGVPAAEFPMDAWREVMATNLDAAFHAARVQLPALLARGGGSLVFVGTFVGHTVGFPGMAAYASSKAGLIGLSQVIAAEYGARGVRSNVLLPGGTDTEMGRQAAPTGDARDFVRSLHALKRMAEPEEIANAALFLASDESSFVTGTAMRVEGGVSITRT

SEQ ID NO: 124505 - protein, 504 aa, Glycine max
  Coding DNA Sequence Number=SeqID_7727
  Gene Ontology: Mol. function=epoxide hydrolase activity; Cellular component=membrane; Biological process=aromatic compound metabolic process
  Homolog annotation: Hit_ID=Q390B5; Match level="QueryCoverage=54%, HitCoverage=93%, E-value=1e-114, Identity=70%"; Hit description =Alpha/beta hydrolase
RGSPHDEVAAARHDAAAHVVGVRLQGQHRRIGGGVLGADGQHRHRQPALCTFLVLADGFRDRAVPGEAGPQCAGAAVGGDVGVGSHRVTAVRPAVEHELQVGAFAATDQCFGQVRDLVEHEVPEEDVVGRGSEDARFRRQAGNHRFGNRQLAHRLRLVAGQCIGNPHTDVMSDYLVALVAQRLHGLVQDGGGTAGVVAVAGAIGFADARRIDRDGFEAGFGQGVQHMAPGVPGLRPAGNQQYGFTVTRGHAMHALAVDAQVMVAQGSVAGSASGKRSGHEGVLRWGSGDAEHLLHLRGADRCTGEVVEDLVGDRNDVVVDECSAFARAGFLVLQAALPFQRRPALVVVLGQLGEDRLEVDLAVAQRAEAAGALGPVGVAAIDALAAAGAELRILDVEHADQRVVDVEVLQVVELLQHEVAGIKQDAAALVLADALEEALEAGAVVQVFAGMDLVAEVDAIVLAAVENRPPAAGQFIEGGIDQARRALREREQVGPGERAGEGAH

SEQ ID NO: 124506 - protein, 107 aa, Glycine max
  Coding DNA Sequence Number=SeqID_7728
  Gene Ontology: Mol. function=transcription factor activity; Biological process=regulation of transcription, DNA-dependent
  Homolog annotation: Hit_ID=Q390B3; Match level="QueryCoverage=98%, HitCoverage=52%, E-value=8e-24, Identity=50%"; Hit description =Transcriptional regulator, TetR family
MLREAVMTYTRRGRPHGCLVVSSASSVSPDGEGVRDWLASHRRQRTAAIIARLQQAQAEGELADDAEVQALGDHFATVLHGISVQARDGISRERLLAMVDVALTPLP

SEQ ID NO: 124507 - protein, 387 aa, Glycine max
  Coding DNA Sequence Number=SeqID_7729
  Gene Ontology: Mol. function=metalloexopeptidase activity; Cellular component=chromosome; Biological process=proteolysis
  Homolog annotation: Hit_ID=Q1S4Z9; Match level="QueryCoverage=99%, HitCoverage=35%, E-value=1e-158, Identity=72%"; Hit description =Peptidase M24
  Pfam annotation: Domain name=Peptidase_M24; Domain location=205-385; Score=-86.6; E_value=0.027; Accession=PF00557.14; Description =metallopeptidase family M24
MADHRNGSAQAANGTAQAAGTAYSIDLNAFQTRLRSFYQHWDAHKTDLWGSSDAIAVACPPPSEDLRYLKSTALNLWLLGFEFPETIMVFTKKQIHILCSQKKASILESVKKSAREVVDADLVLHVKPRNDDGTALMDAIFRAIRALSKSDGRDTPTVGYISREAPEGKLLEMWTEKLKNTKFQLNDVANGLSSLFAAKNNEELTSIKRAAYLTTSVMKNFVIPKLENVIDEEKKVSHSTLMEDTEKAILEPSKVNCKLKADNVDICYPPIFQSGGQFDLKPSAVSNDELLHYDSASVILCAVGARYKSYCSNIARTFLIDADPLQSRAYGVLLKAHEAVIGSLKPGNRLSAAYEAAVSVVENDAPDLISYLTKSAGTGIGIEFRES

SEQ ID NO: 124508 - protein, 64 aa, Glycine max
  Coding DNA Sequence Number=SeqID_7730
MQQQQERVRDKALRRPRFKIEHLQVHQEGKKLKRLLTILQPLWVLKCLEVVQEGGIIILGLGSR

SEQ ID NO: 124509 - protein, 39 aa, Glycine max
  Coding DNA Sequence Number=SeqID_7731
GKASILAKPGVKLEIPDGAVIADKFGRGKNKKAVSTEHV

SEQ ID NO: 124510 - protein, 157 aa, Glycine max
  Coding DNA Sequence Number=SeqID_7732
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=94%, HitCoverage=18%, E-value=9e-39, Identity=60%"; Hit description =Lipoxygenase-4
AAMGAFDGIIDTVSAVHPLLPLIGLLKSHGKIVMVGAPEKPLELPVFPLLAGKHPITAKKETRIDLTVIEILSRHASDEFYLGQRDGGDYWTSDAEPLEAFKRFGKNLEEIENKLIEKNNDETLRNCYGPAKMPYTLLYLSSEEGLTFRGIPNSISI

SEQ ID NO: 124511 - protein, 76 aa, Glycine max
  Coding DNA Sequence Number=SeqID_7733
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=72%, HitCoverage=29%, E-value=1e-20, Identity=83%"; Hit description =Anaphase-promoting complex subunit 10
  Pfam annotation: Domain name=APC10; Domain location=1-76; Score= -66.3; E_value=0.0014; Accession=PF03256.7; Description=Anaphase -promoting complex, subunit 10 (APC10)
MGAETFVDAQSSKLSTLPVNKLIVLYMVFKLDESYTPSKVSIRAGDGFHNLKEIKTVELVKPTGWVYLSFSGVDPR

SEQ ID NO: 124512 - protein, 103 aa, Glycine max
  Coding DNA Sequence Number=SeqID_7734
MMQSYPVRALGRRLQVDWARDPREGPRVLMSLRLSSSFFRNLLKEASQGGEPSYERASSPSFLSKAHLGGEAPSSMAYSLVDGASSPLFSFVFRCISMVENHH

SEQ ID NO: 124513 - protein, 371 aa, Glycine max
  Coding DNA Sequence Number=SeqID_7735
  Gene Ontology: Mol. function=UTP:glucose-1-phosphate uridylyltransfera se activity; Cellular component=cytoplasm; Biological process =metabolic process
  Homolog annotation: Hit_ID=Q9LKG7; Match level="QueryCoverage=100%, HitCoverage=85%, E-value=1e-171, Identity=77%"; Hit description=UTP-- glucose-1-phosphate uridylyltransferase
  Pfam annotation: Domain name=UDPGP; Domain location=31-370; Score =610.1; E_value=2e-180; Accession=PF01704.8; Description=UTP--glucose- 1-phosphate uridylyltransferase
MATATLSPADADKLSNLKSSVAALSQISENEKNGFTSLVARYLSGEAQHVEWSKIETPTDEVVVPYDSLAPTPDGSLEVKNLLDKLVVLKLNGGLGTTMGCTGPKSVIEVRDGLTFLDLIVVQIENLNSKYGSNVPLLLMNSFNTHDDTQKIVEKYKNSNIEIHTFNQSQYPRLVVDDFLPFPSKGQTGRDGWYPPGHGDVFPSLVNSGKLDVLLSQVTPKTLADVKGGTLISYEGRLLEIAQVPDEHVSEFKSIEKFKIFNTNNLWVNLKAIKRLVEADALKMEIIPNPKEVDGVKVLQLETAAGAAIRFFDKAIGINVPRSRFLPVKATSDLLLVQSDLYTLQDGLVIRNQARANPENPSIELGPEFKK

SEQ ID NO: 124514 - protein, 390 aa, Glycine max
  Coding DNA Sequence Number=SeqID_7736
  Gene Ontology: Mol. function=nucleic acid binding
MGHWSMSAVNSVSGKRMIVICCLCAKIGLADPEKEVHVYLENVDPERGHVNELGPVIEAHAMPINYSAEDVAEAVVKECTHNGIEDMDVDGVKSGSNDENEVVETGVQDAETEVVETGVEIEPEVVGVEIEVNNGAYDDEVKEHDGDVEFSDHSKSDPNYVYVSAEDDGQSSDALVDSYQSEEFQSLPNNDDEGDSNYKIVYPQYDPRSRVADKLRFHPNLNHVEAHEHLREHYGVHIDERKMFRTIKEARSLIEGSIQLQCAKLWDYSHELTRSNEGSTKGFKASCRPFIGLDGCFLKGYYGGHLLPVVGQDANNAFFVIAYVVVNVEDKDNWKWFLTLLHEDIGDYMQYGWNFMSNIQKGFLSTMQEVMSSVKHRYCVMSLWRNFSKQ

SEQ ID NO: 124515 - protein, 137 aa, Glycine max
  Coding DNA Sequence Number=SeqID_7737
  Gene Ontology: Mol. function=DNA binding
  Homolog annotation: Hit_ID=Q1SYZ1; Match level="QueryCoverage=52%, HitCoverage=21%, E-value=8e-26, Identity=77%"; Hit description=Myb, DNA-binding; Calcium-binding EF-hand
MKRKKWSELEEQILLSKYSELLRSGTLAKLKTREKKFKLVAEHVNAVHHLLDLASFPFKWLWHDVSIKVRRLDSVVELREVVVKCEERQREREFHQKKVEAEWERKRREAEGVVGGLGDGVGGATVKVGQEGAGEEA

SEQ ID NO: 124516 - protein, 269 aa, Glycine max
  Coding DNA Sequence Number=SeqID_7738
  Gene Ontology: Mol. function=DNA binding; Cellular component=nucleus; Biological process=regulation of transcription, DNA-dependent
  Homolog annotation: Hit_ID=Q0PJI0; Match level="QueryCoverage=77%, HitCoverage=72%, E-value=2e-94, Identity=84%"; Hit description=MYB transcription factor MYB173
  Pfam annotation: Domain name=Myb_DNA-binding; Domain location=89-134; Score=58.0; E_value=3e-14; Accession=PF00249.21; Description=Myb-like DNA-binding domain
MHGDCRYGWEIWERATFENEIVKVWEMKYNLETKKFREGNFGSGGPPEGGGVSLSSGHSVTHIQLNDQFSCGNDYALKVRKPYTITKQRERWTDEEHKKFLEALKLYGRAWRRIEEHVGTKTAVQIRSHAQKFFSKVLHDPTGNNTNTVESIEIPPPRPKRKPMHPYPRKLVETPNKEISIPEQPMKSNSLKSSDFDQENQSPKSVLSGVGSDSLGSSDSDTPNGSLSPMSSISGFHTSSFTRAKPKTTTSEEEAGMDTDSTHDEKPLM

SEQ ID NO: 124517 - protein, 369 aa, Glycine max
  Coding DNA Sequence Number=SeqID_7739
  Gene Ontology: Mol. function=protein binding; Cellular component =cytoskeleton; Biological process=signal transduction
  Homolog annotation: Hit_ID=Q2HSQ0; Match level="QueryCoverage=70%, HitCoverage=80%, E-value=1e-79, Identity=59%"; Hit description =Ankyrin
  Pfam annotation: Domain name=Ank; Domain location=150-182; Score =22.0; E_value=0.0022; Accession=PF00023.20; Description=Ankyrin repeat
  Pfam annotation: Domain name=Ank; Domain location=183-215; Score =29.1; E_value=1.5e-05; Accession=PF00023.20; Description=Ankyrin repeat
  Pfam annotation: Domain name=Ank; Domain location=216-248; Score =33.8; E_value=5.9e-07; Accession=PF00023.20; Description=Ankyrin repeat
  Pfam annotation: Domain name=Ank; Domain location=249-281; Score =34.7; E_value=3.3e-07; Accession=PF00023.20; Description=Ankyrin repeat
  Pfam annotation: Domain name=Ank; Domain location=282-321; Score=1.9; E_value=17; Accession=PF00023.20; Description=Ankyrin repeat
  Pfam module annotation: Pfam domain module=Ank::Ank::Ank::Ank::Ank; Domain location=150-182::183-215::216-248::249-281::282-321
SLESGNTALIDSKAVCGFRHRRDAAAVWNWKTVAVVAPSQHALSIGAIKSYKDVSYFQTEQVGSWEDPDTGSDSECDDEEYEEVEDENFGFESDSEEEGMKASVATDVNITSGDNYEELIKKEIEQLLEPEERAILQQNITPNLEKISTEKWSPLHTLVLSMQMSCVDKLLENGVDIDLPDKEGLTALHKAITGKKEAVISHLLRRGASPHVKDKDGAAPLHYAVQVGAKMTVKLLIKYKADVNVEDNEGWTPLHIAIQSRNRDIAKILLVNGADKTRKNKDGKTALDLSLCYGKDFKSYDLAKLLKTTTDCGRQHHERSCEGKELRSCDEARMRRRQTIDDGVTREAARRRNLGAASLRLSENEKTTD

SEQ ID NO: 124518 - protein, 86 aa, Glycine max
  Coding DNA Sequence Number=SeqID_7740
GVVLAEVLLADSRFTRPDMGFHPTKLNFVPSDADEAPLDVSICLHAFGIVGCGSFSGVKSCEREDPFHPGLFVGDAGGFQSPTREP

SEQ ID NO: 124519 - protein, 476 aa, Glycine max
  Coding DNA Sequence Number=SeqID_7741
  Homolog annotation: Hit_ID=Q7XDI4; Match level="QueryCoverage=89%, HitCoverage=43%, E-value=3e-80, Identity=40%"; Hit description =Expressed protein
  Pfam annotation: Domain name=DUF810; Domain location=50-476; Score =171.9; E_value=1.6e-48; Accession=PF05664.2; Description=Protein of unknown function (DUF810)
MAHLFRDLSLGHSKRDSTPPLPPPPIMPPKPAAVTAADDLPSPLGQLSASLSDSDLALTAYEIFVAACRTSSGKPLSSAANHSSTNSPSQNSPNSPALQRSITSTAASKVKKAFGLKSPGSASRKSPGSGSGQGKPKRPLTVGELMRNQMRVSEAMDSRVRRALLRISAGQVGRRIESVVVPLELLQQLKASDFTDQQEYDDWQKRTLKVLEAGLILHPHMPLDKSNSAVQRLRQIVHAALDKPIETGKNTESMQVLRSAVMSLANRSYDGSYVDSCHWADGIPLNLRLYEMLLQSCFDANDESSIIEEFDELMEQIKKTWGILGLNQTLHNLCFTWVLFHRFVVTGQLDLDLLSAADGQLAEVAKDAKTTKDAEYSKVLSSTLTSIMGWAEKRLLAYHETFDRGNVETMQGIVSLGVAAAKILVEDISNEYRRRRKNEVNVARERIETYIRSSLRTAFAQASSFCFPLAFPFSKR

SEQ ID NO: 124520 - protein, 477 aa, Glycine max
  Coding DNA Sequence Number=SeqID_7742
  Homolog annotation: Hit_ID=Q7XDI4; Match level="QueryCoverage=95%, HitCoverage=45%, E-value=1e-66, Identity=32%"; Hit description =Expressed protein
  Pfam annotation: Domain name=DUF810; Domain location=1-477; Score =325.1; E_value=1.3e-94; Accession=PF05664.2; Description=Protein of unknown function (DUF810)
MEKADSSRRASKNQPNALPGLVILAKDVGSLAVNEKQVFSPILKRWHPLAAGLAVATLHACYGNELKQFISGITELTPDAVQVLRAADQLEKDLVQIAVEDSVESEDGGKAIIREMPPYEAEGAIANLVKIWIKTRIDRLKEWVDRNLQQELWSAQANQEGYAPSAVEVLRIINETLDAFFQLPIPMHPALLPEVMNGLDRCLQYYVIKAKSGCGSRNTFLPTMPALTRCTIGSKFQGFGKKKDKSPNPQKRNPQVATNGDSSSGIPQLCVRINTLQWILGEFDVLEKRIITLLRNSESAHVEDFSNGLAKKFELSPAACLEGIQQLCEAAAYRIVFHDLSQVLWDGLYVGDPASSRIEPFLQELERKLMFISDTVHERIRTRIITEIMRASFDGFLLVLLAGGPSRSFTRKDSQIIEDDFKFLKELFWANGDGLPSELIDKFSTTARSILPLFRTDTETLIEQFKRLTMETYKSSA

SEQ ID NO: 124521 - protein, 316 aa, Glycine max
  Coding DNA Sequence Number=SeqID_7743
  Gene Ontology: Mol. function=DNA binding
  Homolog annotation: Hit_ID=Q1S0F5; Match level="QueryCoverage=90%, HitCoverage=61%, E-value=5e-38, Identity=34%"; Hit description=IMP dehydrogenase/GMP reductase
MGTNQNGKRFYQVKVKGLDVTSLKELGRLMGPLQRKAFCKVYGKILDLITAEVFTEAVVSLAQYYDQPLRCFTFGDFQMVPTIEDKIAAMVRDSAKELDRMKQTRNGVVGLPRKYLEGKARDMASQEKWGPFADILALLIYGVVLFPNVDGLVDLAAIDAFLAYHHSKESPVVAILADLFDTFDRRCEKNSARVVCCLPALSVWLVSHLFQQDTRHPCPLQSYRSCVENGRVDWDQHLARIGGSAINWFPRWKEGKEGVLFSCGDYPNVPLIGTRSCINYNPALAIRQLGYPMRGAPTEGSLSTFLVRDLGAQGLK

SEQ ID NO: 124522 - protein, 327 aa, Glycine max
  Coding DNA Sequence Number=SeqID_7744
  Gene Ontology: Mol. function=DNA binding; Cellular component=nuclear pore; Biological process=DNA integration
  Homolog annotation: Hit_ID=Q1SDN3; Match level="QueryCoverage=98%, HitCoverage=37%, E-value=2e-88, Identity=61%"; Hit description =Polynucleotidyl transferase, Ribonuclease H fold
MNAEIEALEANHTWILTDLPPNKSAIGCKWVYKIKHKVDGSVERYKARLVAKGCTQIEGQDYLDTFSPVAKITTEAKPISTPIDYAVRLHQQSGTPLDDTTASSYRRLIGRLIYLTNTKPDITYAVQHLNQFVAHPSSAHQQAAYRILRYLKAAPGSGIFFPASSTLHLRAFSDSDWAGCVDTRRSITGYSVYLGNSLISWKSKKQATVSRSSSEAEYRALASATCELQWLTHLLNDFGIVYTQPTLLFWDNRSALHIAANPVFHECTKHIEIDYHIVREKLHSGLIKLLPIASVQQLADIYTKALPPGAFHFLQCKLGMSDIHSPA

SEQ ID NO: 124523 - protein, 92 aa, Glycine max
  Coding DNA Sequence Number=SeqID_7745
MTNERRTAENLRENPHGNLTEAPRLGFSSQNQFFFTIFKKMGEMLATQLAKASKVTSSRSNRLREESSGGPKWAWLLFAPPFSLNTPLPFFW

SEQ ID NO: 124524 - protein, 89 aa, Glycine max
  Coding DNA Sequence Number=SeqID_7746
MSEWTHPVNIYLILKVERKDIELVEEEEARIGADSSSATSNKSEIYKEEAGNVAQKHKAKRVESVNVDAKAFGDHWKVQIALCILKLKH

SEQ ID NO: 124525 - protein, 130 aa, Glycine max
  Coding DNA Sequence Number=SeqID_7747
MTENKKEDRGRVQVVIGLLCVDPNADSGSAGFEIEAKNKVKIKDSTTKSPTSVLEDELFYGTTSCALKEEVKLEKEVTADVKDDGTSLISKTMVEEDNLIEARMKEEEVQYEEALDLNSTQFNKLDELLT

SEQ ID NO: 124526 - protein, 79 aa, Glycine max
  Coding DNA Sequence Number=SeqID_7748
  Homolog annotation: Hit_ID=Q9SHS7; Match level="QueryCoverage=48%, HitCoverage=5%, E-value=8e-13, Identity=82%"; Hit description =Serine/threonine-protein phosphatase BSL3
MVGNFIHVNSSQFKNERTELPVYACLAGATADVHCYDVLNNKWSRITPFREPPTPRVAHVAINCYRNYGGCSGSMEIIS

SEQ ID NO: 124527 - protein, 48 aa, Glycine max
  Coding DNA Sequence Number=SeqID_7749
MATNPHETLTLKHWSELAHGRELVVMMVQWLLREVMVTEWEFEENFEF

SEQ ID NO: 124528 - protein, 64 aa, Glycine max
  Coding DNA Sequence Number=SeqID_7750
MERLRDWRLEWEARNDKSLREPNRAFWERSREVNVKENLEWEKGGMAAGPESYINSNEIAQIDF

SEQ ID NO: 124529 - protein, 72 aa, Glycine max
  Coding DNA Sequence Number=SeqID_7751
MPHIFQGCQVEYVKYNTTQRGRGETKWRLLTKKMRGVATNVYSRKMLEKPKMQRSTYFENEGSGVVYARGNY

SEQ ID NO: 124530 - protein, 211 aa, Glycine max
  Coding DNA Sequence Number=SeqID_7752
MKRGDKDKGGGEMWEAGDKSRHPNKYTVIDNHFVQYFNHLTNVFSYSFLMSSTVKLNGVQTKGQETEHNNISEINVRVYNLAQKVPTMMGFGTRGLFKNPDRRIVPPAPSTSKARTTILPLNRALALVGSSYHRSTPQPPPVNKAFCDIEPIYTFEGTYDKHLGCRQGNYWYFMCFKPVAQKSIVLRKGPKRPLREKLTLMQCQSEWDIEK

SEQ ID NO: 124531 - protein, 79 aa, Glycine max
  Coding DNA Sequence Number=SeqID_7753
MILSRVVLEIVSGLKAVDFRQPEVLLVNKVDEFEVRKRPLEALAYMGLNGEYNLKELMRLLKKVPGQSLNDINQLQHVR

SEQ ID NO: 124532 - protein, 63 aa, Glycine max
  Coding DNA Sequence Number=SeqID_7754
  Gene Ontology: Mol. function=metal ion binding; Cellular component =intracellular
  Homolog annotation: Hit_ID=Q306K1; Match level="QueryCoverage=71%, HitCoverage=73%, E-value=2e-21, Identity=77%"; Hit description=LIM domain protein
  Pfam annotation: Domain name=LIM; Domain location=10-63; Score=26.8; E_value=4e-06; Accession=PF00412.12; Description=LIM domain
MAFAGTTQKCMACDKTVYLVDKLTADNRVYHKACFRCHHCKGTLKIILPFLIGKLLVFLAVMD

SEQ ID NO: 124533 - protein, 125 aa, Glycine max
  Coding DNA Sequence Number=SeqID_7755
MLLALHPNKFLDSLCKKPPGSMDEQCEQAKGSRWKKCPEQAKRSAYQGRFPQVEQEAQARQAPTSLQRAQVQALHTTNTQSHHDSRGSFQPGGERVKTRGYMDLMTTFGQASSLGASPSNIYWLT

SEQ ID NO: 124534 - protein, 94 aa, Glycine max
  Coding DNA Sequence Number=SeqID_7756
MVLTPTPSLKSDISTSNTRNDVESASYYVGVYVSTDLEGAGYYVTTYVSTDLESADYYVTTYVSTDLESAGYYVGPNIITDPPFYISGLDGTDV

SEQ ID NO: 124535 - protein, 68 aa, Glycine max
  Coding DNA Sequence Number=SeqID_7757
MEMSVAGEIVVLLLETYVPGFRPPLWCLPRHQPRRSRGGPSFNTAPLLLPRVSLNQFLWLSEASISSG

SEQ ID NO: 124536 - protein, 75 aa, Glycine max
  Coding DNA Sequence Number=SeqID_7758
  Subcellular localization annotation: CTP_CleavageSite=49; ConfidenceScore=5.23e-01
MPPILLALSSSSCVYPLHPKVVLHRSLLFSIALKTVTARLLVVRFTAIVAAIVDVGFECRGDRRIVPPVPSTSKA

SEQ ID NO: 124537 - protein, 280 aa, Glycine max
  Coding DNA Sequence Number=SeqID_7759
MEIVAHAVVVGVFVCLDLLLFFYLLPSCAALLDVFRVLVMIGEKLALVWLVLLVRLVEIDLGMRFAWLVQDISSIWIPWLVHTARPCYQEHGMQHYLKIEILDLHGCTPKFVHELSEGLVICLSQTDLGGRCHVVRPPSSVLCMESFDEGVKAIYGPRFACVKKASRCSSGSVVSSYHSRLSGFHLKGSDHLQCCLCIGSVIPLWCVQASWFRVFMPIIVFGQGLESVRGVSRLRSDPLLTMDKYERIDERPWVSNFIRRLGEVPLIGGETCKIRTLALK

SEQ ID NO: 124538 - protein, 106 aa, Glycine max
  Coding DNA Sequence Number=SeqID_7760
MVKINILFFDWFHAYTIRENLDYPWKQDIIGDLTTNVITNWQIKDGVLIQLELPPATQYQLSKVKDSNDKPVMATPFKTKDVNEEVTSKAIKSPMEQANYTNKYLQ

SEQ ID NO: 124539 - protein, 125 aa, Glycine max
  Coding DNA Sequence Number=SeqID_7761
MTRSKTIQEDYKEKKDSPPKVTDDFLTKEDQELKENEVPTDGNPVPKKEGDEKEILTSPEVNMEADEDVPIILEQPFLSTSDFLVEVSVEARYFDDAKGSSASQVLFKTRIQESKKIKIYDQVDL

SEQ ID NO: 124540 - protein, 84 aa, Glycine max
  Coding DNA Sequence Number=SeqID_7762
  Gene Ontology: Mol. function=metal ion binding
  Pfam annotation: Domain name=PHD; Domain location=6-54; Score=1.4; E _value=0.041; Accession=PF00628.19; Description=PHD-finger
  Pfam annotation: Domain name=zf-C3HC4; Domain location=7-51; Score =11.3; E_value=0.011; Accession=PF00097.15; Description=Zinc finger, C3HC4 type (RING finger)
  Pfam module annotation: Pfam domain module=PHD::zf-C3HC4; Domain location=6-54::7-51
MEEGATCPVCLEEMGKEQNLVACGTCRNPIHEECLMKWKRTKGRSASCVICRARWRDRVEQDEYLNLSAYVGEDDVEQPDVCTC

SEQ ID NO: 124541 - protein, 562 aa, Glycine max
  Coding DNA Sequence Number=SeqID_7763
  Gene Ontology: Mol. function=ubiquitin-protein ligase activity; Cellular component=cell surface; Biological process=protein modification process
  Homolog annotation: Hit_ID=Q1H8M4; Match level="QueryCoverage=97%, HitCoverage=96%, E-value=1e-168, Identity=54%"; Hit description =Regulator of chromosome condensation family protein
  Pfam annotation: Domain name=RCC1; Domain location=158-208; Score =0.3; E_value=0.66; Accession=PF00415.9; Description=Regulator of chromosome condensation (RCC1)
  Pfam annotation: Domain name=RCC1; Domain location=219-268; Score =18.3; E_value=0.0075; Accession=PF00415.9; Description=Regulator of chromosome condensation (RCC1)
  Pfam annotation: Domain name=RCC1; Domain location=279-329; Score =11.9; E_value=0.036; Accession=PF00415.9; Description=Regulator of chromosome condensation (RCC1)
  Pfam annotation: Domain name=RCC1; Domain location=332-391; Score =20.7; E_value=0.0041; Accession=PF00415.9; Description=Regulator of chromosome condensation (RCC1)
  Pfam annotation: Domain name=RCC1; Domain location=34-91; Score=20.6; E_value=0.0041; Accession=PF00415.9; Description=Regulator of chromosome condensation (RCC1)
  Pfam module annotation: Pfam domain module=RCC1::RCC1::RCC1::RCC1::RCC 1; Domain location=158-208::219-268::279-329::332-391::34-91
MEDAGGKIVKSGQVSRKVVDVAAGEAHTLLLTGDGSVYCWGKGMFGRLGTGAEKDELLPVQLNFGYPNPNGTEGTFKIVGIAAGAYHSLALAEESHDNEYAVGDNSLVPRILNKFLELHPPDSSSSGDFIIDVASPVQLSQICAVKAGGMMSLAIDNHGTLWMWGNCPRQSKEGGLALVSSFTPTPVWDFQGHTVVKVACGNEHVVALVSAGETYNGEDLVCYSWGYNSRGQLGLGDRESRLHPEVVRTFDEESPYEVACGAFHTALLTRKKKPSDTVESTCWTFGLGDNGQLGHGTTQSTLFPTPVKELPQNVSLICVDCGLFHTSVVSSDGDVWSWGMEKGLGLCPDASRAGTDSGDALSPRLMSCQPHQLKFPDPVKVACGAAHTVIVARKGYRMWSWGRGRSGVLGDGKGFDCYTPTAVLWPSTMEDSEEEEVKSSGEQDKAREKETELATETEEKLSSALNELKLLQTKLSIMEKYASILHGSIFGKPFDEQDIPVSLRNSGSFDIAKEWESMLEAADQRKLIRLEMFYRDMLTGVKDELMKRRIKEIVQECLQSSE

SEQ ID NO: 124542 - protein, 177 aa, Glycine max
  Coding DNA Sequence Number=SeqID_7764
  Gene Ontology: Mol. function=zinc ion binding
  Homolog annotation: Hit_ID=Q84RS2; Match level="QueryCoverage=99%, HitCoverage=17%, E-value=3e-77, Identity=82%"; Hit description=ZR1 protein
  Pfam annotation: Domain name=PH; Domain location=21-125; Score=28.3; E_value=2.8e-05; Accession=PF00169.19; Description=PH domain
MEEESLAAVPFDRAIEQAIVSIKKGAYLLKCGRRGKPKLCPFRLSQDERNLIWYSGQQEKHLRLSVVTKIVQGQEHIRSQRQNESEKECHSFSLICANGERSLDLICKDKAQAASWFVALKAVISRCQHPRAFSSLRSCKGVQSCVSSPAGILRRKKNLGLLDDTSQFTQVFIHLLC

SEQ ID NO: 124543 - protein, 853 aa, Glycine max
  Coding DNA Sequence Number=SeqID_7765
  Gene Ontology: Mol. function=zinc ion binding; Cellular component =membrane; Biological process=defense response
  Homolog annotation: Hit_ID=Q84RS2; Match level="QueryCoverage=98%, HitCoverage=78%, E-value=0.0, Identity=70%"; Hit description=ZR1 protein
  Pfam annotation: Domain name=C1_3; Domain location=438-468; Score =6.9; E_value=0.079; Accession=PF07649.3; Description=C1-like domain
  Pfam annotation: Domain name=DZC; Domain location=804-839; Score =76.5; E_value=8.4e-20; Accession=PF08381.1; Description=Disease resistancezinc fingerchromo
  Pfam annotation: Domain name=FYVE; Domain location=429-497; Score =46.6; E_value=8.3e-11; Accession=PF01363.12; Description=FYVE zinc finger
  Pfam annotation: Domain name=RCC1; Domain location=104-153; Score =31.8; E_value=2.3e-06; Accession=PF00415.9; Description=Regulator of chromosome condensation (RCC1)
  Pfam annotation: Domain name=RCC1; Domain location=156-208; Score =6.7; E_value=0.13; Accession=PF00415.9; Description=Regulator of chromosome condensation (RCC1)
  Pfam annotation: Domain name=RCC1; Domain location=212-260; Score =27.4; E_value=5e-05; Accession=PF00415.9; Description=Regulator of chromosome condensation (RCC1)
  Pfam annotation: Domain name=RCC1; Domain location=274-323; Score =44.9; E_value=2.7e-10; Accession=PF00415.9; Description=Regulator of chromosome condensation (RCC1)
  Pfam annotation: Domain name=RCC1; Domain location=326-373; Score =15.0; E_value=0.017; Accession=PF00415.9; Description=Regulator of chromosome condensation (RCC1)
  Pfam annotation: Domain name=RCC1; Domain location=377-426; Score =34.5; E_value=3.7e-07; Accession=PF00415.9; Description=Regulator of chromosome condensation (RCC1)
  Pfam module annotation: Pfam domain module=C1_3::DZC::FYVE::RCC1::RCC1 ::RCC1::RCC1::RCC1::RCC1; Domain location=438-468::804-839::429 -497::104-153::156-208::212-260::274-323::326-373::377-426
ASSPYIDPDIHGNIESTRIDKEHKKNLSDSYLMHFTTPHVGKSNVLKDVMIWGGGIGCLVGIVNERFVHPGIYSLVPKLLESTAMLDVHNIALGGKHAALVTKQGEVFCWGQGKWGRLGQKIDMDISSPKIVDSLNGLHVKTVACGEYHTCALTDSGEVYTWGNDVCCADLLNEGRTRSQWIPQRLGGPLDGISISSVACGEWHTAIVSSCGRLFTYGDGTFGVLGHGDLRSYSSPKEVESLNGLRVRSAACGSWHTAAIVEVMFDRFRYNSASGKLFTWGDGDEGRLGHVDNGNKIVPTRVTQLVDYDFVQVSCGRMLTVALTNMGKVFAMGSAKYGQLGNPHARDKVVIVEGQLKQEFVKVISTGSYHVAVLTSAGSVYTWGRGEIGQLGLGDTEDRYTPCFVEALRDRQVNTITCGPSFTAAICLHKPISISDQSTCSGCRLPFGFTRKKHNCYNCGLLFCRACSSKKITNAPLAPSKSKAFRVCDQCFDKRQGGAHSVMASKSRNYNTQQVLKHQHKISDVTEDRGETTVTQGPMLSLGQSCYRKSMPSGRKDWKNHQEIQQDVEDSSSMLGGMPQWGQVPCPAMFQINCTENPVVHVSSSKNKLATVSPFNVESTAYNFSSNVETDTTKSDKVLLEEVHRLRAEAKRLEEQCELKNRKIQECRQKIEESWFVAREEAAKCKAAKEVIKALALRLHTISGKDNVGQEGKVGPNEFVPNVAPIHTEMKSPRDVSVDSLSNSPIVFSDTLKSKFGRSLFPKIDNSNINRAESQQDNNIDGLKAEWVEQYELGVYITFTTLPCGKKGLKRVRFSRKRFSEKEAEKWWEENQVTVYHKYGIEGYINNNTSQSQ

SEQ ID NO: 124544 - protein, 670 aa, Glycine max
  Coding DNA Sequence Number=SeqID_7766
  Gene Ontology: Mol. function=DNA binding; Cellular component=nucleus; Biological process=regulation of transcription
  Homolog annotation: Hit_ID=Q9FFI5; Match level="QueryCoverage=81%, HitCoverage=89%, E-value=8e-95, Identity=41%"; Hit description=NAM (No apical meristem)-like protein
  Pfam annotation: Domain name=NAM; Domain location=6-134; Score=320.8; E_value=2.4e-93; Accession=PF02365.6; Description=No apical meristem (NAM) protein
MAPVSLPPGFRFHPTDEELVSYYLKRKINGRKIELEIIPEVDLYKCEPWDLPGKSLLPGKDLEWYFFSPRDRKYPNGSRTNRATKSGYWKATGKDRKVNSQSRAIGMKKTLVYYRGRAPHGCRTGWVMHEYRLDETQCETNSGLQDAYALCRVFKKTAVIPPKVGDQHYVNVLSHANQMTSDQSSSIDIELYSEGRGEVLESSNYLMPWDTCPSPNINIGSSLNININGGTKRDNNNNNIGTWSHFLSSEDLLNLPTSTSSFPNYGSMSYPPSKVDIALECARMQHRFTMPPLEVQQDFPQVGISELKMAQASASNMCGGSRNNETDILQEILSVAHASQELINQSNYSSSQAFGANENNYAPPHESDFTFMVGTNYNHVNDMNTMGFVDNIAWEDPNARSIEIGDLDDGFKTERMVENLRWVGMSSKNMEKGFMEEQKIVPIEHISNFQANREENEVQVVSEQHNSNKELNDTDIDDFSMGFINTDDPNENFIDEGNIDYSNSTNFEVVEETKVSHGMFVSTRQVADTFFHQIAPSQTVKVQLNPVLAENQSIENAVVMVNQGHSFFRKFRAYVMGKLIKPSNTIASALVFIFALLLVHCVCLKEQVGEDLKPDPKCFDGANTMKKMRQLPAENNIIWNEQENFWSVGIKCGKGFGVVLKKIGIFLTIS

SEQ ID NO: 124545 - protein, 219 aa, Glycine max
  Coding DNA Sequence Number=SeqID_7767
  Homolog annotation: Hit_ID=Q1RYI2; Match level="QueryCoverage=24%, HitCoverage=8%, E-value=6e-07, Identity=48%"; Hit description =Ribonuclease H
MPSEEVLKLNCDGDVTDGRRAYCGGVLKDHFGSFLLAYACNIVSCSVIQPELWAETCSRNSDYNYRISQRMLDNALEHRPSGNKLRGNLPVTESTEDFGPDINPVTCKAIQSESSILFVKEKAVKIGSNFEKHQHQIHESVASHCSINCKSPTARTVFDPATLFPSSQKIPINAKVGSGGGIYHSKKDTKQRIIHCLNEHYLSMAMEYSKITCMGQSSF

SEQ ID NO: 124546 - protein, 125 aa, Glycine max
  Coding DNA Sequence Number=SeqID_7768
  Subcellular localization annotation: CTP_CleavageSite=80; ConfidenceScore=5.85e-01
MASRYRSVSQPAFSIIKSTITKPSSKLLPSSFLLKTRSPVTARQVPFVPFRGGWAVSSVACSRCFPCTRRFHQRASPHVWASIRVGRGRCLRVCSAMPTPEFDFSKFFFTLLLSVSIHCNFPLFS

SEQ ID NO: 124547 - protein, 245 aa, Glycine max
  Coding DNA Sequence Number=SeqID_7769
  Gene Ontology: Mol. function=RNA-directed DNA polymerase activity; Biological process=RNA-dependent DNA replication
  Homolog annotation: Hit_ID=Q10SK1; Match level="QueryCoverage=65%, HitCoverage=45%, E-value=2e-25, Identity=42%"; Hit description =Expressed protein
MRWVVVEQSKRYLIQLMDSAPSSSWLQAFSFLALVWLFNCGCVHGASPAVKVGNFSKVEDAGNFHIYYGQTFKVIKNSADGQSYLLLQPTQFSSINSGRIIQGLHQGLNIAHQESNHLSFHCQTILLIQLFFRLLGLVESLKGITSDYVASPCVLKLYQGGQLEMFNNSDYQKLAEFSSYFLSDTDQQPACNFATFVPFMEDTPLQINLSSITENIKNLSYIYHKRSYWKGVANTLTNWIGMLIN

SEQ ID NO: 124548 - protein, 252 aa, Glycine max
  Coding DNA Sequence Number=SeqID_7770
  Subcellular localization annotation: CTP_CleavageSite=38; ConfidenceScore=5.21e-01
MQHRSKMNKRPRSYDANDEANPRRSPPNTQFRSTINSTAAAANALNATLTVYKEQLISNLKQNIDKPPPIGLTLQESTIKSIEDTVNASYERKRKSAPLIPNDLRADIFPATGLRIGEYKFLATHKGTLMVGFYYATKRLAWEIFDIHGGIKYKIEVPWQNILAMRAIIEENKHGILQIKLAKAPTFFRHIDPPNPRSHPKWEPSNDFTGGHALKHQVHSLGFPPGDLDKYYRKLIQHDNRLLQLSQVSFSK

SEQ ID NO: 124549 - protein, 188 aa, Glycine max
  Coding DNA Sequence Number=SeqID_7771
  Gene Ontology: Mol. function=RNA-directed DNA polymerase activity; Biological process=RNA-dependent DNA replication
VKVNYLCLAKVATTRTTFKPTVAWMRYKNEKYQLKYVQDAGGEILGANKNTYNVSDPDDLEEFHAILCTAEVVIDETLTSDPVNYTMSAFIQNLNVEDRSCFSFISNTSLWRYDKRVYNSVALDWYNGAVSQPQLALADLIEVLFPTGNYTMTYFRNIAKGEVPINIGPEMCDRDTSTAMEPTIVACG

SEQ ID NO: 124550 - protein, 167 aa, Glycine max
  Coding DNA Sequence Number=SeqID_7772
  Homolog annotation: Hit_ID=Q6CQF2; Match level="QueryCoverage=44%, HitCoverage=91%, E-value=5e-18, Identity=63%"; Hit description =Kluyveromyces lactis strain NRRL Y-1140 chromosome D of strain NRRL Y- 1140 of Kluyveromyces lactis
MARLNRAAAPSYLFKSFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 124551 - protein, 101 aa, Glycine max
  Coding DNA Sequence Number=SeqID_7773
  Subcellular localization annotation: CTP_CleavageSite=58; ConfidenceScore=5.46e-01
MDGAKARDLYPAVGARTKPPMSRRARRSLQNPGREPGRSGRRCRSWCLPTLETAQPEVGSSGWKSTARRVVSGAPPAALENPEDRVPPTPGRTHNRIRSPR

SEQ ID NO: 124552 - protein, 845 aa, Glycine max
  Coding DNA Sequence Number=SeqID_7774
  Gene Ontology: Mol. function=sucrose synthase activity; Biological process=sucrose metabolic process
  Homolog annotation: Hit_ID=Q9FX32; Match level="QueryCoverage=95%, HitCoverage=85%, E-value=0.0, Identity=69%"; Hit description=Sucrose synthase, putative
  Pfam annotation: Domain name=Glycos_transf_1; Domain location=562 -752; Score=73.3; E_value=7.8e-19; Accession=PF00534.10; Description =Glycosyl transferases group 1
  Pfam annotation: Domain name=Sucrose_synth; Domain location=8-559; Score=856.0; E_value=1.9e-254; Accession=PF00862.10; Description =Sucrose synthase
  Pfam module annotation: Pfam domain module=Glycos_transf_1::Sucrose _synth; Domain location=562-752::8-559
MASSPLLTGKELVTNDMPDNAMRPSWYHVKRCFAKYIEKGRRIMKLHDLMEEMELVIDNNNERNQVLEGNLGFLLSCTQEAAVDPPYVAFAVRPNPGVWEFVRVSSEDLSVEPISSTDYLKFKESVYDEEWANDENSFEADFGAFDFPIPNITLPSSIGNGLHFVSKFLTSRFSGKLTKTQPIVDYLVSLNHQGESLMISDTLSSAAKLQLALMVADGHLSALPKDAPYQDFEPKLKEWGFERGWGDTAGRVKETMGTLSEILQAPDAVNLEKFFSRVPTIFNVVIFSIHGYFGQADVLGLPDTGGQVVYILDQVRALEAELLLRIKQQGLNVKPQILVVTRLIPDAQGTKCNQELEPIIDTKHSNILRVPFHTDKGILRQWVSRFDIYPYLERFTKDATVKILNLMDGKPDLIIGNYTDGNLVASLMANKLRITQGTVAHALEKTKYEDSDVKWKELDPKYHFSCQFMADTIAMNASDFIITSTYQEIAGSKDRPGQYESHAAFTLPGLCRVVSGINVFDPKFNIAAPGADQSVYFPYTDKVKRLTQFFPAIEDLLYSKVDTNEHIGYLENRRKPIIFSMARFDVVKNLTGLVEWYGNNQRLRKMVNLVIVGGFFDPLKSKDREEMTEIRKMHDLVAKYQLKGQFRWIAAQTDRYRNGELYRFIADTKGAFVQPALYEAFGLTVIEAMNCGLPTFATNQGGPAEIIVDGISGFHIDPHNGEESSNKIADFFEKCLQDSAHWNRISAAGLQRINECYTWKIYANKMLNMGSSYTFWRRVNNEQKEAKQRYIKMFYNLMYKNLVKTVPVPNHEPQQPQPVVSKKQSVKKQGTSKRSQSGLQSLFGA

SEQ ID NO: 124553 - protein, 188 aa, Glycine max
  Coding DNA Sequence Number=SeqID_7775
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=58%, HitCoverage=50%, E-value=6e-32, Identity=61%"; Hit description =Transcription factor, MADS-box
MARISICNRLGQSHISKTGHLLLQLLKRFLQLLKVFHNDHPFHGPGPPELGFGLLLLSIQLLGVLPLRLELIVDMSQLAVELNDFGHVVHVASLRRWASLEITLYDAIHAGVAEGEHFLPRREHHQSHVGAAESAKLAGFLEKPAAALGEECEVLNYRAFSVNAIRKDTTRGFWTARLRKSSLNGVYG

SEQ ID NO: 124554 - protein, 162 aa, Glycine max
  Coding DNA Sequence Number=SeqID_7776
  Gene Ontology: Mol. function=ribonuclease H activity; Cellular component=nucleus; Biological process=RNA-dependent DNA replication
  Homolog annotation: Hit_ID=Q1SZM6; Match level="QueryCoverage=90%, HitCoverage=47%, E-value=9e-24, Identity=41%"; Hit description =Ribonuclease H
ATQIWNLLQLDVQFHVLDDNSLTWLQRNFLAAFGGLIRDNHGPWIMGFYGSCGSSSNKNAKLQAIYHGISVTWLKGVQHLTCESDSKVTFQLITDGVISSHIFYLFIQKIRSFLHLHWKLMFRHSHCEGNTCANWLAKKGASKNDHLLSLDTCPPKLKPMLM

SEQ ID NO: 124555 - protein, 168 aa, Glycine max
  Coding DNA Sequence Number=SeqID_7777
  Gene Ontology: Mol. function=protein binding; Biological process =defense response
  Homolog annotation: Hit_ID=Q1SWU6; Match level="QueryCoverage=95%, HitCoverage=13%, E-value=8e-14, Identity=33%"; Hit description =Disease resistance protein
  Pfam annotation: Domain name=LRR_1; Domain location=128-151; Score =1.2; E_value=1.7e+02; Accession=PF00560.23; Description=Leucine Rich Repeat
  Pfam annotation: Domain name=LRR_1; Domain location=38-65; Score=4.3; E_value=45; Accession=PF00560.23; Description=Leucine Rich Repeat
  Pfam annotation: Domain name=LRR_1; Domain location=80-102; Score =12.3; E_value=1.4; Accession=PF00560.23; Description=Leucine Rich Repeat
  Pfam module annotation: Pfam domain module=LRR_1::LRR_1::LRR_1; Domain location=128-151::38-65::80-102
MELEALSKGLKSLISLYNFGITTKQAVLPENKIANLSSLQYLTIECCDKVESLFLGVELPILKALDLVNLPHWLQGSVNTLVSLMLDNCDNLEVLPDWLPKLTCLKVRYVADCPKLQSLPYGIHCVSALEHLEIADCPELCRKYKPRAGECWNQISHIKKIRTVERNI

SEQ ID NO: 124556 - protein, 47 aa, Glycine max
  Coding DNA Sequence Number=SeqID_7778
MSSFLQGELQKMMNPFGMKTGNPLIFGLLFGLLLVILSLVVEKQACV

SEQ ID NO: 124557 - protein, 143 aa, Glycine max
  Coding DNA Sequence Number=SeqID_7779
  Gene Ontology: Mol. function=protein binding; Cellular component =membrane; Biological process=defense response
  Homolog annotation: Hit_ID=Q1T0I4; Match level="QueryCoverage=96%, HitCoverage=11%, E-value=6e-26, Identity=45%"; Hit description =Disease resistance protein
MTHSYVTDSDVTGREQDKGEIIKLLNQQDPNDDCNSLYVIPIVGMEGLGKSTLAKFVFNDKRIHECFPLKMWVCVSEDFDIKQLVIKIINSANDSAFLADAPDPQLNFNILDIEQLQKQLRNKLAGREFLLFLDDVWNENHVK

SEQ ID NO: 124558 - protein, 238 aa, Glycine max
  Coding DNA Sequence Number=SeqID_7780
  Pfam annotation: Domain name=G-patch; Domain location=26-70; Score =17.7; E_value=0.0013; Accession=PF01585.13; Description=G-patch domain
MAFQSFEVVSCASVEPSPLLPSLSNAAIMVTRVMLRNGFELGMGLGKDSLGNADVVNVKGNPYKYGLGYEPGMPGRRNVPSRFQADKVWPGRLSQSFTSAGMVSEEEVAAVGEEFPQDPPNFVQPCHPDSRLGNWRVISQSEVYTADSIYEGRFFEDPNNEGLTIDFDRDVSQMMNEEEEEDVLSPELERLIAQEEREMKALPRGNRTDKLRDRRGKERSESRNRYDRTYQPRLDNPS

SEQ ID NO: 124559 - protein, 77 aa, Glycine max
  Coding DNA Sequence Number=SeqID_7781
MSEFTSDYPLQISAIPHQSDFAPYASGSCNAQWNAPKLLHDDHMLCSSRILIKMEIEEPWLGLWLPSHYRVVGGPCG

SEQ ID NO: 124560 - protein, 124 aa, Glycine max
  Coding DNA Sequence Number=SeqID_7782
MNEFEYRTQGTNPKLLNPRSLVRPNIQASSVDPSCSEIVTLCLAPPSRFARSQTYQGNPCGVYPNLSSFTGSGVYPNLSSFTGCGVYPDLSSFTRSGVIQNSIACIKRSAPSQVHIIWYQSFGS

SEQ ID NO: 124561 - protein, 105 aa, Glycine max
  Coding DNA Sequence Number=SeqID_7783
MCLFKNLFLNFFTGNRLQVSGVSLLVIDYMFKIQIQNYFQQLFLKLPFCAYPFEVALFDSSLASSKSYVLNKQDQRALIMEFEFKFETTVDEKGYTKTFRAARFR

SEQ ID NO: 124562 - protein, 79 aa, Glycine max
  Coding DNA Sequence Number=SeqID_7784
MSPSRWSLEFESFTIKSTSDHKKFKARIVAEPVGERFDTLELQVDLRFNEMESRITKVEEDVSYIRSSFDLPPPPPPLS

SEQ ID NO: 124563 - protein, 98 aa, Glycine max
  Coding DNA Sequence Number=SeqID_7785
MEAISISVGETGPHGDTKRTSLGNSALFFEKVTPNSVFANKKVFFIEGEAPINSSRSIFLFPKGVLSLGGHHWREIRTKVIKEKHKDILRKKKTNNGD

SEQ ID NO: 124564 - protein, 95 aa, Glycine max
  Coding DNA Sequence Number=SeqID_7786
  Subcellular localization annotation: CTP_CleavageSite=50; ConfidenceScore=5.12e-01
MIFTVATVKKDHHLKKYQNSHPHFEHSSSSCWSNNKTSFKFLVKFSLELELARKAANWDFWLRNKEVSGSVAFNNSECDLNQSLTWSGSAFDESN

SEQ ID NO: 124565 - protein, 134 aa, Glycine max
  Coding DNA Sequence Number=SeqID_7787
  Subcellular localization annotation: CTP_CleavageSite=71; ConfidenceScore=5.40e-01
MKVFIQKEVSPTQRKAKVTKAAPTTKVSPKMIGKEWTSPSPPTSYSPPHTRPFTPPCQRPPLSLINLETFRSDKKMKTPLIDQHRFPLAFTSMNPQNMYRKFETSDMMFKEIVHKLYSSALTQVWMEFDYQHTP

SEQ ID NO: 124566 - protein, 138 aa, Glycine max
  Coding DNA Sequence Number=SeqID_7788
  Subcellular localization annotation: CTP_CleavageSite=55; ConfidenceScore=5.20e-01
MSVKNLIGCLGLHDKIDNTPVSQVTFTSSQLNTYSVATYPSAGGRRGGSWERLPRKENAWSRHQCLFEENVRKTRTCGLQTLIVKGSGVVFTHGEGWSTKAGLLLLRILNCDEELRPTKFLPKAVKLCVNFMLLNGPC

SEQ ID NO: 124567 - protein, 58 aa, Glycine max
  Coding DNA Sequence Number=SeqID_7789
  Gene Ontology: Mol. function=translation elongation factor activity; Cellular component=chloroplast; Biological process=translation
  Homolog annotation: Hit_ID=P34811; Match level="QueryCoverage=87%, HitCoverage=6%, E-value=2e-10, Identity=73%"; Hit description =Elongation factor G, chloroplast precursor
MEELLFRCKAQCSIEGLSQHQYHGSLDARKTTTIEQILYYTGMNYKIGEVQVGITTME

SEQ ID NO: 124568 - protein, 156 aa, Glycine max
  Coding DNA Sequence Number=SeqID_7790
  Subcellular localization annotation: CTP_CleavageSite=40; ConfidenceScore=5.81e-01
MPVTVQSKEPFSVSIKNAKNTKKRGKRVFSLSFLDPSSPRVASGSPRPQNYFRVKEQARLGEPVTLGVSISSLKRVAIARSAHFPIYRRAREVEGGGGGSKVQYLRELRELREKKNKVEETKPRHYRIATVINLYMVPCLVFFLRLPVSFVFKIRM

SEQ ID NO: 124569 - protein, 47 aa, Glycine max
  Coding DNA Sequence Number=SeqID_7791
MPPSESEDVQSSKGKDVKPSEGKDVQSSEGKGMQPSYNEGICMQPLS

SEQ ID NO: 124570 - protein, 80 aa, Glycine max
  Coding DNA Sequence Number=SeqID_7792
MVVFLGSHTLGKLSSTFRFMNRDIPIGNHELDFILGGLDVHLHYVLLVRVVFFSEAWWPSERCSLSDKLVLVIYHLDLFL

SEQ ID NO: 124571 - protein, 48 aa, Glycine max
  Coding DNA Sequence Number=SeqID_7793
MRCYNQEVGVDPVFVDHPWFLEKILISVTKLHGMMENSTKTLWTNYTK

SEQ ID NO: 124572 - protein, 186 aa, Glycine max
  Coding DNA Sequence Number=SeqID_7794
MSSTSSTASSRMRDPIMTRPCILQFIAAFHNEKDYIEIPSFYHSQWAPRYPKFARPSLEQQTCGRPLLAFRMHVWTIELTQALLGDPKPLIHPPIAAIHLPSCGFHMTILRKFRPPLQWFVVPVGPGFHGKYFAEPWYWFLSKDDFVRGDELLFYYRSREDIWEMVIRKQRNWVTTMIGEFKFLLC

SEQ ID NO: 124573 - protein, 113 aa, Glycine max
  Coding DNA Sequence Number=SeqID_7795
MSLDLSIGRAVQGKTFSRMITIFVSMQLLPPAALNFLFGSQKVILVQRGYGKRNQWQITMHDGVPSIAQPWFQYLYENNLMAGEEVIFFFRFDEHVWEVLFRKEVIWDEDLSN

SEQ ID NO: 124574 - protein, 247 aa, Glycine max
  Coding DNA Sequence Number=SeqID_7796
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=99%, HitCoverage=100%, E-value=1e-74, Identity=60%"; Hit description =Transcription factor, MADS-box
  Pfam annotation: Domain name=SRF-TF; Domain location=16-66; Score =85.4; E_value=1.8e-22; Accession=PF00319.9; Description=SRF-type transcription factor (DNA-binding and dimerisation domain)
  Subcellular localization annotation: CTP_CleavageSite=27; ConfidenceScore=5.01e-01
MSGPKKSRGRQKIEMKKMSNESNLQVTFSKRRNGLFKKASELCTLCGTDVALVVFSPGQKVFSFGHPNVDAVIDRYLARPPPTDSGTMQIIEAHRMAHVHDLNVQLTQINNQLDHERKRTNELNLMNKEAQAQMWWARPVDGMSMAQVKQFKAALEEMKKQVARLVDRAMLQSVTNPTLQFFPGVSSSSNSNLVHQPHPLPAPQVFTPHLIQPPMLQNFMFHDGSMMRHHGFDNIGMGGYGPTAGFF

SEQ ID NO: 124575 - protein, 121 aa, Glycine max
  Coding DNA Sequence Number=SeqID_7797
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=99%, HitCoverage=60%, E-value=2e-27, Identity=66%"; Hit description =Transcription factor, MADS-box
  Subcellular localization annotation: CTP_CleavageSite=83; ConfidenceScore=5.51e-01
MSSAKKSCGRQKIEMKKMSNESNLQVTFSMRRGGLFKRLSKKFSPSATPKWTPSLTANSRGTHPRTCRAPCSSWRPTAWATCVTSTNSSLRSTNTSKPRGRAPIDELNLEKKEAEAHLWWA

SEQ ID NO: 124576 - protein, 68 aa, Glycine max
  Coding DNA Sequence Number=SeqID_7798
  Subcellular localization annotation: CTP_CleavageSite=61; ConfidenceScore=5.49e-01
MLQIVTNRTHQFFPAGASSANSSSNSNPLPPTIQNFMFHDGSMMRHHGFDYGRSAASLVHVCDMVSTD

SEQ ID NO: 124577 - protein, 54 aa, Glycine max
  Coding DNA Sequence Number=SeqID_7799
MMNQRRLLPLAFQANDAEKEVPSVLDSFLQRTSGFPGNVWVEDMISFELRFIRL

SEQ ID NO: 124578 - protein, 106 aa, Glycine max
  Coding DNA Sequence Number=SeqID_7800
  Subcellular localization annotation: CTP_CleavageSite=98; ConfidenceScore=5.60e-01
MSPPSLETSQSLKISSKAPQDGFLVKLSSLSVSPQPKTLKKLNNPSKIEFSTLNSLRVKGSAFSEFTLAQRLCTAHPSSRFFCVLSRRIVRLADDSPSARHGSASS

SEQ ID NO: 124579 - protein, 80 aa, Glycine max
  Coding DNA Sequence Number=SeqID_7801
  Gene Ontology: Mol. function=kinase activity; Cellular component =nucleus; Biological process=regulation of progression through cell cycle
  Homolog annotation: Hit_ID=Q39879; Match level="QueryCoverage=71%, HitCoverage=14%, E-value=9e-25, Identity=81%"; Hit description =Mitotic cyclin a2-type
  Pfam annotation: Domain name=Cyclin_N; Domain location=1-70; Score= -4.1; E_value=0.00034; Accession=PF00134.13; Description=Cyclin, N -terminal domain
MVAEEYRLVPDTLYLTVNYIDRYLSGNVMNRQSKYEEICAPQVEEFCYITDNTYFKEEVWVEFFCGFKLYFFMYVEVYTY

SEQ ID NO: 124580 - protein, 115 aa, Glycine max
  Coding DNA Sequence Number=SeqID_7802
MPTVSCTSNVAYQNVNAHPSLTASRLQDGKILVLDSIAFFASGFAACSSFKDEGASAANVSFWSVGVSENKNDDYDCESETIMTRPHEFRVHLIIVQGKRSQHNKFKKPLDKITM

SEQ ID NO: 124581 - protein, 446 aa, Glycine max
  Coding DNA Sequence Number=SeqID_7803
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q8W011; Match level="QueryCoverage=99%, HitCoverage=57%, E-value=1e-152, Identity=60%"; Hit description=Beta- D-xylosidase
  Pfam annotation: Domain name=Glyco_hydro_3; Domain location=3-198; Score=95.6; E_value=1.5e-25; Accession=PF00933.12; Description =Glycosyl hydrolase family 3 N terminal domain
  Pfam annotation: Domain name=Glyco_hydro_3_C; Domain location=270 -446; Score=139.8; E_value=7.4e-39; Accession=PF01915.12; Description= Glycosyl hydrolase family 3 C terminal domain
  Pfam module annotation: Pfam domain module=Glyco_hydro_3::Glyco_hydro_ 3_C; Domain location=3-198::270-446
MKTIGREARAVYNAGQATGMTFWAPNINVFRDPRWGRGQETAGEDPLMNAKYGVAYVRGLQGDSFEGGKLAERLQASACCKHFTAYDLDQWKGLDRFVFDARVTSQDLADTYQPPFQSCIEQGRASGIMCAYNRVNGVPNCADFNLLTKTARQQWKFDGYITSDCGAVSIIHEKQGYAKTAEDAIADVFRAGMDVECGDYITKHAKSAVFQKKLPISQIDRALQNLFSIRIRLGLFDGNPTKLPFGTIGPNEVCSKQSLQLALEAARDGIVLLKNTNSLLPLPKTNPTIALIGPNANASSKVFLGNYYGRPCNLVTLLQGFEGYAKTVYHPGCDDGPQCAYAQIEEAVEVAKKVDYVVLVMGLDQSQERESHDREYLGLPGKQEELIKSVARAAKRPVVVVLLCGGPVDITSAKFDDKVGGILWAGYPGELGGVALAQVVFGDHNP

SEQ ID NO: 124582 - protein, 313 aa, Glycine max
  Coding DNA Sequence Number=SeqID_7804
  Homolog annotation: Hit_ID=Q1SJP9; Match level="QueryCoverage=45%, HitCoverage=29%, E-value=7e-32, Identity=50%"; Hit description =Rhodopsin-like GPCR superfamily; Galactose-binding like
MTNIPYPQPEVLQTIYKVLTTFKEGSKVYGKNSEEWFQKEEDEMVGSIARTLEEEVKFMASSSKFWAEEASLWQVLCELLETHPGLEFLQSTPEFQERYGLSSILVITLHLGNESLNEGGMLFVDKHPNLRVRVVHGNMFTVAVILNEIPQGVKEAFLKGATSRLGRAIALYLCQKKVKVLAAVYNIGAISAAFLANIAKTDAKVSFNGNSYHLSAWSLSILPDCKSVVLNTAKINSASMISSFTTESLKEEVGSLDDSGSGWSWISEPIDISKAHSFSKFCIDLDAATETVLHIESLGHTLHALINGMLAAK

SEQ ID NO: 124583 - protein, 59 aa, Glycine max
  Coding DNA Sequence Number=SeqID_7805
MSQYNEIEAHIVSNLQKMMDENNAHAKSFRMARDRLTGTEVHNVRFKLIAGREKKWSYI

SEQ ID NO: 124584 - protein, 178 aa, Glycine max
  Coding DNA Sequence Number=SeqID_7806
  Gene Ontology: Mol. function=ATP-dependent helicase activity
  Homolog annotation: Hit_ID=Q1RUZ0; Match level="QueryCoverage=56%, HitCoverage=17%, E-value=3e-40, Identity=85%"; Hit description =DEAD/DEAH box helicase, putative
MSSVFICFPTQTYGTSSTELHSLRIPSIADRCGLSLSSLLSAYNHNNTSQNQKNCYIVLKLAANMEEEDDYVEYVPVAKRRALEAQNILQRKGKASAATDDDLEKQRVAETKPSLLVKASQLKREQPEISVTEQIVQQEKEMIENLSDRKTLMSVRELAKGITYTEPLPTGWKARLCM

SEQ ID NO: 124585 - protein, 239 aa, Glycine max
  Coding DNA Sequence Number=SeqID_7807
  Gene Ontology: Mol. function=helicase activity; Biological process =viral genome replication
  Homolog annotation: Hit_ID=Q1SN45; Match level="QueryCoverage=99%, HitCoverage=14%, E-value=6e-65, Identity=46%"; Hit description=AAA ATPase
MVHGPCGILRPASPCMKKGKCSRFYPKKFQPTTLIDGDGYPVYRRRNTGRTITKNEIIIDNRCIVPYNPKLLKKYQAHINIEWCNQSTSIKYLFKYINKGYDRVTVVMVHDDNGTVPHANTPNDEIKEYLDCRKTVVERLHFHLPRQHSILYQDHDDIDDLLFNSSIFETKFIAWMSTNQAFVEGQSLTYSEFVTKFVYNQKQRCWQLRKKGYAIGRLQWVPPTTGELFYLRMMLTVSR

SEQ ID NO: 124586 - protein, 63 aa, Glycine max
  Coding DNA Sequence Number=SeqID_7808
MGLVVVEEVRSNKDAKVGTLLDLTQSGAFNGYSVDPIEDLLGENQNNTGLLFSFQQGLKWNFE

SEQ ID NO: 124587 - protein, 55 aa, Glycine max
  Coding DNA Sequence Number=SeqID_7809
MQHRSGGFGSGFIPIAEYGSDFRKGSSRKAVRLLYSVKVGPLFGWKPIRPWWWQL

SEQ ID NO: 124588 - protein, 69 aa, Glycine max
  Coding DNA Sequence Number=SeqID_7810
MSALVLYVLQKHRVKLEREVEDLKTLAQRGIRAQHGADAQWATLAQGKEVTWRSLIHEGASSASRALSA

SEQ ID NO: 124589 - protein, 103 aa, Glycine max
  Coding DNA Sequence Number=SeqID_7811
MEDTQGTSREEISLKIKPKVGDPTRKITLTKIKEGLLPTGISPENLNLLESSLTRVKLIKGVEPTVISHLDVAYSKGHPHLTKMHNKTPSMKGDSQGSIKTLR

SEQ ID NO: 124590 - protein, 277 aa, Glycine max
  Coding DNA Sequence Number=SeqID_7812
MVPSFLSSSDVYNIVLIYPDLCSISSITAIGVISSARELDGELVEALNDKELELVEALHHRNELVATARGGITGGGVGGVSGVARALTHLGPEKTIEESVGFQQFFRMEAEPRCNGLGNLGNLGRNEAAQVHVHLHHQPINESSTIDIEVKGVRGRSEVEVAENAPRLGLGGKATAPPLGDDRCLEESFQRLSIKRNKLPPDPTLLRGIVLWVIDVGACEASMPLSSLELVIKLIVHGGGELHNPLWKNVPKVNVVLVVELGNLRYKMGGVPSKIPP

SEQ ID NO: 124591 - protein, 180 aa, Glycine max
  Coding DNA Sequence Number=SeqID_7813
MVQRLFKRNKVSLVKNTEEDFGEGSNKGNKVRLFIGGNKYEILSIDKKSYIAPNFDKEILETNEIGVSSASGDSSNNGYHTKDIGAKKENVMHTTHMKANNKSMANNKLVPYKKICGTFSKPFRVDEGKFAIDVAGKRSKIRDPLATHGDMDYTDETTIGMVVAYVESGVHLPNNLVVSS

SEQ ID NO: 124592 - protein, 70 aa, Glycine max
  Coding DNA Sequence Number=SeqID_7814
MRFWMLAFVSKRPFRGNTGSNKIEENHSKCINLTQGVSSSTVRDPSFLGDPTVPSFKGKDGNSILGQGLW

SEQ ID NO: 124593 - protein, 146 aa, Glycine max
  Coding DNA Sequence Number=SeqID_7815
MACLPNYTPPNVAYIPNEDVNNSTPILIKSQQPQSDHAHVSRPMEETHEIPHRDLADFEPCLGYAAEGQAVGGVPLQNTLEGPQYHPQPQPSCSTTSKNPRAMAEMEKLDHLEERLRAIEVGEVYAFANLKELFLEPNIITPPKFK

SEQ ID NO: 124594 - protein, 81 aa, Glycine max
  Coding DNA Sequence Number=SeqID_7816
MTELYLVPDIVILLKFMVPDFDKYKGTTCPKNHLKMYYQKMGVISTILIWLQIECSYKTCAKRSTNLSKNTPKDRGIWQLK

SEQ ID NO: 124595 - protein, 109 aa, Glycine max
  Coding DNA Sequence Number=SeqID_7817
SGWISHYIDAVCSKTNALNYAICLGFQIWYALMPSLMLVLGYYHQIFKPEVVKYIKDTIGVWHNDIVKIASDLIGNNEFFMQPDVGTLESSGASGTGTRPESLTFGNKR

SEQ ID NO: 124596 - protein, 99 aa, Glycine max
  Coding DNA Sequence Number=SeqID_7818
MAASIKKTKKQGEPLKTMRPKLIEELKRYFLKAKIKITEGGCRRSSWMDGGRQRTEIEGGKEWTAWSLGGSFMREEDMLFAVLYLRKVFLGGYNTHTSY

SEQ ID NO: 124597 - protein, 56 aa, Glycine max
  Coding DNA Sequence Number=SeqID_7819
MDLAGSRRSANRQGEGDHKKGQMYQQWLLICEEINSCEKYHRCKIQQEACKEAINR

SEQ ID NO: 124598 - protein, 158 aa, Glycine max
  Coding DNA Sequence Number=SeqID_7820
  Homolog annotation: Hit_ID=Q9FFT8; Match level="QueryCoverage=99%, HitCoverage=30%, E-value=4e-29, Identity=43%"; Hit description =Genomic DNA, chromosome 5, P1 clone:MBG8
  Subcellular localization annotation: CTP_CleavageSite=59; ConfidenceScore=5.72e-01
EFKLNPAAKTFSPSFVNPISATSAANMVYIPNSSPPVSVTIQPEVGFNTFASRPSMPLKVAQYSNLTVSNGGSGSQFSQPIVGHVAHRTQPLRYATHYSPVLSEHAYMQPSSPAVMVGRSPQLVYVQPVSHDLIHGTTTVPPVSARPLLNHVQFPKQQ

SEQ ID NO: 124599 - protein, 77 aa, Glycine max
  Coding DNA Sequence Number=SeqID_7821
MRKRTSEPHKQNHRHRGTKQRVRDDLGCGQEVLWTLDMVKKSSGHSGFCSSFGHGLERMQNLCEVEEHAAMPAKGYR
